United States Patent 8,067,671 (METHODS FOR GENETIC CONTROL OF PLANT PEST INFESTATION AND COMPOSITIONS THEREOF) - sequence listing, part 48

SEQ ID NO: 114269 - DNA, 262 bp, Heterodera glycines
  Promoter: Source sequence=SeqID_10019; Location=532..793; Strand=-; Gene=SeqID_73073
tttttgacacaaggaagaaggttttgaattttaattgaaatcaacagtgccattactcgttgctttgcccaaagactggggagcgacgaattattttcttgttgtgtgagcccaaagactgggaacaacactcgccaattttgagtgaaacccagcagaaccaagacggttgagaaaagtggtttttgaattcgccagaaccaagacggttaaaccaaagatttttgtgtgaaaaattcgagaaccaagacggttaaaaatg

SEQ ID NO: 114270 - DNA, 352 bp, Heterodera glycines
  Promoter: Source sequence=SeqID_12319; Location=2422..2773; Strand=-; Gene=SeqID_47029
ttttcagtcacccttctcgtggagagtggcgccaacgccaatctcgggacagcgaaggagcaacaccgataatgaccgcttctcgtgccggatgggtgataaaaaaccaaaacttgaaaaaatgagtttttagtttagtcagtagtgattaaagaccggaaatttcaaatttgcggatcccgctgcgggttcggaatccaaaatttttttcgggacgggatcccgcgggattaatcccgcatttaaaatttgcgggatcccgtgcgggattttggaaattttgaaaaaattcaattaaagcaaactagcgagaaaacgtgttcgatctgacgcatttggtctttactaaatg

SEQ ID NO: 114271 - DNA, 219 bp, Heterodera glycines
  misc_feature (18)..(18): n is a, c, g, or t
  misc_feature (63)..(63): n is a, c, g, or t
  Promoter: Source sequence=SeqID_4275; Location=1..219; Strand=+; Gene= SeqID_45765
gtcaaagagagagtgttnttcttccccaatttttgttcaatgttttgctattatgacaaaacncaaagaaaaaagtgtgtttttggtgtactttgtttcgtaactatggttcggatgaattactttctttcctccgtttttctccaagccctcacaaaatacatttactcaaacattcattcgctgtgtcaagatttgttcgtttttagcccgaaaatg

SEQ ID NO: 114272 - DNA, 514 bp, Heterodera glycines
  Promoter: Source sequence=SeqID_18640; Location=1..514; Strand=+; Gene=SeqID_47529
tacaattgagaatctactgagccaattgaagtcatttatgtaagcaatctcgacgaggcatatgcaaatgtttttgaacaaaacgaggcttgaaatgttgcgaattttatggaaaaatatttattgtattattcatttgaatttacccaataaacattttgtcagacacatatgtaacattttaatgtagtggtgcaattcatacttattgattttgctattgttttgttttgtcatttctttcacgagaaaaaaaacaagaacgagagagaagagaaagaaagagagttgttcattctcattgacttgaagttttttcacgtgaagtaaaaaagaggagggttggccgaccgatagattctcctttatcacaaaaatgttcaactttacttaacaataaaccccaactttttgttaattgctacagatgaacttttttaaaaattcatttttgaccatagctttgcatattcccttttcaggtagtgtaataattcttattgtaataaaaatg

SEQ ID NO: 114273 - DNA, 666 bp, Heterodera glycines
  Promoter: Source sequence=SeqID_539; Location=1..666; Strand=+; Gene =SeqID_55809
ttttaagccgtgggagatcacaatccttgagtaggcctcccaagcagtgtcagtctgtttagttgttattcttcttcttttttcatatctttgatgaacctatcaatgttaagataataattaatttttataattatttcattaatataatttaaattaaagataatttactttttatatcattaaatattcatttgttattcatataaaaattaatctctcagtttactctccattagtccccatccgttaatgtatgcttctccacttttgaacttttctgtgtattagagggttaagcttatatatatatatatatgcttggggataaagatatgggcggatttttatagttttcccatgtctcagttgtttcgagtatatccacggttttgaaaaaacaataaaaattagagggttaagctatatataatattttactatagtcaaagaaaatttttaaactttttaattcgttacattttgatttgtttcatgtttttatggtaatgccacgccaattgatcacataacattggcattatgtattattttgatcaatgctcactgtgtttttgtaactgatcagaaactgtgccattcgcttaagcagaaagtgatcaaatacaacacatacacgaattgttgaccattttttgtggaatg

SEQ ID NO: 114274 - DNA, 120 bp, Heterodera glycines
  Promoter: Source sequence=SeqID_5613; Location=192..311; Strand=+; Gene=SeqID_58652
agaatttatgccttttgttttaatttaattccccccacccccttaaggcagcaggagatcaaaatacagagactggaaagggcgaatacgcaaaaatcggacagccttaaacgcaaaatg

SEQ ID NO: 114275 - DNA, 522 bp, Heterodera glycines
  Promoter: Source sequence=SeqID_21006; Location=905..1426; Strand=-; Gene=SeqID_51581
ttttcaaaataaggcaaaagaagttaacaggtcttaaatggtaaattaaacaatggttttcctaaaattgatacattaattgcttttgacatgagacttatttctgaagcacggaattttgaaaaagtcgggattcgggaatggcggggtagaattacagagattcaaattcctaagagtagcaaatatttaatctctatacctaatattatttcgcaaagcatgaaagtgccgataagcgccactgaatttactgcctgacgagggatgtcactcaccgacaattttaaatttctctatttttcgaagaggataaaaaattttttagtaaataacgccaaaacatttaaattttaaaaatttatgaaacaaagtttttgtgcctacaaatcaatggaggcactgtccctttccctttggtttatcgctatctatagagagcctatatgtatacatacatataactaatgaatttttagatatttccttaattccatcagaaattttttgcggataaaaatg

SEQ ID NO: 114276 - DNA, 87 bp, Heterodera glycines
  Promoter: Source sequence=SeqID_3483; Location=1..87; Strand=+; Gene =SeqID_84858
aaatcaaacaggtaaaaaatacaaaatataaattataaaagacaaaattaattaattaaaatatttttgcaaaaatatttgaaaatg

SEQ ID NO: 114277 - DNA, 255 bp, Heterodera glycines
  Promoter: Source sequence=SeqID_9404; Location=2216..2470; Strand=-; Gene=SeqID_71293
atttttgaaattgtttgtgttattttgatatgttgtattgctataccattttctagtttaagaaattgtaaaatattccaaaatcaaataattaaatatcaagtgcaataacccaaatatacgggccattttctaaattttttacctattttttgtgtggatagcattttacgcggtaaacacaaggctcggatctgtccttatttataagatttgtccttatttggagggtccaaatcttagaaaataaaaatg

SEQ ID NO: 114278 - DNA, 132 bp, Heterodera glycines
  Promoter: Source sequence=SeqID_22226; Location=2725..2856; Strand=-; Gene=SeqID_52897
gcggacgacgcgtcgctgccgacgccgttggaggagaacagcaacgggagcagcagcagccccggcggcctttttcagtgcccaacggccgaacaccacgcgaacgtggaacagaagcagcaacagacgatg

SEQ ID NO: 114279 - DNA, 843 bp, Heterodera glycines
  Promoter: Source sequence=SeqID_6994; Location=1169..2011; Strand=+; Gene=SeqID_63525
taagtatgattctaaataaaatttttttgacttattgctattaaacgaccatgaaataatatgacatttttagaaaaaatggcgattgcctaataattggtggagtcgttgattggacgtataaacaagaagagagagagatagagccgaaaatcactgctcaacatttggtgcaaaaaaaataatttagctcccagtttaaagtcacaatcagaacgccaaattatgctctttcactttggcgtactatctcttcattttttatagaaaaaacagcatttagtgtttctttccctctcatgttggcgtactattttcacacctcacacacgaaaaaaaaatcaaattcgcaaattctaataattttggttatatgggtataaaatcactttgaacatttagaatcaataaaaaaagcaaaaattttcgcattttggttgaaacagcggcctaggatttgagttatacgtaatgaaaatttgaaactcctacaacttttttctgagatgtcaaattgcttagcattcgcttagaaaaatattctccttttcaaaaacctttttaaatattcggtttgattgggaatgaagcgagttatggcagatcaaaataaaaaaatacaaaaatggcattttctagtgcaaatttcgaaatagcgcgaaaaaattatgccaattacactttttggcgttatgactatttaaattttgaaaaccatccaactttaattaagtgctctgctgaagttcgacaaatttttgctctcattcattttttttattttgtaattaattctattctaacttaagctttgtcaaatatcatataaattcatctcatatg

SEQ ID NO: 114280 - DNA, 164 bp, Heterodera glycines
  Promoter: Source sequence=SeqID_44535; Location=1..164; Strand=+; Gene=SeqID_72018
taaatgcggtagaaaaaggcgagaagaaagagcagattttccggatcttcgctagccaagaaaaatatttggtaatttaattaattaatattttaatcattttatttattttaattttttaaataatttcaaattccttcagaacccggaagggaagcaaaatg

SEQ ID NO: 114281 - DNA, 1003 bp, Heterodera glycines
  Promoter: Source sequence=SeqID_6868; Location=590..1592; Strand=-; Gene=SeqID_63158
aaattgtacattttaaatttaaaaggcaaaaaaatgcaaaaaaaaagtaagcttacattaaagtgaatgcgtaaaagccgaatctacgtggcgtgatttcgagagatgcaaaacttttgaccaggcaacaaagctcgaggaacaatcgcaaattcattaatggaagcccggagattacatttcgagtcccggagggtgcagagccaaatgttaaattatgaaaataggctccaaacaattgtcttgggagcatatgggtatataagaacaaaaaaataatgatatagcaaaatggaaaaatgtaccataattgagacatattgtcataaaaacttaaaatttggctttaaaaaactattatgcatgattatggaaaccaagcattagctatgcaaaaattagaaattggacaaagaaataaatatatttaaatgtcaagaagcagagaatttatcggacctttctttttcaaagataaatgaattccgagaacaagtgcaaaattatagatttgacacgaaaatattgtataataaaattaggataactgctttaagacatttatttaaacccgaaaaagaaaatttttttagcccatatcgtacggaaagaaaaagagaaattttttattcagtatttcggcagatctaataaaatcgcaacttttttgcaaaaaaaacgaaacattttcgttactaatagaatcgcatgatttttagtgtaatatttgagccttacttgtgcaaaagaccaaaaagtttttgcaagtttgaaggccattcactaatttcgtttgttgaatctgaactaaattagggttacgtcatgcattacaacccaaaatttgagtatttaagaagataaaaatacacataactcatctgccgttttacaacttttgaacgggtatgggttccagggggggggggggggacttggattaatatcccccgctaacttatatttaatattattttagatgtaagcccaacaaaacgacatg

SEQ ID NO: 114282 - DNA, 581 bp, Heterodera glycines
  Promoter: Source sequence=SeqID_11058; Location=1..581; Strand=+; Gene=SeqID_46920
gtaataattacgtttgcgatttttaggcaaatgcctaagatttttgcgcacttaatacgtgtaaataagcatgaaaaacgcattttccgcttggtttggggtgtctacgatgattttataatgcctaactttgcctatttcggggttttcgtgcctaaggtgcctattttaagatttttgaaaaaatctttaacaaaaatgcaataaaaacggaaaatacacccctaagaaatggcccgaaacatttttcggaaaatacacccctaagaattgaaaatttttcacaaaaattgatccacaaaatttaatatttttctcttaaaaaaatatttggtttttaaatttgtctttattcgaaaaaagttttaaataatttcatttacttttgaaaattttaaaattttatatgttttgctacctaaaaagcgttaataaaaaaaaattttgcctatttttatgcctatttggtgcctatttcgtgatttttttttctgcctttttagttgcctatttcgcgattttgtgtgcctaaaaatcgcatccctagtaatttgtcaatttgattccattccaagagcatg

SEQ ID NO: 114283 - DNA, 553 bp, Heterodera glycines
  Promoter: Source sequence=SeqID_14837; Location=1826..2378; Strand=-; Gene=SeqID_78992
aacccaccaaaataggtaggctttaggctctaaaagcagcctcaaatttgggggtgtaaaatgataaaatttattcaaaaaagtaaaaaaattctaccaaaatcagtattgagataaataatttttaaaaccaaaacccatgtcaagaaaataaaaaaattgtggagatgaatttttgagaaatttttcatgtgttaggggtgctttagaaaatttttcggtgcttaaggggtgtatttttgaaaaaatttttaggtcgattcttaggagtgtattttgagtttataattcttggttcctccagagctttgaatatccacgtaatttgtttcataataataagagcgacattttataattgctacgacaggaaatataaaattgaacatcgattttatataaaaattaaatataatatgtgtaataaaaatttttatttctcatccgaaagacatagaataatcctatatcttaatattctatattgcatattaaaaatatttatttaaaacttttttttttgctttaatttgactgataaaattcgacgatg

SEQ ID NO: 114284 - DNA, 125 bp, Heterodera glycines
  Promoter: Source sequence=SeqID_18091; Location=2407..2531; Strand=-; Gene=SeqID_82676
aaaaaaagattctcaaataatgagtttttcaggatgagatttaccccggtaaataccgggttgttgcatttgaaaagtcagctgatccacggaaatcaatccgtgttttgtggaagggccctatg

SEQ ID NO: 114285 - DNA, 168 bp, Heterodera glycines
  Promoter: Source sequence=SeqID_25300; Location=1..168; Strand=+; Gene=SeqID_56051
tttatttttaaaaaatttcaacccttttttttaaattttctaaaaaatttaagaaaattcttcattcaaacattgaaatttttaaatttgattttttaaaaaccattttggcatttttagaaaaaatttgaaattttattggataaaaaatatatacaggatgttatg

SEQ ID NO: 114286 - DNA, 263 bp, Heterodera glycines
  Promoter: Source sequence=SeqID_13420; Location=3881..4143; Strand=-; Gene=SeqID_77305
ctttattgcccaaaaagcgattctattagactgaaatgaatagaaaataggggattcatggccattctatgcatttgaatcgtttttgggcatcaaggtgaattagggtgaaaaatgaattttcgacttttgttcgaattagggttcgggttcgatatggatgtgatattcgtgttcatcaccccctaaacccccaagagcacctcaaaatcgctcaaaatctcttttttacctctttttttatgggaccagtaaaaccgatg

SEQ ID NO: 114287 - DNA, 1003 bp, Heterodera glycines
  Promoter: Source sequence=SeqID_7800; Location=133..1135; Strand=+; Gene=SeqID_66011
ttttgcggtagaaacccaactcgtttttgacccaactcgttttttgggtcgaaacccgaaaatcgaggccaaatcgcctaaattacctaatttaattcgggaatacttttatgtcattttaagtgatttttaagtttaaagccaaaatttagttgaaatccgaattttctaacttttcgaacttacttttcaaatgcctgtccaatttcgaagcccggattcaaattcgactaaaaagaaagaaaattcaaaaaagtgcaaaaattcatttccacctcaatttaattataacgtaaaactaagaaatgatcaaattttaacaactccagtggaagcaattttcaaacacggtaagaccgcactaacttgaaaaatttttcgagggaaacgaatatccgggtttttgcggtatgctggaaatcggacattggctgccaacggaacgacagattatcatttaaaaaaaaatttaattatacccaacaatatacaattccgacatccatttcgaacctctgacccgaatttgtaattcgaaaattcaatttttaacaaaatctaagtgtacaacgaaactggctcaactgcaggaaatttatgtcttgcctttattttgagtgtttctggcttgtttattgtattaattacaatctgaaaagaaattttagctcgaataattttatttctcaaattttcccatggtctaatccaaaattcgcataaaattatacccattagatggtcaatcattcccaaaatttcacactcggccaatcttttccacaataaccattttcaaattttattaatgcattttgttgtaaattcgaaattcgttcaaaattgaattttcaaattttgattcgatcacgggtcggcattcgaagtgggttaaatattctgaaagctcaagataaaagagacacgggtggatacaagacgctaattaaatttcaactggtgaatcattaaggaattaaatcatttacattcttttaaaatg

SEQ ID NO: 114288 - DNA, 1003 bp, Heterodera glycines
  Promoter: Source sequence=SeqID_6391; Location=171..1173; Strand=+; Gene=SeqID_61358
ttaaatgattattaaacatttaataattttttttgaataaggaaaatttttaaaccgaaaatttattatcaagaaaaaaaaatgaattttggcgatcaatttttgagaaaatttttcaattcttcggggtatattttcagaaattttttcaattcttagggatgtattttctgaaaatttttcaagtcatttcttaggggtgtattttcccgattttattccatttttaatggaattttccggaaaaaaaggccaaaaaaggcaccaaaatctgaaaaaagcgccaaaaaaggcaccaaaacagcaaaatgccaaaaaaggcatttaaggcacgaaaatccgaaaaaggcaaaaaaaggcaaaataaaagtcaacgtagaaagctcaaatcaagtggaaaatgtgttatttatgcttaatatatcgaaactagtgcgcagaaaaaaggcatatgcctcaaaatgcggtctctaatcatgttcttctccaaagtcttcatcgcggtcattgttgttgtcgttatgctcacattgttcagaagttgtcgcgttttcgccgtcgttgttgttcagaaacttgcgtttacgacatttttgaagaatttcaattttttcgattaattttgtttataaggcaattatgatatatttatatatatgtataatatacatgtaaatagatgtaccaaaataaataaatttatattttttaatttgtcgggattatgactcattttggcttagtcgggatttcgacgcgtcgggattttgacagcgcgcccccacattgattattctaatttgtacttacttttggttaattttataactttttttttgcagtttttcgtgacttgaattcccatctcctttcatcaattccactttttcatgactataaaaatggttgtttttttgatttgcctctcatatctaataaaaaaatatttctaaacacaaattattctgtcctttgtgaaattgtgctaattgcctcaaaaatg

SEQ ID NO: 114289 - DNA, 91 bp, Heterodera glycines
  misc_feature (59)..(60): n is a, c, g, or t
  Promoter: Source sequence=SeqID_44707; Location=1..91; Strand=+; Gene= SeqID_72151
aaatagcttctgagataataaggtttatcataaaattcaaattaaaaataaccctcaannttattggtatgaacgatactttccaaacatg

SEQ ID NO: 114290 - DNA, 801 bp, Heterodera glycines
  Promoter: Source sequence=SeqID_2383; Location=6964..7764; Strand=+; Gene=SeqID_79462
tattttttttcttaaccaaaaatttttcggccaagaattgtgatgtttaaaagtaaaattttgtagattttccccaattgtttggcgcttttccccccgcttcttccccctctctgctgctctgttggactgtttgtttattctctcatcatccgccgaccgaccggctaaatttaaactcagtcggacccctaaaaataaatatttgatgcatatttgtgaatgaatatgaatgaatgttagtgatgatgatgatgaggagtgtttaatttattattatttcccattttcgagtacacaaattttttttcccttttttatgcgcaattttattttatttttttaaatattttaaattgttgttgttgaagaatgaagaacgcttttttccgtgggagaagcgggggggggggggaattttattattaggtatttatgattatatttttaattttgttgttgaagaataaggaatggggaacgctgttttgcgagggggggggctaagatttttatgccaaattttattttaacaacaattggagagctatttttttacgatatttaaaacaaatattttatttaaaattaatattttcatttttgttgttgaagagacgcattttttccggctgggggggggcgggtgagatttttgcgtattttagcaattttattttgaaaacaaatatttaaattaatatttctaattttttgttgttggccgtggtgctgcgattttcatgcgcaattttatttttcaaaacaattattttatacatatatgtatttatttttatg

SEQ ID NO: 114291 - DNA, 527 bp, Heterodera glycines
  Promoter: Source sequence=SeqID_1015; Location=3007..3533; Strand=-; Gene=SeqID_66119
tgtttgggatagggacgatcccccggtggaggggaggataatccgcccgaattgggacgacggagaaaccaatacttaacccagtttattgcgcccggatgaagctttttggacggaatcgcttttctgatcaaaattgcaattaaaaagcaacatttcttattttaaaagcacatttgttcgggccttcttctaccgatcgtttttccaatttaaattttgtctctttcccccggggcattgagcaagtcccgcctctatctgatcagtcactcgcccccgctcaagtgatcagcagccattcatttgcccaaatgcccgcggcattgcgtcgcatcgcctccttttgtgcaaatttttagcgcttttccctttcccaaaaaccaaaaaatgatttatgccattcctatttcggctttttgtggtgccacaatgttttttaatttatatccccaataagccgacaaatgacatttctgatcacatttagattttcttttttatattcaaaaagtattccaaaaatg

SEQ ID NO: 114292 - DNA, 400 bp, Heterodera glycines
  Promoter: Source sequence=SeqID_43020; Location=649..1048; Strand=-; Gene=SeqID_70792
ttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatg

SEQ ID NO: 114293 - DNA, 1003 bp, Heterodera glycines
  Promoter: Source sequence=SeqID_15068; Location=1345..2347; Strand=+; Gene=SeqID_47266
attttgaaattttatggcagaatgtcactattttatcaagaaaatataaggtttgcgcaaaatttggttattttttgacaaaaaactgttagcaaatcgcattaaaaattacaaaatttttcccggtggcgcctatcggcaccgccggaccatctccccacttgttccccaaaagtttttgaaaaaacgcaccgcaaaaaaaagtatttttaaagacaaaaaatcgccgcttggcttttaataaaaaaattggccttttttggtgaaaatctgttaacaaatcagaattaaattacaaaaaatttttcaggcggcgccggaccctctcccctcgcacttcccaaaagttttttggaaaaatacgccgcaaaaaattgttaaaaatctgatttttttatcccgaatgcactaaaattttatgatttgctaatttcctccccaaaattgttaaaatcattaatgggagaccaaaaatatactatttgatacatttttgatcgaataaattttaaaaataactgatttgaagcaatttttgcgaaatgttcttatttttgaccctaaaatcttattttttggccttgatgttcttattttgaaaaattttcgatccgagccctgcatttatgtgacagttacgtaataaattttacatttcacaataaattttttggccattaaagaaattgcagggcggtgactcattctcatcatttccctcccttcccatcgtttttattaatgtgaaaatacattttctaagtctcgagaaatcaatacaaattcttggaattactcaaaatgaaaaaatatctcccttcctacaaaattttaataagcgaatttcaaattagcgcatgttttgattttgacacagaaagtggcatttgttttcaaagtttcataatttaaaaattaaaattgcaattttatataagaaagattttgttggtttgcctcgcagaatcgatttccaaatttggaaaaagtaaatttaaaaatg

SEQ ID NO: 114294 - DNA, 242 bp, Heterodera glycines
  Promoter: Source sequence=SeqID_29447; Location=610..851; Strand=-; Gene=SeqID_59945
ggtatggtcatggcaaaaatttttcgtatttattttttattaaaaaattttaattattttaaaatttattgcaccgtattcagcagttggacgacggctctggatgtttcgcaattggtggaagaaagggcgcagcaaattcgacaggcaattaaatgaaatgaaattaaatttcaaaaaaaaaattaaattaaaaaattcttgcacagatttgctcccaagttgatgacggcacactgatg

SEQ ID NO: 114295 - DNA, 1003 bp, Heterodera glycines
  Promoter: Source sequence=SeqID_9546; Location=2518..3520; Strand=-; Gene=SeqID_71827
taactccgaaagtactgtttaagccatgcttttatgccttccctcccaacagttcggacttatgcagtttttttctcatgttttcgccagttcttttgttgggtttcacacacacgcacacactctcttttttctctctcttcttcctcctctctctctctccctctctccgcacacactctcttttttctctctcttcttcctcctctctctctctccctctctccgcacacactctcttttttctctctcttcttcttcctctctctctctccctctctccgcacacactctcttttttctctctcttcttcctcctctccctctctcttcctctctctctgcctctttcttcttcctcctctctttctctctctccttcctcctcccccctctctctttctctctctgacttttgtcttttttctgaattttggaatttgtctgtcttctttgcccccccccccaccttttcatttgttcccccttttccaattaattccttttcatcccggccgattcatctcaactttttcattcttttcccacttttgcccatctgctgttgttggccctccctctgcttttaccgtaccattcgttctccactcattcatttacacataaacaccctctctcttttctgcttttaattcatccaatcttcttgaatttattccgtcacaaccccaaaacagttcgattcttttcgctaatcttgcaaatccattgggtcaattcattcaaaataagtaaatctttaaacatttaagtatcaaatcaacttaaataaatatatggttttttataatttttctaatcgtttcagaagtgccgacgtcggcactaaacttttcctctcctctcaaatctatacggaaatttgtctctgatcagcagcaaagtttgaaacatttgcaacttataatcacatttatagaattaaaaataatcaaataaatatttttaataatttaacaatttttaaatttcagttggaatg

SEQ ID NO: 114296 - DNA, 56 bp, Heterodera glycines
  Promoter: Source sequence=SeqID_35903; Location=106..161; Strand=+; Gene=SeqID_65354
ttctgcccgcttttccgcccgatgaaagtgccaatgcgtcggctggccaagcgatg

SEQ ID NO: 114297 - DNA, 731 bp, Heterodera glycines
  misc_feature (82)..(82): n is a, c, g, or t
  Promoter: Source sequence=SeqID_14756; Location=1..731; Strand=+; Gene=SeqID_78881
ataaagggaaataaccaactgatgagggggatggcgtccaacaaatgcaaaaaggataccggtgctggtcagatcgaatatncatggtgtattagtagcagcccattcacaaataataaaattaaaaatgactaaatagtgccatcagtagggctcgaaattatatggactaaaaagctcagaaatggccaaatattaaccaaaatatggactaaaaactgacaaaaattaatttactaaaattccaaaaatattcaatatttgcttaaacaaacttaaagaatacacaatattaccaaaaaatggatttaaatcttaaaaacgccaaattttttaaacaaattctaacttcataattccaaacggctccctgatatgccaaatattttataaattttttgaaccaaaaagcattaaatttgtgccaaatggtatgaaattaatcccgtaaccccagactcccgcctcatattacctaatttgcaagggaccaataatttaatttcaaaaatcggaaaaaaactaaaaactttacttccaaagagtagtaactcattcgaaaactctttttgaactctgcaaatctgtgtgttttttacttatttttgtttttcgtcggagcctcaattctgtttattaccgtgaaaccaactcgcaatcaagcctttacttccttaccaataacctttcatatttagatattttcagcagcttttttgtattccgtaatg

SEQ ID NO: 114298 - DNA, 1003 bp, Heterodera glycines
  Promoter: Source sequence=SeqID_1722; Location=1571..2573; Strand=+; Gene=SeqID_75504
ataattttctaaataaaaaaattccacgtcttatgagcaaatattttgttagatttaaatgcgctttatgtattggtaattaaaaacggattgtttaatttgtttgtttacacaaaatcctcgagaaattttaaattcggtaaaaattttcggattggaataaaataaaataataaagcatttttatatgtttataaggttttgtataacgattgtttacccaaccgcctcaattttgcacgtttttccattttaaaactaatctacggagcattacaacaagagataaaaatattggtcttgttttggattacattgattcatcgtccatcggtggttattttgttattaaaattatggaattaatattaaactgtcttttaaccttttaatcccattaaacactacccaataattatcttatataatcctttttagtgaaaagtggtctttgttaattctcattaaaatttgtttattttcattaagcttttctccggaaaattgccaaactattgatccgggagttgcagccatctgcaattttttttggcacattttattctttatcctccgactttataaagataggataaatctattaatattcccttatctgttgtgcacattttgaatatatattttgatcatttttggttgcatttgaaaaaagttacgacaaaaaaaaggtgagacacggcttattgcttcacactttatgttattataacatttgttactagaaatgcacactaaaataaaattatcaattcttgacaaatgaaaagaaggaagtcgaccgttttgtgatgcattttttgcgtcatattttttggcccaaaaattaattttactaaaataaattaataattttcaattgaaattatgattattaagcaaatttgccggcaaactaattataactaatggactagtttgaaaatggctgctactgatttcaactactattatttgtattatttgtagggctgcaaaaaatatg

SEQ ID NO: 114299 - DNA, 438 bp, Heterodera glycines
  Promoter: Source sequence=SeqID_23413; Location=1183..1620; Strand=-; Gene=SeqID_54121
tatttgaataatgaaatttttgctatcatagtaaatgaaaatatataggatttatgtgacagattttggcacggaataacaatttggcatcaatttcggttaaaattttaaaaaaattgaaaatttgagactcattgtaagcggtgccgagagaagccgctggaaaaaaattttaaaaattcgcgaatgtaaatttatttaaattcaaataaaaaatattgtgaaaataaataagtaaacaaaaaaaaaaatttaaaaatggagatcacaaaaagaaaaagtttcaatttttcgaatttaaataatcaaattaacaaattttggtgatggaacaacataatcattaaaattaacaaattgatgggaatgaatgaattttggggacccaatcaaaaaaaataaaaaataaaaatgtaagaaataattggcgacgaaatg

SEQ ID NO: 114300 - DNA, 168 bp, Heterodera glycines
  Promoter: Source sequence=SeqID_1534; Location=1..168; Strand=+; Gene= SeqID_74308
taataaagatttcaaagaaatataaaagaataaattcaaatttattaaaatctaaattttttacgaatattttctcagataatcacaaaatttttactaatattttttgccccttttttatcatttttaactaaactttaattacatgcagtgacgtcaacaattatg

SEQ ID NO: 114301 - DNA, 241 bp, Heterodera glycines
  Promoter: Source sequence=SeqID_1248; Location=965..1205; Strand=+; Gene=SeqID_70714
gtggggttcatttaggcgctcgcgtttgtacgctggggtcgtatgggcacaataaatgtcttttttcatgacatttccaaaatttttgatattcatagtgattttggagtgtctgatcagtgatcaccgtaaaaaatttttaatggacgtcaaaatttctcgtttcccaaacatgagtgcctaaatgtaattccccaaatgctattttcaaggactggacagcataaatccacttgaaatg

SEQ ID NO: 114302 - DNA, 229 bp, Heterodera glycines
  misc_feature (102)..(102): n is a, c, g, or t
  misc_feature (180)..(180): n is a, c, g, or t
  Promoter: Source sequence=SeqID_37974; Location=974..1202; Strand=-; Gene=SeqID_66935
cgatagagaagtgatcagaaatgccaaatgaaatttggaaatcaaaataaaatcaattaaatcgaaatgatgcagaaaatgaatttgcacacgacctcggancatgataaaatagttaaggaatgcgcatcggctgaggtttttgttttaaaaattattaaaaaaatataaagtaaaatntaagaaatggaaaaattggggagattttgtgacgcaatcacacaaaatg

SEQ ID NO: 114303 - DNA, 56 bp, Heterodera glycines
  Promoter: Source sequence=SeqID_22489; Location=1..56; Strand=+; Gene= SeqID_53159
ataagggttttttcaccagtcgaattagactaatttcattaacaaattaaaaaatg

SEQ ID NO: 114304 - DNA, 151 bp, Heterodera glycines
  misc_feature (70)..(70): n is a, c, g, or t
  misc_feature (97)..(97): n is a, c, g, or t
  Promoter: Source sequence=SeqID_16840; Location=1..151; Strand=+; Gene=SeqID_81266
agagagtgctgaagactcggacaaggagtgggcagaaagaacattgggtgaattttatggatataaaganccggagtgattaaagacagtgatatgnagatataccacgtatttaagtatattatattttatattttattaaaataaaatg

SEQ ID NO: 114305 - DNA, 763 bp, Heterodera glycines
  Promoter: Source sequence=SeqID_7297; Location=1..763; Strand=+; Gene= SeqID_64392
agtcttccggagcaggacaaaacattcgccgccgcccccacgtccaaaatttacgaactaacaaaacacggtatttctccgcttctcacctttaaaggtatcgattggccagtagaatgtgagatagtttccggcgcacagacacgggggggggaggggagcagctcaatttttgttcacctatggtgctctgtctcattgaaataatgtgcccggtcctcaaggtaattttaatatattttccactgcgatgttttgtcccagcgacattttaggctgtgtcggggcactttgccattctctttgtcaatttttccccttttcgcagtttgtccgcgattgatgatatggagtttcgcaaggtgcacgtcagagggtattaccttttcgaccgccaatttgtcattcggtggcgctgtcggttggaccccgcaaataccggcacttcgaattcggaaaaatatggggcgtatgtgatcactccgatgagactggagggcacaaagtacttttctgttcggtttcaccttagtttcctaaattcactttttgcaacagaaatataagaaatgaccataaattgttttttttcttattgtaattttgggaacctttcggcgtctgaccatcttttggtgcattaaagaaatttcggaaattggggtttacacgtttttgttttgaattcgagtcgaagctcaaaactacctaaagccaaattgtccccactctaatcgctaaatttgttagcgttacaattatg

SEQ ID NO: 114306 - DNA, 1003 bp, Heterodera glycines
  Promoter: Source sequence=SeqID_21194; Location=1348..2350; Strand=+; Gene=SeqID_51783
acatcctttatttattttagttttcccaaatttcggttgttattcctagagttgtacgggaccgggactggtaccgaaaaaaaggttggggtcaattccataccggccgtttccatgccataggccattttcgtaccaaaagtataaatattaatagacagtgaaattaaaacatccaataaaatttttcactactttttagacttagctccccaaaagctttcggatgataccaaatttatcaggattcgatcgttttaaaaaaaaagttagaagtgtcaaatctttgaatttttcgaattttgaaccgagccaaaaataggtttaaaccaaattccgcaacttccgggaaacccaaaaccgggctcaaaatcccggagctttagggacttcgggttcttacagtacctgctggggttaaatttgaatagttaaatccgggtcttacttcctaattttcgtgccaattgtaaattcgggaaaaaaaaattctcgatccaatttaagaatccggggaccggataaaactggtaaaatagacaaaacaatattttaaaaattttttacttcggcttgtaaaaaagtatgaatggtcattgttttgaagctttgcacggttctttttttgttagaagtatttccattttcttctctacaacagtaaacataaaatatattgtcttataatgcatgagaaacatcaaaatgttgaaaatccccttctatttttgaaattttgccgaaaaaatttttggtacgaaaatggcctatggcatggaaacggccgcatagaaacggcggcatggaaatgggtcgatcccctatgccaatattcatgttacaaaatgtgtcacttaaacatcaattaagcttcaggaattcctctttcttttcatttgcactgtccgacggattggaaaatgatcaccgatatgcaattgggtattcattcatcctttggcatttgcttgttcctttcattttttgctgcttaggtatcatg

SEQ ID NO: 114307 - DNA, 1003 bp, Heterodera glycines
  Promoter: Source sequence=SeqID_4623; Location=931..1933; Strand=-; Gene=SeqID_55127
tttttggccaagccaaaaggcaccgcagagagaagaatcccctctccttgccttctggttaatcctacttatgctcaatcacctttttaataattgcattattatttaataataatatataaattatataagtaaaacatagatttggttaatcctacttatggtcaatcaccattttaataattacattattatttaataataatatataaattatataagtaaaaaattgaattgaattatcctgctgtgatcattaacaattttcaaatccatttttactccgtttaaaaggcagtgttatttccattttttcattttaataattaaattttctcaattttacaataccctttgaaaaaaatcaaattgaattaattaatgcattttattataatccaatagaattagtaatgttcaaaaatttaatatcttttttatacagattaattttattttttgggtttactaaaaagcaggatttaaaaggtctttcagtttcatatttaaaatttatttattttttcatttcaaaatatcaaattaaattgttttatatttaaacaaacaattttcagaaaatagaaatattccaaaaatgcgaaataaaattataataatgaatttcaatctttttaaaatcaaaaaaaaattatggacaattgtaaaaatttcttaatggttcataaggcatagcgattctaccaatttttataattaattttttaaaatttaatatgcaaactttgctaattgctttttataaataattacttcattatttaatgtaaacaaaaatggtattaaataagggacaaattgttttattaatttatatttgaataaagaaagacataatgctatttaattacttagttcctttttttattatcattcctcatcaatttttatttccatttacaaatgcaattccattcgtgagttaaataaatttggcaattaatttgtctaatcttttttttatcagagagaagaaaaaatg

SEQ ID NO: 114308 - DNA, 465 bp, Heterodera glycines
  Promoter: Source sequence=SeqID_15559; Location=1..465; Strand=+; Gene=SeqID_79841
aaaaaggaaaaaatttaaaatttttcaatttaattttcccaataaattgtagacaaaattttcttaaaaggggttaaggtacaataattaacaactttttaaatattcataacaaagtggctttgaactttttgtcgtcgagcatttgagttggggttagtgcccagcacatccacgggtggcaagctgtgctccatttcaaagcatttgcttcaaatagggaaataatttttatagaacaattatatcttgacaaaaaataattatcgttataatctttggttaatcccccgaactattacttaaatcactccactaccatacattagggattgcgaagcgcttgcggactgttcaagaaatcagacttcccgaaaagcattcactgcgaaggcttccagttttcctcgcggtgttcagtagtttaatactccaattcaccgcttcacctagtgattaccaatg

SEQ ID NO: 114309 - DNA, 1003 bp, Heterodera glycines
  Promoter: Source sequence=SeqID_24889; Location=1206..2208; Strand=-; Gene=SeqID_55635
agaagggcgaagcgctttatcccattcccagatccgacggtttacgcaccagttattttaatatatttgtttttaatgatatcggtagttaatcaagttgtaattgtggactcttattaattttattaatagccttataaaatattatagcttttgtagcgtattttgctccctataaatataaaagagaacaccatattttttattcttttttttgaagattttgaacctcgattatgtcccaaattgaaagagtttcaattataatacataatctaatttaattatcaaaaaattcaaattagaaaatatttagggaaataaaaatatttcttatttatttaatatttatgacaaaataaatgatgacaaaaataatttatgcaaaagaagtataaatataatagttgaaattagaaatttaaaaaatcaactagaaatgtattttgaaataatctgtcaagctgcctaattttactagttaattagcaagtttttcaaataaaattttgattaattatgagttagtttttatttttctctcatatgctttattattgcgtactagcaaaaaatgttcttctttattgcttcatcgtaaatgttattataacagatagttagtttttagtttaaatccttttaattctctttgatcccattttatgttttaaattaatgaatatatttttaattaaaatttcaaattacattgtttaataattttataatatacgaatcgccatttgcgccacgacattcattaagcatatagaaaaaagctcccaactttgggtaattaaatccaaacagttttgtatgtttgaaaaattttcctttctcgtcggcaatccctttcaacttttatataatcattttttgggcagagttaagcactgatgatgttgacggtgagtagtgggggccgacaccagcaaaccgcaaaaaaactgccaacaagttcaagcagtacaacaaaaagccgacgacgacggcgagcatg

SEQ ID NO: 114310 - DNA, 858 bp, Heterodera glycines
  misc_feature (206)..(206): n is a, c, g, or t
  Promoter: Source sequence=SeqID_28899; Location=1..858; Strand=+; Gene=SeqID_59467
ttttcccttttttttttgtgtattttttgggggttaattttttttttggggggggtttaaaatttgtttctttattttccaattactcattttttgttttgggtttttttcggggatttgttttacgtggatttgttttttaaattcttcatgactttttgtcgtatttttcttattttctttatgttttttgatagtattaattnaattattttcctttttctgggttttttcgtatttcatatttcatttttctaataggtattctattttttcacaggtcaaataccccggccatcccaaatttgtgttcgttactgccgccaacgatgcttatttcaaaacccttcgcgtattaattgcaaccataaaacagagatttggctgtaaagaaaaaataattgcgtacgatttgggaaatatcacacagaacaaatccatggtacggttatattacctaatccgattttcgtggataatagcttcgacggattccagctcctatgaaaattcctcaaaattttattaaatcattaaaataagcatagaaatttatgaaaaatttgtggcctgtcgtcaacacctaataaagattctagggcaaaatagtgatttaacccatttgggatttattcctaaaaatcagggtttgaattccgctaaacatatcctgtggcctttggcatcatttgaacgctcacaacttaaattagctattttaggaaaaaaaaataaaatagaagaaaataattttgctcaattataaaaatgacttttttgcatttaaattaaaattaatacctaaagacggatgagcttaattcggtgtgcaaattgacttggcgaacttttcaaatg

SEQ ID NO: 114311 - DNA, 98 bp, Heterodera glycines
  Promoter: Source sequence=SeqID_4001; Location=901..998; Strand=-; Gene=SeqID_52769
ggtaaaattttttttattaaataagggcaaccatatggttttcacttctttttttagattccctttcgctgtccgttcagtcgaagctgtacaaaatg

SEQ ID NO: 114312 - DNA, 277 bp, Heterodera glycines
  Promoter: Source sequence=SeqID_3252; Location=923..1199; Strand=-; Gene=SeqID_83921
tctcaaaaatgaggaaaaatggcttgaattgagtcattttttggataatcggtatttacaaggcacccctcagcgaatacttgctatagagcaatcattcaaaggccattttgtagagaattttgtgctctttctgttcgtcatattcatcttctatggaaaatttttcccaaccccctagaattttttttcgaatttactcagattttcgtattttttcacccgcaaaaattttgtgtttaatgccttttttatggcataaaattaataaaaaatg

SEQ ID NO: 114313 - DNA, 143 bp, Heterodera glycines
  Promoter: Source sequence=SeqID_16734; Location=252..394; Strand=+; Gene=SeqID_81133
tggtaaaacagtgaaattaatacttaaaaatcaaatttatatttaatttaaattttttcaacgacttttccaaatttaacgcacttgaagaatttcgactgttgaaggcaagaattgagcaattggagcaactgcagagaatg

SEQ ID NO: 114314 - DNA, 505 bp, Heterodera glycines
  Promoter: Source sequence=SeqID_14513; Location=1..505; Strand=+; Gene=SeqID_78564
atctttgtagcttttgtgccaccatttatttcatagaaattaatgacttcgcgtgttgaacacctttttttgttgtaaaatgttgtcgcgtgccgcccatttaaatgggacgcggaatggcaattaaaaagcacaaattaaaaaaaaattggccattaatttttctttcttttaaaattcgcattcacggactttttttctcacagccattgaaaggtttatgatgagaaagaactttatgttcttaaaccaacaaattaagaaaaaaaattaatttattttcataaatgtactcttcattaaagtagaaacaatatttgtttctaatttacttattttttttattaatttaatgtcttttcattggcacttcgagtttaaaaaagaatgcgtcttgcaattttgtttcattattgttaaaatttaaatttttgcaattttttagcctttcaaattttcctacatttcctcctccttctcattcgctgttatgggtcaacaaatg

SEQ ID NO: 114315 - DNA, 223 bp, Heterodera glycines
  misc_feature (9)..(9): n is a, c, g, or t
  Promoter: Source sequence=SeqID_1156; Location=2969..3191; Strand=-; Gene=SeqID_68980
ggatgaagntgttgctgcttcgggagagtacgcggatgtgcacttttttgttggggacggagacgaaaaagaggcgagttttgaagaatgaataattttattttaaataattttaattaattttattttatgtattttatttttttcctacattagttcctttaagcttgtgccagcacataaactcattttgaagcacgcgtccgaagtatttgaggcaatg

SEQ ID NO: 114316 - DNA, 1003 bp, Heterodera glycines
  Promoter: Source sequence=SeqID_21692; Location=151..1153; Strand=+; Gene=SeqID_52304
tattctagttctttagccattttaaacatttataatcattcaattaaatatttttgttttacaattaaattttaaatttgtctaaaaactcactcaaggaatgataaaaatttaatttctcatttttattaccataatttagccgcaccgtgaggaattaatttgtaatttaattttaatttctcatttttattaccataatttagccgcaccgtgaggaattaatttgtaatttaattttaatttctcatttttattaccataatttagccgcaccgtttactcatttggcctggcgcttgtttgtctttcatttttttttatttcggcgctcagttggctcctcatttggcccgatcattgggccaaaattgtgataaaaatgattgatggtgatttgtgtggtgcattttccacctccccttggccatttttccccgaccaaattattcttcacgcgatttgcctccgctccgtctccggcggggcgttttggacaatcgattttacataatttttgttttatttttaatttgattgggtgcgactttctgtccagtttaattattttacattttaaaaataaaatgttacgagaaaaaaatattaattatttcattcaaattaattaaattccttcattgaataattcttgttaattaattttgataatttaaactgttaattaaatgtatattatttaattctgactaataattattcttaattatcacattaatcaaatataatctgcaattatggttattatttttaataatctagttttactgactatttttaatgtaaaacttatttcattagtttgggtaattgttgcaaataatttttctaataaaaaattgtaattaattaattaattatagatttattatgttcaaatgttttttaattataattgatgttcttgcccaaccaattaccaactcagcttaaaaatcaacaccaaaacagtgaaaaaggtcaaagaaaacggaacaaaatg

SEQ ID NO: 114317 - DNA, 56 bp, Heterodera glycines
  Promoter: Source sequence=SeqID_32488; Location=1..56; Strand=+; Gene= SeqID_62793
ctagagctcggtattttgaaaaaagcctggacctggccctggacctggattccatg

SEQ ID NO: 114318 - DNA, 114 bp, Heterodera glycines
  Promoter: Source sequence=SeqID_18571; Location=1932..2045; Strand=-; Gene=SeqID_83201
ggtcgtttcccattattattttttagttttgctttgcgttatcgaatattttcagttgcgttcgataaattgcaaagggactctcgacacttctttgaaaccatcgaccaaatg

SEQ ID NO: 114319 - DNA, 77 bp, Heterodera glycines
  Promoter: Source sequence=SeqID_17059; Location=952..1028; Strand=-; Gene=SeqID_81488
ggtgagttttgccgtgcttttcccatttgattctacgtttttcaattgctgtctttcaggtgttcagcatcgtcatg

SEQ ID NO: 114320 - DNA, 1003 bp, Heterodera glycines
  Promoter: Source sequence=SeqID_2631; Location=2352..3354; Strand=+; Gene=SeqID_80809
ctgatggagggcgtttgctagcctgatggtgggtgctttgccaacctgatggcgggcgtttgctcgcctgatggcgggcgtttgctcgagtgatggcgcgtgccaactcgcttgaaggtggttggcaacggaaggatggtttctgtctgtatccttaattaggagagttattttcccgtataatagttttgttgacaataaacggatagcttcaagatttttttgcgggagtgtgttttcggaatgagttgaaatgaaaacaggtaaatttggatattgggtcccagatcatgagaggctcattcaattgaaatcacctgcttggtagagctttggtttttggcggccgattgccaagctttgttctgttttggcactgtgactaaatgccgagcctgaaaaggttttggcgtttggttatcagaagccgagcatagttaagttttggcgcggcggtgaatgtcgagcctggctaagttttatattgtacaattgacaaccgtacttgtctgggttttggtttttgacggccgagtgccaagcgttgttctattttggcactgtgacccaatgccgagcctgaaacggttttgaatttggctatcagaagccgtgcaaaaccgagttttggcgcggctgttcaattccaagcctggctggtattagcttttaattattcataactgacagtgactttacgatgctgtgacaataaccgtcttttgatcttaaaaaaataattgggtcgtgatagtataaatcaataaactatcttaaaaataagaaatgaattaaatgggcaaaacactatcaaaggtttatttcaatcttaaatcccagcaagttatgtgggaatcttgaaggttttactagaaaaattaacccaaaaataaaacttaaagatgttcatgagtttcatgataattttacaaatgctagtataattttgaacaaaaggtacgacaataaaaaatgaaaataataataccaaaatttaaaaatg

SEQ ID NO: 114321 - DNA, 411 bp, Heterodera glycines
  Promoter: Source sequence=SeqID_38289; Location=1018..1428; Strand=-; Gene=SeqID_67149
caactgaggtagccgtttctggcattattttgggtgcgattttgtgttatttccgaaaattgaaaataaataattagacgccaaaatactatattgatgaaaatacatattgaataatgtatgaagagcaaaaaataattaactgtcaatataaagaacataaaatttaaactctaaaagaatatttaagttaagtttttcaagaattttttcttattctaattttccataacaaatttttcacacagacccccttcttatgcatgctaacaaaaattacaaatccacctatccgtttccataaaaaattttcattttaagacagagtatttgccaaaactcaaattttccctggcggcgcctatcttcgcctcctcacaactttcctaactgttttcgatttccagaatg

SEQ ID NO: 114322 - DNA, 170 bp, Heterodera glycines
  Promoter: Source sequence=SeqID_42702; Location=1..170; Strand=+; Gene=SeqID_70530
gaggaggaggagggtgaagtccgactcggagacgaaggacgagcagaagaggcttatgaaatggagggggaacacctccgacaccacaacagctggctgagcagaacgcaaaaacaggttggcagagaagggacagactttcccaagaagaaacaccccacggacagatg

SEQ ID NO: 114323 - DNA, 216 bp, Heterodera glycines
  Promoter: Source sequence=SeqID_12116; Location=3435..3650; Strand=-; Gene=SeqID_75683
tcagtcgagacgaaattgaaaagctgaaaaatatcatccgccagaccgagagcgctttggtgaaacttggagaagtcggactcttcaaaggacaaacgatacaccgcatcgacctaatcgatggcgcacggccggtccaacagagaccctatcgttatcctgtcgcacttcacccgaaaatagagcgtcaagtcaaggagttgctgcgtcaaaatg

SEQ ID NO: 114324 - DNA, 318 bp, Heterodera glycines
  Promoter: Source sequence=SeqID_27757; Location=1..318; Strand=+; Gene=SeqID_58426
ttttggacaaaacagcttgccgtactaaactgactctcgtactaaaccgaccctcgtactaaaacggccgtactaaaacggccgtactaaaccggccgtactaaaccggccgtactaaactgacccggtccggtcccgtggcactctactactaatcatcaatccttcccttttcatgactataaaaatgtttgttttttcgctttgtctcgcatttgaaaaaataaaagtttctaacggaataattctgcaattcttccttccctttgtgacatctttcggaactcggccaaaattgtgctaattgccacaaaaatg

SEQ ID NO: 114325 - DNA, 592 bp, Heterodera glycines
  Promoter: Source sequence=SeqID_26894; Location=436..1027; Strand=-; Gene=SeqID_57634
ccccgtacgggggtccgaatgcgggaggcgtactcccgcacggtggtccgaatgcgggaggcgttcccccgtacgggggtccgaatgcgggaggcgttcccccgtacgggggtccgaatgcgggaggtgttcccccgtacggtggtccgaatgcgggaggcgttcccccgtacggtggtccgaatgcggcgggaggcgctcccccgtacggcggttcgtatgcggcgggaggcgcttccccgtacggagggggagagaatcactggcgactgagacgcctatgaatgacgaagagacgcttgaataaagggtgccattattgtgataattcaactcttatgctttgatgttttttatttaaaattgttcaactgaaatagataaataatgaggcaatttgaaaaatcacttatttaattttttgacaactattttacaagctctttggaaatgaattgggctccaaccatgttatatttaaggtcttgacgacagaaaagaagtcagacgtttgataaaaaagacctttaaaaatgttaagtgcggccttcgatctgtatggaataaaacagaaaaggtaaaagacaaaatg

SEQ ID NO: 114326 - DNA, 1003 bp, Heterodera glycines
  Promoter: Source sequence=SeqID_624; Location=2755..3757; Strand=+; Gene=SeqID_57747
tgttttataaaatgttctttcttcaattaacaaatttcttgattgattatttacagttttgctaggtttatatacgaattaaggaaattaattatacatttgtgcataaaaattttgaccaaactttgtcttcaaattattccatggaacatttttgactatttctcattttaaagaaatcataaaatgcttggctgctccgctttcttcaaaaggatatttttacgatcattaaaaattatttttattttattcattcgatttttcatcccttttatttatagtcgtaaaaattcaacagacatataaaagacaattctcgacgagacattatacaaaacaaagaaataataattaaaaaacgaagccaaactaacgaatgcttttttcaattttcctccttctcatggtcatttttattatttgttttatatttaaaaaataatttttatgttaattagtagggatgcaatttaatttagtcacggaaaacagcaaaagaggcgctatataggaaaaaaaataattaaatttccaaaaaacatacaatagataaccaaaaaatttttcaaaaatatatttgagaaagaatcgctgagaacattttcatttagggttatgttttcattttttgaaaatttttaggttcaatattagagttgttttttcccttttattgaatttttgttcaggaattttctaagaatctcgaaaaaggcaaatataggcatttcgtaatagcaaaaaatgctaaatttcaactcagacaattacaaccaagcaaaaaattcttaactcaacgaaacaattatttaataattgcatcccctaaaatatttttatttttaaattgcataataatttagacagccgaatttgcgagcggaaataattcgtcagaattggacattggcgatttctacaaaaatagctcatcaagtgatgtttaaaaaaacaaaaacaaaatttaattgcctcttttcagttccaatttataagaatg

SEQ ID NO: 114327 - DNA, 215 bp, Heterodera glycines
  Promoter: Source sequence=SeqID_5457; Location=1..215; Strand=+; Gene= SeqID_58125
atgatcaatgagtgatcaggaaagaaacaaggttgctcttaattgtctgtggggtgataatagtgtcattaattgttacggaattggtgatcaaattgtgcgttaattattcgccagaggggtaaaaatgttaccggaaaataccgattttgtgatctgaagagaattgtcggagaaaaatatttttcttatcagaacactgctctaatgttatg

SEQ ID NO: 114328 - DNA, 187 bp, Heterodera glycines
  Promoter: Source sequence=SeqID_10518; Location=2371..2557; Strand=-; Gene=SeqID_73745
agttcaatttgtgatgttcgatggtttctcaattatataaaatggttcagccgatacgaacggcgacttctcaacggacagcgccgaagcgtcgacgagcgaaggcgacggaggggcggcggagccgcagcacagccaatcgctgcacaacgaactgctgatccgcgcatcgtccagcattttaatg

SEQ ID NO: 114329 - DNA, 165 bp, Heterodera glycines
  Promoter: Source sequence=SeqID_17295; Location=458..622; Strand=-; Gene=SeqID_81772
ttttccaattttttttcgttatattatagcttttttttcttaaaaaggatataaaaaagccatctaaatttcatagtttatttttccaaatttttttaggcctcaatttttacacattatgcatacattttaaacatttgttgcagtgtcaaaatggtgctgatg

SEQ ID NO: 114330 - DNA, 64 bp, Heterodera glycines
  Promoter: Source sequence=SeqID_26057; Location=1..64; Strand=+; Gene= SeqID_56803
aaaataggcactaaaaaatggaaaataggctctaaaaaatcctcatttttaggggtgtaaaatg

SEQ ID NO: 114331 - DNA, 1003 bp, Heterodera glycines
  Promoter: Source sequence=SeqID_7060; Location=1639..2641; Strand=-; Gene=SeqID_63707
agaccgactttctctatttgaattaacccttgctatatattttgcaatctgatcaaatcacataatcatggtctcgaccataaaatattgtttgcttgactaatttcaagagtaaatttgcaaatttttccattttatttctccagtttccatgtctgatcagttcgtaatggccttcaaattcaaaatgttgcattaccttcatagtgcccattatttagcatttaaattctaaaacttttggactgatcagtcgctaaaatttttcgtttattttctctgcccgatcagttttaaaaaaatcgagtttttgcagcctttccatgactgatcagagtgaaaataaatttatttatgataaaaaaattctctgatcagtccatcaaagaaaatttacattttctgcttggagcacaatcaatcaatagtttttcaaatcaaatgtgactgatcaatgcatttttctcgatcaataattgccgaattttaatttgattggtcaacctatttcggtcatagatccctaatcaatcaataattatcgatttgttttcattcatagctattataaaaatcagtcaataatgattttctcttttccgatttaaaaatcagtcaataatgattttcccttttccgatttaagctgctcagctgagcgctgcggccgccctgtacaacaacagcagcagcaccaattcgcttgtcggcggttgcgcgccgccgcaaccgtccgctaccattgctgcaacatcatccgcggcacccagccatagcagcagcaccggaagcagcgtgtccgccttcgcgcgactgttgccgccgacgccgtcccactcgctgcaacattcgccgctgcaccaaatttcaccgcaaccgtcgccatcctcagcgacgtcaacggcagcggcatccacagcgaccacgatggccgcgctcagccaactgatcggtgccgcggcagcgaccgcagccgccgcgtcatcaccggcgggcggcgatg

SEQ ID NO: 114332 - DNA, 418 bp, Heterodera glycines
  Promoter: Source sequence=SeqID_28724; Location=1..418; Strand=+; Gene=SeqID_59303
atccgcacaaaactgaggtaatcttacccagctaattaaataccgataatatttatgaatagaaatggctcaatgtttatccaataatatctttgcaaaattattaattgaattttctaataaatcaaaaattaatattttaatgacaaaaaaatgaatttaaaatacaataatttatattaataattgtttttcttttaagtttaaaatgttcaaagaaagcttccttcaatctttctcaccacaatcccaccaatttaaatgtttcgctttgtttggaatggcaacgttaatttttatttggtgagagttaaaagccatcacttaaaaacaattccaattaatgagttttgatttcgcaggtactcaacggtaatgcacgacacggaatgttttgaaattaaatggccaaaaaatg

SEQ ID NO: 114333 - DNA, 514 bp, Heterodera glycines
  Promoter: Source sequence=SeqID_22962; Location=430..943; Strand=-; Gene=SeqID_53661
tttttggacggagacggaatttgtatgtgacaaacaaaagacagctaaaaataaaagaagttattttttaatagtcggaataaaaaaatagggagtgaagaatgcaaaaaaacgatgagaattggaatgatggcaaagtcaaaaaagtggccgtatttatacaaaaaaatgttggggagcacttcaaacaaacgacacatatcgcaagcagccatcgacccatttttcgcctatcgcagcagtcaccgccaaaaaacttcttcacgacgtctcaaatctggaaattcctcccgaaatcgaagccgacaacgccattccggcatatgcaaagctgttcatcagacaactcacagctctgctcggttcgacgaccacacttctccaacaacagtgtgcagcagctgatgctgtggaggaagacaggcgccaacattcactcgtggtgattggcttgccggagagtcaggagaaaacgcccaccggtcgtgccagcgccgacaaaggtacggccatg

SEQ ID NO: 114334 - DNA, 458 bp, Heterodera glycines
  Promoter: Source sequence=SeqID_1848; Location=2925..3382; Strand=+; Gene=SeqID_76346
aagctttatgcggtgccgtgcataaaaatgtgccgccacattgatgttgaacgggttgcgcaattgcccataagcaggaagaaatgcggcgccttgtgccgaaattccagtgacgaagaaagttttggtcatcccattacggtcgttgtaggtggtgcgcgctttgcgcccaatgatgtgtttcagcacaagcgcccgatcctctgggtggttgagccggtcgcgcaatgacttgacagggcagttgagaagctgagcgcaaaatgtgcttacaagaaccatggcaggagaatgaaagtgggatgaagttgaaaaattttacttttatttgcgcaaaagtgtggccacgcctacactatttgaaaagagtcacggttttagacatgcccgcccactaaaagccaaaacattttgcctgccaaaaacccagaatcattttaccaatttttgtcaaaatg

SEQ ID NO: 114335 - DNA, 422 bp, Heterodera glycines
  Promoter: Source sequence=SeqID_34422; Location=1..422; Strand=+; Gene=SeqID_64226
acttttatgccacctaaacattgttgcgggctcaccactggcgcttttttctatttttttaaattttgaggcgtggcctattttcataactttatttttatggggtttcatttggaattttgaatttcttttattgtgatagctttatattatgtcttttgtgcaaagtttgaagataaaaagctaaggaatttttggaaatatgtacaatttcaactgttaaaaagatgaaaaatccacacaaaaattcaataaggtttttagaccagcaaatgatatgagaatgacaaaaaaattttatgaccttaaaattccttaatgtgtagaattttaagttaaaaatgtaaaaagaaaagaaaatttaataaataaaaaaattattacattttatgagaattttattattattgcagaataaaatg

SEQ ID NO: 114336 - DNA, 97 bp, Heterodera glycines
  Promoter: Source sequence=SeqID_18346; Location=503..599; Strand=+; Gene=SeqID_47512
ggttcccaacactttccagcttgtttctatatgtttcattgttaggttcaactccgaattgaaacgaattgccgacagtcacctcaaccgaaatatg

SEQ ID NO: 114337 - DNA, 517 bp, Heterodera glycines
  Promoter: Source sequence=SeqID_8454; Location=359..875; Strand=+; Gene=SeqID_68124
aaaaagcattgactttcgctatcgtgataaattatttgtaaaaaaagatttgtttttaggggtaattagaatattgcatgctttggtttttgtaaaaaaaatttaaaaaaaatttttcaataaaaaaaatcaaaactcatttcagatataattttatagactccttcaaagtgacaattagagatataaattaattccgatgcctatagatagtatttatccttcaagtggatatttgattatgaattttgaaaatttgtatttttttattaaaaaaccacaaaacatctttttttatacaatccagaaaattttttgaactaaataaaaaaaacctatcgagtctcccttctaacaattttacagcaaacaaacgtaaaattttttaatttaaaataattacaaaatgttaaacggtaatccgaaactgctcggcctgcacactctgccggtttagcagcaacaaattaaaaggaataaattaaaatttaattaatcaattaatcaaaagaaaatg

SEQ ID NO: 114338 - DNA, 177 bp, Heterodera glycines
  Promoter: Source sequence=SeqID_13512; Location=1..177; Strand=+; Gene=SeqID_77406
gttcggaaaacattgacttcttccgaagcaggggcgtcttcgtcttccaatattgacacaagacaagagtccgaaactgctgttttacgtgacctggaccagggcaatttgaccaatactctgacaacgcccgtggcaaaaagccaaaaattggatcaaccattttcggcatcaatg

SEQ ID NO: 114339 - DNA, 286 bp, Heterodera glycines
  Promoter: Source sequence=SeqID_21303; Location=1..286; Strand=+; Gene=SeqID_51893
ttgggatcagtacaaaatactgggtgatcatttcgcaaaatacggatcacttgaaatagaaagtgagaggggagagggaaaagggagagacagagagagaagggtcaataaacatattgcagagagaaaagaaagtgtgacggaatcattggaagaactgatccaaaaacaagaggaagctaaagatggcgaggagagagtgaagcatgccattgctggcagagagacggcagagagaagagggcaagaaggaatagtggaggaaagggggagaatagaagagatg

SEQ ID NO: 114340 - DNA, 775 bp, Heterodera glycines
  Promoter: Source sequence=SeqID_5849; Location=1..775; Strand=+; Gene= SeqID_59436
tttcaaaaaatttgatcaagtttgaaaaaaagttatggacgaaataatttttttttacgatttttagtcataacttatttcgaaaagcaataaaattttctttcatcagtatgtagatagagaacattaagggctatgaatgatcccaagaatgtttaatttggtcaattttaacaaaagttaagacgatttttttgtctaaaaacagtacgagttgggcagtacgagtggtccctgaaaatacgaaactggaaaatgcgacaccgagagaaagttttcacaaagaaaatacgacaccaaacttagatttttaaaaatataaatttatatatttttttcaattaaagtctggaaatgagcatcagtacctaaaaagacttgttaagtgtggataacaccactgattattaaacgtgaaaaattggcaaaataaattagtataaaattggtagctgctcttcctccaccttccattattattttccatttgccatttacccattggttttcgtctctttttgttcgactttatctccctgacaattccttcaaaaaatgattctgtacgttttgtagatttcttcacaattttacctttttgaatttcccattttttagtctgttcgttgtgccaatgtttgttgggtgttgtgacattctttggagttattgggaccgcctcaaaaaaccaaaaaagaaaatgtaaaaacatttggccattcacacgaacaataaacacattttggtgatgattttgcacaacatttggccaatg

SEQ ID NO: 114341 - DNA, 87 bp, Heterodera glycines
  Promoter: Source sequence=SeqID_40223; Location=837..923; Strand=-; Gene=SeqID_68624
aggttcaacaatgccctggtgattgccgaagtgctgggcattgaggcggcacgcggctcaatcatttccgaaattttgaccacaatg

SEQ ID NO: 114342 - DNA, 132 bp, Heterodera glycines
  Promoter: Source sequence=SeqID_18009; Location=895..1026; Strand=-; Gene=SeqID_82583
gtttttaattttttttttttttttttctaaaaccattatttttcataggattgggccaacaaatgtgagggcgatgcgcccgtgttgccctgtcaggatgtgaatgcgcccgacctgtacattccgttgatg

SEQ ID NO: 114343 - DNA, 822 bp, Heterodera glycines
  Promoter: Source sequence=SeqID_1209; Location=1..822; Strand=+; Gene= SeqID_69950
gaaccgtcctgttccgcagccaaacgtattttttctttgatcatgccttttggtattgttttttgatcgtatttgcttaaaaatcatataatcagaaccaaaaaatatgatatcaaccaaaagtccaattaaatattttttaataatgcacaaaatttcgccacgttaagtcctcggcaaacgtttggctctttcgtttggagtggacagtttcagaaacttctttgcctgatttttaacagattttgtgataaaaaatgccaatttggttgattttcgtcttaaatttaattttaaattaaggatctgagaccggcggtgccgttaagcgtcgccaagaaaatttttgaaagtttaattgtgatttgttttatgtaattttcgagttgttgatcacgaatctgacatcaaaatttagattattcagaaccccggacccaaactcgaacgaagtcaaaactcaaatcttcgaattccgcatttttatttcaaaacgaaactgaatcttagtccaaaataaaaaagttaaattagggaccacaattctttgccattaccataaaaaatcatttaaactcgaaaattcggaatcatgacatttttagtgaatttttgtctttttcgtccttttatactcacaaatttgtccattgaaattgcgcaactaacagctttttcattggttgaaatggctatttaaaagcgattcttcgtcaattgttgtcattgtcccagtattatttctttttttttgatttttgatttttcttttttatgttcattcgtgtcaataatttttcagcctccaatttcagccacatg

SEQ ID NO: 114344 - DNA, 191 bp, Heterodera glycines
  Promoter: Source sequence=SeqID_17059; Location=1..191; Strand=+; Gene=SeqID_81489
gttggccgcgttgcgcggcgtccccgtgcaattggtgcgaaagccgcgactggtgagaacggcacacattctgctgacattcacatttttgactatagccgacattttcttgaaattttaatcgcgtcaaagtcgagactctcggttttgccctaccaaaacttaaattcagtcgtttgtgttttcagatg

SEQ ID NO: 114345 - DNA, 798 bp, Heterodera glycines
  Promoter: Source sequence=SeqID_11080; Location=1..798; Strand=+; Gene=SeqID_74415
ttatttactctaaaaataaattcttcaaaagaataaccgttaattgaaaaaagtcagtaataaaaaaggaaattttatataaaaactttttaaagtatagtgcaaaaattcaatttgtgaataaaaaatgaaataaaaatgcttttttgactaattacggaaaagaataacattgaaaaaattttataacaatattaataaaaatcaataatggttgataaaatttctatttttaggcgttattttattgtaaaaaatgtacgaaactaagtttttttaaatttttttatagcgaatatactataaattaaatctgtacaattttttattataaatatttaatttatatatttgcaaaggaaattatattcacaggaaacagttgaagtgaatagaaaatcctttgtgctaaaattctgaaaggagcatatagtggaaatccatataatgagtaaaccctaatttatgaataatattataaaaacaagagtcaaagcaaaaccaatattctttttaagttaagacttaaaatgtaagcaccttttttcggcgcttgtcggcactgccggaacgtctcattctgttttttttaatttggttcaaaaaacaccaaaatcgtttccgaaacctgacataaattcattgatgcaatggataaggaaaccataaatgcatttgtagacagctcatatttctcacgtaaatgaaataattaagataccacttcacctaatctccgtgtgcaaccggactgaatttttcagcacattgtcatttttttcagaaaattttcccatg

SEQ ID NO: 114346 - DNA, 111 bp, Heterodera glycines
  Promoter: Source sequence=SeqID_19955; Location=1196..1306; Strand=-; Gene=SeqID_84720
ttttttagttaaaatattttgaatttttacctctaaaaatcaataagttattagcttaattaatttatttacccgaaacattgacttggtgtatttgaaaatgtcctaatg

SEQ ID NO: 114347 - DNA, 191 bp, Heterodera glycines
  Promoter: Source sequence=SeqID_5668; Location=3719..3909; Strand=-; Gene=SeqID_58845
gtcaccagtcattggatacttaaattcattcgaattttcattaaaaaaatttccatttttaccacgaattcattagcgcatttttccgcactttttttaatgattcaatttaaaattaccattaaattaaaaggaattcgtttcattcacctacctatttaaaattagtttgattacctgcaaaaaaaatg

SEQ ID NO: 114348 - DNA, 1003 bp, Heterodera glycines
  Promoter: Source sequence=SeqID_23120; Location=439..1441; Strand=+; Gene=SeqID_53827
ttcttaatttaaaggcaaatataaccaaatatctctcaataaatatttgttgttggtgggaaattttgacaattttgccatataacgcagggaaaaagtgtgaccaaattggccataaatggaaaacatgaaaacaattaataagaagacaacaaaaaatgtttgtaggcggccaaagttgtgtcaataaaaaaaatcttgacgatattattatttaataaaataagtaaaattaattaaaatataaaattgattggtggggaaaatttgtcaattttgccattgaattcaggaaaaattgtgaccaaattagccacaaatggaaaactattactagggcttctttttttaggcaaatgcctaaaatttgcgcacttaataagtgtagctaagcacgaaaaacgcgttttccgcttggtttggggtgtctacgatgacttttataatgcctatttttgcctatctcggggtttttgtgcctaaagtgccaattttaggatttacgaaaaataacaattattttctttttgttatttagcttatttcatcagtttatttttgataattgttgagatttaattcaattttccaaggtgtccctattctaatgtaacaccccaattttggaaaaaaattcgtaaatcctttttccgtcgtcatttcgtcttctcacttttagaatcttaatattttcagaattgctatatacaattaaaatttcaaatcgattggttcatgagaagtggtcaaactcccacaatagggtgtccctattctaatgcaacacagtgtactttctttaattcaagtttaatttaagtttagaatgccatgatatgtaataatctgatggcttaatgaatgtgtggcttaattaaggctaattgccaataagggattattaattaattctttgtcaaattaaagttattttatgccaaaattattttcattcaatttagtctttttatattatttttctcagaatgccatgataagcatg

SEQ ID NO: 114349 - DNA, 405 bp, Heterodera glycines
  Promoter: Source sequence=SeqID_1792; Location=3205..3609; Strand=+; Gene=SeqID_75997
aaatttaattatctgggctttccgaacaggctaaaagtattgaaacgtattaaataaataaataatttggcaacgcctattatctgtttagcttaccacccactccttaaaattggtcaaaattaaaagaaaaaatcccattgaaaaaaacatttatttttaatgactaaatttccttactcattaatacaaatttgttatctgctcattttcccccaatttagggagtctttatggatgccgaaccctttgtgtgcctctggccattcgtttcacagcatttgcatgttcggcattgaagatttgccgcaattagccacctttccccacctttttgtcaacaaatttttgccctccttcgattttggcgctgcgatttgtgtgtacgaaagaatgtttaacatg

SEQ ID NO: 114350 - DNA, 203 bp, Heterodera glycines
  Promoter: Source sequence=SeqID_3123; Location=823..1025; Strand=-; Gene=SeqID_83301
ggtggaggagggtggctatattttaggagacacgataattttttttttctagtaaatacttcgcttacaaattagagtgcagtttttaagaaaaaaatttttagttaaaaaattgatataaatatttccattgccatcacaccaatcttgttttacaaaataatttttattaagttaaattccataaaatttaaagatgtatg

SEQ ID NO: 114351 - DNA, 395 bp, Heterodera glycines
  Promoter: Source sequence=SeqID_24991; Location=1..395; Strand=+; Gene=SeqID_55729
gctaattttaagttgttctaataataaaacatataacggcttaaatgcgcgggcggatttcttaatgcaaaaggatatggcaatacaatggttcaatattgctttgatggatattcattttgctatgcggcaacctgcgccaaagttacgttttcttttcattgtttcgatagcaaattattaaaaaaaaaaacaaattttttttgcgaaatttttaatttttatttgagccgaaacgggttcggattcaaaattctggcacattgattttttaaaattaaaattttaagctctacgaaataaatgtttaaatttctatgtctgatatgttaagaaatgaatttataatactgttactgattgtattttaataataactttaggtgaggagcatg

SEQ ID NO: 114352 - DNA, 561 bp, Heterodera glycines
  Promoter: Source sequence=SeqID_3956; Location=1579..2139; Strand=+; Gene=SeqID_52578
ttttcgagctttttagtccatatttcgggcttttttagtccatattttatgtccatatttagcgttttttaatccatataatttacaaccctattcatcatttatcgcttggaaatgattgatactcgtatgtatgagaagtaaaatttgtatgagaaacaaaaccacaatcaataagtatataaatacgcagataaaatgacggtttttggaatgcttaaatgaaaaatatgaacataaaataaaacaaaaaagggcgaaaagaattttcaacgaagaaatcaataaattttaggcgaaaatttttttaaaaaccgtcaaaaccataaaatattttaaaaatataaagtcagtttgagtcctgggaagttcgagccccgaattcgaattgaatctctgaaatgtaggctggattcgtgattagcgacacccaaaaacctaaaaaaaggtattctatccaattcttcaaaattgtaattttttcgaaaaaattatgggcgacaaaccatataaaagccgatttttctcatcactgccaattttttaggtgcattaattatg

SEQ ID NO: 114353 - DNA, 59 bp, Heterodera glycines
  Promoter: Source sequence=SeqID_9662; Location=1..59; Strand=+; Gene =SeqID_72251
gatagggccagtatgtttaaaacaagcttcatcatgatatacataaaaaatttcagatg

SEQ ID NO: 114354 - DNA, 173 bp, Heterodera glycines
  Promoter: Source sequence=SeqID_12891; Location=1..173; Strand=+; Gene=SeqID_76626
tttcctatgtaatgattgacgccttttttctttataaacatacgagcaaataaaattttatttgttcactttttatttagtttaatttttagctttttttattatatttattgaatttaaataaaaattagttaaattaaatttaaaaaaattaattatttcctaaggcaatg

SEQ ID NO: 114355 - DNA, 60 bp, Heterodera glycines
  Promoter: Source sequence=SeqID_28176; Location=1417..1476; Strand=-; Gene=SeqID_58823
gttgtctgtggcacgggtgcgaggagtgttttgaggcacttggacgaagaaacgaaaatg

SEQ ID NO: 114356 - DNA, 661 bp, Heterodera glycines
  Promoter: Source sequence=SeqID_353; Location=3048..3708; Strand=-; Gene=SeqID_83880
ttttttaaaattagtaaaattaaattcaaattttatttaccccaaaaatgaaaattttggcatttttattaaaaaaatatattaaaaagacctgaaaattaatggagagaatgctcatgaacaaagtcatctccttcagtgtgctccaatttttgctaattgtttcttaaatgaaaatttttaaataaacaaaagaaaagggacacttttttattgcttaagcaattgcgaaatgtgtccccattaattactagtgatgctcgagaccgaaaatttcccgataccgagaccaagatttgaccctgagaccgaaaacccaagacacgagaccaacgaaaaacccgagacttttctcgagaccgagactctccagcatcactataattccgctaatttcacattcaattaattagcaatcaaaattattcacccattgccaccaatgacatcgaaaggtaaaatccctaaaaaacaaattcaggaattaaatcaaattaaattaatgaatttttacttggaagaatcgggcaccaaatatggccataaaagtgaatggctttgtgagaaattcggccgccaatggcaccgccaccgtacccaatccgttcagaataccgtaggcagtgaatgtgcgacgaaagccgaccaaagcgcacaaatg

SEQ ID NO: 114357 - DNA, 1003 bp, Heterodera glycines
  Promoter: Source sequence=SeqID_38705; Location=174..1176; Strand=+; Gene=SeqID_67438
taaaatacaggcagtgagtgcacatttgttttgaaattacaggcagtgagtgcgcaatttgtttgaaataggtccgagaataataaggcactgagggtgcgcgaccaagaagtgatcagattttgttaccaaggcacaaatagacagagagtgttgtgaaaattgaacagaattgtggcaattgagacaattggtcagagtgatcagacaattgatcagagagtgatcagacaattgatcagagagtggtcagtgagtttatcagtgatcagtgaattaatcagagtgatcagacaatcgatcggagtggttagacaattgatcaaaagcgatcagatatttgatcagaaagtgatcacagtaaaaaacgaaccaattgatcagagattaattagggtaaaataaattaataaatttcctaaaagttgtcaaacgagtggaaatttaaaatttctcatattgcccaaatttacgtcatttttgccggtcaataaatttgattacggaaatcaaaataaaccaccctaacacccctgagtatctgggactaagcgatcttgagcgagaaagaaggaaacttgaaggagaacgaaaaaggaaaagtaaagaaaagttaggagctaacagaaatatggctgatgatgatttagaagataaatatgtggcattaaaggcaaaagtccaagacttagaggatcgcttgtccaatcgggtcccgaattatctcccccctggagttaaagtcccaaaatatgatgccagaggcgacttttttaaatttttaaaggaattcaatgttttggcgacagcaagcaactggcacccgccggattgtgtccgattcttacctttgttcttagaaggggaggccaaagaaatttaccaaaatattccggcggacaaaaaaacaaattggagaaccctaactagtgaaatcgcggagctcactaagaaacttgacggacccatgtgggcgaggaaaatgctaaataagacaaaaatg

SEQ ID NO: 114358 - DNA, 376 bp, Heterodera glycines
  Promoter: Source sequence=SeqID_39990; Location=1..376; Strand=+; Gene=SeqID_68429
aaaataaaaagttaaaagagaatttttttttaaaaaaattttgtcgtaagtactaggattcctgcgcgtgacgggatcccgcgcgggattttgcgggatcacagtcttgcagggattaatccaagcgggatcccgtcccgcaaagaaatttgagttccaatcccgcagcgggatccgcaaatttgattttttgtgcgggattatgcgggattttattatttttttgaaaatttttctaagacagaatgccaaatatttttaaataaattaaataataaatttaattaaagttagctcatttttcatcgtaaactagcggggtcagcgccttcggcgcatcccccgctaggtagtacgcttgtattataggattatg

SEQ ID NO: 114359 - DNA, 937 bp, Heterodera glycines
  Promoter: Source sequence=SeqID_21529; Location=1664..2600; Strand=-; Gene=SeqID_52139
tttcggggaggcattgctgaactcgttggagatgacataccccttaattatgcacttcggtaagatcatcgcggcggccagatatggcacaatttaaaatataaaaaaaatgctggggttgtcaattcgtggattacctgtccaaaaaaggttttaacgttatgccgcacattttttgattttttctaatattgcaacgcctaagaaaccatgtaaaaaagttttcagtattttctgacgtttatttttagttataacatgttttccagtgagttaattgaaaactcacgtgaagttaaacgaaaaaataatagttaaatggttcccccattttttggcacaaacatttttaaaaactgaaaattcgaattcttcagaaattcacttttatctttgaatctgtgcataattgattatttttggtgttgtaatggtttgtgattagttatttcttggttttaatttattttagaacaaaaagcaaatttttaataattggggattctcgactttttgttcgagttcgggtccggggttcgaaatagaccaaaaaggatttccatatcattagcaatacattaaatcaacctagtaaaaattatttaaaaaattttcaggggcgggtgacaaaacctacaaaattcctgcttttaattactaaatctacatatttgaaaaacaatttgtccttcctcccgctcgtggaaattacgtccccccccccttctctcacaactttttttaagcccctctttttaaaatatttcataatcaattttaaaatacaatgaaaattataggcattttatttgcacagaattgaatttaaatgaattaattttttaaacatttgtcagatatgcccaccgtcacacatactttggcactttttgttgagcagctgagccacaaaacaggctcttttgaagcggaaatg

SEQ ID NO: 114360 - DNA, 1003 bp, Heterodera glycines
  Promoter: Source sequence=SeqID_6542; Location=1578..2580; Strand=+; Gene=SeqID_61945
gctttataccattaacattgtccaaccatggagtgagcttgaactttgctttattattgacgcgatgacattttttggagaaatattcaaaataaatttcaaaaattttccactaaataaatcattcgaaaaataatctctctgtctccattaatctgccagtatctaattatctccccctttctaagggtgttgataaataatatacccgggcatataattagagaaaatacggtatgtacataagggatggcattccgccgaggctccaaaaatatgcgaaatgaatgtttttgggttagtaggcgaaatgtcaataggcgatatgtcggtaggcgagatgtcgagtaggcaaaatgtccgtacacacagcggcccaattttgtgctctcatttgtcagtgcaaataggtttattatttatttagtaatcagaacgccaaaactttgcaaaacttaaatttttttggggattttcccttgtaaaaatagaagagccgatctcgagttaaaaactagacagctaaaacatgaaatgtttttacgacacttaaacttgaaaattctttgcacccaaatccaacaatcttggtgtcattcgaaagctcgtaacatgctttattagccttacaaaaagcaacaaaattttcaagcctggaaaaaatttattaagaaaaaacttcaaaatttttgttaagctttcgaatgatatcaacaatgttggatttagatgactcagaaaaaacgtttagtggaaaaacgagctggcgccgaaacgaagtggaccccatttcacggtcctaataagtttcaaaaatgggtttaagtgcaaaaaaactccaacatttttttgtcgaaaaaacagtaaaagtcggctttttggcatcattcctctgacatcccaaccccattactcaaaggcctcaaaacacccatcacatattgtacatattatttggaaaagcctgatcatctccatccatccatcatcatcattcaccatg

SEQ ID NO: 114361 - DNA, 697 bp, Heterodera glycines
  Promoter: Source sequence=SeqID_2728; Location=2812..3508; Strand=+; Gene=SeqID_81294
tctggaattcagattatttttacgtttaaatcgttagggtttttggggtcggagaatcctactccaatacctatttttcatcacaaatacacaattgtaatttcgtttttagaatgagtaacttttctgagaaaagaaattttggcgctatatgaaaagtgacatattttgaaaattttttcaaaaggggggacccttttgttttgcaaaatttttttgtgatagtcataaaaatgtattctctggggtttttggagaccccgatcacgaatctttcaattattttgatcaattccgatttcctaatctaaatttgaacaaaaaatcataatttgaaaaattaaaaatttcgatttttattcgagttcgggttagggattagaaattagtcaaaatacatgtcagattcgtgattaaaaactttgcaaatactttttcccattttgctgtcccaacccccgccacaccatttgcgtagtaaaatttcatgttttttaaggaaaagtgagtgaatggaagaaaatgggggaggggagagagctttataaattaataaaaatttagaaaatgggaaaccgtacaaatgaaccaataaattcgtataaaagtggttgctgctcttcctctaccttccattattattcattcgccattattttcgtctctctctctctctgactttttctccctgacaatg

SEQ ID NO: 114362 - DNA, 156 bp, Heterodera glycines
  Promoter: Source sequence=SeqID_10042; Location=1..156; Strand=+; Gene=SeqID_73102
acttatagttcaaaaactaggctggcgcgaaaacgacccggtacgaaaacgtcctggcccgatatccccctattaataattggcagtaaaactctaatgtcaaaaaatgaattaattattcaagcaaaaacgaagcgcattttggtggccaaaatg

SEQ ID NO: 114363 - DNA, 579 bp, Heterodera glycines
  Promoter: Source sequence=SeqID_1125; Location=768..1346; Strand=-; Gene=SeqID_68220
tcggggctatgatgagccatcacatcgtatcatcgcatcgttgatacgatgctaatttgaataggccccaggtaatattactctgaccccgcctttatatgtcagcaccccaaaatccgcttttttacttttattgcaaatgatttaatacatttccatttgaaaattttacttaattttttaatttcattaaaaaattcccaattaaaattgtgctccctggactttcaaataatataaaattatttcttttaaggaaaacgattgaaaaatcgaagaaaaattatcattctttttcgattttgacctttttctattttttatcgaaaaaaccgaccggaactccttatctgatctactcttggttaaggtaaatttgttttttattatttcaatttctcgagatgagacgacgcagcattaaatattgtagacattaaaatcaattcaattgacggacgagctataaagtattaatattgtttagacgtcataagaattaatattttttaccactttcaaaaaataaatttcattaaatgagaaaaaaatattaaaatttttagaattttaaaaatg

SEQ ID NO: 114364 - DNA, 76 bp, Heterodera glycines
  Promoter: Source sequence=SeqID_37018; Location=1..76; Strand=+; Gene= SeqID_66201
tttgctactttcaacgttttttattaatttattaattcaacctattttaaatcaattttctcattttaagcaaatg

SEQ ID NO: 114365 - DNA, 171 bp, Heterodera glycines
  Promoter: Source sequence=SeqID_12090; Location=217..387; Strand=+; Gene=SeqID_75644
tggtaactaaaaaattcttgataatttttttaaatacaattttaaaaaattttcggcgacgtttcggcggtgacgttttgtcctgctcccgtttaatccgcccatttttggcatttttcagctcgtctcaaagttgtgattgcccgcggtccattcttcagtggaataatg

SEQ ID NO: 114366 - DNA, 1003 bp, Heterodera glycines
  Promoter: Source sequence=SeqID_4307; Location=957..1959; Strand=-; Gene=SeqID_53982
tgccgtaaatttttacggttttgtgccgtcgtctgctgctgtccccgtcatgacagctgcatttgtagtatataaatcattaatagctagctagctatatattatagcatttataaaaaaaatcagaatgttttatgttctataattaaattttaatttttaatcccaccaatttttgtttaaattttattttcgcttaactatgaagtcacaagccataattccatcattctaatttgatcattaattcgtcttcagttaatccatctggaagaaaagttgtcctcatttttgggcgggcgttgtgctgcttccatacatcggtattcgccccctattatcgtccctattaaggcatttttgaaaaattccttacaaaataattagtaaattactggcactgcgaaaaatggattttgaatgaaaggttgataagaagaaaattagaaaccttttggcattccctcgcagtattattatctattatattatttgagaatgtctttccgtcccaaaatttttgctttttttgaatgagaaaatggattttttattgaagcgaaaacattttgtgtttttcgttctttctttgcatttgctttccattgggacttcactctgccttatttgtcataattagagatcggatacggacaggatccgtatacggatttttacggatccgtagtccgtaatccgtatttttttcggccgatacggattttttacggactacggattttacggatttttaatccgtaagtccgtaatccgtatcgatgtcaagtccgtaatcctgatcccgatccgtataaattatgacacggattacggatttttttctgacgttttttaaggtacaaatgtgtaaattttttaaatttttgcagtcattttgccaaaacataaataattttttttatatttaaaaaattgaaagtgtaagagaatgtcattgttattttttctattttttgcataaaatatttaaatttagaatatg

SEQ ID NO: 114367 - DNA, 1003 bp, Heterodera glycines
  Promoter: Source sequence=SeqID_586; Location=395..1397; Strand=-; Gene=SeqID_56953
tttcaaatttcacatttttaatataaaaatagtttaaatgatcttttattgaaccaatgatcattttcaacttcgtttccgagtattcaaacaaaatttgaaacaaaaatgttgaattcaaaaatttaaattttcgactttttgttcgagttctagtccggtgttccaaattggtcgaaatggatgctggattcgtgatcagcgactccgaaaagcattggaaacaatttccatggcttttgaaaattaaaaaaaaaatcctatgggctgtgaacagtacaagtacccgtttttgaagtgggaaaagaatttgcgtaaatgaaatggcagaccaaacgtggcactaaacgttttaataattgtggagcaaatggggagagaaaggatgaaaatatggggaggcccactgtcgactaaacaaaatgataatgagggatgagggagaggggaaaattggcaatcaatcaaagccaaatccaactcacttttattgggaggacccatcaaattaactgattatttcctgatgttggccctctttttaagctttgcccaaaaagtcgaaaaagtgaaacgcgtacactaattaagttttaattatggtgtaaaatagcgtaagaattcacttcgtgctcatattccaaatttaacccaatcactggagtaattttagccaacaagggtaggacaaagccaaaatctattaagcctaaatgggaaaaaattttcaaaaattattttttttattatttcctctacaattaaaatataaattttgatgaaataaatcagttaaaacttgtaaacttttttgcttttgagggaaatggtggagagattttactaattttccatgtataaatttaattataagtcatttgcatcaatagagtaaggagtgtccgtccgtccaaccaaatgttgaaatgagaggacaaaacaaattattttacatttatttatttatgattaagattcatataaatatttgtcctttataatg

SEQ ID NO: 114368 - DNA, 63 bp, Heterodera glycines
  Promoter: Source sequence=SeqID_24328; Location=99..161; Strand=+; Gene=SeqID_55053
tctgtgaacgagacaaataaaattacaaaaaatttgttttgttccagacccacctgcattatg

SEQ ID NO: 114369 - DNA, 1003 bp, Heterodera glycines
  Promoter: Source sequence=SeqID_12761; Location=1904..2906; Strand=-; Gene=SeqID_76470
tttcctaaatttgtccgatccaatacttttgttatagccatagcatattaggattagctgatgtaagtgccaagattggggctcggaaacctgcgctagtgtgtggcgcgaccttttttggtaaaatggggttggggtaatagtttaggtagatggttgcccccatttttcggagaatttttttgtttgttttcaaaagtcatgaaaacatgtttctaagtgttttcggggtcgctgaacacgaatccggcatccatttcgaccaattcttaaaccctggacccaaattcgaacaaaaagtcaaaaattaaaattttttgaatctcacattcttggttcaaactttgtttaaatacatgaaaacgaagttaagtcattagtgcttcaataaaagatcatttaaaccatttttagactaaaaatggaaattcgaaaaatttgagttttctgctttttgttcgaactgggtccgggattcggaattggtcgaaacagatgccggattcgtgatgagcaaccccaaaaaccattggaaacatgttttcatgacttttaaaaacaaaaaacaattttcacaaaaaggggggggcgacaaactagagtattaccgaaattttgacttcacatgaatagggcgaggatttctagttttttaactatttttctgcggctttattttgatgagaaatgcacgaaaaacacattctttttcaaaaaattttcgtttttagtgccactattcatcactagaaagaattattttggaagttggccactaaaataattatttgtcactattggcgtttcgtcattatttttgtcactattttgccatttttttgtcactatttagttaattattttggggttttttgccactaaaaatcctcgccctatacatgaataggtatataaaaaaggatgaaaaacaattccacgcttatttttgctaattttttcaaaatttttccttattttaggctaacttattattttctaaatg

SEQ ID NO: 114370 - DNA, 74 bp, Heterodera glycines
  Promoter: Source sequence=SeqID_29143; Location=1..74; Strand=+; Gene= SeqID_59692
ttgtttagacatttcgccgtgccaccacttctgtcagttacaatattcaactttttttttgggtggaaccaatg

SEQ ID NO: 114371 - DNA, 887 bp, Heterodera glycines
  Promoter: Source sequence=SeqID_39672; Location=1..887; Strand=+; Gene=SeqID_68185
ttgaaaatttgagtgcactttgtttcgaaaaattgcctatattcactcatgaaatttttaaattttcgtttggggggaggaattcgaagaatttttccattattcgctggaaaatttttaaaaattttcatgcctgggaggggggatcttggattttctgagcccaaaattctggatttttaattaaattaacagtcttttaaattttttaaatgcctctttttgtggtgctgttttttcaaaagattttggatttattgtggcggtggtccggcgcgccgccggaaaattttcgaaattttaagtgaaatatgttaacagaatttgccaaaaaaggaccaaatatttggttaaatttgcagttttaggttgtttaaaaaaagaaaaaataataatattttaaaatattttttattaattaaatttcaattgaaataatgtaaagaaaatagaaaaaagtatctgttcggttggggaattgaacccaggagattaacaatgaatgtcagaagatttagccactacgcaacataaggaaacaaaaaaacactttaaatgaaataaataatttaattttttctcaaaaaattctccttctccaccaatttccttctcgttttctcgcccagaccttattcttaccagtgcttatttagtcccgccgggactggcaaaaccgggaccgggatttcaattttccaaaaaccgggaccgggacctgaaaaaaccgtgaattcccgtcccggtcccgtgcaactctagaatttacataccgtattttctctaattatcccccatggggatgataattattttaaccttcctcatgaaaaggggggaggaataataaagattgggtggcagttagagaaaaacgacgacaaatg

SEQ ID NO: 114372 - DNA, 595 bp, Heterodera glycines
  Promoter: Source sequence=SeqID_10731; Location=1198..1792; Strand=-; Gene=SeqID_73980
ttttttacgaaatgtctcgaccaaaccacgcacgactcggcaattttcttgatccgacccgcgacgaccctttaagtgctggcacgtgcgatttaataaaatcaattttaaaattccatttattatgaaaaaatggggaatatccaaacagataaaaatcaataataggatttacacatgttttcaatcatagacaaaaaaaaattcctttatgattctaatttcataaaatagcaataaaaaatttttatcagtttctttaacaacaattatttttatttttaacattaatttttcttttttgtggaatagaaaagcaattagcgaaattacgcttgtaaaaggttgttaaagctgaaaaaagcttattcatcacttgttctaatttctttaattaaaacatttatgtattagacaaataattctttcattaaaattgccttttaaatggaattgcttataaatacattttttatttaaactttttaaaattatttttatttattttttaaattacaatgtaatgcatttaatattaaatcatttaatttcttcaataatttcggatattataaattatttttcagaaattatg

SEQ ID NO: 114373 - DNA, 587 bp, Heterodera glycines
  Promoter: Source sequence=SeqID_44546; Location=669..1255; Strand=-; Gene=SeqID_72026
aatagtcaaaattctttaaattttctattattaaaatcatgatacttataattatattttttaaataattataatttttacaaaatattttaagtccaattttatactataaaatatttttttatgatatttattagtttcttttctttaaaatcttttttgctgcaattcggcgatttttctttttggaaaattgcgagaagaatttaataaaatttagttccaaaggtattaaaaaataaaacgtttttttatgaaattgattgtagttatattttaatattaaaatgtaaagttccaaaggtatttatttatctttaaaataaaaatataccgtttaaatgcgcacagtaataaattgtgaaaaattcaaatataacttgattatttaaacatttaaaataaaatttaagaaagtcaataaattagagttattacaagaatatatattatctttttctttgagataatttaaatagcttctcaagttttatttttttattctccgattaaaatttaaattaataaatgcataatgaattaaaaccacatgaaaatctcggagaaaatgaagaatttaaaaaatg

SEQ ID NO: 114374 - DNA, 62 bp, Heterodera glycines
  misc_feature (37)..(37): n is a, c, g, or t
  misc_feature (42)..(42): n is a, c, g, or t
  misc_feature (50)..(50): n is a, c, g, or t
  Promoter: Source sequence=SeqID_4145; Location=1..62; Strand=+; Gene =SeqID_53360
tgctctaaaaataaaaatttccaaatttggcaaattntaatntattttgntaaatgaatatg

SEQ ID NO: 114375 - DNA, 1003 bp, Heterodera glycines
  Promoter: Source sequence=SeqID_18109; Location=1074..2076; Strand=-; Gene=SeqID_82689
ataaataattttcctttaaaaatttttacccaaaattgccgcggagtcgcaaattccgcggatcgccgatttaaaatcccgcggtcgtggatcgcgcattgcggattcaaattgcagcggtcgcgaatcgctgatcgaggaaaaaaatgtcgcgaatcgcggatcacgcatcgcaatcgcggtcgcgtcccagcgctggtgcgcaattgcagcccattctctgccaaactccgcaggaggaaacaccgaaaatcaatggaattgcttcgcttggggacgccaccccaaaaaacgaagccaaaaaacatttgtttcaaaaaaatactctcacaacgaaaaaatgtagatttaacacactgttttcgcgacggtctacacctgactgcttaacggttccccctgaactgctaggcccagctgactaaattcggcaccatgccctcagacgcctagtttttttaagggtaattttaatagagttttcgcattgtcatatctttatgaacaataaatagtttatgcctttttaattttcttctttatttgaatacatttttttaattttgaacgattgttttttaaattttagcattttgcttttttgtcctttttattatttacaagtcttttgttaatatattacttaaactaatgcatttttataatctctcaatttcgtttctttttatgttctacaacctttaacttttccatttattcatgtaaatggagtaaaacttgttgatatttattagaattcgccttgttcgattttttgcctttaatttttattatgcgtttttttctttcgatgttttatctccgtcatttcattgtatcacattttcacggtctttgtgttttttttttcaagttcctctcactccgtttttcggagaatgataccacataatcctctagattttttttgattatctttttcatcattttgttaatttttgatcattattctccaatataggtggtgctttatgataaaatg

SEQ ID NO: 114376 - DNA, 862 bp, Heterodera glycines
  Promoter: Source sequence=SeqID_27209; Location=1..862; Strand=+; Gene=SeqID_57896
cccccccccccccccataaaaaaaaaaaaaaaaaaaaaaaaagaaaaagggggagcaccccccccacccaaaaaaaaaaatagatggttttttttttccttttttttttttgtggggggaggggggggggggggggtaaaaaaaattttattatattttttttttttttttggtggggggggggggggggggggggtttttttttttttttttttttttttttttttttttttttttttgggggggggggggggggggcgcgccccccccccccagggtggggtgtgtggggggttttcttttttttttgggggggagagggaggggggcgctctttttttgttttttttttttttttttctctctttgtggggcgcgcgcgcggggggggtttttttctttttttttggggggggttttttttgtttttttttgtttttttgtgtttttcccacaaaggtttttggggaagacaaccaaaaaaattttaaaaaaaatttttttgtggaaagaaaaaattggggggcaaaaaaacacaaaaaaaaaaattttgtattttcccccccaaaaagttccacccccggggaaaaaaaggaaaattcttttttttttttttggggcccccaaaacttttttttcttttattggggtttttttcaacaacaaagtgccaaatgggccgaaaatttcccctttttatttttcattttttgttgcccttttttttcagtgggaaatttgaatttaaaaaggcgggaaatggagagaaatttcattctcgtcacatttctaatttttatcttctcaactattacatctgattgctgctgctcaccgactccatcgacaacgacacgcgatg

SEQ ID NO: 114377 - DNA, 97 bp, Heterodera glycines
  Promoter: Source sequence=SeqID_10340; Location=1371..1467; Strand=-; Gene=SeqID_73522
ttttacccaatttttttcatgtttaagttggatttgtgcggatgtttggatggacattctgccatcttttgaccatgctcaacttggactcaaaatg

SEQ ID NO: 114378 - DNA, 379 bp, Heterodera glycines
  Promoter: Source sequence=SeqID_22157; Location=1..379; Strand=+; Gene=SeqID_52815
ggggcgaattgatcagcgtctgggccaaaaaagtgatcgcaatagaagatatggccaaaaaagtgatgacatcggaaagaaagagccaaaaagtgatcgctaaagaagacaggaccgacaattgattcggtcggagtcagctaatggcggcagagccaaaaaagatcggccagtgatttctccaagttataaacaattttcaaagaatgaggatgtattttagccaatataaaaattaaaataaataagctaatttttagtgtggagctttttcttttattttctttttaattattttttatttaaatcaatatttttaatatttgtaccaatttcctaatcattatttttagcctatcaaaacattaagtagaaaatg

SEQ ID NO: 114379 - DNA, 79 bp, Heterodera glycines
  Promoter: Source sequence=SeqID_13438; Location=2340..2418; Strand=-; Gene=SeqID_77328
tgtgcgattttaataattttttaaatatttttatattttaatttgaaaatattcgcttttcttttttctccttcagatg

SEQ ID NO: 114380 - DNA, 144 bp, Heterodera glycines
  Promoter: Source sequence=SeqID_6419; Location=3872..4015; Strand=+; Gene=SeqID_61492
tgtggcgatcaggaagatgcacattttatttcacactatttcaatgtttttgataaatatttgatttgagtgtggtttatcggttgtaattcctaaatattttgccacatgtacatatcatttcctcatttttgttttcagatg

SEQ ID NO: 114381 - DNA, 706 bp, Heterodera glycines
  Promoter: Source sequence=SeqID_17606; Location=1241..1946; Strand=+; Gene=SeqID_82118
tgtccgaaaagtgttccaatttcttaaaaatggaaaaaataattaaatttacatttaaataaattaaataattaatgtgcctccagcatttgggcgcgcagcttccgcttttccatgtacagctcttgcgaaaagggcaactgctcagggtcaatttggtccgaatttgggcggtactcaaaactctgtgaaaaaatgggagaattttgtatcaaaatttgagtgaaaaaattccaccggcggttacggtaatcgtaatttaaaccactcccccgccaactacaaaaattaaaaatcgtaaaatcctaaaaatttatggggaaaaaatgagcaggactcaaaaacttaataaatctttaattgaaaatgataataagacttgtttttgtacagtaaacaggcaaatatatacagtatacgtataccgatcaaccgtaacccgtaattgcgggacgaaaacaactaccgtaagctcacggccccaatggtgggcggccatcgcccaactcatgcggcccgtgtacacctcgcgcaaaatgttggccaccaaccagcacgggatgttgcggctgacatcgctgaaacaggcagccaaatttaaattcaaaaatggttaaaaaatgccgaaatatttaaaattaattattttccaaccgtaaataattaaatttaattattattattatttaaaataataataattatg

SEQ ID NO: 114382 - DNA, 441 bp, Heterodera glycines
  Promoter: Source sequence=SeqID_25488; Location=563..1003; Strand=-; Gene=SeqID_56220
tttttctccagcaattgttgaaggggacgagccaaccgtacacaaattgatggattttcggcaccttatgcgcggtgattattatttttatgcaattaaattgcagtttttcgcgcaaattttcaatttttcataattatttactttaaataagtttattttaattttattcatttatttttgagattttcaaaatctaaattgacacttcgttcattaaattttcaaaaatttaaaattttagctaacaatttccaaatttcaactatttatcaaatgctctgtttcaagttcgaaaatctttcacaaaaaatgcctacaacttccaaatttctaatatttttccatccttttgaattttggaaattaaaattttccaaaaattgcgcaaggccattggccttcaaattttaattttcagctcgtcacccgcgcacaatg

SEQ ID NO: 114383 - DNA, 926 bp, Heterodera glycines
  misc_feature (19)..(19): n is a, c, g, or t
  Promoter: Source sequence=SeqID_1054; Location=1..926; Strand=+; Gene= SeqID_66964
aagttacttcagtcttttntaaaataataattgcactcggcaggtaatatgtataaggaattaaaaaattgaaaatccggaagcgaacaagcggagtattttttatttatgcaatttatgatatttaaaatttttcattatttaaaaaaaagtgcaggtcaatgcggcggacctctatcaaaaatttaaaaaaatattaataaaattaaattaagcacaaaaacgaaaaccgctctataaagctgtaaaaaatgatgatatcatttttaaaataaatcttagcattaatttctgcaagtttataaatttttaacgataagtcttaataataatatgatttaaaaacaatatttttatttccacttttaaaacgaattttctattgtaaaaaataaagaaaagccaatgtatatgaaagaacgatggtcttcgtataaaaagttttgaacgaaaatgaaaaaattagaataaaaaaattatcaagaaagtttaacgaataacaatattaatataaagcgaagaaaaaattttaattgatgttcaaagcagaagtaatcaaatagaaacgatggaaattttcaaaataaatgtgcaaactttggcacatactaattacatttaaagaaaattaattcttttttataattaaattttcatacaaatgaattaatgttttattttacaaaattaatccacaaaaggcctaaattgacttatataaaaattaatggaaaagaaatattatgaagtaatataataacaaattttattgaatacatatttacattgatatcccaaaaaacaaactcaaataataattttaaaaaatcaaataaatttctattgcaagccttttcgaatttattatctttgctattaagatatgacttcatatgtttggaattttataaaaaataaaccaaatg

SEQ ID NO: 114384 - DNA, 132 bp, Heterodera glycines
  Promoter: Source sequence=SeqID_12459; Location=4163..4294; Strand=-; Gene=SeqID_76092
aaaaaaattttaatttaacaattaggacgacaggcgctggagatcatccgcaaaacatggcgtaaccatttgaccccaaccgaaaccgcctcattggcggacaaggccagccaaagcagcgactccgccatg

SEQ ID NO: 114385 - DNA, 506 bp, Heterodera glycines
  Promoter: Source sequence=SeqID_30282; Location=1..506; Strand=+; Gene=SeqID_60701
ttgtaaaatgccaaaatcgccattctattggctttttcttttcctttatcggaatgccattggcatcccctctgcttctcttcccttccctttcttccccctccccctaccaacgatggcatttcatttcaattatttgagattttctgtgcgctaaaacttgagatttaaaaagaagccaaaacatatgatcactcgaaaatggaaacccaaataaaagtatgtcaccaaatttcagactgccccttaggcgaaaaattcatcccttttatccctttattctccatcctccacagctctcttcctctctctctctctgtccgctctctctctctccctccctctctcctcactctctccctccctctctccttttcggtgctctaattaaccgcgataaaaacatccgaataaataaatagcttctgagataataaggtttatcataaaatttcatttaaaaataaaccctcaattattggtatgaacgatactttccaaacatg

SEQ ID NO: 114386 - DNA, 1003 bp, Heterodera glycines
  Promoter: Source sequence=SeqID_7168; Location=3374..4376; Strand=+; Gene=SeqID_64034
aataaaagaatttttcataaaaataatttattagagcccggtagaatgattctggatcaaactgtaaattttcattgaaataatattttgaaattttacaggacccgtacgctttattctttgtaatttttagaccgtttttttattctaccaaaattgccttaataacgcaaaaattggataaagctttcacaaatgattaaagtgtttaacgcaaataaatcagaaaaataaaaaattctgaaagaaggaagtccgtcgatgctgacagagcaaatttttgccatatttattcattttttattgcaaatattcaattggaattatgttttttggaattcaattggatcctgaagaaaattaaatttcctgaacctgtaatagaatctgaactaggttcctgaacgtattttcagtaatttattgccattgatggatttttacgggataataaataaatgaccaactaactataaaaaaataaatttcttttttgccttcgtcgatacttttttcaaggttttcatttttcccatctctcagcatttaaaaaaatttcgtaattctccatatttatctgagtcggtaaacaatcttttgctcccatttgtcagctgggagaagcaccctttgctcagttactttttaatttcttttttctttttgtttgcttttgcttctcctaaagtctagaatgaatttcaaagaacactttgggctgtaggtacataagttgattgatttttcttctttttaaaatctcaaagcctttttaaatcgcagagactgcgtaatttgccatccataaatcacttaatatttggtttttacttaaaaaccataaaatggtttttacttaaaaaccataaaatggaaaaattttgacgaaaatttgcgttgctcaagagtaacaaaatttttaatgcttcttatcatatagcctaaatgttctctttaaccttcaaaatttcaaaaaatttttctgactttgaaacaagtcatg

SEQ ID NO: 114387 - DNA, 57 bp, Heterodera glycines
  Promoter: Source sequence=SeqID_23230; Location=1..57; Strand=+; Gene= SeqID_53943
agggcagtgcgttaccctcctaccactttcctgaagacggaactgctggtccgcatg

SEQ ID NO: 114388 - DNA, 163 bp, Heterodera glycines
  Promoter: Source sequence=SeqID_5596; Location=1..163; Strand=+; Gene= SeqID_58599
agtcgaaggtgtcgactgattagtgggtcagaaaagtcgaaaaaagtcgaaacgaaaccggaacatttggtgatcatttcgaaagaatgtaccactcgcgcaacgcatcagcaatgtaaatttaaccgaattgaaaaattgaattcatttttcagaggcaatg

SEQ ID NO: 114389 - DNA, 297 bp, Heterodera glycines
  misc_feature (19)..(19): n is a, c, g, or t
  misc_feature (67)..(67): n is a, c, g, or t
  misc_feature (101)..(101): n is a, c, g, or t
  misc_feature (110)..(110): n is a, c, g, or t
  Promoter: Source sequence=SeqID_29458; Location=1..297; Strand=+; Gene=SeqID_59955
caatcgctttttggaattntaatgagtaatcagggaccgtaaaatgacattctatgcttctcttgtntgatacacggaaagaaataatagttagtcctttngtgaatttntagaaattttatccgtcaaatcgcttttggaattttaatgagtaaatcaggaaccgtaaatgaattctctggttctcttgtggatacacgggaagaaataatagttagtccttttgtgaaattttagaaattctatccgtcaaatcggcttttggaattttaatgagtaaatcagtaaccgtaaatg

SEQ ID NO: 114390 - DNA, 816 bp, Heterodera glycines
  Promoter: Source sequence=SeqID_13195; Location=2137..2952; Strand=+; Gene=SeqID_77024
aattaaattttttgaaattattgaattaaatttaaaaaatattttttaattaaataattattatcagaaagttaatttcttttaattgaattttctaaaaaggttaattaaattctgtgcaatattttaaaattaaatggaaaaagaataaaaaattattgaaataattttaatttatttatattattattaaataatttaatttttgtttattattatttacctgaaatgcatattgtactcgctgagtgctttcacggtgacggagcccggaattgaaaaaatgataagcaaaatggagaacagtggcagaattgaacagaattccttaaacaataaatgaaacaatgttttttaaatagctaattattgacagaaatattttgaaggggcttaatgaacttgaaaataatgcttataatatgaatattgttagtccggaacgggatcccgaccgagattggtcccggaacaccggctattcgtgtcccgttccaaattaaatccattatcccatcccgacccagaatttttgatcacgcttccagttttcctcctaaattccggaaccgtctaaaacctatttaaagttttaatgcggcataattaaggacatttttcatcttatttaattaaaaaaatttattaatattattaatttctaaatttaaaatcaaatctattaaaaaaattttaattgagcgaagaatttgatttaaggacgctgcttttaaatcaaggacaaattgccgtcctggaaattaatttaaaaaatataattgcacaccaaataaaagtgtgctcaacgtgacaatg

SEQ ID NO: 114391 - DNA, 273 bp, Heterodera glycines
  Promoter: Source sequence=SeqID_3847; Location=3948..4220; Strand=-; Gene=SeqID_52118
aaagacaaatgatacacaaaaatggacaaaggagcttcgataattagtaaaaaaagagacaaattgtcaataagaaatggacaaatcaaaaaagatgacgaattgtcatgtgcttagactgttgaagcggaggagcacacccatcagcatcgaagacggtggaacaacaacgtcttgcagcaacaacagaagcggacggcacagccgaatgacgcggcgcggggcgcgacggcaaacgctggcggaggagggggcgggtggggcattgacatg

SEQ ID NO: 114392 - DNA, 565 bp, Heterodera glycines
  misc_feature (13)..(13): n is a, c, g, or t
  Promoter: Source sequence=SeqID_7185; Location=1..565; Strand=+; Gene= SeqID_64074
aaaaaattaaaanttagattttcggaaatgtataaatttctcatttctaagccggaattgcgcagaaaaatagttggcggtgagtaatagtattagattgctcaaatgttgggaaaccatttctggccagtggccacaattcgaaaatttgacaagcaagcggtgcagaaaaagaagcgatgaaataacaacgaacgaagtgaaaaacaaaatcagtaatatgtaaaaggaatggggggggctgcaaaaaagaaatgggattattgtcggacgcgatgaatccccatacctttcaattaaacggataatcattgatgaaaatttctgttctgttgaatatagttatcagttatcactttcatattaagtaaagtcatcaactgattgcactgcattaattaggtaggcggtttatttagtattagtcatttcattggaactgtttttaatgacaatatgaatagcgacaataaataagaaatacatacctaatctaaacaaatttcagcattgaccgacaatttgtaaattttttcctcgaacccactttaagagaacggcaatg

SEQ ID NO: 114393 - DNA, 1003 bp, Heterodera glycines
  Promoter: Source sequence=SeqID_12761; Location=1999..3001; Strand=+; Gene=SeqID_76471
cctattcatgtatagggcgaggatttttagtggcaaaaaaccccaaaataattaactaaatagtgacaaaaaaatggcaaaatagtgacaaaaataatgacgaaacgccaatagtgacaaataattattttagtggccaacttccaaaataattctttctagtgatgaatagtggcactaaaaacgaaaattttttgaaaaagaatgtgtttttcgtgcatttctcatcaaaataaagccgcagaaaaatagttaaaaaactagaaatcctcgccctattcatgtgaagtcaaaatttcggtaatactctagtttgtcgcccccccctttttgtgaaaattgttttttgtttttaaaagtcatgaaaacatgtttccaatggtttttggggttgctcatcacgaatccggcatctgtttcgaccaattccgaatcccggacccagttcgaacaaaaagcagaaaactcaaatttttcgaatttccatttttagtctaaaaatggtttaaatgatcttttattgaagcactaatgacttaacttcgttttcatgtatttaaacaaagtttgaaccaagaatgtgagattcaaaaaattttaatttttgactttttgttcgaatttgggtccagggtttaagaattggtcgaaatggatgccggattcgtgttcagcgaccccgaaaacacttagaaacatgttttcatgacttttgaaaacaaacaaaaaaattctccgaaaaatgggggcaaccatctacctaaactattaccccaaccccattttaccaaaaaaggtcgcgccacacactagcgcaggtttccgagccccaatcttggcacttacatcagctaatcctaatatgctatggctataacaaaagtattggatcggacaaatttaggaaaattatagttaactattattttttcttttggtttacatttacatatcaaatttaattttttcagctttttccaaattattttcattcaacaaaatg

SEQ ID NO: 114394 - DNA, 577 bp, Heterodera glycines
  Promoter: Source sequence=SeqID_7671; Location=1..577; Strand=+; Gene= SeqID_65582
acacatttaaaaggacgaaagtttggggaaaacaacagactccctcaaaataaacactaaaagtaacattatgacaaatcgaatcaattcaatattcaattgaaaattgaaaatcggaaaaaattagcacaaacttagagatttatttgatcaatcacacaattcacaaaagtatttaatttgcgaaacatacttataaaaaaggcattgaataattaaaggaaaaaatttcatgccaattatgaaatcattttccgtttgatatgcaatgaatgccaaatttgtctggcaatgccatcggcaccctcccccctccctccccatcccttttcctccccctctcatcatccatcatctccgttctctctttataatccatcatttcccccactcactcattcgctgtcattcgttcggcatttctccccccccgccccaaatgaaatgcttcttcaaattggcctcctccccattttgtcctatgcttttcattattttcattatttggttgtagtaccacttccgtgccccatatttcgtccgcttcttctccgatgcggaagccttcgctgaaatg

SEQ ID NO: 114395 - DNA, 287 bp, Heterodera glycines
  Promoter: Source sequence=SeqID_43998; Location=1..287; Strand=+; Gene=SeqID_71554
atgaatttatcttagagtaattaattaatatttactctttttcaattaattgctaattaattaattaactgtctaagattgttttgaatttaggatagttaattaaataattaatgactattttaaagtgattttcggtttaattaaaactagggttgttattaattaattgctaataattagtagttatacgtctcagataataaacctcagataattatttaatattaattaattaattaccctctctcagatggttgctctgcctgttgttgcctttgattatg

SEQ ID NO: 114396 - DNA, 686 bp, Heterodera glycines
  Promoter: Source sequence=SeqID_16584; Location=1..686; Strand=+; Gene=SeqID_80996
atgcaaaaactttttaaaaacagatttctttaagaaaattcttctcatttttaagaaatctaataaaatccatgttttttcaaaaaaggaataaattttttaaataattttagttttactattcttgctgatttttgtcaagtttaaataagttgttttttttcaaaacaggtttctttaattttttttttactcatttttagcatttttgaattagaaaatttaaaaaatccatctttttataaatgtgaaaaaattagagtgccacgggaccgggacctggtagcggacaactgagtacaactgagtgccaaggtcccggttttgaccgggaccgggactagtcccggttttttcccggttttcccagccaaaaattcccggtttttcaacccgaaaaggtcccggtcccgggtttgcccaaaattcccggtcccgtggcactctagaaaaaatcataaaataattttattttacaattccttacaaatattttcttagtaaaataaattgactgttttttcaaataggatcattgctcatttgtttgtgagtgaaaggcgcggaaaaactgaaatttttgaatttcctatctctgaaattttccaaatgtccctaaacaacagaattgtgcggatttggtgcaaagattagaccaatggacagaacaacagcttggacccatg

SEQ ID NO: 114397 - DNA, 481 bp, Heterodera glycines
  Promoter: Source sequence=SeqID_31360; Location=1..481; Strand=+; Gene=SeqID_61726
cgttggatttttgctccccataaatgtttgagtactccaaacggacacttgaaaaaatcgatttttttgttttcggggcagtccccccgaaccgatgcgcccagatttatggggagaccgaatccttcgggaatagcttccttatagcctgtactttaattctgcgttggatttttgctccccataattgtttgagtaccccaaacggacactagaaaaaatcgatttttttgttttcggggcagtccctccgagccgatgcgcccagatttatggggagtccgaatctttccggaatacattccctataacctgtactttaatcatgcgaagcatttttgctcatacataatagtttgagtactgcattacgatacacaagaaataatagcttaaaacatgctggcgccgaaacgccagcgccgaaacgccggcgccgaaacacagaggacccctttccattgccggcaaaaaaataatg

SEQ ID NO: 114398 - DNA, 125 bp, Heterodera glycines
  Promoter: Source sequence=SeqID_6045; Location=1..125; Strand=+; Gene= SeqID_60127
aggggttttcgaggtcgctgatcacgaatccgggctctttcagcgctaacgttcgctacatgagctgcacagggacaacaaatttactgtcatactgtatcaataataccctcattggcaagatg

SEQ ID NO: 114399 - DNA, 341 bp, Heterodera glycines
  Promoter: Source sequence=SeqID_9142; Location=1..341; Strand=+; Gene= SeqID_70373
gttttacacgactttgttaaaatttttaaaaatgaatgcgcacaaaaaacagacaaaaatttttgattggaggttacgccgttagtttttttaaaatttaatcgggcaaggatgagaatccgaaaaaaacgcagggtttttttttaagattttgcatttgacgctgccattgcttttttgtctttcattttctttccttttatatcttttattttttcgtctttcgttttctgtctttgttttgttgcattttccctgtgccattttaccatataaaagcaccgccaattcctctctttccctccattcacttctctttcattaacagtgccgctgaaatg

SEQ ID NO: 114400 - DNA, 78 bp, Heterodera glycines
  Promoter: Source sequence=SeqID_17618; Location=320..397; Strand=+; Gene=SeqID_82129
agtgattgccccgaaattgaatgattgaccaaatttatcacaggacgagtgccgaaaccgggccaaaattcgccaatg

SEQ ID NO: 114401 - DNA, 397 bp, Heterodera glycines
  Promoter: Source sequence=SeqID_6499; Location=1753..2149; Strand=-; Gene=SeqID_61805
ccctgtgagtaagtgttttcactagggtcgcgacttttagtgacgaaaaatcccaaaatagttaactaaaatagtgacgaaaaagtgccaaaaaagtgacaaaatagtgaaaaaagtccgaaatagtgacaaatagtgacataattttcagccaaaaattgagcaaaaataatttttattcactgattgcagttgcaaatgagtaggacttagtgtcaaattatcgtgccaaaattttgaattgatattagtctatgttttttgtttttcttcttctgatggcggattcaggaaacatcctagcacggttgcaatacttttattttaagtgtctgccgataaattaagggaattacaaaattcccaaaaaacgctgtcagaaaaggtcaaagcaatg

SEQ ID NO: 114402 - DNA, 1003 bp, Heterodera glycines
  misc_feature (725)..(725): n is a, c, g, or t
  misc_feature (742)..(742): n is a, c, g, or t
  Promoter: Source sequence=SeqID_14234; Location=361..1363; Strand=+; Gene=SeqID_78251
aatacccaaaagaaccccaaaaagtcagagttttcaaatatttgtgaaaattttcagaatgagaattgtttaataattatttcataatttattttattgcctcgttaaaaacatctttaggaatataattatcccactaattattgccttctttttgcttttcgccaccatttttctttgtctaaaattgattgataattatttgcctcctcgtctccccttaaaaaaagtggtcgtccgcgtgcactcttcgtcatttatcatcaaattaatctgtgactgaccgaaatgaaatatttttatttcttttcttaattaaatggttgatgtaatccaccaatgattttcgtacatatttaatacataattttctttaacttttctatatttattaatatctaattttgtaataaaatattgactttaatgcttttctaaatatcacaccttacctttttagtatttgacaaacaaaaattgtcataattttttaataaattcgctatttaaatataaaataacatttttataatatttaatgtattaaatttaatattaatatttttggaaatagacaaaatttaaatgtgaattttaaatttttggtgacgtcattaaacaattatttttccaataaaaacatcaacaaaacaatacttttctgtgtggaaaattgtttttggcatcggcatgaaataatttatgcctgaataagcccttccttntaagccactcaaaagcnctcttattgagttccctccccaatgagaaggagcacttgtcaaacaaacgaaaaatgcccaattttcaaatatttcattattttcagtctaaaatatttaaaatttaattaagactattttaaataatttttaataaacaattgtttttttttgattttttaaataaaattctgactacaaagctagttttttaaattaatttccccttaattaattcttcccattttaagtgtccgacaatttaaaaaaaatccaaaatg

SEQ ID NO: 114403 - DNA, 1003 bp, Heterodera glycines
  Promoter: Source sequence=SeqID_9892; Location=679..1681; Strand=+; Gene=SeqID_72920
ttttaattttcctcttttaaaagcaaaagactttagcatccaacattttgaaaaaagaaacaatcaccttgaatcacttttcatttcatttttagagggatataaattaagactaatggtcaactcccctacacggggaaacaatttattagatttattatttacaaacaacgaaaatctattgaataatgttatagttgaacccccatttggtaatagtgaccataatgcaattcaattcagcataaatttacaggttaatagtaatgcttcaaaaaaattttataatttcaaaaaagcaaattatttgaaaataaatgccatactctcaatggttgattggaatttatttttttctgattgcccggacatagagcttatttaccaaaaatttatgtttttcctaaataatttgataaggaattatgttcccatacaaacaacgaaaaaagttgaaaaactaccagaacatattttgaaactaatcatctatcgtaaacagctttggaaggatattcacaaagaccatataaaaataaaattcttagaagtttcgaaaaaatcgatgtagaaataaataaattttataaaaatcgcgaaataagtttttgcggactttggactctaaaaaacgtttccaatttataaattctttccttaagactaaaaatactatgatacctgcatttactgataaaaatagtctgattctcttctcagataaggaaaagtcgaatgcattagcgcaacaatttttttccgtttttacagatcaaaatttagaacaatttcaatgcatagaaaatcctgaaaaaaatatcgaatattttaacataactccatatgaaatttatttttctctttccaagctttcaaattctaacaacactagtattgatggaattcccaatatttttttgaaaaattgtaaagaaaatttagtccgacctcttttccatatttttagtttctcatttatgactgctcaaattccagaaatatg

SEQ ID NO: 114404 - DNA, 51 bp, Heterodera glycines
  Promoter: Source sequence=SeqID_16858; Location=517..567; Strand=+; Gene=SeqID_81285
cgtaaaatttaaaagcattcccaatttttagcatcctttccttagagcatg

SEQ ID NO: 114405 - DNA, 417 bp, Heterodera glycines
  misc_feature (109)..(109): n is a, c, g, or t
  Promoter: Source sequence=SeqID_2185; Location=1..417; Strand=+; Gene= SeqID_78342
aaaactggttgaaaacggcgtccacgacgtttgacgtaattggtgtatggggcagtatgatgtcacctggtctaaagtcagaaaagaaattatgacacctaccttattngcagcgccaagtgtgttttgtccatctaaaattgcttcctcgatcgaatggtgcacacatgagcgtagctccgcagcggggtcagcacatttgtcaatttcctcaatgacgaacttggattttgagcgcaccagttgatattttttactttttgaagtgaggttatcaattttacgaatgcatttatttggttgggattttttggggaaggaggaggaagaattttgagagagggaaaaacgtttcattttatttgaataatatatgaataaaaactttatgatttatagatgatataagataatatg

SEQ ID NO: 114406 - DNA, 61 bp, Heterodera glycines
  Promoter: Source sequence=SeqID_8394; Location=139..199; Strand=+; Gene=SeqID_67913
ggttgtttggctgactgatcagccaaataatttgttatttcagttcatgaggaggataatg

SEQ ID NO: 114407 - DNA, 333 bp, Heterodera glycines
  Promoter: Source sequence=SeqID_30597; Location=1..333; Strand=+; Gene=SeqID_61000
ccgatgtgtaggagaatacagcgttcctaaagaagctcgcttccaccagacccgaacaaaagaagaacgaattaatcgaaaacgccacagctgaccaaattttaggaatcgttgaaatttgtgcaaatatattgagttttagttttaaactaacgaacaaacaaaaagaaagttgtcacaattcgccgatttctatagagaaattgcaaaatcacgttcagagaaaacggcaagaaaaaggatacagcagggggagtggtatagcactgggggctatcttgatcccggtactgagtgtattagcccaacatttattagaaaaactaactcatg

SEQ ID NO: 114408 - DNA, 726 bp, Heterodera glycines
  Promoter: Source sequence=SeqID_18362; Location=2032..2757; Strand=-; Gene=SeqID_82961
ttttagcgtcccattcctaatggggtcaaattgccaaaagaatttgacgcgcgcaaaaagtggccggaatgtgcggatttcatcggaatggtaactgaccaaggtaaggaaaagaaatctattgactatataaattgacaaaaatttctatcatatttttatataaattcttggtgaacgcagaaaaaataataaatttccgcgaaaagttttgtttgggctttatttaattgtctaattttaagacttcaacctaaaaaatgtttacaataagcttgtttttcatagtcaaccaacttcgataaagattggtaaacatcgatagcccaaggcttctcaataaggcttcctagtttcagaaatttcatcatttaaaaaaaaaatatcgccataagaatacaaaaaaaaatcggatgcttcacagagttatcaaaattttgggttaaaatattcagacattagtctaccatttaaaggtgcttgtaattcatgcgcgtccgtttccgctgcatcggtactcaccgaccgtttttgcattgaacgcctcaaaaaaggcatacgcacctattccaattacccatcttcgtacgtatctgcccaagacacgttggaatcgcaaaattgcaagtacttcaaagtagcaaaagttaacattaataaagcgtaattaaaaaatttattactttttaaagtagcgacaaagagggcgcataattcaaaacaatg

SEQ ID NO: 114409 - DNA, 183 bp, Heterodera glycines
  Promoter: Source sequence=SeqID_25495; Location=1234..1416; Strand=-; Gene=SeqID_56234
ttttgacaaaaatttgcttacaaatcacatgagagcataaaatcttcaatcacttggctgacttttttttaaaaagattcagaatgccataatgccaaatttaattaaaaatatggaattgcttaaagcatttaagaaataaaaaaataacgaaaaatacaaatattacttcaatttcaaatg

SEQ ID NO: 114410 - DNA, 101 bp, Heterodera glycines
  Promoter: Source sequence=SeqID_11178; Location=1..101; Strand=+; Gene=SeqID_74525
cccccccccccctcgtcagcccctttacagccataaattttaatttaatttatttggttaaatatcttttttaaatattttttcaaattccagttgaaatg

SEQ ID NO: 114411 - DNA, 99 bp, Heterodera glycines
  Promoter: Source sequence=SeqID_18941; Location=1..99; Strand=+; Gene= SeqID_83666
tcaaaaaaatccgaaaaagaaaatgtaaaaacagcataattttcaaaaaattttgcaaagctgataactatataataaaaatagaattgaaaagagatg

SEQ ID NO: 114412 - DNA, 504 bp, Heterodera glycines
  Promoter: Source sequence=SeqID_44718; Location=312..815; Strand=-; Gene=SeqID_72159
taggcaaacagcggcaactgcaacacgtcagtgttcgatcaatgccggcgcgttaaaaatgtgtcacacaaagaaagagaggaagtgaccccagtcatcagccagtcaattcctaaccgttgtttttgtcaccttttggcgaatgtactttttgtgtgccaccattttttggataatcctaatgcctgatcaaaatattttgctaaaaaacgcattttgccaagcaattttggggaatttcaaaattgttcagaaatggggcaactgtggacacgaaaagagacaatatcaattctttgtcgtataaatgtaatttcttcaccttatgcctttccactttttcttggaattctcccaacttttatcgcaagttttgacgttaaacatacaaaaaatgtgcttcatgtgttttcaattatggatttaacgggtttaccaactcaaattgataaatgagaaaaatatgttgacttttaattaattcccgtcacactgcacagaatg

SEQ ID NO: 114413 - DNA, 1003 bp, Heterodera glycines
  Promoter: Source sequence=SeqID_5128; Location=4723..5725; Strand=-; Gene=SeqID_57018
attcttaattagatattaggccaatggcaagaaaccaaaaaatgaggaaaatgaacaaaattgatggctcagttggttaaattcgcattttcggagcactgggttcaaatactacataaaaataaaaaataaataatttgtatataagaaagctaaaaaatttataaaataattttttcgactaaacgaatgtaggatactttttctttagtgaaaataagcttaaaacaatcaattgtaaaggttgggaaattaatagaaagtaaacaaagctggaaatgggccctttgtctctgttttaaattgcatttaattgaaaaaacgatattttattattccatatccaagtgattgccaaaagaagacagattccagaaaagctagaaaactttgcttaattctaatggaaaaattcttttaacggtgtttccgattgtaaagcctgaaacgcatggacaaaaagcacaaaagaactccttaacaaaaaatattaaaaagttatatttatttatttatttttaattaaatttttttatcattttattatattttacttttgtattgactttgaggcaaataatttgtgtgattttattcatatttatttgtgactatggcaacgaaatatttccggaattttttattttttcaaaaaatatttatttttaaaaaataaaaataattacttttcaattgaaacacatttaaatgtttaataaacacgaaaaaataataaagaaaattacttacctcacccggatgcgtacttaacttcccccccccccccctcagaatgatgcttcagaaaggcgccgccaaatttttttttttgaaattatcctttttttaacaggttacagaatggttcaaaaaatgaccaaattttgccacatatcttatattttcttgataaaatagtgtcataatgcataaataatcgcccagtctccaattacccccccccccccacctttctgaggagattgaaaaataatcccccatg

SEQ ID NO: 114414 - DNA, 1003 bp, Heterodera glycines
  Promoter: Source sequence=SeqID_15574; Location=734..1736; Strand=+; Gene=SeqID_79859
gacctaaataggggcagaaaatcgcgaaaaatcgtaaaagaggggcgaaaatctgtgctttttctcaatgatagagacatgaaaatacctacataggtagtacgccaaaatagggttgcgaccccgacgtgaagaggaaaactatagagagagagagatgagaaaggaagcgagaaagtaaaccgaattgatatattcagaaagaaaggaggaatgggagatagtgaaagaaaaagagagataagatgagtgagagcgcagagagagagagagagaggagaaagagagtgaaaaaagagcagagagagagagagggccgccgagagaaagagggagagagaacagtgagagagagagagagagaatagtaagtcaattgagggtaaaagagagagagattagagagagaacagtaagagagagagagagagagagcaaagaagagagagagaaagcagagaagatagagagaacagtaagagagagagagaaagcagagaagagagagtgaaaaagagagagagacagagagcagagaagagagagcaaagcagagaagagagagtgaaagattattaaaataaaatggcagccataatcaagaatacagcaacaaagttaaaaattgcgaaaatggatgtaaattttataatgaaaatatatttcactattttttacagctttattgtacttaaattgaccttaaccggccgcaactattattttttcaaaatttcgggtcctcaaaagtcgggtcctcaaatgtcgggaatatccgcaaatgtcgggtcctcaaatatcaaatcctcaaatgtcgggtcctcaaaagtcgggtcctcaaatgtcgcaccacgatatttattttacccagtgcagcagttatgtactggttgttgttttgtttttttattcgttaattaacgcctcccctcgattcgtcaactcaacgattcgtcaactcaacgattcgtcaactcgacgattcgtcaactcagccaaaatg

SEQ ID NO: 114415 - DNA, 60 bp, Heterodera glycines
  Promoter: Source sequence=SeqID_16548; Location=1284..1343; Strand=-; Gene=SeqID_80952
aaaattgaatgaatgcttctcaatgaggagcattcattgttggttttcagctcgaacatg

SEQ ID NO: 114416 - DNA, 294 bp, Heterodera glycines
  Promoter: Source sequence=SeqID_18259; Location=1..294; Strand=+; Gene=SeqID_82856
atttgattgaggtcacgctaatatattcataagtgcatttattcaaatgcatttcatttatattatatttttatggtttcaaaatttatttttattaaaatatttctctaaaaaaatttttgttttataatttctattaatagcaaaaaattattaaacgacaaattcccatttatttatgaaatgatgataaccatagattgggttaacaaataatgaggggtttaggttaaatttataattgctttaatataatatttaaaaaaaatctaacttttagaaggccgagaaatg

SEQ ID NO: 114417 - DNA, 177 bp, Heterodera glycines
  Promoter: Source sequence=SeqID_1998; Location=5377..5553; Strand=-; Gene=SeqID_77254
ggtgagggcggacattttcacgctttgattcatgcaaaaaaaaagggtgggcatcgactccagcccctcgcattatttacattttggttttcaaactgctttattgtttaaggtcgtcttcatgcaagcgaactcactcattctaaaagcgaatggagcgaaggaactttcccaatg

SEQ ID NO: 114418 - DNA, 336 bp, Heterodera glycines
  Promoter: Source sequence=SeqID_19089; Location=1..336; Strand=+; Gene=SeqID_83836
cgcagcaattggcgcccgcgccctccggcgccccgcatgttgggttgaacgtgttgctcggcgggcctggacggctccaacccgtccctgctccactcgctttcgctgctcgctggaggggtgggtgcaacggcaccgacccccgggggctcgatcggccgtttggccaatttctaatgcgttttccctttgtgctgcgcttcagcgccaacaggcggcaccggcaatgcgcttctgaccgcgttggccacccaacttttgctgcctcagcagcagcagcaacagcaaattgtgcagccatcagccaatcatttgaccgccgctttgctgcaaatg

SEQ ID NO: 114419 - DNA, 943 bp, Heterodera glycines
  Promoter: Source sequence=SeqID_2396; Location=1556..2498; Strand=+; Gene=SeqID_79525
tttttcgaaaaattaaataggtctagacgattttcaaaagataaaatttcaattctcctgaaagttcaaatctgattgactcctttaaatgcaaacgtaacaatctaatttatatatttaagcacacagcgagcaatgggaatttttattgggaaatagccctgagtcttgacgagggtcgtgagaaagtgggcctaaagttgcgcgagatttgtcacaacgtgctacatgttttttcgttccttttcattcagtttgaggaaagtgaacgatgggggagagcagaaggaagagtgggggcggggggggaaataaaatgaggggcagaggcggccgaagagttttctctttctttgctttcccacctccaaatagagagaaagagagatagagagagagagaaaggaaaagagagacagtgggaaaataaggggaagaaagtggagggcccgtctcgcgatggaaaaaacgctcagcatttgttacgcatgaagggcgaatatgagaaacgcaccaattccgagggatggaccgatgggtggggcgatgcttaaatcgagggaccgattttcaatgcattttgtgctaggaaaagagacaggggaaaaagagaaaaaggaaatttgtagtgaaagagaaaaaggcagaaataaatagtggataacgcacgaattccggggatagacacgagcaacgcacaaagaagcccattttgaaagtgggcaagggaccgttaaacattgacaacgacagaaagtgcgagagatgaatgagtcagcggtggaagaaaatgcgaaaatgcaatgagacgcaccaattccagggatgggtgagcagtggaacgaaatagcgttaattttttggagagtctgtggcggaacaaagtgcaccgatttattggaggtgagagaaaaacagggaatgtctcgcattgccaaacatg

SEQ ID NO: 114420 - DNA, 83 bp, Heterodera glycines
  Promoter: Source sequence=SeqID_29877; Location=618..700; Strand=+; Gene=SeqID_60340
ttaggccaaaaagttttgtttatgtgagggtaaaaaggggaaaagagctgctaaaactgacaaactttggcaattccgaaatg

SEQ ID NO: 114421 - DNA, 386 bp, Heterodera glycines
  Promoter: Source sequence=SeqID_21344; Location=1..386; Strand=+; Gene=SeqID_51946
tttaggaaattagcggtgatcaaatcaaaaatggtgcagttcaaaattaattgacaccaaaaagtgattgaattgtaatgttcaagaatttgaaaatttaagtgatctgtagtgaaaagtattttaaaaaataattccaagaaagcctgatcaaatgaaaaattttttttcttattaaaatctgataagtaaatttatatattcaacaaagtgattgagctaattgacgttgaattcattattttttttaattaaattcaaaaatcgtttaaaaagatattgcattaaatcaaatcaaattaaattaattttttttttaattaccgcttggccttgggatccattacggcaaaacgtgtgttcaagacgggtgtccacaggccatg

SEQ ID NO: 114422 - DNA, 142 bp, Heterodera glycines
  Promoter: Source sequence=SeqID_27768; Location=1075..1216; Strand=-; Gene=SeqID_58433
ttcattccatccacttattattcgtcctcctccaccgccacttaaatcgtcagtttatttaggtaattaattgttttgttatgtgcattttcattgtgctaattgccccccccccgtttttcagcgaatggccaacgcaatg

SEQ ID NO: 114423 - DNA, 459 bp, Heterodera glycines
  Promoter: Source sequence=SeqID_22779; Location=232..690; Strand=+; Gene=SeqID_53474
aaaaacctgttcttttatttattttttttaatttaaagaataaaatacaggtgattgtttaggaatgcggtgactcattcatttagacaaaacgaaaactaattgatgaatcagtttgattcttgctgctattgcaattgatgccctttcactgatgattggaaattgttttttattcgtaaacagcaaaagtcgagaccgtttttcatttaaaaacatgaatgaaacatttgtattaatttcgatcattgagaaatttaatttccttcaaatttcgcattttttttatttttagttcttttcccactcccttatttagactttagcctttttgttttcaatcgtattttgttatattaaaaccggcttattatggagaatggcactcttaggtcaatgtatagtgcaacctccgttgatgaccggagccaattttttgaccgaactgccaacataatg

SEQ ID NO: 114424 - DNA, 141 bp, Heterodera glycines
  misc_feature (8)..(8): n is a, c, g, or t
  Promoter: Source sequence=SeqID_33466; Location=1210..1350; Strand=-; Gene=SeqID_63526
ttataatnagggttcaattaatatattgtatatttcataaattaaattccgaaaaagtttgaatttagttcaaaaattttaaaatttgattaaattgtttaaaatatttttaaaaatatttaattaattttaaaggacatg

SEQ ID NO: 114425 - DNA, 581 bp, Heterodera glycines
  misc_feature (27)..(27): n is a, c, g, or t
  Promoter: Source sequence=SeqID_13272; Location=413..993; Strand=-; Gene=SeqID_77106
ataaactggctgtataacaaaataatntcgggaccggcagtgccaaaaaaggcgctgccggaaaaaattttgaaaatttgggttttttaataagatttacaaatttttgggccaagcaatgccggaaggcagcggcaggtgaattttaaaattcagctctattttcgaacgggttttaacaacaaaaatttttgaatttccgataatttttgttattcttcgatatttggtcaaaaatattttgaaagatattaaattttcatgatttcgtcaaagaaaattgaattttttaatttcaacgaaaagaaaattaaaattaaaaaaattgggttaatttgttaacatattatgccaaggatgatcgtttttatgggcatttttgtttaacattactttatttaataaaaatttggcaaaatgtttaaaaaattcaaattttttataaattttttttgccttttctccaacgaaaatgccattcttaggagtgtatatttaacccggccccaagtttgagttaaaatcggggtcggggtttgtcggggtcggaagcgtcggggtcgggattaacccgaaaaatg

SEQ ID NO: 114426 - DNA, 1003 bp, Heterodera glycines
  Promoter: Source sequence=SeqID_799; Location=3306..4308; Strand=+; Gene=SeqID_61586
tggtttggcccccgaggggagggcgaaaagccgcgcaaaattcgtccaacaagaaaacttttctgaaggaatgcttcatcccccaggccgcccatcgcataggacacaaaaatgaaaagccaagccgataagtgctttatggctgcgcaattttttatgtgttggtcaaccaacaaaaccaccgggagcattttttgtgtgtgtaaacaccgcgcgcgcttgatcagtttaacgaaaaaatgcgctgcttaagcattcatttttttggaaaattgttttttcaaaaacaaaaaaaaatatctctacttgttttttaggcatatgacacgaccctctcctccccaaaaaaatagggaaaatatttgcttaaaatttgctttttcgttaagcttgttttgtatttattatctgtgttatagggctattaaaagattaggcctttctttatgttgcccggcttaaaccttcaaagggtagagctcaaaatttttgtagaattcttttttaaaaaaaaccattaatacaacaacaagcttaatgtaccttaaatttgggttcttccccgaccgaattttaattggatgcgagtgttttttaaatgagttgctatgtaattgtaagttttttttattttagaaaaatttctatcattttttttcaactttttatgcaaatttcgtctccctgacgaagttgttgtccccgacttcctccatgatccccgaggagttgttctccccggggatcgggcagcaaccttactgaaaattttcaacctcgggcatcacttactcactcattttgtatatataataattttttcaccttttaaaattttgatcacatctcaacccattaccgttaaatattgatcaccaactgatcagagtttttgtctcccattttctcagggctaaagcgagagacaattaattgattgcttcgtccattgcgagagagagcacttcaagacgagagcgtaacagacgaacaaacaaaaatg

SEQ ID NO: 114427 - DNA, 220 bp, Heterodera glycines
  Promoter: Source sequence=SeqID_22501; Location=262..481; Strand=-; Gene=SeqID_53169
acctaataaccttaattatcccttattgaacaaaaaaaaatgtcggcttttagatacgcaatatccgccgcgttttattaacaccttgaatgatctgcatgtcaaaaatggtgaaagagttgtgttaaatttactgttgcgctcttcgcttgaacccaaagttcgcttactaataaatcttttgtgttagcccagtaaaagccgaaaatctcaatagatg

SEQ ID NO: 114428 - DNA, 191 bp, Heterodera glycines
  Promoter: Source sequence=SeqID_32362; Location=840..1030; Strand=-; Gene=SeqID_62678
ttatcaccatttttgagaagtgagttagaaatgataaacttcacgattcaaaccagttttcggtgctctaattaaccgcgataaaaacatccgaatcaattaaatagcttctgagataataaggtttatcataaaatttcatttaaaaataaaccctcaattattggtatgaacgatactttccaaacatg

SEQ ID NO: 114429 - DNA, 257 bp, Heterodera glycines
  Promoter: Source sequence=SeqID_45280; Location=1..257; Strand=+; Gene=SeqID_72604
tactcagattttcaaaaaaaaaagtttaggtttttggctataactttttttttgcatccaaatccaacactgttggtatcattcgaaagctcttagatgctctattagctttacaaaaaacaaaaagattttttagcctgggaaaaattttattatgaaaaaattaaataatttcgacttttcgcaattttcatgtataacttttttggtaattgtctgattgcgaagcgatagcttagaaattgcttcaaaacatg

SEQ ID NO: 114430 - DNA, 132 bp, Heterodera glycines
  Promoter: Source sequence=SeqID_5323; Location=3635..3766; Strand=-; Gene=SeqID_57681
gctgaaaaacaattataaacttaattaattattaatttttgctacttttcttttttgtcgtcaatgggtcgccgtcgtcgtccttttttgacgtgtcgttttttggcgtagtcccaacacatccaaagaatg

SEQ ID NO: 114431 - DNA, 684 bp, Heterodera glycines
  Promoter: Source sequence=SeqID_13876; Location=1..684; Strand=+; Gene=SeqID_77822
gatcactcaattgcaaattcaataactcactataacactgccaaattaaagtgatcactcaattgcaaattcaataattcactttaactttgccaaattaaagtgatcactcaattgccaattcaataattcactataattctgtcaaattaaagtgatcacttaattgccaattcaataattcactataattatgtcaaattgaagtaatacacccaaattgccaattcaataattcactataattatgtcaaattgaagtaatacacccaaattgccaattcaataattcactagatcactcaattgcaaattcaataactcactataacactgccaaattaaagtgatcactcaattgccaattcaataattcactataattctgtcaaattaaagtgatcacttaattgccaattcaataattgacaaaaattttgccaaagtgatcacgcaattgccaattcaataattgacaaaaattttgccaaagtgatcacgcaattgccaattcaataattcactataattatgtcaaattgaagtaatacacccaaattgccaattcaataactcactataacactgccccataaaatgggcccctgatagtgatgaatcaacagattccacatttattcattccttactactttatcctattccttcaaatttcctacaatg

SEQ ID NO: 114432 - DNA, 682 bp, Heterodera glycines
  Promoter: Source sequence=SeqID_22974; Location=1719..2400; Strand=-; Gene=SeqID_53673
ttttaaaaaaatatttttacaaatataatgattagggttgtaaattatatggactaaaaaacgcgaaatatggacattaaatatggactaaaaaagcccgaaatatggactaaaaaggccaaaaatggccaaatatggaccaaaatatggataaaaaatgccaaaatatatgttgtaaacccccaaaaatcccaaaaaaaggtgtgcatatttaatatttgcttaaataaacctaaaaagtacaataaacaaccaaaaaatggggtttaaaacataaaaatgcatattttttattgttgttcgttgtatcaaaaacacctccaagtttgccaaatttcgaaaaaattctcattaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattcccgaaaacccccaaaatatggatttatatggactaaaaaccttcaccaaatcaaaaaaaaaatgctatttttaagcccctttcttcatagcatatg

SEQ ID NO: 114433 - DNA, 262 bp, Heterodera glycines
  Promoter: Source sequence=SeqID_3630; Location=2440..2701; Strand=-; Gene=SeqID_51201
attaattaattagtctaaaggaatggcacttgaaagattaaacagcaatgaaatgccaaaaaaaaattgataaataagtgatcagtaaagcataaatgccaaattatcatttgtagaagcaggcatttaaaaagcaaaagtgagaaatgccaaaaaagtaaaacaaaaaattaacgaacattttttcatgtaaatacaaatttgaaaaatgtaagggagacaaatagagaagtgaaaagtgatcagtgaaaattccaaaatg

SEQ ID NO: 114434 - DNA, 78 bp, Heterodera glycines
  Promoter: Source sequence=SeqID_29493; Location=959..1036; Strand=-; Gene=SeqID_59986
ttcaaaattgtcattccttcaaaattgtcattccttcaaaattgtcatctcctctcctaatcgatggcaaacagaatg

SEQ ID NO: 114435 - DNA, 97 bp, Heterodera glycines
  Promoter: Source sequence=SeqID_20426; Location=1..97; Strand=+; Gene= SeqID_50961
atttttatcaaaatttacaaaaggcctatgttataaccctgcgaaaggtatcgtccttttaaaaccatatttaacattacctatcgaaataattatg

SEQ ID NO: 114436 - DNA, 1003 bp, Heterodera glycines
  Promoter: Source sequence=SeqID_5881; Location=3306..4308; Strand=+; Gene=SeqID_59544
aattgaagcaatcaatgccgtaagacttttccattactttttaccatttatatattaagattttaagttattttacttaaattagaaataattttaatgaatgtatatttaattatagcaaaaaaaaataaaacaaataaatgtcattcaaattaaaaaaaaataaaaattttcttcatattatatgcaaaaactaaaactgcaataactcgtcataaaatttattagtttttgtttaaataaaaattatattaaatgaaattgaaatctaaagaaagaaccttttaatcgattatgcggtctacgacgagagaagaaagttaaaattacttaggtttaaatttccttattttatttttattccaaacgaatttctcattgttgaataaaaataaagagaatttttttaattataaaaaattaatttcattgaaactattaatatacacgtaaattaataaaacagaacaaaatgttaaagttgttgatttagatgttaaaataaaacaattatattcaatgaaaattaattggaaattcattataataaattcaaattaaaaaaataaaatatctagacaatagtaaataagaaaaataaggcattaataatctaataattttatttgagataatgcccaagcaatttgctatttaacaaaataaattatttattcaacatttgaaatagaaatttttaggacaatgcagaaatattaataaaaacaaaattattgtatgaattgaatttgaaaaaattaataaattaaaagcgcaaagtttgtattaatttaaaaatcctacgctcaaatacaaaaagataacaaatgattggtttcttctctctgacaatattagaaattaaaaatattcctaattattttgaaaataatgtaaagtcatttaatatgactcaaagtgaagatcacccgaaagatatgcgataaaccaagtaaaaataatcatttaaataaaataacatattattaattatgccagaatg

SEQ ID NO: 114437 - DNA, 93 bp, Heterodera glycines
  Promoter: Source sequence=SeqID_40234; Location=1..93; Strand=+; Gene= SeqID_68636
ggcggtacatcatccgccaaagcaaatgttgacgagtggcgggccaatgtacgaattttgagtccggaaggcgacgggcgggcaccgacaatg

SEQ ID NO: 114438 - DNA, 1003 bp, Heterodera glycines
  Promoter: Source sequence=SeqID_5794; Location=4842..5844; Strand=+; Gene=SeqID_59252
ttggggttttgaactctctctgaaaaaattctaaaataattttttctatggtaaaattgacgctgctcacgaatctggcaaaaagattgtctcttttaatctctgactaacatctgcaatgacttctaaccacttatacaatagactaatctttgaacagcagcgtcgctgattttatgcctttttcaatgggacttaattttgtattgtcatcgaaatggatccgatttaatctaattaatgcgctttttaaagttttgttttttggatttgtcttgttattttcttttttccatcattagacgattgtcgcaagattgagcatgcgacagcggaggatcgcatgcgaatgcataaccccgaaccggcacgagcagcacaggcaattagcaattacatggacgagccggaaagtgttctgttcgttgcaatgtcagacaaaatgaatttataaatggcaataaatattatgcaaaaatgaagttaaattttaattgattattttggcagtcatttaaaatttaatttaaaaatttagtttttttatcttaacagaacagcatatgatggcagtgccaatgtgattgcgtgttgtcggttgaaattgtgccaaaatggcaacacaataaacggaggaccatttgcgcagattggcccttttgcaacattaataggctggtttcgttgatttgattgtttcaattgaagataattatttaattacactaactaatataaattataaaaatttgtgaagggattttaggtgctaaaaagtaaaaaggtacctaaaaagagctaagaaaacgccaaacagatgctaagaaagtattcacatttttttaattaaatgaattcctgctttactatttctgtaaattaaatttttatttcttttgaaaaaatgaaaaatttccttaaatacaaaatttaaaaaataattattttttctttaaaaaatttctattaaaagccgaatagccaatttagctggtagttaatg

SEQ ID NO: 114439 - DNA, 79 bp, Heterodera glycines
  Promoter: Source sequence=SeqID_8909; Location=3320..3398; Strand=-; Gene=SeqID_69606
aaatcttcaacgcgaaattcgtcttgagttggaatcatcactaaggcggttattgataatttatgtagaacaaacaatg

SEQ ID NO: 114440 - DNA, 1003 bp, Heterodera glycines
  misc_feature (527)..(527): n is a, c, g, or t
  Promoter: Source sequence=SeqID_2611; Location=1797..2799; Strand=-; Gene=SeqID_80709
ggaaatgccaaaaatgagagagacaaatgccaaaatggggagggaaatgcaaaaatgagagagacaacagtgccgaaggggactgtcgaatggatgccaaatgccaaaacatttcactgtaatactgccgatggtcccccccccccccgtttttggaaaaatttttttcgattctaaaaagtcgtgaaaacaagttttatggggtttttagggtcgctgatcacgaatctgacattcattttgaccattttcgaatcccggacccgaattcgaacaagaagttgaaaattccaaattttcaaaattcttacttttgtgcctaaatttatcaaaataatctaaatttagttaaaaaccattgcaacaacaaaaaatgtggtactagtgcagttggtacgccacaaaaaaaattcttttaaaatcgtataaaaaatgtttctacgttgattacggtgggggtcgactgggccccagagccttcgtacgaaaaattggtcctggcgcaccccttgttcatgaggcttgangggggctaaagcccccccccccgaaacccaaaaaagtaaaaattttcagtacatttttttgaaattttaagcgattttcttaacaaaattgcgttaaaatactcaaaaattttcccggctgcgcctatcggcaccgccggacccccattttactatatttttgaaaaatggaggccaaaatggcaaaaaatagtaattttttggcgaaaaaattttgtaaaatacccccctagttcgggatttcaaaaaacgaaaaatacacccataaaaatcgactgaaaaaagaaaaatcacccctaaaaatcgaaagattctccatcactacacgcgatccgtcctaccagtacacaatgggctaccgcggaggcctttctttcaaggacgcgaaaatgattaacctgcattattgttcgagtaaaaaaatatataaaaataaaattaattaattaattaaattaaagaagtttgcccaaatg

SEQ ID NO: 114441 - DNA, 74 bp, Heterodera glycines
  Promoter: Source sequence=SeqID_26801; Location=1075..1148; Strand=-; Gene=SeqID_46015
ggtgggtggacagcggacggaaccttacaattgccacaaaattaaaggcgcacgaaattattgtgctggaaatg

SEQ ID NO: 114442 - DNA, 1003 bp, Heterodera glycines
  Promoter: Source sequence=SeqID_32499; Location=315..1317; Strand=+; Gene=SeqID_62803
ccaacagcattctcagaataattacgccgatactaattgttctgggatttgtttctcggcgcgtttgtttgggaaaaatttggaaaattggctatctctttttctgctcaacagtaataggaattccaaccgcattctcagaatacctacgccgttatggatttaatatatcggggcgtttgtaagggaaatatttgtcaacaagaatatatacgtcatctcatggacttaaaatcgcaaaaattaggcagtttttggtgaaaatctgttaacaaatggcattcaaattttcaaaatttttccccggcagcgcctgtcggcaccgccagaccccccccccccccccccctctgtcccacaaaatttttggaaaaagcgcgccacaaaaaaagcgtttttaaagcagaaaaaagtcgtcgtaaatgaggaaaatgatcagcggaaataaaaaaatattggaaaaaatccattccggtgaaaaatacaagccatttgaataaatattaaccatttttcattgcatataataaaaattttaaatgtccttgaatttcatgaattttccccactatgtccttgcaaatcggcatacccgtccttggaagccgaccttggacgattgcagccctgccctaaagggtcgactactttagatgcttgaaaataactgcaaacttaaaatcttttgcaatattttttattcatatttttttttttgatttaaaaggcgggaataattttcccgtttcccttctcgctttttctgtattccgcttcaaaattaactgatattgatcagttcaaactaggaatgcactttgaaatctatacagattcatagtgattcatataaaccactgaaaatatttttcataatattgggttgacttgtggatgttgtcgtgtggaagagcttcctggggaagattaccttgactccgcattacatacacattctgatatctcttaagaaattctttcttcgtgaaaaacttcggaaatg

SEQ ID NO: 114443 - DNA, 102 bp, Heterodera glycines
  Promoter: Source sequence=SeqID_34605; Location=1..102; Strand=+; Gene=SeqID_64352
tgtcgggcagtattggacacgtgcagaaggccatggaactgctcaaggcactgaattttttcggtagcatttggaaattggagaaaaaaatatttaaaaatg

SEQ ID NO: 114444 - DNA, 520 bp, Heterodera glycines
  Promoter: Source sequence=SeqID_246; Location=1..520; Strand=+; Gene =SeqID_79589
attttgtcactatttcgacattttttggaaaattctttaacaaaaatgcaataaaaccaaaaaatacacccctaagaatcgacctaaaaattttttcaaaaaatacacccctaagaatcgacaaaaaaaatttcaaaaagcactcctaagaaatgaaaaaattttctcaaaaaggtaattttgtggcaagaattttaattttaaaaattattttttttatgtacctattttgtttttttgcccttaaaaatcccagccctactcatttgcaatgcaatcagtgaataaaaattatttttgcttaatttttggctgaaaattatgtcactattcgtcactatttcggactttttgtcactatttcttcactattttggcatttttactcactattttagttaactattttgcctatgttttcgcctttattattttcattttttacacatttttaactgtcatttttcccccaatttaagcgcaattcatttcttttccgttttttctacccaataaaatg

SEQ ID NO: 114445 - DNA, 1003 bp, Heterodera glycines
  Promoter: Source sequence=SeqID_12722; Location=2044..3046; Strand=-; Gene=SeqID_76417
tataattattaatgcttagagtgaaaaattgattgacaaaatccatgggtgataatgtatgaattataattattaatgcttagagtgaaaaattgattggtaaatccatgggtgataatgtatgaattataattattaatgcttagagtgaaaaattgattgacaaaatccatgggtgataatgtatgaattataattattaatgcttagagtgaaaaattgattgacaaaatccatgggtgataatgtatgaattataattattaatgcttagagtgaaaaattgattggtaaaatccatgggtgataatgtatgaattataattattaatgcttagagtgaaaaattgattgacaaaatccatgggtgctaaagtaagaattataattattaatgcttagagtgaaaaattgattggtaaatccatgggtgataatgtatgaattataattattaatgcttagagtgaaaaattgattgacaaaatccatgggtgataatgtatgaattataattattaatgcttagagtgaaaaattgattggtaaatccatgggtgataatgtatgaattataattattaatgcttagagtgaaaaattgattgacaaaatccatgggtgataatgtatgaattataattattaatgcttagagtgaaaaattgattgacaaaatccatgggtgataatgtatgaattataattattaatgcttagagtgaaaaattgattgacaaaatccatgggtgataatgtatgaattataattattaatgcttagagtgaaaaattggttataatagaaaaaatcagaataaaaggcgaatgattgcacgattaaaatcattggaattaaataaataaaagttgtatttttacttttgtcgtcataaatgcgtatttttttgccattctattcaattaaatattattattattcataatgaattatatttataaaaataatatttttttaataaatcccatttttttagaaatg

SEQ ID NO: 114446 - DNA, 294 bp, Heterodera glycines
  misc_feature (45)..(45): n is a, c, g, or t
  misc_feature (127)..(127): n is a, c, g, or t
  misc_feature (174)..(174): n is a, c, g, or t
  Promoter: Source sequence=SeqID_20638; Location=1..294; Strand=+; Gene=SeqID_51190
tttgtacaagtgccattaatccatattttcggcaaacgactgatntgccctttggtttttcggtgtcatgacagtgggtacaaaaggcaacaactcgtacaatggcttaggctaggcctctatgctntaggccaggcttaggcttgcttggacctaagcttaggcttctttatntagtaaaaagtttttattgtacgagtttcatttgcattccccaaattgttttaggcatttctctgtgccaccactgcggtcaatttcattattcacttgagacagcccaaatcaataatg

SEQ ID NO: 114447 - DNA, 374 bp, Heterodera glycines
  Promoter: Source sequence=SeqID_8570; Location=1..374; Strand=+; Gene= SeqID_68564
cagcagaatgctgttgcacagcagctgggttcttttcactgtatgcccctcccacccgccgctgccctcgtagaaagacagtcagacagtgcactatttcccacctttccctccctctactttttttcaaattcatttttaacgcaaaattcaaacaaaacgccacaccaattcaaaccacggacacatacacacagacactcaactttaatatataggatttcccgtttccagcatcactacagaattgaccgattgtgtcatagtgaaaacaaattctcgtcagcagctactccacttcacaatccgttctttttctccctttgccctttcaattccaatttgtcatatttttgaaccatttttagcaaatg

SEQ ID NO: 114448 - DNA, 83 bp, Heterodera glycines
  Promoter: Source sequence=SeqID_38544; Location=105..187; Strand=+; Gene=SeqID_67328
agtgatcggattggccacacggaaacttactttttattcagttggcctctgccgggagtaacgaagaacgaatgataaaaatg

SEQ ID NO: 114449 - DNA, 613 bp, Heterodera glycines
  Promoter: Source sequence=SeqID_1940; Location=1590..2202; Strand=-; Gene=SeqID_76925
gaacaaaataaatattatattcggaatctacgcctcaaaaaacccatagaaagtaaccaaacaccactactacataagaatgaaaaaacaaattactttatttaataaaaatttggcaaaatggttaaataattcaaatttgtatgttttttgtcttttctctcacgaaagcattccattcttaggggtctatatttaacccgaccccgagtcggggttaagggttggcgttgtcgcggttgggagcgtcggtgtcggggttatccccggaaaatggccaaaaaagtcggggtcggggcggggtcggggtcgcaaccctaggctaaacataaaattttcaacacatttccatttgagtgagtttcatcgaccaaaatgtcatcgcttttctcaaccgttttggccagcttttcaccaaatgtccaattaattttttccatcaatacgttcagtgaccgcattttggagtttattctgtgcaacatttgggcaatgctcaagaaaaatatttatggcatggatctgtctgccagaattttttgccttttgcgacaattcgttccgtcaattctcgacgactgtccatcgctttgcgttatcaatgtcaattatg

SEQ ID NO: 114450 - DNA, 290 bp, Heterodera glycines
  Promoter: Source sequence=SeqID_6308; Location=1..290; Strand=+; Gene= SeqID_61096
attttttaattttactttattacctagttcttattcatttaatggagcgtaagcattcatcgatggaggtcagtaaacaaattctatggtaaattatgcattttacggaaaagattacattcgttggttacaattacacacatttttattgtttgtttttggataaggcaaatcccgattattttttatgcttttacactttccttttgatagaatctttttatctgcgctcaaagtgccaagcccaactccgttttgttgttggattctttttctggctcatcgagatg

SEQ ID NO: 114451 - DNA, 162 bp, Heterodera glycines
  Promoter: Source sequence=SeqID_10991; Location=6140..6301; Strand=-; Gene=SeqID_74302
ggagataaaaaatagtccacagggagacggtcagtcattgtttcggaatccgttgcgtgcagtcgactgtgtgcatatcgaaaacactgagcacagaaaccaaccagtgtacgtggaagggtcacttgaccttgtcgagggactcgaactttacacaacatg

SEQ ID NO: 114452 - DNA, 624 bp, Heterodera glycines
  Promoter: Source sequence=SeqID_11845; Location=883..1506; Strand=+; Gene=SeqID_75350
aaataattttttgccactattttggcgtttcgtcattatttttgccactattttggcatttttgaaaaacttcccaaaattgcaataaaaatgaaaaataaacccctaagaatcgacctaaaaaattttcaaaaatacacccctaagaatcgacctaaaaattttcaaaaatacacccctaagaattggaaaaatttcgcaaagattcttcccccaaatttttttttcttgttcaatatttgctacgaaaatattttgtaactgcaattagtgaataaaatctttttccttaattttaaattattttcaaattaaaaatatatttaaaaaattacacccctaaatttggaactttttcgccactatttttaccactattttggcattttttggtcactatttagttaattattttgagattttttatcactaaaaatcccatccctaattatgaatattaatttttaattatttaaactctctttatctgtttaaattttgttatttcatgattttttatcacaagggattttgacgcagcacatttcgattaaaactgtgcgtacggtagtgcaaagaccaaaagaatttcgattcattcttgacaatataatgcttaaaatg

SEQ ID NO: 114453 - DNA, 317 bp, Heterodera glycines
  Promoter: Source sequence=SeqID_17669; Location=220..536; Strand=+; Gene=SeqID_82198
tgtcaatcaaaatttttttattttgcattttccctatcgatttcgcaatctacacgtgacttttttttgttgcatatttcgcaatagacacgtgactttctgccattgcatcgaaaatttatcgtttgtcaacgaaatattcctcaatgtcaatgaaaaacaatcacgtgccaggtgtcagctgacacgagccattctgcggccactataaaagccgcccaaattcacttctccattcagttcaaccaaaagttggattttgctaaaataaaattgtgcgctcttatttaaatatattaaatttaatttaaaaaatg

SEQ ID NO: 114454 - DNA, 89 bp, Heterodera glycines
  Promoter: Source sequence=SeqID_9616; Location=1419..1507; Strand=+; Gene=SeqID_72098
attcactaaaaatctgtcgcaaaatatcaaaaaattcttttcaaattttcctaaaacttttggaatttcagttcataatctaccaaatg

SEQ ID NO: 114455 - DNA, 153 bp, Heterodera glycines
  Promoter: Source sequence=SeqID_3986; Location=2808..2960; Strand=-; Gene=SeqID_52704
taggagccgtaaattgggaacacctgtctgaaatcgattcttcggaaaaacaacgaatttgtcggaaaagggtagatttgggaagaaagcccggcggttggtaaaattttggcgaccagtgtttcggtgtttggacgtaaattggatgcaatg

SEQ ID NO: 114456 - DNA, 199 bp, Heterodera glycines
  Promoter: Source sequence=SeqID_1852; Location=465..663; Strand=+; Gene=SeqID_76369
ccttaaaaacgaatggtgaatgatcaaatagaaatttggtacatcaaacatacgcttagaagcagatgccgtgccggttgtttgagatccatgtccacgatgttggtgtttcggatgtgtcgaagtgccagcaatcgaagacgacggtccagcggtgcgcacagaagtttcgacggtgacgaaagttgttgcaccaatg

SEQ ID NO: 114457 - DNA, 560 bp, Heterodera glycines
  Promoter: Source sequence=SeqID_3736; Location=732..1291; Strand=+; Gene=SeqID_51681
tattgtcagaatattggcctaaaagatgcaaatttaaaaatgcaaaaaataccttttcaattgcctcctttcatttccttgatgattaattgcagttttcgcattattcggcccaataaagggtctttttcttttattgccttaatcttcaggtatttctcttcgttcgcttctgttttttcttcctttcgatcagacatttttttgttcttcttaatggaattttggcaatcattaaaaagggctctctaattatttttattaatcattttaccaaatctaagcgctttggatctataataattgttttccctcatcccttttcagatattcaagtggtgttttgtatttattttattgttttttaaattttaccatatataatatatatatatatatatatatatatatatatattttaattttgcctgaatttggtgtgcattttgctgttgcggttcgaacacttcttcaatcagatgctgattttctctcatttttttgaagtgttgctaataccttgacttttattgctgctgcccgctccattgaccaaaatg

SEQ ID NO: 114458 - DNA, 142 bp, Heterodera glycines
  Promoter: Source sequence=SeqID_14415; Location=1..142; Strand=+; Gene=SeqID_78453
aaattcacacttgaaaaattttttcacttttttgttcgaattcgggtccggggttcggagttgggtaaatacgagttaagattcgtaatcagcactctcgaaaaccattaaaattggttttgagcacaaaataaaaaaaatg

SEQ ID NO: 114459 - DNA, 423 bp, Heterodera glycines
  Promoter: Source sequence=SeqID_12908; Location=1998..2420; Strand=-; Gene=SeqID_76649
agtaataaaatttaattttaaaagtgttttgatgcaagacaaaaaaaaaaattttttttaaagccatagaaaaatttttaaatttttttttcttgaaaatttcttttatattttataaaataaatttttgtttttttggggttggggcaaaagacgcgggatgggggaaaacgaagtatatccaatcaagtaccaccaccaaatattcgaaaatagcattacagagaatataaattttttcaaaaaaaaaattttttttaaatcagaggcctttgcgtggatcagaccagcggacattggcaactgaatttgttggtcgagttctgtgaccgtggcactttgcagcaggcgatcatcggcggcggcgcttgtgttgtcggcactgatccgccgttggcattggcaccggcggcgcccgcaatg

SEQ ID NO: 114460 - DNA, 617 bp, Heterodera glycines
  Promoter: Source sequence=SeqID_8629; Location=1902..2518; Strand=-; Gene=SeqID_68722
gaattttgaaattgcctggacctggacttggaaaatgaaccgtgacgggatcccgggaccgggactcccgtttttccgggatttccggtcccagtttttgggccgggaccccgccgggaccgggacgttttcaaactttgtgcacctttattataaaatttttaaaaatggtaaacttctattttagcttgggaataggccaagcaatgcaggcacgatgacatttcgcctactggacattttgcctactaaggcaaaatcggacgtttcgcctactaagtcaaaatctgacatttcgcctactgacatttcgcctactcgacatctgacctactgacatttcgcctactcgacattttgcctactcacctaaaatcggacgttttgcctactcacctaaaatcggacgttttgcctactaagccaaaatctgacgttttgcctatgaatttttgcctactggaaaaatgctaaagagaaaagaaaaatagtgtgatagagtataaaatgcgttgtttttgcatcaaacatataatttgtttcatttctatttttctgtaatttattcaaagttcccttttcagcccaaaccaacaaaaaaaatttttaataagatg

SEQ ID NO: 114461 - DNA, 342 bp, Heterodera glycines
  Promoter: Source sequence=SeqID_20819; Location=492..833; Strand=-; Gene=SeqID_51400
agtgttgaggtcaaaattgaacaaagtgcatggatcggaacatagccttttatatttttgacaaagttttgcgtataaatatgcaacaaaatgaaaagtgcctttaaattctaataaattatatatagggaaaatatgaaaaaaagactaattactagagaatggcaaatcaacctttttattagtttttgcggggtatcaatttaaatgttgatatttaattaaatcaactaacattatgccatcaacgcaaatatcaacgtaatttttaaaatttgcgaaaattttttaaaatttatatgagcggtttataattttagtgcgagagataacgcaaaaatg

SEQ ID NO: 114462 - DNA, 181 bp, Heterodera glycines
  Promoter: Source sequence=SeqID_2989; Location=1..181; Strand=+; Gene= SeqID_82654
tttgtccatcccttttttctctcattttaaagtcatttatttaaattttattttttttcatctaatttattatgtacacaaattcagaaaatgcagaacatttgactttaactcgaaaaaagttttttaaatttttgttataacaaattaagaatcaaattttcatttataaattcgaatg

SEQ ID NO: 114463 - DNA, 209 bp, Heterodera glycines
  misc_feature (49)..(49): n is a, c, g, or t
  misc_feature (63)..(63): n is a, c, g, or t
  Promoter: Source sequence=SeqID_3758; Location=2584..2792; Strand=-; Gene=SeqID_51758
agataagacaaagggttacgggctgtgcattgatacggggtacagactntcgggctaaatacnctgtagtccgtaaaaaacacctatcgttcgaataaatacagttacgggttcataccgtaatcgctctctagtaaatacagtaaactagacttgctatattctttttttttgcagttttcacctgtcgatagcgcttagacgagatg

SEQ ID NO: 114464 - DNA, 780 bp, Heterodera glycines
  Promoter: Source sequence=SeqID_25177; Location=847..1626; Strand=-; Gene=SeqID_55907
tttttatgactgtctgaagattaaattagcattaaaaattaatttataccgacaaaaattggacaaatggcaaaagaaaattgcccaaattgttgaaacaattgcgatggttttgtgactttttgttgtacaaaattcgcccactcattcaactcaaattacaaatcaaacaaaaaagattttttgcatcttttggctttaaaacagttaagaaaaagctttttgggccaattgaaaataaataaataaataatttttctctaaaaataaaatggactcattttttcatttgaaaaaagggaatattgaatttctttaaaagaattttccaattaaattaaagaacaaacacaacacaacacaactcagatttatataaagaaaagctcaaaagttaaaatccattaaaaaatatttttgcgtgtttatattgttggtatattttaatttaattaaaaaaaattaatcaggtaaagaagattatttttttacaaaatttcaccacaacgaaacaaaaaacaaacgaatgccgaaagccaacagagaaaaccaaaaacaaaaaaaagtccaatgtgacaattcaaaaaatgggaaaatcccaaaaagctaatggagaaattttacagaatttccgatttttcaatttgaaaaatatcgagaactatttttgaatatgtaaaatctcataattttgctaaattaatgacgaattagataaggaattttaaatttcttaaggtgtggcccatttgcgcggagaataaatggagcaaataaatg

SEQ ID NO: 114465 - DNA, 750 bp, Heterodera glycines
  misc_feature (123)..(123): n is a, c, g, or t
  misc_feature (155)..(155): n is a, c, g, or t
  Promoter: Source sequence=SeqID_18991; Location=969..1718; Strand=-; Gene=SeqID_83736
cggattaaaaacagttttttcataaaaattttttttatattaaattttttaacatattcatcgtaataatttacactggtgtaaatcatttcgtaaatggagagaataaatttggtcgcttgntcaaaaagaaaaacatgtgatgattaaacatntaatttattcaatgttttatcacatttacacttccattttcatttttgcttattcataaatattttaaataaaaataataatcatttatttttggtaaatgctttacaaatattttttgttggcattttctttggtgcttgtgcaccgaataaatgcttacgaatgcggcacatttcgagaaagggacaaatattaccaagaaacagcagaattggcaaaatttcaatttaaagtaaattttttatttgttaatcctagcatacatttgacagtgttttggaaaaaaacggcataattgctgaacatttttgaattgcctattcaatactcatctttaaatctatttttagcattttgaatttaagaaaatgaaattttgcatttttttcagatttttttttagataaaatccgctttataatatacgaaaaccataacaatgattaagcagactcagatacaaaaatttctaaattttccacaatttaaggatctttctcctataattggccttattgtatgttgcctacttattgtgcttttttctcccattaagatcagccacggtaatccggtaaagtcaaacaacaaatg

SEQ ID NO: 114466 - DNA, 1003 bp, Heterodera glycines
  Promoter: Source sequence=SeqID_4339; Location=29..1031; Strand=+; Gene=SeqID_54103
ttgataaaattaaagaagcatctttctaaaaatttaaattcaaaataacaaaagaaatagcgaataaaattgcacgaaaatttggtatttccgcaaaaacaattcgagcgtggaaaaataaattccgaagttataattaattattttttaataaataatttatttattttttatttgaattgaagggaaacattacggcattgtcgaaaaaaattggcataattaaaagaaaaatgcaccaatgctaaacgagccgattaagaagaatgaatgaaggattgagacagaagaataaatagtctatatttatttagtttttagtatataaaatactttcgctcttaaaatagaaattttatgaaaataaactttttttttaaaagcgaacattttttcggggtttttatacttaatgtgcctattttcagttaaaaaatgcaataaaaacgaaaaatgcacccccaagaaagacccgaaaaatttcctaaaatacacccctaagaattgaatttccaaaatttgatcccaaaaatttaatatttttttcttattaaaaatttttggttaaaaatgttccttattcgaaaaaaaactttaaaatatttaattaaaatttacaattgaagtgtttaaattcttacgtgttttgctacctaaaaattgttaataaaaattattatttgccttttttttttgcctatttgaagattttgtgtctatttaatgcctattttacgactttttgtgcctaaaaaaggaagcactccctactctttaattaattaatttgaatcctaatgtaagccaaatattttgaaaaaatttccccttttttaaattaacaaaatttttgcgaaatcaattgccttaattggaatttacgtggaatttgcaggaaatacgcacgcacattaaggcatatttccttcgctatttaaatcgttaccaattcatacgtcaattaattgcaaaaataataattttttagcttcatcaataaatg

SEQ ID NO: 114467 - DNA, 152 bp, Heterodera glycines
  Promoter: Source sequence=SeqID_641; Location=820..971; Strand=-; Gene=SeqID_58003
tttatcggaacgatttgacacctgagtggttttcaacttgtttttgaagaaaacggaaattttgaactacgtaatttggttgaatttgcaaacgacctgggcgctggaaattttgaattttggttataaattgattttctgggagaacaatg

SEQ ID NO: 114468 - DNA, 294 bp, Heterodera glycines
  Promoter: Source sequence=SeqID_14593; Location=821..1114; Strand=+; Gene=SeqID_78670
cctgaacaactttgtcatgatggaccatcctacttaaacatcaaaagcatccgctgaatgtccattccccccttttttgacattttttccgtttttctcaccaattttctgcaccacttcgggtgccatgtaattgcccgtgccgaccaccgaatgcgctctgtccctcttccggtggtgccgcatctccaacactttgacgcgctggtccaacccagggggcaacgagaaggagtcgtcccggacatggccaatgggtgctccgtttgattgttcgtcgtagactacgtaatg

SEQ ID NO: 114469 - DNA, 707 bp, Heterodera glycines
  Promoter: Source sequence=SeqID_16936; Location=1..707; Strand=+; Gene=SeqID_81367
gaaggaagagaagaattggcggaagagaatgaggaagagaagaattggcgaaagagaatgtggaagaggaaggaagagaagaattggcggaagagaatgaggaggagaaggagagaagagaaggaatttgccagaaaacgaagaagaattatttggtaaacgaatgtataattccttggattacgcctcttttccaagttttagtgtatttttaaagtttattttaaaatttattattattattttcttaacagtgcgatgtttgtggaaagagatttgcgtttgcatcagttctatggcagcatcgccatgtccacacggcgaagaaaaattttttggtgaattacaaaacttaattttatattattgtattttttaaatttattattaatttaattttttgaattttattacaatggaccggatttaaatggatttctattttttcatacttatttcgacctaaaaagcatgtaaatcgtatttttagcttggtttgatcctttttatttccacatttttaatccatatttcgacattttcacaaagatggaaaacttttggaaaatatttccctaaaatcgaaaaattttgaaaaaataccaaaaattgtacaaaaaaaaattttaatgtgaaaaattcgcctaaaatgattttgcacatataaatccgataccaatttattacagtgcgatgtttgtggaatg

SEQ ID NO: 114470 - DNA, 501 bp, Heterodera glycines
  Promoter: Source sequence=SeqID_2364; Location=1575..2075; Strand=-; Gene=SeqID_79334
tctttgtgctagcttatcgtcacaatttataaataaaatcaattattaaatgttaagtccataattaaaagggtttaaatgttaagtccataattaaaaatgtttttgtttatttacgtttttgtgatggccttctccgatgaagatatctggcggcgatgaatgtgtggttccattaattgtatgctgtgaccggtctttggactcaatcgaatgaaaaccgtgaggagtgtcaaaataagtgagaaataatgaaattttctaaattgaaaatgccaaatttaaattcagttggtaccttttaagtcaaattttgcctttactctttctaaatccttattttagcaggcaaaaatgcctatttatggccaatttcaattaataaagaaaaaatataattgatgaaatgttttcgcctttcataatcgcatcgaatttttttgtcagaaagcaacattttgaaaattctgagtcccaaaaactaattctatggtaaaaatg

SEQ ID NO: 114471 - DNA, 237 bp, Heterodera glycines
  Promoter: Source sequence=SeqID_19238; Location=1..237; Strand=+; Gene=SeqID_83983
ctctcaaagggtgggccaagaaaagcatcaaatttactttcttaaagtgaaaactgaacagtttgtccccgtcattagaaagagagtggcgagagagtaatccgcgacggttctgccgctgctccgttctcctcccagtgtgtggtccgactgagtaccgacgcacatcgactcgcctatgtgatgttctacggtaccaacccgtgggtgctgttcatccgtctgcatgcgatcatg

SEQ ID NO: 114472 - DNA, 339 bp, Heterodera glycines
  Promoter: Source sequence=SeqID_28330; Location=1..339; Strand=+; Gene=SeqID_58959
tttggccatttcagtcacgggcccattactcggcccaaagtgctttccgaaaaaaatctttcggattcgttcgttacagaccgagaggagtcacatgatatatcatttgttaaatttgttgaggtaaaagtattcttgaattttaccttttgggtttttatacatatttctggatttttttaaaatatttatgtatatattttgaccactttttatacatatttttggcatccttattaattgcaaaataggtgagagaaatgataaaaatgttttttatgcattatatgaatcattgtttacaaatcatcaaaaattggcaattggagggccaaaatg

SEQ ID NO: 114473 - DNA, 748 bp, Heterodera glycines
  Promoter: Source sequence=SeqID_18898; Location=975..1722; Strand=-; Gene=SeqID_83607
ctcaatttcataagataattagcagaaataattttgctaaataaaaataaaatgaataatataaaaagcatttaccaaatagaattacttagatttaaattattaaaaagacattaatgaaataataaaaaaaatcataataaattcgtgacgatataaataaataaatttaaaaataaataaataaataaaaaagcaataattgtttgttttcttttcagtaattcaagcgcaactggtcatgagttattttcaaaaaataatagtataatagaaccaaaagaaaattaaacaaataaaatagaaaattctttgaaattttttaaattctattaaaaatactaaatatttatataaaataaaagaaactcaaatattttaaatagaaaatattctacaaaataaagattttaaagcagtaataattattaattagtctcatcatacagtgtaacaaaatgacaggttcactttcaaaaaaatcataatatcggaaaaagtcgacctaaaatctgaaataattcatgtaagcctaacttttgaagcttaacaaaaaagcaattacattatgctcaccagatcactccttcttagtgatctgaaaacgcgaaaatggcttgaaatcgggaaaatttttgaaaaaaaaaaattcctaggggatcagaaagaggacaaaattttctacaaaatgacctttgaatgatggatctacgacacgtcttcgctgatgcccaattggttaaaaatg

SEQ ID NO: 114474 - DNA, 551 bp, Heterodera glycines
  Promoter: Source sequence=SeqID_37996; Location=1..551; Strand=+; Gene=SeqID_66952
gtctcgagattttataaatgcaagaaaagagcaaatattggcattaaaaaagaaattacaatgaaaaattacgaaattcaacttttccgagtataattttttgtctattgcctttatcaaaaataaacttatacaaaagcttccatagaccttaagctttagtttaataccaagaatataggtattgaccaagtaataaaaaagttatggtctaagaaactgggtatggtcattcatgggacgcataatatgacatgggacgcataaaaccgactataaccgcctatttttgcctatttcggggtttttgtgctaaaatttttcaaaaaaattatcccaaaatttaatatttttttcttaataaaaatcttttggtttaaaaatttgttcatattcgaaaaaactctaaaacatttaataatttcatttacaattgaaatatttaaagttttaacgtgttttgttacctaaaaagcgttaataaaaaattttatttgcctatttttgtgcctatttaatgcctatttcgcgattttttgtgcctaaaaatg

SEQ ID NO: 114475 - DNA, 79 bp, Heterodera glycines
  Promoter: Source sequence=SeqID_11103; Location=691..769; Strand=-; Gene=SeqID_46927
ggcaaaatcatttaaattttatttgaataaattaaaaacaaaagccaaaagcgcagagtaccaaaggttcttcgacatg

SEQ ID NO: 114476 - DNA, 106 bp, Heterodera glycines
  Promoter: Source sequence=SeqID_32918; Location=1..106; Strand=+; Gene=SeqID_63143
ggaacttctgaaaatctgatccatcgtctggtttgtttgcattgcaagcattgctgatcaattgcagtcaaattattccgccgatatacgaaaagtgctcaaaatg

SEQ ID NO: 114477 - DNA, 81 bp, Heterodera glycines
  Promoter: Source sequence=SeqID_31056; Location=984..1064; Strand=-; Gene=SeqID_61432
tttgaaccggcgcattattcgagcagaccaaataaatgggctaaaggacagcgaaatgaaagcattgggaaaaggaaaatg

SEQ ID NO: 114478 - DNA, 142 bp, Heterodera glycines
  Promoter: Source sequence=SeqID_3157; Location=1..142; Strand=+; Gene= SeqID_83466
cgaagacaacaaagtgctcggcattcgatggaaaccaaaacacaatcggctcatcttcaaattgccaatcttcgaaggaaaaatcacaaaacggacaattctgtcgcaaattgccaaagtctatgacccgctcggactcatg

SEQ ID NO: 114479 - DNA, 604 bp, Heterodera glycines
  Promoter: Source sequence=SeqID_22169; Location=1..604; Strand=+; Gene=SeqID_52829
atgtttagaagctttttctaagctactgcttctcgactatacaattatcaaaaaagttatacactgaaaattgcaaaaagtcgaaatttttgaagttttttcttaataaaattttttctaggcttgaaaatcctttcgatttggtaaggctaatagagcatgttaagagctttcgaatgataccaagattgttggatttggatgccaaagaaaaaagctttcgtggaaaaacatgctggcgcccaaacgagcgcgcccaaacgtgagcgcccaaacgcgcgcgcccaaacgggtgggtcccattcgaacctgggaccccccattttttaactaactcacagaccactaagacgaaaaatccaacttaattgtacttggagcccaaaattgaatcgccgtgaatagagatcgattccgatctgccgggccgaactgacattttcaaaaacgaccggtttccgggtccggtctctcaaaaagcggtcaaatttgatttttccaaaaatcaccggtctggtttccgggcccggctcggtttttatttttagtgcctattttagcagattttttagagcctaaaaattggatccctaataatagtatg

SEQ ID NO: 114480 - DNA, 196 bp, Heterodera glycines
  Promoter: Source sequence=SeqID_1196; Location=1..196; Strand=+; Gene= SeqID_69701
actagagtccggcgggatcgggactcccgcgggattttacgggagtcccgctcccgactcccgctttttcggtgaacgggatttttaacgggagcgggatttttacgggattcccgttcgggactcccgtcccggaaaattttgaactcccgatcccgctcccggaaatttttacccaaaaacgggagtaaaaatg

SEQ ID NO: 114481 - DNA, 275 bp, Heterodera glycines
  Promoter: Source sequence=SeqID_13456; Location=1270..1544; Strand=-; Gene=SeqID_77345
tcgaggattgaaaggtgtatcatgttttgattacctacgaaaataaaaaaagtgggtaataaaactattcagaaatgatgatatagccgcggcgttaagtactctccaccgacacggatagtcttgttttctcacatctacgcgatgctttttagctgaataagatcgacactataagcagttcattgatggaaatcgtagaattctacactgctggtgcaaaatagtatgcgttggctttaagacgtataaatgttctacatgatgcggaaatg

SEQ ID NO: 114482 - DNA, 292 bp, Heterodera glycines
  Promoter: Source sequence=SeqID_11450; Location=2769..3060; Strand=-; Gene=SeqID_74848
tcgcctaacgcaacgcggcgggttgaccagcaggaaatattcaaaagtgtccattgttcgcactaaactcatccaccaaccccaaatctgtgcacttttatttgtgaaattcaaaatggaaaatttaaatttaaattttatttaattggtttacaatttttacattaaaatttaaaaataattattgattcgttactttttttaatcatttttatttatttatttaaaaaatgtttagtgttgttcacaaattatatatatttaaataatgttttgctgacaaattgccatg

SEQ ID NO: 114483 - DNA, 739 bp, Heterodera glycines
  Promoter: Source sequence=SeqID_34200; Location=1..739; Strand=+; Gene=SeqID_64049
tacaatgatgttgaacagcgtgacggtctgtgttgctcgtccggacgggcaattggtctacagagcatttcaaataattttatactatcgtttaaaaatattttaattttaaattttttattaaataattaattaattaataaaaaataaaatcttttcactctgtttatttgacatgaatattatttgaatattgtgatatggattatatttttgtttagtgcagcacaaaaacatacaaattatttaacatatatcaatgtgaattggtcaattaaaaattgccaagtatggtagccttttgcctattatggattttgaaaattacggtagccattttctgtgaattaatattaatatacatcacacatattaaattcgtcaatttggtgtaaaacaaatcaattaggtgcaatgaaaataatttttcgagttacggtaaccgtatgcattagtcatccacaaattcatttttttcacgcatttcaaatgtgctgcaaatgccccaatcacgcagaagtgtcactataaagtgctggtgctaattaacaatttgaaaaataaaaaacaaagtataaaagtgcccaaaatatgccaatcattaatttcaaaaaattttttagatcggccctttgtaaatataaaaattaaattttccgcagttaattaaccttaatataaaaaaagaaaaataaatatctccagaaccactcataaattttagtgccattttattatg

SEQ ID NO: 114484 - DNA, 193 bp, Heterodera glycines
  misc_feature (162)..(162): n is a, c, g, or t
  misc_feature (182)..(182): n is a, c, g, or t
  Promoter: Source sequence=SeqID_26316; Location=2111..2303; Strand=-; Gene=SeqID_57067
aatattttgttgagttaataaataaaaaattcctttttatttaatttttttttgataaataaattttataagtttaaattaattatttttttaattgatagaattttatgtatatgttgtatatttttaataagttttgtaagtgttgatgaaatttgtagntattataatatgtgttgtangtgttgtaatg

SEQ ID NO: 114485 - DNA, 865 bp, Heterodera glycines
  misc_feature (17)..(17): n is a, c, g, or t
  Promoter: Source sequence=SeqID_1097; Location=1..865; Strand=+; Gene= SeqID_46587
gccggaccggaccggantgccatttcaaaaatgaccggattccggatcggtctctcataatccgatcaatccggtaatccggtcaatccagattttttccaaaatgcgctggggctttttatgccatttcatgatggcaccccttctcttgagaatctcgcatacatttcagacgagcaaaaccaaaaattaactatacgaaaaaaatgacgcgctcgctgattaaatgattcatgtcatataattagctgcccactaattgatcaattagggtcgctaatttgtttttgctcattcattcgtttcgtttctttgcgcccgcccccttttggccgtataaatttgtcgcgcatgtgctcacaattcattcattcattcattatcgcaccacacgttcattttccattcccatcaattcatcatttctcttcccatctttaattacctttaattacccccccccccttctgccgatttttctgatgggccgtttcaaaaatatggcccgaccaaatcttttcattattacactaaaaatattttggaaatttaacaatgaaaaagaagtgaattttgttttagggtttaggaaatttaaatgtcgtgggtacgggaatggtaactcggatttggggtaggggatatttggaaagctggaagaagtcagggcttgggatatttggaaaagccgggtttcaaggcaatggatattttgaaggattttgaggctggggatatttggaaaagcgtttttggggcggaaaacattcaaaaacgggctagtttcgagaatcgggatccctaacatttgttcacttttagctctataacacataaatttcataaacattcatcattgaaaatg

SEQ ID NO: 114486 - DNA, 103 bp, Heterodera glycines
  misc_feature (27)..(27): n is a, c, g, or t
  Promoter: Source sequence=SeqID_10707; Location=1..103; Strand=+; Gene=SeqID_73958
aaagaaaacgcatatgtcgacattttntaatgatgtgtgatgacgaaatgaaataaaattcaaacattactggagcaaagaaatattcaaaatagcatccatg

SEQ ID NO: 114487 - DNA, 181 bp, Heterodera glycines
  Promoter: Source sequence=SeqID_17927; Location=645..825; Strand=+; Gene=SeqID_82485
atgttttgaatttttaaaattctatgttttttttttactttattggttacctaaataaatggattattttttcccttcatttcattcattatttcttaaaataattaaatactttattatttgaactcatgtaactcgatctttgtcatttttaaattttgcttttgcatagaaaataatg

SEQ ID NO: 114488 - DNA, 209 bp, Heterodera glycines
  Promoter: Source sequence=SeqID_42552; Location=420..628; Strand=-; Gene=SeqID_70419
ggttaggcaataatttttaaattttcaccaaaatttcgttctccgtggagaagcctgcagcacttaccagaaatttaaatatcaaaaaaaaatttgttgggtagaaattatttattctttgtttttaaaaaaatcaatagaaaaatattgaaacttgaatattgatacctatctttatttaactattctaattcagaaccgtcgcaatg

SEQ ID NO: 114489 - DNA, 195 bp, Heterodera glycines
  Promoter: Source sequence=SeqID_40001; Location=539..733; Strand=-; Gene=SeqID_68441
tagtgtacactattaaacaaaactctcgaataatgttcttgaatgggtttatgagtttgttaagtttcaaaaaattaattcaaattacatacctaacttttagtttctactcattcgaatttcattcccattctctccatctgtccattttattccgtttttttcttttggtcgctgtcgccgttgtctccaatg

SEQ ID NO: 114490 - DNA, 223 bp, Heterodera glycines
  Promoter: Source sequence=SeqID_5959; Location=3247..3469; Strand=-; Gene=SeqID_59831
ttatgtttattgaaaaaccaaaattttttttatctttcttcatttttgtgctgttcgttttacaaaaaaacctatttacctaatgcaattgaagcaaacaccattttaattttgtattttagtcttctgtcctttcaatttcaaaaaaattgctcacatttgtgaaattttgtagctgtttgtctgtctttttccgcatcgataacacttccaaagagaaatg

SEQ ID NO: 114491 - DNA, 122 bp, Heterodera glycines
  Promoter: Source sequence=SeqID_23243; Location=1..122; Strand=+; Gene=SeqID_53960
ccgtaactgctgcaccatccgtcatcaaagcattgccgattgacgaatctggcaaaattctctttccgatcgtcgaccaattcggtacggaattgggattagtcagtccctaatccggcatg

SEQ ID NO: 114492 - DNA, 343 bp, Heterodera glycines
  Promoter: Source sequence=SeqID_2309; Location=4388..4730; Strand=-; Gene=SeqID_79032
ttaagtggtcggaataacccaataattttggggagtagaaaacagagagagagagagagatgctaatgaccctaattagtaaaaagcatttataagcacgcataatccgttcataatgctttgctcaaatcaggcaaaacatatttccatatgaccctaattttttaaatgtgacgaaccaaaaactcaatctcaagtctcagtagcgagatatcactcttacccaatatagtataactacaaatttaaaaaatgtcaaaacccatacagaaaaagtggcattgaatctaaaaaaagaagagacaaaaattggacccgtggcactatcatcatcatcatcatg

SEQ ID NO: 114493 - DNA, 115 bp, Heterodera glycines
  Promoter: Source sequence=SeqID_7214; Location=1847..1961; Strand=-; Gene=SeqID_64171
aatttatcggcgctcaactattaattcatttaattttaaatttattttagatatcaaaaccccatgtgacaattttgctttattatttaatgtttccagttcctggggcaccatg

SEQ ID NO: 114494 - DNA, 65 bp, Heterodera glycines
  Promoter: Source sequence=SeqID_14593; Location=1493..1557; Strand=-; Gene=SeqID_47219
tgtaaaattattaattcatttttcgcttttattccccatttgcttacataagttatttcatcatg

SEQ ID NO: 114495 - DNA, 862 bp, Heterodera glycines
  Promoter: Source sequence=SeqID_19681; Location=1..862; Strand=+; Gene=SeqID_84415
ggccaaggccactgagtcccaaatgattaagtctcttcgatagacacattaatcccaccataattaagtttttattaaaatcttaaatgagtaaaatttacgaaaaattatgaatttacattcagtcccgaaaccccgacccggctggtccgggtctaataactattcttttaaatttttgaaatttctcaccaataatccactatagctctcatttattgagaagactattaaatgcacaattctctattttataaaaatttttatacatttttaatcaattttttattttcgtgaaaataatcaacaaaaaacgaaattaattaagacatttggcagtaccttaaaaattttgaagaatcaaaaggaattactgataaatgtttatttcttgtttcttctgattttttaaatattatttgccttactttcgaattgttttaaaaccaacatattttattgtatagtttaacattcaatgcattatattgcattttttcatcaaaaaaaattactacaaaagcctaatattgtaaataatttaaaaaacgccttaaatcattagaataataaattaaatttaagactataaatttaattaaggggggtccactaaattcagtcataatggtgaacaaaattaaaataatcttttttctttaaatctaataatcttggtatcattctaaagcccttcagaagccctattagacctacaaaaaaccaaaaaaaaaatttgacctgtaaagaagttattaagaaaaaatcacaaaaattttgacttttttgcaattttcagttagaacttttttagtaagcgactaatcgctaagcaattgcttagaaatagcttctaaacatg

SEQ ID NO: 114496 - DNA, 387 bp, Heterodera glycines
  Promoter: Source sequence=SeqID_13910; Location=1636..2022; Strand=+; Gene=SeqID_77862
tttcatcttccaaatcgaagatgttgtccaagtgttagtaaaaatcttaaactgaatggattattgctaacaaataaataaaataaaattcgagattatatgaaaaatatttttttttacttatattttccaatatatataggttttcccgggtctaactacattttttgttgaaaaagttattaacaatcgagctcaaagaaataaataaatgatgtcgtcctgaacttttaaaaaaatacaaagcattctttttaggaagacttaatgagtgaaaatttttttataaaatatttattctccattctcaagtctaaaaatttcctgtttcatgggtcaattctcgctctcggactctaagtttactatttttggtcatcttgaatg

SEQ ID NO: 114497 - DNA, 53 bp, Heterodera glycines
  Promoter: Source sequence=SeqID_34852; Location=1..53; Strand=+; Gene= SeqID_64551
cttcttcttgttcgtcatcatcgatgtgctgctgcaatgcgttggccaaaatg

SEQ ID NO: 114498 - DNA, 698 bp, Heterodera glycines
  Promoter: Source sequence=SeqID_5446; Location=3852..4549; Strand=-; Gene=SeqID_58076
ttttatgtcttaaaaatatttccattggcaattttaaaataattttaaattcgacaaaaatttaataaaaataattacttttaatattcgctgttattttctccaaataatttatacaaacctaataaggtagctgctgatccttttttcaaattaaaggaaaaatgcgttcttttgaatgttttatgtttttaataatttgactggcttttattggtactaaaaatttaaaatttatatgaaaaaatagctgagactttaatctataagaaatatacaaatattatttatttaaaagtctcccgaattttttacgaatttttttcctacatacgatgtaggaaaatcgctggttccttccatgtatgtctacatacgattttcatagagggaggctcatcgtatgatgggctcgtcgtatgtagaaatgttttaatttgaacgcacatacgacatatcgtacaaataatcgtctgccgcagacgattttacgagcgatgtgacgatcgcatcgtagatgcgatgatacgatgaatttgaacgtacatgtgatgacttggtgtgataaatcgtatgcgggagacgattttaatttgaacgggcatcggggctatgatgagccatcacatcgtatcatcgcatcgttgatacgatgctaatttgaataggcccctggagacccagaccatcttaagatg

SEQ ID NO: 114499 - DNA, 120 bp, Heterodera glycines
  Promoter: Source sequence=SeqID_10432; Location=511..630; Strand=+; Gene=SeqID_73631
aagaataaaaattataagccgaaaatcttttttaatttcgaaggatttcactaattataaaacttataaaacaaagtccaatatcccctcatttcaacattcaaaaaaggtgaacttatg

SEQ ID NO: 114500 - DNA, 485 bp, Heterodera glycines
  Promoter: Source sequence=SeqID_7696; Location=1..485; Strand=+; Gene= SeqID_65653
aatgagcggaaaaattttatttttaaaattatttgttatatagattcctatattgtaatcactttttaaaaataacacaccgaatgtattaagtaagctgttcctttgcagaaacaagggcccatcgtcgtggtgagcttgcccagcacaccctcagttgcgtcatttctccaagaaacttcagggtctttttggtgaaaaggcttggtcttatgccttaaatatagtaaaactttaatatgactcaaataggcgaaacatttaagcaaattttgaaaaagccgaaaaattattgtttttaattaaccacaaaaaagttaaaccagcaggctttttaaaaaatgaaattcatgggaaaagctttaaattaattccaagcgataaattttgtatttttcagaaaaattatcaacgatcccagataggacttatcatatgtagattttgaaaattagaattctaagctgcctatgaatttaaaaatg

SEQ ID NO: 114501 - DNA, 756 bp, Heterodera glycines
  Promoter: Source sequence=SeqID_16603; Location=921..1676; Strand=-; Gene=SeqID_81018
tttcaaattttttggtttaattacccaagtttgaggtcatttcccggtataaattttttattaattctgtgtctcgtccctgcctgcccctgaaccccgcaccgtggaattcatttggcccgaccccagagcaagtcgggacaaattggcgctcctgggtggatttgctgtgaaccacggactgaaatcgacggatcccggtgacaaagggggaagggaaaagcaaattagagagcctagacaagaccctctgaggcttgtctagtgttcatagtttcgtgtagttattgtcctccgaggcataacttcacgagggacgtagcggacttagtgtttaccctctgaggaagcacttcgtccgaacagagggttggaaggtgttgtgtagtggacaaagtacttgcccttcgaggaagtacttcgtgcaaaaagggtgttttcgcgcactaggccattgacaaataaggaaaaaaggcaaactaacagtcctccgaggctttagtttagccataaggcaaaaggcaaactaacagtcctccgaggctttagtttagccataaggcaaaaggcaaacaccttgtcctccgaggcaggtgtttagtcacaaaaggtccaggaccaaggccagactgatcccggaaaaagacacaaaacaacaagtgcaccacaacacacacacacgcacaaccaaactgcacgcaatgtctgggccaatacaaaaagggatcatcaatgcactcaaagctctggacaatg

SEQ ID NO: 114502 - DNA, 82 bp, Heterodera glycines
  misc_feature (16)..(16): n is a, c, g, or t
  misc_feature (27)..(28): n is a, c, g, or t
  Promoter: Source sequence=SeqID_31371; Location=1536..1617; Strand=-; Gene=SeqID_61734
tttgaaaatgtcctcntttttcatctnnccaatttataatatttttaaattaaactcttaaaatataattattaagaaaatg

SEQ ID NO: 114503 - DNA, 1003 bp, Heterodera glycines
  misc_feature (674)..(674): n is a, c, g, or t
  misc_feature (986)..(986): n is a, c, g, or t
  Promoter: Source sequence=SeqID_6075; Location=589..1591; Strand=+; Gene=SeqID_60226
tggaccacaatattttttttcaaaaaatttttaaattatgggttacggattacggaaattaggctttttcatatccccataattacggatttagtccagaagccctattttcgacactttcattacgcaaatatcaataaaattgtggttttctatggatttcataatttaagtttggatcaatggacggaggacaaagccaatcaatcaaaaggcatttcattcatatcagcggggcttttcacgccaattgctgcttttccgcacatttttttgatgtttattcactttggcctttctttttcgcgaaatttcgtcgtcacaatgattcgcttccaattataaattccattttcatttgatttttcgtggctaattttaaagtaagccaataaaagatcaaatgaatttattttcaaaataaatttaaaataaaataattattttcgttgatgaatgccttgaagaaattgttaggcggtggagggaaaaagaatggcaaaagggaagaggagaagcaaagggacaacagcgaggacgaaggcgaacacatcgccacggacttcgacaaaacattcgaagaagcggccaaaaagacatcggcgacggtgccacagatcatcgaataccgtaaagcaatgactaattaagagttaattattaaatgaattatntaaagttaacccgtaatgaagcaacacttaacccccccccccccccggcacaggcggaagtccgtcgagaacgaaccgatcgaaaagtccgtcgccctatcagtgtcgaattaccacacagcagcaacagcccaagcagcaacagcatcccatcaaaaaagtgtccagtgccgttgcaaatcgcacgtcagagctttgtcgcgatttttgttttgaatttttattttagacccacgcgaattcgaaaaggttcggcacccggcgcctataaacttttgggcgatgcgaaaagcgcaacgccggagaaagatntaatgagacggaaaatg

SEQ ID NO: 114504 - DNA, 167 bp, Heterodera glycines
  Promoter: Source sequence=SeqID_27464; Location=1..167; Strand=+; Gene=SeqID_58158
ttcggttttaattatgctgtacatgcttttaagccccgccgtgcggcggctccccgttttgtgcactattttagtttttaaaattggttccggactttttggctttttgaaataaattgtgaaaaatatacgaaaattattttagcttttaattatgcagtacaatg

SEQ ID NO: 114505 - DNA, 500 bp, Heterodera glycines
  Promoter: Source sequence=SeqID_14252; Location=1152..1651; Strand=-; Gene=SeqID_78269
ttagttaagtaagcacagcagaaaagataaatttctacatttataaaaaaatattataatattttgaatgatttttgaacagtagcggaagctttcagcttaagtcagaatttatcaattagataacattcggcgcatcgaaaactctgttaggcaggcagggatgtgatctgaaaatttttaattgcttgaaaatttttaaaaattttcatttcggggaattccccccccccagtaccggtaaccgccggtaaaaatttgcactgttaaaaataggagtttagcacaaaatgaatgatgcaaaatttagggaaacgaaaaattttataaaaatagaacatttcgccaaattttatcattttaaaaacaatcttattttatttcgtcatattaattcattgaagattaataatatttggttttaaaatttcttatccctgattaatccattgtacaagagaatcatgattttagttttggtaatccaaatccaataaatg

SEQ ID NO: 114506 - DNA, 98 bp, Heterodera glycines
  Promoter: Source sequence=SeqID_33162; Location=759..856; Strand=-; Gene=SeqID_63310
ttttcattacatcagaaaagcaccattgaagagaaagaattaagtaactattccatatagagtattgtaaacatagtcaagatacatttcaaactatg

SEQ ID NO: 114507 - DNA, 517 bp, Heterodera glycines
  Promoter: Source sequence=SeqID_3549; Location=1693..2209; Strand=-; Gene=SeqID_50828
atgtatcaaattttccctcaattatagaaaaacaaattatttcgttttttttaaaattttctatttcaaaaagaaaagacaataattccaatgaaagatgaaaacgctcattttactccacagcaaatttcaaaggttttttaatatatcttttgttattttttatgtattctactagtaattttagctgttaaatctacacatcaaaagtcacaaatgcctagatgttaagtgccaaactgaacgacaacagttgcttagcaccatagagaagctggcaagaaatttttacgacatttacaaaatgtttgaaaaacaggttacaaccaaaatatgatttaaacaattttttgcgggtgcttagaaacgtgagatgagcagaattagcaatttatacaaggatttctgtatacaatttggtctgccggtgaaaattgacttggtgaaacaacaggaattcagtcagatcgacaaagtcgctaatatggtgatttgtttcttatctctttaataaatg

SEQ ID NO: 114508 - DNA, 245 bp, Heterodera glycines
  Promoter: Source sequence=SeqID_42870; Location=1..245; Strand=+; Gene=SeqID_70677
ttcctagtcgtatgtgctttgcgttggttaattggcgtgggtgagtgtggtggttgggccgtttttgcgatattgtggctggaaaaaagaagcgatttcgctgtggggagcgcggccgtctgggtttaagtgcttgcttgcgcttgtgctcggcattgaacggtgatggctgctgctggggtgccacctttgtcgtggcctcagtttctccagcgattggcagctgtcgaaatgaataaaacatg

SEQ ID NO: 114509 - DNA, 385 bp, Heterodera glycines
  Promoter: Source sequence=SeqID_1196; Location=1223..1607; Strand=+; Gene=SeqID_69702
ggaaataagcttttgtcattaatatcaaatcagatattacattgtgattgaatcagttcttttgtaaaatttatgtgggctaattagtcttccgccagattagggatcattttgatcaaaaagggttactcattaaaaaataataattagaaagaaatgacgcaatataactttaggactattatttgataggttggttatataagggtttgaatatcatattagttgtagtttaagattaatttgcgacatcaataaggaaaagatcaattcaatttaatgaaatgaattgaattaattaaaatcagagttagttttaatccctgatcactgataagtacagtaattacttcatttcgtccatcacaacagattcggtaaaatg

SEQ ID NO: 114510 - DNA, 119 bp, Heterodera glycines
  Promoter: Source sequence=SeqID_15480; Location=2176..2294; Strand=-; Gene=SeqID_79755
tggagcagcagtacggcaacaacggtaccaacggtagtgatggtgatcagacgaaagtggaggctgatcatgatcagcagcagtatcaccaaatgcggaatggtgggggaaaagtaatg

SEQ ID NO: 114511 - DNA, 150 bp, Heterodera glycines
  Promoter: Source sequence=SeqID_26638; Location=949..1098; Strand=-; Gene=SeqID_57389
ggtgggtcgaccgtggaacactcgcggacaaacactccccagcagcagcaacaacagcagttttcgcttcattctgttccgcaaatcaacgctaataacaatcagtcgtatcatcaggggcctccttcgcatcagtcgcttcaacaaatg

SEQ ID NO: 114512 - DNA, 369 bp, Heterodera glycines
  Promoter: Source sequence=SeqID_16872; Location=1272..1640; Strand=-; Gene=SeqID_81299
aaaataaacttttctttatttagctttatagtaaagagtcaatcataatgcatttatagtgattccctgctcagtcacaagaaatactacaatgaaaaatgtgatgtagaataccccatgggaaagccaaaaatatatgaatgtttaagcacaaatgcaaggctaattaagtgaaaaaattaattatatttttcctagcgcattagtggaaaaactaaaacagaaaatattattacttaggcaggcattttttaagaataaaaatattcatgaattcactcaagaacctattgttgctcaatgcaatttagtcaattatatagcgacctttatgcgataaatgaaataattaaaatcgattttcagatg

SEQ ID NO: 114513 - DNA, 444 bp, Heterodera glycines
  Promoter: Source sequence=SeqID_8420; Location=1144..1587; Strand=-; Gene=SeqID_46596
tttattaatgaaaaaaaattctgccttcttctttaaaagaagaaattgaaattaacacacaacataaggaggatttgaacctgagacccactttttggtgactaactcacagaccactaagacgaaaaaaccaacttaattgtacttggagcccaaaattgactcgccgtgttatcataaaaaaattttgcaaaacaaaagggtctctccccccttttgtttttgataaaattcaaaatcggccacttttcatatagcgccaaaacatctcaaaaaagctatgggtcgcggattctcgactttttttgagtgcccggcaagcatatttgtttccaaggccaaaaatccttcaaataatgaatgagcctacctatcttttgatttcgttatttttttatttacggtttatctatttttatgagtgactgttttaagcaaaaaatg

SEQ ID NO: 114514 - DNA, 1003 bp, Heterodera glycines
  Promoter: Source sequence=SeqID_11199; Location=602..1604; Strand=-; Gene=SeqID_74551
taaattccattgaagttgaaaaatcttttttgttgtatttatttttttgtgtcttctgccacttctcataattccactcttaattaggtgataattgtccattatactttctctctattgtaaataattaatagcccaattagttcctcctatgtgacgggtatttatttattcgtttgctattgtttcaattgaattcaaaaatgcgttcctaagtaatttgtattcactgatgatcatctttgattgatacatattattttgcataaaatacgcataaacatttcaaattcaagtgaatatttttttaattttaaaataaaataagccttcatttttaccaatatataaaaaaaggaattatttaaaaaaactaattaaaaaacgactgaaaccatgagctccaaattttaataaaattccagctaataatatacttactagctagctttcgccgccttttaccctctctcactcattaattgctcaagataccgttaaaaaacagttttgttttttgtataattaatttttcttaattttacatttttgaaaatgttatgccacgagtcaatgtgcaaaataattagcatgtaattagtaattttatggtcttgtccactttaagcaattttattataattgaattttttatttttttttaatattaatttccctatagttttattcaatttttgtacattaaaaaacggattatgatcagataaaaataaatattcatcaaatcgtatttggcggtggattcaatgaataaatgaatgagtcattcggtagggaaagcaaaaataaaaaataaatgtgaaaacaatttgcttttagtcatttgcttcgcttttgaccactgcaaaacagaaaatgttaatatcatttattttatttttgcgtaaaacaaattattaaaaaataaaaaaaataataatttatttgaatcttaattgaatattaattttaaaatattttagagtcaattttcagcgcaatg

SEQ ID NO: 114515 - DNA, 87 bp, Heterodera glycines
  Promoter: Source sequence=SeqID_14136; Location=1115..1201; Strand=-; Gene=SeqID_78130
ggtaattcttaaacaatacaaccctcaaattctgcttgtcttttggtaggcgttgacatttgtgtggccacccctggtcgtataatg

SEQ ID NO: 114516 - DNA, 297 bp, Heterodera glycines
  Promoter: Source sequence=SeqID_33096; Location=325..621; Strand=+; Gene=SeqID_63260
ttttttaactcatttttcaaaaataacggaaattaaacggtgctaaacattcgaacgattaatttgttcttggaatggcatcattattagccttttgtcctgggaatcccattgtctctctgagggattaatttttaattaattgtttgttaattgggcgaattgaaataacggacaaagtaaaagggcaaaacattggcaaaatgccactgatggcgagggggagagattttctgtcgtttattttgaaaattcaaatttcgatttgctttctcttagggtttatttctccgaatg

SEQ ID NO: 114517 - DNA, 97 bp, Heterodera glycines
  Promoter: Source sequence=SeqID_8848; Location=1154..1250; Strand=+; Gene=SeqID_69419
tcgacgaaaaaagccttcggattattgcagacgaaattttgaggtatttaaaaaaggaaaattgaattgcttctaaaaggaaaatgagtaccaaatg

SEQ ID NO: 114518 - DNA, 487 bp, Heterodera glycines
  Promoter: Source sequence=SeqID_1716; Location=7383..7869; Strand=-; Gene=SeqID_75485
agagtggaaacaacaacggtaacagcaacactgacagaccagaaacaatacaacaagaaaagagacaacaacaacaacaacaacaaaagcaagcgaagaaaaaagggccaacaccaagtcaatacattcaacaaaacaccagctttttcaagcagctgagcaactgtcgctcggcacgcgcacgtgcctatcgtcagctggtgaggggggcgagcagtgagcagctgttgtgtctggtggaaagtgcgttgaacattctccgtgcacgtgtcccgctcaggagcactcatcttcagcacttgcgcgctcaggcccaacacgtgcgtgcgttgggccgtgcgagaagcggccacggggcacgtcgactgttgctgagacagcagaccgggcgcggcgtcccggccttggctggcttggtggccagcgttgtgcttccactgctggcggataagctcatgagccgcaaagacagcatcatccaaacatg

SEQ ID NO: 114519 - DNA, 92 bp, Heterodera glycines
  misc_feature (53)..(53): n is a, c, g, or t
  Promoter: Source sequence=SeqID_4063; Location=1..92; Strand=+; Gene =SeqID_53033
agcgttcaaatgcaacgtgatttttccaatgattatgtaaatttctggttttntcattcttcacatttatagcaattcctcgcgatggcatg

SEQ ID NO: 114520 - DNA, 252 bp, Heterodera glycines
  Promoter: Source sequence=SeqID_38139; Location=188..439; Strand=-; Gene=SeqID_67045
cgtgtcgttgtcgatggagtcggtgagcagcagcaattagatgtaatagtgcagagaatagaattaagaatgtgacgagaatgaaatttctctcaatttcacgcctttttatattcaaatttcccactgaaaaaaagtgcaacagaaaatgcatataaaaggggcgaatttttgtccatttgcacatttgctgctgacacaacacccaatcaacgaacgaacgacttcagtgcgcccaacaacaacacaatg

SEQ ID NO: 114521 - DNA, 214 bp, Heterodera glycines
  Promoter: Source sequence=SeqID_18278; Location=1876..2089; Strand=-; Gene=SeqID_82871
gtgattaaaagtggtacaaaagtgattcaaagaggtatatcagtgattaaaaaacgtacaaaagtgattagaagaggtgcaaaagtgcttagaagaggtacaaaagtgattcaaaaacgtacaaaagtgattcaaagaggtacatcagtgattaaaaaaaggtgcaaaagtgattaaaggaggtacaaaagtgattaaaagaggtacaaaaatg

SEQ ID NO: 114522 - DNA, 295 bp, Heterodera glycines
  Promoter: Source sequence=SeqID_21451; Location=1618..1912; Strand=-; Gene=SeqID_52058
taatttttcttaattttattttataaaatttaatattttatatgaatatacacacacatacaattctaaaaaaaaaattaatttgcagcagataagtcagtgtaatgcaaaatttcattttgttttctattcatgtttttgtttattattttttgaatttccaattaaattggtctttttaattaatttatgagcattagtttaaaaaatttaatgttttgaaattataaaagtgatggctcgcaatttaaaaaaacaaatttatttttattttagaaatggccgggccaaaatg

SEQ ID NO: 114523 - DNA, 156 bp, Heterodera glycines
  Promoter: Source sequence=SeqID_19106; Location=1..156; Strand=+; Gene=SeqID_83847
ttggtcacaatggtggatgagtcgttcgtcgttctgtcccggctcggcacccgttcttcctccaccaatgccctccaacccgcggccgattcgcttctcctcgacgttctcttctctcttcccttttggatgccctccaacgaattgtgcaacatg

SEQ ID NO: 114524 - DNA, 121 bp, Heterodera glycines
  Promoter: Source sequence=SeqID_5039; Location=155..275; Strand=+; Gene=SeqID_56675
ttttggaaagtcaaaaataaactgaaaaaagaacacaaacttaacggacaaaaaagttctgtaaatgttctgtaaatatttgggtttatgaattaaacattgccaataatttcagaccatg

SEQ ID NO: 114525 - DNA, 129 bp, Heterodera glycines
  Promoter: Source sequence=SeqID_345; Location=838..966; Strand=-; Gene=SeqID_83391
tttttatgcatatgttaatgcaacttcctgtttatttatatagagatgttgcacacatttgacccattttatccctccccgatttaatcatataattttcttttttttagcacggaaaaataatcaatg

SEQ ID NO: 114526 - DNA, 167 bp, Heterodera glycines
  Promoter: Source sequence=SeqID_9598; Location=5307..5473; Strand=-; Gene=SeqID_72032
agtttgaggttgggaaaattaaacaccaaaaatcttgggagaaactcccaaacgcaatgaaaatgccaaaagcattgtcagtggagtcggaaatggcattttaagccctaatttcaacggcacaactgccccaattccatattccatttaaattttggcgttaaatg

SEQ ID NO: 114527 - DNA, 1003 bp, Heterodera glycines
  Promoter: Source sequence=SeqID_12158; Location=513..1515; Strand=+; Gene=SeqID_75731
acaaatcattggaactccaaaaattgtcattctgtacagattctaatataaaagtaaatttttaaaaatttgaattttgcaccagaaaattataattattatttttttggtttttaactttattttgaaagttctaagaggattaacgtccggctgtgcacatagaggaggccgaaaaaaatcgaaattaattaaattcaaggttcccaactggaaatttaaaaaaatgagaatttggccgacaaaaacatgcgcttaaaaaatagtttatttttgtgattttgagcaaattttttgagaaaaataaggaaaatttagtttttgaccgtttttaacatattttcactgaaaattggcaattaagggcagactttgaaatttttaggggaattttgggggtcggtggtgccgacaggcgccgccgggaagaattttggaattttcaatgaattttgtaaagaaaaatgtagcatgtagcaaacgaaatgtcttattttttccaaaaaagtgattcttaagggtgtaaatattttcgtctttttcgtccaaattccgtctgacgaaaacgaaacgaaaatttaaaatttttaaatacgaaaacgaaacgaaaattttttgacggacgaaaacgaaacacgaaaacgaaactcaaaaagtgacgaaaaaagggacgacacgaaaacgacacgaaatttcgtacataaatcagtaccaaaagtacttattttataaataaataaaaataaattaatcaaaaaattatatgaataattaatcaattaactgacggacatgtaaaagaatgacaacatttactggatggcatgaatgaaaaatttaaaaaaaaataccaatacataaaagatgtctattttacaaatatgaaaagtgtaaataaattaaggcaatggtaaactttctgtttaaagaaaataaagataaaattatatgaataatatcatgaaatattaacattatatacataactaaaagttctaggatg

SEQ ID NO: 114528 - DNA, 110 bp, Heterodera glycines
  Promoter: Source sequence=SeqID_21359; Location=876..985; Strand=-; Gene=SeqID_51963
agcagtgaggaaaagtggcacaatttatttgttggcacttttacagtatttttaaatgattttcatttgttcccactgtttacatttgctttttgctctgtgtcgagatg

SEQ ID NO: 114529 - DNA, 967 bp, Heterodera glycines
  Promoter: Source sequence=SeqID_22790; Location=433..1399; Strand=-; Gene=SeqID_53487
atttacacacaatcgacttaaaaacttcaaaaaaatccacccataaaatggaaaactttcaaaaaaatacacccataaaatggaaaactcaaaaaaacaccccttcctaatttgaaaatttttcaaaaatttgcccactaatatttattttagtctttcttgaacaatacttgtttttgtttttaaatttttagagaatttttttttgtagtcaaatcaaatcgtttattgaaacaaaaaaaaagaaaaaatatttttttaacccatttttatgggggttttataccttttcatactttttgcaatttcttactcataattcaatatgatacatatttctttcggtttttcctacctaaaaaactcataatattttaaaaaaagatataatatttaacaaaattgtggtttatttaaccacaattaaaacgaaaatacaattttatttaaaataaactgcggttaatttaaccgcaaaaagggaataattgggccgcttttttttgtccaagtggcgcctttgtgagactgacggccacagctcgcaagttcgaatcccttccgaattccgttttttttcaagtattcccccattttactccattttccaattattttcccatttttcatattgtccaattatttcccccattttccctaattttccccctttttagccccctcccccccaaaatgcccccctctgttcctcctcccttttcccctcttcgccccgtcgttcgaccccaaaaattcgtcgctgtcgttcgaccgttcccttcgctttttcgccctcgaacaaaaaagacgacgaccgttcgaccgatgaaagcaccaaaacgcttcggtaatttttgcattttattctctttccatttaattttcgccttttgttttcagtcgctccgcgcgcgtgccgaaaccgtcgccggcgctaattcaatcgcttttagacgcaaaagaaatg

SEQ ID NO: 114530 - DNA, 1003 bp, Heterodera glycines
  Promoter: Source sequence=SeqID_4483; Location=22..1024; Strand=+; Gene=SeqID_54619
agttttttgcattttttaaaattttctagttattttgataacgattattaacatttaataaatgataagaatgaatcattttatttgcaagttatacgataatcaattattgttggagtattcttactacttttagttagagtagagcgggaccgggaattttgggcaaacccgggaccgggaccttttcgggttgaaaaaccgggaatttttggctgggaaaaccgggaaaaaacccgggactggtcccggtcaaaaccgggacctcggtactcagttgtccgtgttttggtcccggtcccgctctactctacttttatgtagtgtatcaattttttagtccattgtttctcaaagtcttttaatgagttttaccaaccatgaataagcaacatttgcctaaatcctcttattctatctcaagtagcctcgctagcatactttggaatttttgaagttaataattattgttccattctcttgatttataataaaaattatcttaccagaataaataagactagatttattaacaaaataatctttcttttagatgaaaggttttatttctcgattttaattacttacttttttatcttttaatattcaatagtttatcttttaatttataatttttattttaaaataaaatatatcaatgctacttatttttattaagtcttaaaattattttaattcgaaaacatgcataataatctcaaccgtggataattaaatccataaatgtgatttttgaaaacaagtatacggattaatttgttgcatctcttttctaatttaataaatccagatctttagaaatagggattatgatatttcgacaatgttttaggtgcagttttttattttaactgtattttaaataaattaatgattactttttttaattaataaagtcttaataaatgatgttttatattaattttaatttactttcttataattaattagattaatattttaattcattaatatgaaaatg

SEQ ID NO: 114531 - DNA, 509 bp, Heterodera glycines
  Promoter: Source sequence=SeqID_32373; Location=520..1028; Strand=+; Gene=SeqID_62690
ttatggtaattaaggaattgtttttaatcaaaatagataaaaaatcgatgtgttatatttttcattttttaaaatataatacactttttattaatgaaaaacaaattatgaaatgtataataattgaatagttatttaaattgaaatgaaaaagattttacaattaaattttaaaataatagctgaaattctttaattaaatataataaataatttaaatgaaaatcattattcatcaaaaaataatttaattaaactaaaaaaatttattattaataaaaccaaacatttaagtttattaaaagtaatgaaaattaacccaaaaaatataaagaaaaataatgtacaccgtccggcttcgaactttgcccccccccccaaaaaatgatgcctcagaatccccaatcacacagggattctgaggtcttaacgatgtcaaaagtaaaatctgatcacgtattcgtgatcagcggcccaaataacccctaaagacatgttttggtacaatg

SEQ ID NO: 114532 - DNA, 405 bp, Heterodera glycines
  Promoter: Source sequence=SeqID_41832; Location=471..875; Strand=-; Gene=SeqID_69881
aatctataaataaacttgttaattttttcaaataaaaatgttttacttaaaattatttctagtttggttcttgttggtcggaacggaaagttgttgcctttcaaaagaagaaaaagagcaatttaccagtgcccgaagaactgtagaaggcgtatttagagacataattaggttagataacgaagcaaaagaattttctttttctgcacataataccatggttgaagcccaaaatataaaaaataaaaaccctgataaacctggtgtaaatttttggcatagcaaattattagatggagttttaaaaattcatgccctatttgacaaaataaaaaagaagaaaaaaatatgaaaaatattaaaaaaggtatggaaaaatgtctagacagaaaagatttaactatg

SEQ ID NO: 114533 - DNA, 52 bp, Heterodera glycines
  Promoter: Source sequence=SeqID_19309; Location=414..465; Strand=-; Gene=SeqID_84048
atttataattaaaggtcagtcactttgtggaattttatttattttaaatatg

SEQ ID NO: 114534 - DNA, 127 bp, Heterodera glycines
  Promoter: Source sequence=SeqID_28746; Location=1..127; Strand=+; Gene=SeqID_59324
gaaaaaaaccagcaaaaaaattttcaattttttttctttttcatttggaaggtccttttttctccaatgggaaatatttttttttgaattattataattaatattaaaccaaatttttaaaaaaatg

SEQ ID NO: 114535 - DNA, 429 bp, Heterodera glycines
  Promoter: Source sequence=SeqID_34444; Location=817..1245; Strand=-; Gene=SeqID_64236
aaaaatggcaatgtaaataattaataattataagtgaagattttttaattcatttcgtaattaaaatccctaattttttcaatgaaataaaaagtgcctttaggaaaaaattttttaggatggctaatcttttaaattaaaaattttgacaaatttatattacaaatacatcaattttattatttttttgagcattggtcagaattaatttgacaattttcaaatttttgtaattcattgatctgcatttttgctggattttataatttaaatttttatgtttttaagtttgaaaacatttacaaaatccttccgaattttttgtattttacttgctgatatttcaaaatttttattgcatattttttttattcctgaaatttaaaatattttaaatttaattttaagacaaattttcatttaaaaatg

SEQ ID NO: 114536 - DNA, 164 bp, Heterodera glycines
  Promoter: Source sequence=SeqID_27883; Location=206..369; Strand=-; Gene=SeqID_58552
tctacaaaaaataaataatttatagtttaactctaaaaaaatttaaggaaaataaaaatggtttaatttaaaaggaacaataaaagaaattaggaaaagccagaaaacccattgaatttcgcgaaaacaatgaatttttttagaggaaccgaaagcaccacatg

SEQ ID NO: 114537 - DNA, 481 bp, Heterodera glycines
  Promoter: Source sequence=SeqID_4978; Location=2259..2739; Strand=-; Gene=SeqID_56431
ttctgctgtggccgaatcagaccgttcgtcaccgttgcttctggagtccgctgctgtggccactgacgccgccactcattttgtagcccaaggcagtccccaagcgtcggtaagtcagttttatcacaaaattctcatcttgtgctttgtaggctggttgtccccagggataatttaaattttaaaagttgggtgaggctagggagggaaaatattgccaatggaactaatttaacaacgaaataaaatgtctgtctggcagcacagatgggagtaaattactgttcttcctttgatattacccctaacgttctattaaaattcttttaaaaaatttttgtagcttccaacgcctccatacattgagaacaatgacgtgtggagaggacagttcatatggagggaacaagaattcttcgactgtacgtgcacacctgtgagtggtggtcctacagtgtcaaaagcgggtcgtgagatgatg

SEQ ID NO: 114538 - DNA, 181 bp, Heterodera glycines
  Promoter: Source sequence=SeqID_7931; Location=1..181; Strand=+; Gene= SeqID_66419
aaaaggatatgtggagagaagagtataaggaaaaaatatggaatcgaaattgaattggctaaagtgaagaagaatccaggattgcggtacatcagcaaattgatgcttaatagtttatgggtaagaaaattgaaaataaattacgataggtaattttcactttcagggaaagttttcgatg

SEQ ID NO: 114539 - DNA, 804 bp, Heterodera glycines
  Promoter: Source sequence=SeqID_18681; Location=447..1250; Strand=+; Gene=SeqID_47536
accgagaatatgattgttggaaattcattgagctcactccttcgtgttgtctctgtgtcgggggcggtaccaggcgaatatacggaaaaaatttacgactcaccgctctatgcacgtgttctaccaaaagaagtatcagaaattgaaattgagttacggacgatgacagacggacgactggtaccattttcctatggtacagtgctggtcgtactgatatttaagaaggtgataaatttttgaaatcactcattattgtttttattatcacactcaattgataaaatggtacatactctttatgacacttcggtttcgggctatgatgcattttttgtgcaaaatggttgtggagtcggggatgactcctcctaccaagtttttcgaggagcgccaccgtttcagcgcggatggggcccagcacagacgggtgcggggctaggtgatatttttcgtggactctggcgatttttcctgccactaattcgcagagcttgagattctgttgcagatgaaacaattcagactggaaaacgctttataaatagggtaatcgatgaaaaacccggtttgaagggaacgatagagacgttggcaactgagagtaaacgtggagcggataatgttttagagaagggcggatttcggcgtcaatttggcacaggagggcgaagaaagcgtataaaagctaacaattcctccattctatcacatcaaacgataattggaaaaacaataacaaaaccgttaattcaaagcaaaaagaggcttcgatcagacgcgttcgggctttattaaaaaatg

SEQ ID NO: 114540 - DNA, 295 bp, Heterodera glycines
  Promoter: Source sequence=SeqID_20438; Location=1670..1964; Strand=-; Gene=SeqID_50976
ggttgcattgaattcaaatcttcagcaatactcacagcaagagattgcaccacacagattgtggtttacattcagcaattagtggaaggaaataaaggctaaaggcatgatttttcggtcacctcgtagagggggaaatcagcgacaggcggttccggaaaatgttcagcctcgaaaccaaaattttccagcatttccaccaattaatttggacaatcaacaaaattttcaacagagaaatgaagagaataatgagcgaaataatggaaatcggaaccattcagggactcaaatg

SEQ ID NO: 114541 - DNA, 55 bp, Heterodera glycines
  Promoter: Source sequence=SeqID_3071; Location=915..969; Strand=-; Gene=SeqID_83057
aattgtatcccgctttatagattgttaaatttaaaataataaatattgtatcatg

SEQ ID NO: 114542 - DNA, 384 bp, Heterodera glycines
  Promoter: Source sequence=SeqID_17139; Location=1308..1691; Strand=-; Gene=SeqID_81578
tcctttattcaacatttaccacttcgttcgctgttttggggacttcggtcatttttatcatctcctacattaattagtctttgttaattttcggctcagcaaatttggacacaaaagagcaattaaaacaaagaaaatgattgtttttgattacgatgagattgtcgaattacgcattcaaattaattatgaagagcataaatatttgttcttgaaaattggaaaaaaatgcaaatgacttaattttgatttacacgaaaaattgttgtttgtttttcaatttttaaatgaaattattatttttttttaatcagaaccaaaaagttaattttttgtaaattaacatttttcggccaaaagcagttaatgcatggaaataaaatg

SEQ ID NO: 114543 - DNA, 810 bp, Heterodera glycines
  Promoter: Source sequence=SeqID_5909; Location=898..1707; Strand=-; Gene=SeqID_59642
gaagaggtaaaaaagtgattagaagaggtacaaaagtgatagaagaggtgtaacagtgattagaagaggtacaacagtgattagtagggtacaaccataggggtggaagaggtataaacacggttaaaagaggtacaattacggttaaaagaagtatagtttaaaattaaacaaataaggaaatggttttattaaaaaaagaaaaattgaatattaataatatttttaatataacaaaagaaattctccatttctttattaaaaataaactataaagcatatagaattatagaatatttgaaattgaaatgaatttatttttaacaaatttaaattaaattaaaacatgaaatttttttaattttaataaataattaattttaaataaaacattcaccaaaaataataatttaaaaaataataattaattttaattttttaattaaatttttcacaaaaaaaaacaatttaatttaaattaaaaaaatttatttttttatatagaaaaaaacactcatttaaatgaattaaaacattaaaaaagtgattaaagaggtacaacagtgcttaggagaggtacaacagtgattaaaagaggtaaacagtgattagaagaggtacaactgtgattgattagaagaggtacaactgtgattagaagaggtacaacagtgattagaagaggtacaatagtgattaaaagaggaagaacagtgattagaagaggtacaaaagtgatgagaagaggtacaacagtgtgagaagaggtacaaaagtgattaaaagaggtacaatagtgattaaaagatg

SEQ ID NO: 114544 - DNA, 1003 bp, Heterodera glycines
  Promoter: Source sequence=SeqID_2551; Location=2450..3452; Strand=-; Gene=SeqID_80374
ttcctgttatgtgtagggagtgtaattatatggatataaattgcgaaatatggccataaaatatggaccaaaaatcgtaaaatatggaaataaaatggcaaaaatatggacataaatttttcaaattgagggtataatttcccaaaatttctttaaatttgttaatataaagtaaagcccttcaaaaatggctaaatatggtattaaaaatcattttagaagaaaaaacacgataaagctaaaatttactcatttttagcgaaaaatcaaccagaaaagtgaaattttatcttttttgcttatttttgacataaacttattaatttttaagaaaattcaaatttattcaatattcccgagaaaatttggcgaaaaaatgatttttttgaaaaattttccggtttttgggctcaaaaaggccaatttagctgctggggccgttctaatagaggttttttggaaaaatatcaaaatatggacaaaatgccaaaatatggaaaaatatggatatggaaacccatcctaaaagcttaaaaccaagctaaaaacatgtttttcgtgcgtttcaggcctcccacagtgcaggaaaaaaaaataaggatttccatataattggaagccctagccataacgcattttaaaaagtacacttcagtaccaggtgaatgccacgccagggtttggaccgtaactgaaaaaattgccgtaattacggattacggatttccgtaattgaaaatcagttacgtccagccctgattctgaggcatcattttgaggggcgagggcgaagttcgaatccgggcggtgtacattatttttgtatgcatttttgggttaattttcagtgcttttaattaatctaaaatttgttgtaaattatttaaattcatattatccccccggatgattattgttcaacctccttagataggggggggggctaattagagataataggtaaagtgaattagagtgaaaaaacaatatttcagtgcgaatg

SEQ ID NO: 114545 - DNA, 59 bp, Heterodera glycines
  Promoter: Source sequence=SeqID_14184; Location=532..590; Strand=-; Gene=SeqID_78198
tttttgagtttaaaataaaaatattttcagttataagaaataattcgttgaaaaaaatg

SEQ ID NO: 114546 - DNA, 345 bp, Heterodera glycines
  Promoter: Source sequence=SeqID_65; Location=2788..3132; Strand=+; Gene=SeqID_59399
atttggcgctcaataatgtacacattttctaacattaaaaaatattgcttaaatagttggcacaacacacacacacaagaatatatctgacagttgttgttgttttgtctaaattttataatttgattttgaaaataatatttctgcgcccttgctgcgtgtctgtcgtctcatctaaatcaaatggacaatggtaagaaaggagagctcaatgatcgcaaaggtgtgaaacggcgatacccattccctctggtgtccgcaagagcacaagattcatggtaaaagtgtaataagataccgcccaagcttccgatcaaacacaggagaaccaaacttgaacaaatg

SEQ ID NO: 114547 - DNA, 171 bp, Heterodera glycines
  Promoter: Source sequence=SeqID_7975; Location=1..171; Strand=+; Gene= SeqID_66555
ccactttttctgtttttgtttttgtgcacatcttcgatccttatctcgaccaatttccatgccttctcaaataccgagtttgcatatttgcattagctcttatcttttttgctacatattaacataaatgaacatgagggtcattcattcgttgcaatctcaccaaaaatg

SEQ ID NO: 114548 - DNA, 114 bp, Heterodera glycines
  misc_feature (16)..(16): n is a, c, g, or t
  misc_feature (48)..(48): n is a, c, g, or t
  misc_feature (70)..(70): n is a, c, g, or t
  Promoter: Source sequence=SeqID_44330; Location=1460..1573; Strand=-; Gene=SeqID_71826
taaaattttttttaanttaaaattaaacgctttttgaatgacttttanaatttatttttttttgcaattnatcgttataaaagcaatttaatgggcacaaacaaatgggcaatg

SEQ ID NO: 114549 - DNA, 118 bp, Heterodera glycines
  Promoter: Source sequence=SeqID_15882; Location=3664..3781; Strand=-; Gene=SeqID_80216
gtcagaatgaaataaatttcagatttttggcgtaaacgatttcgcaaatgtgccctctgacggccgttccgattttgacgttcccactgctttccatgaaggagttcccttcccaatg

SEQ ID NO: 114550 - DNA, 121 bp, Heterodera glycines
  Promoter: Source sequence=SeqID_5039; Location=153..273; Strand=-; Gene=SeqID_56676
tggtctgaaattattggcaatgtttaattcataaacccaaatatttacagaacatttacagaacttttttgtccgttaagtttgtgttcttttttcagtttatttttgactttccaaaatg

SEQ ID NO: 114551 - DNA, 233 bp, Heterodera glycines
  misc_feature (68)..(69): n is a, c, g, or t
  Promoter: Source sequence=SeqID_35901; Location=917..1149; Strand=-; Gene=SeqID_65351
aaatcaatgagataaaagcaattataaaatggatttatatatcatttcattttataaaatgatataannataatattattttcttattaattctgaaaaatctaaataaaatttatgctggtggaataaaagaagaaaaaaactttgacgaaatatttggccaaagatgggacgaaaaagaggagaaaaatggagagaatgaaactgatcaaaatggaataaatggacaaatg

SEQ ID NO: 114552 - DNA, 78 bp, Heterodera glycines
  Promoter: Source sequence=SeqID_17088; Location=2204..2281; Strand=-; Gene=SeqID_81518
tatgtcattcaggaatacatatgggcgcacattccatctttgcctgataaagatgacgacacgcccattgcaaaaatg

SEQ ID NO: 114553 - DNA, 767 bp, Heterodera glycines
  Promoter: Source sequence=SeqID_10639; Location=3866..4632; Strand=-; Gene=SeqID_73877
tcatcacaaattgtactttcctcatcaaaatggactgattttacatgtccaaaaaacaataaataataaattaataataaaattacaaaaaaaaaaaaaattttttttttgcaattttttagaaaattttcctgccaaaaaaaggacaactacaaaaaattggggtaaatcactcactgctgggcgtagaaaatgtgaaaaatgattaatcaaatcataattacttataaatgatgggggtggacgagtcgaaaaatttatcggcacttttccccggggtccaccaccaccaccactgacactgatataccccccaaaaattgaaccgttgggtgtgtgtgggtgctgataaatcttgtccaacaaaatcagcgattagaaaaatgataatttttctggtgctaatgattataaagatggtatgataagtggacgtcttgaagttgttgttgttgttgttgctgtcatttgttgtccacaacaatttttctcccgcccccgcccaaaaacgccggaggggccatttttgggtaccacaatatctcaagagtgacaacgaggagagtaattaagtcttgagaactgaaaactatcatatcatcatcaccacccaacctttatctgttgaaataatatctatcccattaaccctaattgcctttaaaatgataaaagggtcggcgctggggtcggcaaaatttggttttgataaaaaaatgatgacaaattttttgataagatttttgctagttttcacactgaaaatg

SEQ ID NO: 114554 - DNA, 289 bp, Heterodera glycines
  Promoter: Source sequence=SeqID_36449; Location=1..289; Strand=+; Gene=SeqID_65755
aaaaaaattcttgaatttgcttctgaattttttaattttaacccgaaaattactttttcgaaaattttgcacaaataagaggcgaagaaattcaacgaaatttttattaggattttgatttaaaatgttgagaggtttaacaaatttgtacactgaatgttggatcgtcaacaccaatgagaaatgactaacagaaaagagggagaaaagggcgttggtttaggaaaatagcttataataaaggagagacgagcagacgatgagtgagagaaaaatagtggtaaaaatg

SEQ ID NO: 114555 - DNA, 1003 bp, Heterodera glycines
  Promoter: Source sequence=SeqID_3200; Location=3670..4672; Strand=+; Gene=SeqID_83657
taaatgtttacccgaaaagggaagagagttgtgaaactataaggaaaaatctaatgctattgtttcatagtgaaaagagatgaatatgcaacgaaaaccggtgaaatgagaatgaaaaggaatgatgatacaagggggatagatgaattatgtgttagtatgtggtcaaacaggtaatgaataggtaaaactctgtgataagtcgtgaaaagcaaatgtatatggtgaaaagtgaaaaggtaaaagcaaaaatgttcactgataaatagtgaaagttggtgaaaagcagtaggcgacaagcgaaatggttagtggtaagtggtgaaaagaggtgaaaaacaatatgcgacaggtgaatgtcctgtggtaagtggtgaaaagaggtgaaaaacaatatgcgacaggtgaatgtcctgtggtaagtggtgaaaagaggtgaaaaaacaatatgcgacaggtgaaatgtcctgtggtaagtggtgaaaagaggtgaaaaaacaatatgcgacaggtgaatgtcctgtggtaagtggtgaaaagaggtgaaaaaacaatatgcgacaggtgaaatgtccagtggtaagtggtgggaggaggtgaaaaaataatatgcgacaggtgaaatgtcctgtggtaggtggtgaaaagaagtgaaaaccaatattcgacaggtgaaaatgtcctgtgttaagtggtgaaaagaggtgaaaaacaattggcgacaggtgattttcagttataagtggtgaaaagatgtgaaaagtctaagaacattgatgaaattctagagaagtgatgaaaagaggggaaactaaaaatggaaaagtcaaatatttcaaaaacagaaaatacaacgacgatgctgattttcgtgttatgtggtgaaaggcaaaacagaacagtagttgagatagaagctattttaaagtggtaaaaaggcaaagaaatgttcgaatatgtaaaaatataataaaagaatttaagagatttacatttaaaaatg

SEQ ID NO: 114556 - DNA, 69 bp, Heterodera glycines
  Promoter: Source sequence=SeqID_18869; Location=1341..1409; Strand=-; Gene=SeqID_83569
agttgttccgacggggccatcgacggaatgcaaaaaactttctcattttaggaccgctacgggaacatg

SEQ ID NO: 114557 - DNA, 160 bp, Heterodera glycines
  Promoter: Source sequence=SeqID_17681; Location=1..160; Strand=+; Gene=SeqID_82208
ggctggcacaaataattcccttccccccccccgctctcgttcgttcgttcggcggcttctcaaaaacaattttcaattagctgacgcgacggctggcacaattctcttctcccgtttttgtcatttctttacgaattatgaatatattttctagaaaatg

SEQ ID NO: 114558 - DNA, 1003 bp, Heterodera glycines
  Promoter: Source sequence=SeqID_19747; Location=297..1299; Strand=-; Gene=SeqID_84487
tttctcccccttttccccctaattttcttaagtagtcagctgtttcttccttcccctcattagcattacacttacaattagttcatcactgaaatttatccgcggttcagcagctgtaaaaatgcgaatttttcgaggtgctaacatttgaaaagcattttaatttaaataaattattaattgagcgaaattaattaatttacatcttaattacatgggtataataatggcttagccctaattgccaaatgagacaattaaccaacaaattatcccagcaatacaataatttttaataaatgaaaccttaacgtaaattagcggtttttgttgcattattttcaaaccacggggtaattaaagaggtaattaattaatgtgaaaggcgtgaccatttctaattattttaattaattctaaaagtgccaatgttctcgcaaaaaatcattaaaaacaaaaatttgccaattgattatttgcaattatttttaatcgattctctctttttgagcaaataattcatccaatttctccaatttctgaaccatcccccaattattccattcgttttttcttcacattttatccatttttgcttcatatttttgtgcttttattttatcattttatcatttctccggcggaaattccaatttcaatttaaatttcaatgttttaatttaaatttcattttttatttattttttttagattttttgctgcaaattgataaagcataaaatccttagaaaaagcaaatcaccaaatgagcagcagattccaggcaggcttttttctcttttcttttttttttggtggcgtcccaaattaaatttttattaattaataattaaattatttttatttattttatctcatcagagtccatccactttttctgttcttttgtgcccaatattggattaaatgaatatgaaaagctccaaatatccacatttaatggatggcatttccctcgtggcgttttttgatgaatgaaatg

SEQ ID NO: 114559 - DNA, 1003 bp, Heterodera glycines
  Promoter: Source sequence=SeqID_3863; Location=1019..2021; Strand=+; Gene=SeqID_52205
ccaatttttaagaaaatttaattttagttcaatttttttgacaaaattttgctaaaaaatgtctttttcgaaaattttttcggtctttaggagtcaaaaaggccaatgtcagcgcctcagatcaccactagaaaaaatgaattaaaaaacaatttcgggaccaatgttctcaacaatcatggcctgattttttttggctattttttcatggaaaatgtacatattttccccctattttcccccgttttcctctttattgccccccgcggacgaaagaagtgttaaaaacatcgcaaatgaattctcaaaacactcgccacattagtttagaggcggtggtggttgtggtgcattgagtggtgcaatcgattcattcgttttcattttcatttcgtaaaatatggaaaaaatttgtcctccataataatcactaatcgtttttatggcgaatggcgtaagaaacgccgcggggcgattatctctattttctccattctctctctctctcaatccaggaatggagccactacacgcgcaatccgcggcatttttttccgcgattcgctaatgcgacaatttgccatccgcgtagcgcggggattttcatgtccgagctccacccctgcttcttccgagtcaatggcaactcgtacaatggcaatttgtacaataaaaaataaaataaagccttacctaagcttaagcatagcctggcctaaagtttaggcctaaacctcgtaattacggattttgtatgggttctgcgtaattggctttcaattatatacagccctgctgatctccttggcacacgcttcgatctgtaaatgcaataaaaattaccgtaattcatacgggccttattgacccaaaaaaatgatgagcatttacgattttccaggcttgaatatttagccttaacacattttccaacattggctaattaccgtccctaactaattggcttttttccctcccacttaattgggtaccatcaaaaatg

SEQ ID NO: 114560 - DNA, 242 bp, Heterodera glycines
  Promoter: Source sequence=SeqID_21827; Location=585..826; Strand=-; Gene=SeqID_52462
actgaaaaaaggtttaatgatcgaattaaaaaataaaaatgtaactttgcaagtgctaaacggctgatggagtccctcgctgacaatgttcgaaggattaaccaccaaagagaggaaaattaagaagaggaaatggacacaaacgacgagggaaagctcatcgaaccaaaaggaattgccagttcgagaatccaaaattgggttgcgtcgatcaacggcataaataacaattgcgaagaatg

SEQ ID NO: 114561 - DNA, 93 bp, Heterodera glycines
  Promoter: Source sequence=SeqID_24172; Location=2371..2463; Strand=-; Gene=SeqID_54883
gggtgtttcgcacaaaaacgagcgacggagagcaaaaatgttgctcttttcacatgaaaacgttgcgctaggtgccctgagagatgaataatg

SEQ ID NO: 114562 - DNA, 305 bp, Heterodera glycines
  Promoter: Source sequence=SeqID_34759; Location=1..305; Strand=+; Gene=SeqID_64474
aattgcaatgtccgatcccaatcacggcaaattttcaccggtttaccaacccctttcggggaaggacaagcacgctgattttgccagtgtagcgcgcgtgcagccccggacatctaagggcatcacagacctgttattgctcaatttcgtgcggctgaacaccgaaaatccctctaagaagttgtgcccacagaagcaatgagccaactatttagtaggctagagtctcgctcgttatcggaataaaccagacaaatcgctccacgaactaagaacggccatgcaccaccatccaccgaatcatg

SEQ ID NO: 114563 - DNA, 1003 bp, Heterodera glycines
  misc_feature (1)..(1): n is a, c, g, or t
  misc_feature (6)..(7): n is a, c, g, or t
  Promoter: Source sequence=SeqID_15442; Location=70..1072; Strand=+; Gene=SeqID_79704
ncgcgnngcgcgcccccttcgaaatgcgaaagcgaaagcccatccctggtgtggggttaccataactttttggtctgcgaggagcttgttcctgtattatttggaacccgcaaattctgggaaataacaccaggaacttttatacaaaaaaacgaacaacaaatattcaggaaaaaaaaaatttgcatttcaagaaaaatctcttcaacacgttgaaaacccacaaaaaatgaattattgtaaaattagttaatgcaaagtctaaattataattgttttggcacaacaaagtgcgttgtggcaaattgctgaatgaaaaactgcaagctttaagtgaatttttgcattttccaaggcaattgagaagggggggggagacgggagctctttttttgccgaaattcccacggattaaacacgccaaaattggtggaaaatgccgagaacggacagatggaaattggcaccatcagttctcccaattcacagtgcaaggatggcaacactttttgtgaagcagcattgatttatttgctgctttccgggcccggggtggacactttgggcgttggaggggaggggggaatttggcatcatcaaaaagagtgccaccccccttggcggggggggggggcttaaaatttcattttttcccatccattcaaaagatgagggggggggggggggggggagatacaaatccctgaaaaaatttttgccaaaaaataattgcatttttattagtgttttttgagagtaatctgttttctctgtttgacaacaggggtccaatttttttgttgagttttcctattttccgggactcctaggggccagaaaaatacgaaaaactttcttttaaataggtcattaagttcttttttgaatttttacggcaaatttttcgaatttatatgggaaacatttttcttaattgtgtgaaaatattgtacatttccctcgtcctcctccttttaaatgatgatgattttttaacgaaatg

SEQ ID NO: 114564 - DNA, 1003 bp, Heterodera glycines
  Promoter: Source sequence=SeqID_3799; Location=475..1477; Strand=-; Gene=SeqID_45636
ttttacatattcgaacatttctttgcctttttaccactttaaaatagcttctatctcaactactgttctgttttgcctttcatcacttaacacgaaaatcagcgtcgttcgttgtattttctgttcttgaaatatttgacttttccatttttagtttcacctcttttcatcacttctctagaatttcatcaatgttcttagacttttcacatcttttcaccacttataactgaaaatcacctgttgccaattgtttttcacctcttttcaccacttaacacaggacattttcacctgtcgaatattggttttcacttcttttccccacctaccacaggacatttcagcatattgttttttcacctcttttcaccacttaccacaggacattcacatgtcgcatattggtttttcacctgttttcacctatttccaaatgtttttcacctcttttcaccacttaccacaggacattcacctgtcgcatattgttttttcacctcttcaccacttaccacaggacatttcacctgtcgcataattatttttaacttccctaaatccaaaatctaaaaataatgatgaataacagaaaaaaacaatttatggggaagaggtgaagggagcaaaaaaattatcaagaaaaattatttttaaattgctacgaatgactttaaacaacatacattcagaattttcaattttattatttttttaaatgggatttgaattatctttgggtcattgagctgactgatgataattaattaattttgcttaaattttcaaaattttgagcagcctatattttgaactcgttttttaatgtaaatcgctgcaatcgccgaccgttactgatacgccaaattaccgggaggtcatcattttaattaaattattaaagtagcaacgcttaacaaaggttataaattataaaaaaaagtgaaatgaaaaaattggaatgaaaaatttataaaattaacattttgtaatttagattatg

SEQ ID NO: 114565 - DNA, 63 bp, Heterodera glycines
  Promoter: Source sequence=SeqID_10089; Location=848..910; Strand=+; Gene=SeqID_73154
agtaaaaattaaaatacgattttaaacttttaaaatgattttcccatatttgagcggattatg

SEQ ID NO: 114566 - DNA, 316 bp, Heterodera glycines
  Promoter: Source sequence=SeqID_6449; Location=2435..2750; Strand=+; Gene=SeqID_61615
atgaaggtgctaatgatgatgatgtatggcgccggtaacggacaagatgttgacccgcaagccaaattttaaggctagatattctctgatgatttttagcattcaaccaaaaaaacgctttacaggattttttgcttttcatcttaaacaagtcgcttctatttgcatttgccatattatatatatagtaatgcgttaaaaaacgctccttatttccaccgaggtgctgaagatgtgcgaaaacagaagcattaatctcatgtttagcctttttcttttgcacacaaccacaatacatttgaagagtcaaataatg

SEQ ID NO: 114567 - DNA, 738 bp, Heterodera glycines
  Promoter: Source sequence=SeqID_687; Location=738..1475; Strand=-; Gene=SeqID_59039
attttacaaaatcattgattttgtctatgatttttcatcatgtaacataatttttaataaaaaaattttcatataaggataacttgaaaacatgtttttttgagttttcagggttgctaaccacgaatatgaccttagtgttggtcagttccgaatctcggacccgaattcggacaaaatgtcgaaaaatcaaaaccaatttttgttgtgagaattttgaatttcgactttgttcgaattcgggtccgggattcgaaattagtgaaaattaatgtcatattcgtgatcagcggcccagaaaacccccataaatatgttttaacgactttttgaaaagaaaaatttaaaaattttcatttattagggggatgtatttttgaaaaagattttggtcaatttttgtttgttagggttgttttttcgttttattgcattttgtaataatattagcaaaacgccaaaaaaggtgaaaatagttttttttctaaagaggcagattatgaaactttttttttttaaatttcccatttaatgatttttgtgtaacccctttttgatgattttgatatcgacccagcacctatggatacatacccctttcttaggaaataatgtacataattaaaaacaaaaaacccattgaagggtacccgcaaagccccaaacaccaaatactggtcgcatttctggcttatcattcgtgctaagtatttcctagttcttttttagataaaaatg

SEQ ID NO: 114568 - DNA, 236 bp, Heterodera glycines
  Promoter: Source sequence=SeqID_14612; Location=1855..2090; Strand=-; Gene=SeqID_78695
agtgattaaaagaggtacaacagagattaaaagaggtccataagtgatgagaagaggtacaaacaatgattagaagaggtacaacagagattagaagaggtacaattttgatgaagaggtacaacagcgattagaagaggtacaaacaatgattagaagaggtacaaaagtgattataagaggtacaacagtgattagaagaggtgcaacagcgattagaagaggtacaaacaatg

SEQ ID NO: 114569 - DNA, 161 bp, Heterodera glycines
  Promoter: Source sequence=SeqID_29165; Location=1346..1506; Strand=-; Gene=SeqID_59707
cctataaagaaagaacatgactactgaattcatatttggaactgacttgatcccgaagcgagttgtagtatgaaggcagatggtttgcctttttcgaaccgcagccatatccaaagtgagcggaccgaatggttccgcaacagtgcgtcactggagcaatg

SEQ ID NO: 114570 - DNA, 461 bp, Heterodera glycines
  Promoter: Source sequence=SeqID_1272; Location=6635..7095; Strand=+; Gene=SeqID_71161
gcggaataatgggtttggggcggaataatgtgtctgatactacttatgtttattcatcaaaatacataatagccccgagggagtgttaagaaagaccaaaagggggcgggcggggagagaaaacattggcaaacaaacccaagggcaaatgattcatccaaccgtatctttggatcattattttatttttaaaattttttatttttctcattaattaaactaattatttctaaatctgatagggcaaaaagtttttaggcttagttttgatttatttaattattattttcaagaatgaatgaggacggccttacgccgtttgaccaaattccggaattacgggaattacgggactgctttattaaagtcggttttttaatttattattttttaaatattttcattttagttacttcacacccaaattgatatgtggaataagttggagaaggtagtaaatg

SEQ ID NO: 114571 - DNA, 56 bp, Heterodera glycines
  Promoter: Source sequence=SeqID_2648; Location=2032..2087; Strand=-; Gene=SeqID_47370
ctttgagggaaactgttttcattttgaaattggtgaattcgcttttgtttagcatg

SEQ ID NO: 114572 - DNA, 72 bp, Heterodera glycines
  Promoter: Source sequence=SeqID_45392; Location=631..702; Strand=-; Gene=SeqID_72691
taaatcgcttgtcaacgctatttttaaaatttcgataaatttttaaaatgaacagtcattttttaaaaaatg

SEQ ID NO: 114573 - DNA, 1003 bp, Heterodera glycines
  Promoter: Source sequence=SeqID_13172; Location=276..1278; Strand=+; Gene=SeqID_76994
tggtggctaccctgattatatcatgttaagcttatattaaaaagaaaaatattcatttcttactattgaaaacatcaaatcaaaaactattttaaaaaagtcaatcaattttggattaataatcgaatactattcaatgttgcattttccggctccaaataaaaatatatgtaaaaatggagaaaaaaacaaatcaaaaaccgggatgtcggagattcctcggcttgatcggtctcaatactgatctttccagctctaatctattttcttgaaaatttctgactccattcctttatagtacttataatagggaattttttgaaaatcttcttattctaaaacaggaaaagagccaaattataatatgcggacatggaaatgagctcagacaaaccgaaccaaaaagtaagaaaaaatagaaattataaatttaatattgtatcttatacatattaaatagaataggaaaatttaaaaatggcagagaataaatccagttagtttttattcgtttttttgtcaacgccaataaattaacggcaaaattatgacgccataaaagaggtgaaaaacggcaaaattataaacggaataatatttgattaataaactgaataaatttgaatttaaaaaacggcaaaattatgacctaaaaaagaacaaatggaataaaatttataatttgaaaaacggcaaaattatgaccccagaaaggagatgaacaaatggcatcaaatttgaatttaaaatataaccagaacaaatcttttttataaataattctttttatccatgtattttgtttaatgtaaaaacttctaaaaacatttaattctcccattttgataattcatctaatctattcggattttttagggtagtgcggcctatctgaagcagaaattcattaatttgataattaaattggtggacaatggccgatcacaacaaccaaaaaaaaaattttaacccaattgagctttgccaagaagcagtaaaaatg

SEQ ID NO: 114574 - DNA, 318 bp, Heterodera glycines
  Promoter: Source sequence=SeqID_18040; Location=855..1172; Strand=+; Gene=SeqID_82624
tgtccgaagctaaaagagggggtggtgggaaaatccttctttccatgcatcaatgcgaccgaattttcccatttagaaaaccagaaaagatgaagatggatggatgaatcaagggattgtttagattaaaggatgagaagtgggcaaggggctaaagaaccagacaaaatttaatggtcacaaatcgattggccggcggaaggctttggaataacgacgacggctgacgcacctttttgagggggaggcacagacagaaggaaatgtgagagacatgcacactctatgaatccactcgacggcgcgctgtcagaaatg

SEQ ID NO: 114575 - DNA, 213 bp, Heterodera glycines
  Promoter: Source sequence=SeqID_19255; Location=1592..1804; Strand=-; Gene=SeqID_47574
attttaacgttttttaatttttagatttttctcaatttttatttttggaattccaagagccaacggtcagtaagcgcgatgaagcttgtccgctttttgatgaaattgtcccatgagtctgtgaccatcgagctgaagaacggcacacaagtgagcggtgctattcagggcgtcgacgtggccatgaacattcatttgcgctcggtaaaaatg

SEQ ID NO: 114576 - DNA, 127 bp, Heterodera glycines
  Promoter: Source sequence=SeqID_32754; Location=357..483; Strand=-; Gene=SeqID_63005
gccgttcataaggccaacaaccaccctttttcgaacattcctaagagcggacgattttcgtaaaatcttttctcttttctgatccgtgatggagattatcgtctttcgtgggatttttttaaacatg

SEQ ID NO: 114577 - DNA, 628 bp, Heterodera glycines
  Promoter: Source sequence=SeqID_26181; Location=927..1554; Strand=-; Gene=SeqID_56929
ttgatcatatccgcgatgcttcgaatgcccgagttgtgatgtattcagagcgagttgttgtccggcttgttgagtgaagagaaccgatgggctagcagagtgaattggttgaagcatgtctaaactgaaaacccttcccccttttataccaaaaattcttggttatttaatagcattcaaattttacacattatcattttatggttttttcatttctaaattattttttatcgttttattttttttttctccccttttatttaagaaaggaaaacttttcataaacaattttaattgcttttacgttcaatcgttttattgtggaataaatttatttattatttggggcgttttattagattattttttagtttttattgcgagaagcattcgcttcgttttttatgaattcattttgttttatttatttattttagtttacttttattttatattcatttatttatttaattttaataaaaaattttatgaaatgtttattttattttggatttatttttattaattattttgtattttcaggtaaaattcttattattttaatttggttttgtttttttaatagttttatattttttcggatttaatccgacaggctgcacatatg

SEQ ID NO: 114578 - DNA, 672 bp, Heterodera glycines
  Promoter: Source sequence=SeqID_11136; Location=1540..2211; Strand=-; Gene=SeqID_74481
ttcctgcaaatatttcatatacaatacgtaaattaagttttcttaacattgctgcaaattatttattcaccaaaatcatatttaattttttttctaaatttctttatttgttttacaatatcagcttgtttaaattaaaaaactttcatttcagtggtcaatggccattgttgacaattttttatttatactgattaaactttgatttggcccaatgcgcaaatattaacaaatatttttaatcaaattttataaggacatttccattagctaaagcgtaaagcaaattaaattaattttccgtccagttttcccgcttcataaacaattaagctataatttcattttaactccattttataaaagcgcttaattgttgttcaacaattggtcagaagtgcacctgactgtatttaacagattttatgaggttttgtttgacatgagttttgcggtgcttctacttttataaattttcgaaatccacctttctgctatgtgcatttttgcgaattaatcattcattattcatatgaaaaaatgtaaattttttaaattaatttttcgaaaatagagattcacaaaaaaacgtacggactcctgccttttttcataatcattacgttgcttttagtgggttaattacattttatagcgtaaaatttcaagatg

SEQ ID NO: 114579 - DNA, 878 bp, Heterodera glycines
  Promoter: Source sequence=SeqID_25334; Location=693..1570; Strand=-; Gene=SeqID_56084
cttccctatagtctgtactttaattctgcgttggatttttgctccccataaatgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgttttcggggcagtccgaaccgatgcgcccagatttatggggagaccgaatcgatagttatattacttttctgatttttgctccccataaattgagtaccccaaatatttttttcagaaagtcatg

SEQ ID NO: 114580 - DNA, 212 bp, Heterodera glycines
  Promoter: Source sequence=SeqID_469; Location=1217..1428; Strand=-; Gene=SeqID_53580
ggtatgtgagcgtcctgcctgatagatttcggcagcgacttcactgtggctgaggacgacgacgatgatcattattttacacattcatatattttttgcttataaatgtttaaattgtgcacaataattggtcaatgttcctcaaataccttttgtcacactcgtattatcccattgattttgtttttcagatgccttctaagcaagaaatg

SEQ ID NO: 114581 - DNA, 65 bp, Heterodera glycines
  Promoter: Source sequence=SeqID_31067; Location=831..895; Strand=-; Gene=SeqID_61441
ggtatttaaaaatccgatacaatttagattcaagaaattgttttacgtttcagttaaaactgatg

SEQ ID NO: 114582 - DNA, 1003 bp, Heterodera glycines
  Promoter: Source sequence=SeqID_13478; Location=158..1160; Strand=-; Gene=SeqID_77368
accaaagaaatttaaaaatattaaaataaatactttcttttgataattaagtttatttaccgtaaataattcagtgaagtcgtcattgtaacattgatattgatttccgcaatgaggcaagtaaaagattataataaatttgcgaaaatcttaagggatatttacttatttagttaaagaaaataattatttaattgatgaaaaatactttcaaaaaaattaattaaaaaaaaataataactttgctcagcactatgaaattttaattataataaaattattcagttcgtataactttttaatataatacattatacaattgcgctgaatataaagacatcctattcccatgggccgatcgagttgaaattttaaatgcacgtaacaatcctgaaaatattaagattctaaagtgagaaggcgaaatgacaacggtaaaaaattttacgaattttttttcctaaaaacgggtgttccataaatataaagacattagtggaaattcagctcaactggttcatgggaagtggtcaaactcataaaagttcaaactagcggtgcgtgaaccgtcggatctgggctgggaaaaagcgcttcgcgctttgtgagcttcgctacctagactgtgaagcgatttaaattgatcgatttggttggagaaatttttttttgaatttttaaaaaattattatgggttagtccacatcgaggctcaagacgggcgcttcgcgcccgttatttatgggttgtgagtaattgttggatccgaagcagttattagaagaggtacaaaagtgattagaagaggtacaaaagtgattagaagaggtacaaatttgatgaagaggtacaaatttgatgaagaggtacaaatgtgattagaagaggtacaaaagtgattagaagaggtacaccagtgattataagaggtacaacagtgattataagaggtacaacagtgattagaagaggtacaacagtgaatagaagaggtacaacaatg

SEQ ID NO: 114583 - DNA, 578 bp, Heterodera glycines
  Promoter: Source sequence=SeqID_3412; Location=1..578; Strand=+; Gene= SeqID_84569
cgaaaatgcgaaaagcgaaatgcgaaaagcgaaattttttctacaactttttaatagttaaaatcataaagcaaaaatcattttttaaaattttattacaaatttaaaaatcaataaaacgcttttttgaggcgcgctttttccaaaaaaactttttgggaagagggggcaggcgccgccgggaaaatttttgaaaatttgattaaaatttgttgacagattttcaccaaaaaatcatcaaattttgtgatttttgtatcatttttctaatgagaaataagagttttggcgcgccgctgagaacagtttttcatcaaattaccaaattttgcgattttgggccattttctaagaaaaaataggagttttgggggcgcggcggtgccgataggcgccgccggggaaaaaattggaaattttgatcatttataaacagtttttcactgaaaattagccaatttataggtaaaattttgaaaaattttatgggaatttaatccaattcttaggggtgtaaaagtcgcttttcgcgccaaaaagcgaaatgcgaaaagcgaaatgcgaaacgccaaaaaatg

SEQ ID NO: 114584 - DNA, 498 bp, Heterodera glycines
  misc_feature (460)..(460): n is a, c, g, or t
  Promoter: Source sequence=SeqID_30066; Location=968..1465; Strand=-; Gene=SeqID_60513
tatcattcgaaagcttttaacatgctctattagccagatttaactcaaaatataaactgagcaaaaaattcattccctttgctgggagggtaacaaaattgtggaatcaactcgataaagaactaatcaaaacaaactctttaaatcaatttaaaaccaaacttaaaagttcactagggtaatgaaaccagaaatagaattataacaaattcctaagtgatttggttttatttttatttttcgacctcatttgactttgacctcaatttatttatttattttcacatatttgtcttttaattcttgtgatcatcactttattttatcacttactctacgacacattatctgaacagtcgtcagagtaagaggttttcgcccttctgatgacttttttatttttacgaataaacaaacaataaacaaaatttggttttttgaactcttctgatgccgctgngaccgaggtaatccgcccatttcagattatgcaatatg

SEQ ID NO: 114585 - DNA, 249 bp, Heterodera glycines
  Promoter: Source sequence=SeqID_45535; Location=1046..1294; Strand=-; Gene=SeqID_72814
ttgaaaaaattctgtttgaaaaaatttttaaaaaatttctagcggcgtgatttcggcggcgtgattttgtcctgttcccgaattttttagaaccacaaagtccgtgggtttttttgcttttgaattttggccaggatattttattttcattttttctactaatgatacaactgctttagccgtgaccatccgtcccagcaattggtgaacgtggcccaggcctttctgaagtacggtgggcctgccatg

SEQ ID NO: 114586 - DNA, 793 bp, Heterodera glycines
  Promoter: Source sequence=SeqID_2594; Location=3981..4773; Strand=-; Gene=SeqID_80626
aatttcattacacttaatttctctaaaaaaattctgggagaattcttccaccctacggtatttatttcttttgtaacatccttgtatgttatatatttttttgtctaaaaaaatctcacggcacgttcagttcagcgctaaaattacagtagaaataaaatattataaaaaatcggagggcacggggtagggacagttatccctccccattacccctggggcaggccctaacaagaaaattatgtaggcaaaacccaagtgaatttttttatttttttttttgctcttcggtcacaaatttttgagagaataattttaaaaaaataaaaatgtatatacccaaaaaaaaaaaaattaatatcctataatttaattaaaaaatcatcattcctttaaaagcgcaaattggcataaaaatgttgtcgtgttagccaatcttaccctataaaatgctagcaatagccaccaaaaatgcaagcatataaaatggcaccaaagtcgcttttcttggcactttttacgaaatgctaaatttcgcaatgatcgaaaatttaaatgaatttttttaagttggaaaaacggccatgaaaatgatatttagcggcacaaatgcactctattttagcagctatgatagtcagaggcatagtaaggttcgtttgtttgatggagccaaattgtgatgcggaaattttgccggattttcaaaatttttcccaaattttcccgttagacttccaacttttcgctgggaaattttgaaagttgtaaaatcgaagagaagttggacatg

SEQ ID NO: 114587 - DNA, 318 bp, Heterodera glycines
  Promoter: Source sequence=SeqID_12261; Location=1530..1847; Strand=-; Gene=SeqID_75848
gtgttgatactcattttttcaattagatgcaattacggtatgctttttcaaaatcacttatacgatctacatttttacaataacacaaaaatactgtctcctccaaaaacaccgtattcttacccttcccactaaaaatactatttttggagtttttatcaacgaaagtgccgtatccgcccacataaataccgtatttttacggacctaaagaattttattttactaaattggactgtttatcaattaaaaacaccgtatccccgaatactaccgtatctctcaaatcctaaaatttttagacattatcatagaatg

SEQ ID NO: 114588 - DNA, 509 bp, Heterodera glycines
  misc_feature (94)..(94): n is a, c, g, or t
  misc_feature (123)..(123): n is a, c, g, or t
  Promoter: Source sequence=SeqID_15122; Location=1025..1533; Strand=-; Gene=SeqID_79305
ttatttatatttttaaaatacctacaaaatttcttgagtcatgacaataaaacaaaactaaaattctcaagtaatttggaaaacctaaaatctntaagaatttaattattgaaagtgaaattntaatttttttttcaggacccggttggaccccatacctggccccggacctggcccctaccctatttttagattgctttagatcgttttaaatcaattttagtgaaatatactgtatttaccttttgttttataaaatctgtaataaaaagaattacaaaaaaaagttattattaaatttaagcatggtttaaattatttattctttttattctttgaatcgtaaaatttagcatttttattcatttatcgattcacatttaaatcgatattgacaaataaaaaaatatttccattaatttgatgaaacgctaaaattatagaaataatattgtaaaccattttccatattattatatatttttaaattccgttaataattcgaaatg

SEQ ID NO: 114589 - DNA, 305 bp, Heterodera glycines
  Promoter: Source sequence=SeqID_43848; Location=524..828; Strand=+; Gene=SeqID_71427
ataaatatgttatgttattaattttaaacattttttcggaaaaaatcagtagaatctattttggacaaaaacagcttgccgtactaaactgaccctcgtactaaaccgaccctcgtactaaaacggccgtactaaaacggccgtactaaaccggccgtactaaaccggccgtactaaactgacccggtccgtcaaaatgtcgccaagccaaaaaataatgaaaagtcgaataatgattaaaatttaagaattttagtaaatttaatgaatttatttgtaaaattttgtagatataattcacaatg

SEQ ID NO: 114590 - DNA, 306 bp, Heterodera glycines
  Promoter: Source sequence=SeqID_31787; Location=430..735; Strand=-; Gene=SeqID_62082
tgcggagactgcgctggtttaccaccaactccaccagctgcaccttttggatgtggacggaattaggtcagaaaaagccacaactaccattcgattatttaaaaaatcggaaaataattgaatcttttgccatttttgtcgccccttttggccaaagaaaaaagtttcagattgagttcacgcggtgcgcttaatttggcactgttggccaccaatttggccgagtcggcgggctccccagccattccccactcattccgtgccgaaatttacctttgtgccgcgctccgttccgtcctgtgcatg

SEQ ID NO: 114591 - DNA, 941 bp, Heterodera glycines
  Promoter: Source sequence=SeqID_5657; Location=550..1490; Strand=-; Gene=SeqID_58802
tttcttaaaaattaataaatttatgtcaaaaataagcaaaaaagcgaaaatttcgcttttgttgttgattttgcgctaaaaaaattaataaattttagcttttatgtttttttcttttaaaatggttgcacgtaattgccgaaaaaattcgagaccaatttccgaatgttgaccgactaattgcaaaacgaaagccgtctttgtcaaagcgccttaccgagtcaaaaaatttggaaatgtatctcatatgcaatttcaaccaataaatttgaagaaattttgaactcaattttgaaaaatttatgtccatattttgagatttttgccattttatatccatatttgtggcatccctaataattaccatccctaatcataacgtttgccaattttcaaaatttgaaaagggcggatttaacctttacaaatgaaaaattatccatcgaattgatttatttgattgatttgggggttgaggataaggtaaaacgcccggcaaatgtcatcattttgcaaaatattctcctttttggtggtcctcttatgttgcgttccctttttcttcctcttccgatccgtcgtcattttatgccaaaatgattccttcacttccgtttttgtcaatgatttttcgtttcccatttaaacattgtccaaccccatttaaggcaaaaaacttcaaaaattgttttaataaaatgtgattttcgtgtttctttcatcaagtactatccgtaaaaaataggaaaaatcaaaaaaaaatcagggctctctctattcatatacaaaaaatacaattcccttttcatgactataaaaatcttttgttttccgctttgactctcattaaaaaaataaagtttccaacgaattattattctgctcttttgtttgacatcattcggaactcggccaaaattgtgctaattgccacaaaaatg

SEQ ID NO: 114592 - DNA, 86 bp, Heterodera glycines
  Promoter: Source sequence=SeqID_8785; Location=1..86; Strand=+; Gene =SeqID_69217
gcgcattcgcctcgtcgttgagcaaaccgcgccaagcaatccatcgacctcagcccgtccatttgctggtggacattggcgaaatg

SEQ ID NO: 114593 - DNA, 652 bp, Heterodera glycines
  Promoter: Source sequence=SeqID_2340; Location=1..652; Strand=+; Gene= SeqID_79221
cgaaaatgaaaaaaaaatattcaattttatttaagcctttttattaaatactcacggatgctttttcgagcttatctcagaactatagtcagttcaagaagcaaatttatagaatattgtttttattattaaatatttaatagttcttatttcattcagttattatgcatttacagaatatttttgcgaaaaattttattaataataacattaatttttatcctattaagtcccggattataccttcaagatgttttttctttgtattccattggcaattaaaatttcattattctcttttttcaatcttatttagttcttttataaaaatgaatgatttttaatgattttcaaatccgattttagtccctctataaagaagagtgatttgccattttttcatttaataattatttacttttcttaattcgacaatacctttttaattagaaaacaaaaatcaaatattttttacaattttttgatttaactgctatttgtctttgtttaatctattttaattaggtcgatgataatatgctaattgcatttatgtaagggcagcaaagaaatcaaatctgtgaatattcaatggaaaaatatgaagcacatcttggaattatgtattttatgctaaacaattgacaatatg

SEQ ID NO: 114594 - DNA, 382 bp, Heterodera glycines
  Promoter: Source sequence=SeqID_9625; Location=1155..1536; Strand=-; Gene=SeqID_72119
acggacaaagcaacaaataaaaacaatgataagcagaagaaatgaattaattaagaatgaccgatcgatcataatttatcagtggtaataatgttttttatggaaaaaacctctttatttttttattttattcataaaaataaaaaagtcatcagaagggcgaaaaccacttactctgacgactattcagttaaatgtgtcgtagagtaagtgataaagtaaagtgatgatcacaggatttaaaaagacaaaataatgtgaaaataaataactaaataaattgaagtcaaagtcaaatgatctttgccatctttgtccgctaattgaccagcagcagcagcacaacggggcaccactgctgctggtgttcactgccaaaatg

SEQ ID NO: 114595 - DNA, 84 bp, Heterodera glycines
  Promoter: Source sequence=SeqID_7244; Location=616..699; Strand=-; Gene=SeqID_64240
ggtaaaatatttattacatcgaagaaataagcatttcaatggcacattcagtttgaactttgttttcctgtaaccaattcgatg

SEQ ID NO: 114596 - DNA, 214 bp, Heterodera glycines
  Promoter: Source sequence=SeqID_42497; Location=440..653; Strand=+; Gene=SeqID_70371
ttctctctccttatcttgtctctcccctccctctaactgcctccccactctcttcttctgccattggctctcctcagccccacccccattacgaaggtgaatgatgcttctcctcgcgtcctcgctgcgttccctccctcctcggctttttccttatttttccaacacttttcaaaaggctttttccaacgcttctgtcccccgtccaccaatg

SEQ ID NO: 114597 - DNA, 391 bp, Heterodera glycines
  Promoter: Source sequence=SeqID_11681; Location=2440..2830; Strand=+; Gene=SeqID_75154
tttgtttaggcctgaaaaagaaatattttttagtccatttcttacagaaagaaatagagaaattttttattcattatttcggcatatctaataaaatcgcaacttttttttgcaaaaaacaaaacattttcgttactaatagaatcgcatgatttttagtgtaatatttgagccttactgcacaaaagaccaaaaagttttgcaagtttgaaggtcatttactaatttcgtttgctgaatttgaactaaattagggttgcgtcagcattacaatgcaaaaagcgactatttaagaactctaaattttcattaccgatatataattttgccttcaaacattagtttatgctatttatttttgatttaacattttttttcccattaagaaatg

SEQ ID NO: 114598 - DNA, 743 bp, Heterodera glycines
  Promoter: Source sequence=SeqID_938; Location=1..743; Strand=+; Gene =SeqID_64516
tttggcccatttttgcgccaaacattcgccatttcactttcaaagatggcgatcatttggacaatttgcgtcgtctcatctcaccgacaattctcactgattgccatcaactgaattcaatcaactccaattaccttttgcccgatttgaacgctaatgatgggccaaatttaaatgctggccaagctttgtccaaatggttgcacactccgcgcactgatggccaaccgaagcgattgcgttgttacgaagagttgaacggaccgtcaaacatcgattgggtcaacagtttcaaagaggtgtgtggccacataatcggggcaaattttttaaaattcacacaaataaaaaaatttaaaacttttttaaggttaaattaaatttttgaaaatttcctatccatatgccctgcggcatttgtcgtttgatttgatcaatttggctttttgtttaggtcagggctcccatccgtccttgaatggcaaggacgtccttgaaattgggccctctttcttgaaaataaaaaatgtccttggatgccaaggacgtccttgaaaatgaacatttagaaaagttttaaaaaaattcaaagaaatttgagaaatctttgtaattttcaacgatattttgattatattatggcattatgtaaataaaatgcaaattttcaaattttctcatgcttgtgaatgaatttgttacgcaatttttcgcgtttgcgacataatttatattttagaatg

SEQ ID NO: 114599 - DNA, 1003 bp, Heterodera glycines
  Promoter: Source sequence=SeqID_23183; Location=1140..2142; Strand=+; Gene=SeqID_53889
tggcccgaacagctgacgcgccacagttcgagcttctcgatttctgttaaatcgcttaataacacatgctaatctctttccccctcgtctctcttctctcatttttcccttttctctttctctctctttctcttacactatttcccaatgtatcgtaccgtacattcgctattccatttgaagtgacagccgccccatttttgagcccaaatattgcgaaaatttccccattgtttccccaaataaaccccctgacggaaagggcccattcctaagggtggaaaaaacaaaagcgctcattaattaacaaagggaaacattttgggggagtaattaaatcacattttttgtcccgggacataagcgaaacacaagacaaggatccgaagattgaagtaagcaaaagggtcattaattggggtgcttaatccatcagaggaggaaaaacgaatttgacaaaagaaactgaggaaaaactgaggaaaatcgtaacatttgaggaaaagagaaataaagattaattgaggagaaagacaaaaggcaattaaaggagtcgggaagaaactaaaaacggcaaattggcgctaattggctgacggatcatctgactgagaacacaatcgacaatttggcactaattgttgtctgatcaattgacacatcatttgactcggcaaaaattttcgccaacaattcattcctcgccatttgctattttttaaattaactgcggatcacccactaccacttcattacattctcatcaccaaaactacaaatttcttaattcattaactgatcatcgacaattatattcttttattcgaattcactttaattcgacaaaatttcttcgagcactgaagaagacgacccaacacgggagcgaacggagcgtgagaaaagacattttgaactcaatcagaaaagggaacttcatcggatggaagtggagaccctaaaaaagagggtctcgactttagagcgggaattggattcgatg

SEQ ID NO: 114600 - DNA, 249 bp, Heterodera glycines
  Promoter: Source sequence=SeqID_44020; Location=1139..1387; Strand=-; Gene=SeqID_71571
aaagatttgctgagagagcaaaaacaaaaaaatgtgtcgtaataataaagaataatgagcaataaaaaagaaaaatgagaaaggaggaaaagaaaagttaagaaaaagagtaaatgtttgatttatatttgtacataataatgaaagggaaaaaatcactttaatttggttgaaaaaactcgttcgatccgccccttaggcattgacgcgccatttgctcaaatacgttttgttctcgaaccccaaatg

SEQ ID NO: 114601 - DNA, 369 bp, Heterodera glycines
  Promoter: Source sequence=SeqID_5112; Location=1371..1739; Strand=-; Gene=SeqID_56948
aatgcattttgaaaacaaagacaaagaaagggccatataattttctctaaaaatttgaggttgcgcggacgtggccagagactgtgcacaacgtgctgacttatgcataattgaggtgtaattgacagtttgcataattaaataaatcatttcttctaataatttaccgtctgtactcattttgcgctattacttagggtgtaacataagtttccgcacaactttttttaaagaatttttttatgaatataaatttaaaaaaccacaatatctaacattattattgagaatgagtttgctatttatcgggcaagggataaatcccattagaaaagtatttaaggagttagagttgataatgtaaaaatg

SEQ ID NO: 114602 - DNA, 53 bp, Heterodera glycines
  Promoter: Source sequence=SeqID_18913; Location=2106..2158; Strand=+; Gene=SeqID_83630
ttcaaaaaaatgcaaataatttttattcgttcgaattgtcaggggaccaaatg

SEQ ID NO: 114603 - DNA, 177 bp, Heterodera glycines
  Promoter: Source sequence=SeqID_40113; Location=1..177; Strand=+; Gene=SeqID_68540
tgataattttagcgttcataatgggattgtataaaggcgattgtagaaggaattggaagcgctaaaattgtttgaggagctttttgagcgtaattacgatttttacttacaccattttttgctaggcttagatcacatgcgattttcgccactctgataattttagcgctcacaatg

SEQ ID NO: 114604 - DNA, 256 bp, Heterodera glycines
  Promoter: Source sequence=SeqID_681; Location=3955..4210; Strand=-; Gene=SeqID_58864
caagccacgttttgtccaagccacgaattgtccaaaagagtaaaaacccacgaattgtccaaaagtcgaaaaagctcataaaaacccggaaaatgggtctattttagggtttccggggtcgctgaatatgaatacgacatttatatagccccttgcctaaccctagacccacccgaataagaaaaatctcaaaatttgattaaaatatgtgcttttttttgtcttcagattttgctattcattaattgaacaaatg

SEQ ID NO: 114605 - DNA, 1003 bp, Heterodera glycines
  Promoter: Source sequence=SeqID_156; Location=329..1331; Strand=-; Gene=SeqID_75375
aaaaatcccaaaaaaggtgtgcatatttaatatttgcttaaataaacctaaaaagtacaataaacaaccaaaaaatggggtttaaaacttaaaaatgcatattttttattgttgttcgttgtatcaaaaacacctccaagtttgccaaatttcgaaaaaattctcattaaaaaaaaagaaatgttcgcaaaaaaatgacgaaaatatttattgaaaatgccaaaatgacgacgaaaactcaaatttttcgtgttttgtggggtgtaatttttaaaaatttccaaaaagttgatctttaggggtgtatttttcgtttttttttcatttttcttgtgaaaatttccaaaaaatggccaaaatatggactaaaaacccaaaaatggcgaaatatggatttattccagaaaacccccaaaatatggatttatatggactaaaaaccttcaccaaatcaaaaaattttaacgcagaaatgctatttttaagcccctttcttcatagcatatgcgcagaaaaaatatgttaatccatataatttacaaccctaataatgaacgttagctatagttggctcttaattttggtgaaatgtttaataaaattcaaataaatgagtatagaacaggaaacccggtcaaaaaaccaaaacccggcaaaaacccggcaatttcaaaaacccggcaaaaacccggcacggaccccaaaaacccggcaaatgccgggtttaccaggtaaaataacacccctggcattgatggcaaatttgtggaatttccgtgggcccgtccattcactgcccagcagaattcgctttaagcaccttcggattgagtaattaaaaaattgattataatcaaaagcagttaatgtaaaaagtatcattttttccggatcagctccttgttcccccttcccgcgaaaaatttaaaaaaaataaataaattgctgaaaatttatttttgataaaatttcttaagattgaggagacaatgacggcacaatg

SEQ ID NO: 114606 - DNA, 404 bp, Heterodera glycines
  Promoter: Source sequence=SeqID_14534; Location=1..404; Strand=+; Gene=SeqID_47209
tgcatttttagtttttacatatttttttcctgagctcccagtgatctgaaaagcacgaaaaccatggttaagctaatttctaatttttagaaccttttttaagtttatattttttagaacctaaaaattttcgaaaaaaccttttatctatttggcgttttgcccaaaatataggtaaaaatgcaaaaaaaaaaaaaaaatcccccccccctacgaatcgaaccctaaaatttccgaggctgggccctagactggttccttcttaaaataccatcacggcccggctgattttaaaatttcagtttcctcattatcttaagcatttatttttgctatttcttttttttcatattgaaatttcacaagaactgtgcttctattgatttacgtacctttttatgatg

SEQ ID NO: 114607 - DNA, 246 bp, Heterodera glycines
  Promoter: Source sequence=SeqID_30132; Location=30..275; Strand=+; Gene=SeqID_60571
agtcatcatccgaggcggacttttctttttcgttgtagggtttttttaaattttataatgttttattttgctaatttcaatggcaaaattcatagggttgggctgctaaaattccactatttttttaaggacaaataacatacaaatacaattccattagctaaaatacaatcccattagctatcgttaattaacattttttaattgccacatccttttgtttaggccagcaatgtcttctcaatg

SEQ ID NO: 114608 - DNA, 245 bp, Heterodera glycines
  Promoter: Source sequence=SeqID_10387; Location=2011..2255; Strand=-; Gene=SeqID_73576
tgaccttctgttgacgagcattgaggaggaacagcttacttcagaggtattcgtttattcaaactgttacaagggagtgacaaatcgggaaaatgaaatttaaaaggctttgccttatatttttgataataacttttaaacatgttttgtttgtttgaggaacgagaggaggcttggaaggagtacgagagcgaaagactgcctcgccaacttttgccattgccatcctcatttgaccatggatg

SEQ ID NO: 114609 - DNA, 336 bp, Heterodera glycines
  misc_feature (50)..(50): n is a, c, g, or t
  misc_feature (61)..(61): n is a, c, g, or t
  misc_feature (66)..(66): n is a, c, g, or t
  Promoter: Source sequence=SeqID_9938; Location=1..336; Strand=+; Gene= SeqID_72975
tgctccgctcgggttgtgttgctgctcgtcctgctccctttaagcgtcgncccccggccgntccgntgcggaactttgcctttcgccggccgcaacgattgttccgcctcagaagcgttcttcggacgtgccgtcttcgtcgtttttcctcttttaattcccccccccccctcagcgtgccttcccggcactccgcgcagttgccccggcacatgtccacccggttgtcgctgtacggtggacagttgttgctacccaagctcaaacccaggcccaaacccttctcctccggtgccacaaccccaaacaaatgtcggcaacggtggtttcaacatg

SEQ ID NO: 114610 - DNA, 651 bp, Heterodera glycines
  Promoter: Source sequence=SeqID_44987; Location=564..1214; Strand=-; Gene=SeqID_72388
aaaggaaaataaccaaaacggaaaagcatattcaaattaaaaagcaaaggttgtggaatttaattcggatcaaaaaggaatggaattaaattcccccccaaaaataaataaatttgaaatttgttgttatggttcattgccgatccccgacttttagaaattattatttatttgaattaagcaaagaaatattgattacagaacactattgttccgtaaattactggacaaagaaaggaaaatcttatagaaaataaaattatttgcccaccaatagaaatatgcaaattaattaaatgtttattttgcctagaaaaattggcaaatcccgaatgcatgttgaccgaaacgctcatactaataggaatcggcctaacttgtattatttcttttattatttgcatagcaagttttatcataaagtttatcataaaaatatggtggattattaaaatttgtttttatgggccatatttggcgttaaaatgggtcttgaacccaaaattagacaaaaaatttaacgatgagatacagaaaagtttattaaatgaatttgaaaaaagagaaaaagaaaaaattcaaaaaagaaaaaacagaagactatatagacttggaagcattttaatattactatttttatgtttgacaatg

SEQ ID NO: 114611 - DNA, 218 bp, Heterodera glycines
  Promoter: Source sequence=SeqID_26649; Location=1619..1836; Strand=-; Gene=SeqID_57401
agcagaaatgccaacggaggagagagaaaagccaaaaggaatattcattccgggctaaatttaatgacaattaaaagaattggaaagggtaattaggaatgaatgaatgtgggggctgttgcttcagctcaacgggccccttttatggggcagtaatatctttaatttttaaagattcatcctgaattggagaaagatcatccaaacgattaaacatg

SEQ ID NO: 114612 - DNA, 691 bp, Heterodera glycines
  misc_feature (12)..(12): n is a, c, g, or t
  Promoter: Source sequence=SeqID_8445; Location=1253..1943; Strand=-; Gene=SeqID_68096
caggtcaaatanagaccatgcaatattttagattaacacggtcccttttcgaattggctgattaaaaaagtgggcgacaaattcacatattgaggaccaagaaagggcaaattgtgccgagaataaataatgccataaattaaattctatttccattaattgtggagtgggtgccgagatgagtcagctgttaagtttcttaagctttaaaaagtaaccatttcctctttctagtgacatttcgcattatggcactataaaactccaaaaatagcattagcgatggtttgtgctactgtatttaaacaacagaagccgagcagagtttgtatgacatgacgaatttgttggggaatttggcgaagcgaagcgtaatgattggttattgtctgctgacaatttgacaaaatgatatggggcgggggcgggggaatatttgcagcacaaattccccccggggacatttttaatattttcgtgcgcggagaatttgcataattttcgctatcaaatgatagttttgtccttgtctcttcacgcattttttacaattcactgtcattattttttaatttttatttattcattttatttttcattttcaattagtccatttcatttttttattatttttctttttgttgtttttttctgttcaataaattggccgtccattcagcgaatatcaatg

SEQ ID NO: 114613 - DNA, 366 bp, Heterodera glycines
  Promoter: Source sequence=SeqID_11221; Location=1..366; Strand=+; Gene=SeqID_74580
gtacagtgatgacatagtcagagcatcggttcgcccagcagcatcagcaaccgctgcagccagaaacaaaagtggagcagagtcgtccgtgacaacatgtcactgcaacatcgcttgaacctccgccgccacatcacacgcctgctgttggtggccgcgctcgcgtgttgtcgccggcgaccaagcgtcgcgtgcatggcacaggcagcgacccaacaacgcagctgacgccttcgactgctgttgctgctggtggtggtggcggtgttgcagcggcgccacaactgaaccagcagcgcaagagtggcgtgtttgccaagttggccgagagtgggaagaagcagcgagcacaacagcagcagcatg

SEQ ID NO: 114614 - DNA, 481 bp, Heterodera glycines
  Promoter: Source sequence=SeqID_23600; Location=1..481; Strand=+; Gene=SeqID_54292
agtgaaataatgaatgaatgggattggagtgtagaaaaattgaatggaatgaatcacatttttgttcctcatctgccggtgactgacatttgtacacatgcatacgcgaaattcaatagatttgctcgatttaaagcgatcaaaagatcgaaaaatatccaaatctttttagaattttcattttttcatacaattttctctaagtctaatcctattcaattgagtgagcttaatactacttttttataagttttttctcacttttttagtttttttctttcgtaaatccgttaatcataaaattaattatcatttgactttttcatactcctttttgtcatattcttgaaccgcatgtcactcactataaacaaaaaagtcattaaatttgtttcgtaattgcctttttgccaattaggcaaacagttttctcttcatttgtacgcacgcaattctctccctctctttcctaatccaaatg

SEQ ID NO: 114615 - DNA, 160 bp, Heterodera glycines
  Promoter: Source sequence=SeqID_4091; Location=1243..1402; Strand=-; Gene=SeqID_53155
ttggcgacgatcgtctggtcggtcgcgtcattaaccttctgctgttggtggccaagttaagttcttcatcgaacgacctcgcaatgtctacgaggacaaaacgcctggcggcataaaatatgagcgtttgcagtttcccatcaaacctgcctttgccatg

SEQ ID NO: 114616 - DNA, 172 bp, Heterodera glycines
  misc_feature (5)..(5): n is a, c, g, or t
  Promoter: Source sequence=SeqID_10307; Location=57..228; Strand=+; Gene=SeqID_73473
tgtgncacagttaccgcaacgacaacaggtgcgtggcagtggaaaaaggacaccgtattcagtacaacatatcgtaaaagagagtgctcttctgagaatcaacaacagcgatgatgcatattgtcttttttacgctttggaggcaagcagaaaataccacagcaaagagatg

SEQ ID NO: 114617 - DNA, 95 bp, Heterodera glycines
  Promoter: Source sequence=SeqID_37284; Location=642..736; Strand=-; Gene=SeqID_66391
aatattttgtttgcaggaaatcgtccacaggatgaaaattttttggttttccacaaatatcttgtctgattttttccattttagggcggcagatg

SEQ ID NO: 114618 - DNA, 540 bp, Heterodera glycines
  Promoter: Source sequence=SeqID_25909; Location=831..1370; Strand=-; Gene=SeqID_45964
agcagccgccgggactggaccacatccactcaaaaggcatcatccattgcgacatcgccgccaggaactgctttcactcggactgcatggtgggtgagaacatgatggacgagggaggggtcagaaaaatttggtgccaaaatttaaggaaattgaaaaaaaaaaaatttttttgactttttttgcttttcaagagtgaagtgattgagaggggttttcaatggaatttaatttttctgttttttttcttccccaatttttatgtaaatgaattctttggtcgcttctttgctcacaaagctgcaacaacaatggcaaacgctcatttacgctgtttttcctctcaaactactgtagattttgctgctcatttgctttgtccaattcattgagtatgtttaaattcccccccccccatcgtccacatattatgggaaaacaaaattttcttataaaacattaattttgctcatttttaacaggtgaaaatttcggacttcggcttggcgcacaagggaaagatgaagaagatggacgatg

SEQ ID NO: 114619 - DNA, 838 bp, Heterodera glycines
  Promoter: Source sequence=SeqID_321; Location=3359..4196; Strand=-; Gene=SeqID_82139
agcgtgctcgactccgatctcaacaaacctggctcgtctgttcgtccgccctgcactgaccaaggaacaactcaaggaggaatatgaagcgcgtgtccgaaaacgccagaagcattaagttcattaccaccaactgacaaaattgttcatcaaattcaatcgctccaaaaacaataccctcatcttttcaataaataattctaccagacctccaacagccaatggggtgattaattagtcttaaatgtcctaaattttgtccgggaatttgtttaaatcatcatcaattccgccgattggaggtcaaactattgaacggcttctatttcttaaaaaactacaacccgccgatgatggcattttgattcgttaaaaaacagaaatttaggtgaaatccttaaaattttgattgctgtgatgccagaaggaacggagtgtgggagaaagtgggacaaaggacctgagagaacctctaaaaggaacgcccgtagctcagttggttagagcacggcacggattgctggggtcgtgggttcgattcccaccgggcgagttaccttttatgttctacattgcagctaacgaaaaaatcaccatcaccgttaaattgatttaatgaaatattaggatatgaaatttttttgaaatttctatcacccaaatgataatttttatggcttcaataaaaatttttattaattaattgtttaaataattattgttaattgtctaaataatatttattcttaaataaaactaattaaataattgattaaataataattgattattaattgtttcattccttaatggctaagtcacttcgaccagcaacatg

SEQ ID NO: 114620 - DNA, 494 bp, Heterodera glycines
  Promoter: Source sequence=SeqID_2476; Location=895..1388; Strand=+; Gene=SeqID_79930
ttttgcccattccaaatccggcatcctaatgaaaatgcccggggggagggggagggacgggcagtagcggttggtgggaacatcttccttcagcaatgccaatgccatttatgatgcctttggcataaagcagcttgttgctgtggcgaaggcgggcaatgcttgaaaaattccatggcgcatttgccgtcccatttcaaaatgcctattttcgaaaatgccaaaactgatttactgttttgtctataaaaatgattgaactgatggacccactactcattcacttttcttttcaattttgttccattttcatctgattcattttcatcaaaatttctttcatttcgttagtcattttgcgctttttccaatttccaatcctccgaaaccaaaaattattattattttttttttttataatttggcaaattaaattttatctttttttttaattgatagataaatcaattgaaatcattcaatactcaaatatg

SEQ ID NO: 114621 - DNA, 91 bp, Heterodera glycines
  Promoter: Source sequence=SeqID_16099; Location=515..605; Strand=+; Gene=SeqID_80455
agcatttgttggccacacttcaagtcaaacaaagcaacaaaaagcacaaaattatgacacaaattatgggcaaattggacgaaatacaatg

SEQ ID NO: 114622 - DNA, 1003 bp, Heterodera glycines
  Promoter: Source sequence=SeqID_6728; Location=610..1612; Strand=+; Gene=SeqID_62653
ctccaaaatgtagtattagaagaaaaaaaattattaaaatcaatggaaatctcaattatttccaaaatatgatgctattgtccactcggattttgccaaaaatctgtttatagccgatggtggtgagtttcatgaaagtgtttattatgagttcaatggtaaatgtttttattagggttaggtcgggaccgggaccaaaacacggacaactgagtaccaaggtcccggtttgactagttttgaccggaaccgggaaattcctggcttttttcccggttttccccgccaaaaagtcccggtttttcaacccgtaaagtcacggtcccggttttgcccaatattccggtcccgacctaccctaattttatcaccagttaaaatcaaaactgaatatttataaaatgcatatttaaaaacattttaaatgcacatcgcccatctgttctctttaaatctttttttaagaaaattttggcgcaaatttcaaaatttatgaaaaaaaccttaattaatttattgaattaactaattaataagttactcaattttcttattatttcaatcattaattaatattcagttacccattttactggaaaagaaaacaattttggcttgaatttatttgtcgatcaatgagagtaagtagcagctccctccgtagtaaactacctaattaattgcttgcaaatagaaccttaattcttttaaaaacggagcttaattgaaccaataaaagtatcaataacgttaatatatacaaaaaatcattcttttatctttttttaaatatttatacaaaaataaattaatttaaagccggcaattttaaaataattaaaaaatttgttacagattaacactaaattaaaaattctattttgaagttatttttggttaaagttgaccaaaacgtttaccttctgatagagctctttaaataagaaaactcataaatttaaaattgatttttttttaagtgcttgccatcaattgattaatg

SEQ ID NO: 114623 - DNA, 433 bp, Heterodera glycines
  Promoter: Source sequence=SeqID_12180; Location=1..433; Strand=+; Gene=SeqID_75756
ccgttaaatgttcagaacggaaatgctattaatctgctgctagtttggggaggggggatatcggattaccaaatgaatgaaatggagggggggggggcgaggatgggatgaatgcgattggagaatgttcaaaagggataaacacgaaatggtggataatgaaatgagtgggtcggcaaatataatgacgcaaaatctcaaaatagttaactaatagtggagaaataatgccaaaatggtttcaaaagttgccaaaaatttggtttcagcgaaataataaacaaaaaacaagcgagttgaaaaattttttgcaatttgctgaaatgaagattttttttatataattaagggaatttttgtctgaaatttcctacatgcaattaatgaaataaaatatgaaaaagccgcaaaaatagctaaatcactaaaaatg

SEQ ID NO: 114624 - DNA, 626 bp, Heterodera glycines
  Promoter: Source sequence=SeqID_2159; Location=7592..8217; Strand=-; Gene=SeqID_78163
aacaaaaaaaaatgtgtcaaaaaaaagtgaaaaaaatttcaaaaggttactctttgcaaatagcgtcaaatatgcagaagtttaaataggaacatttggttttcgcagttttaaattggttagaaatagagttgggtgatttttttcggaaacgggggaatacaccaaaagcagagcattttcctgttttgaaggcacactccaattttatttatttatcggtaaagaaaaattgccaacagaagaagggcggggatcacttactctgatgactgatcacagaaaatgtactcatagaagagtaagagaataaattaacgaacgaatgatcacagcttaaaataaaataaccaaaaaatttgtatttgatgtaattttggcagaaattgttttgcttttatgcctccaaaatatgtaagtctattaatattgaacgcttttgtgcattttaaaaaatgggtgtgccttaaaaacaggaaagtatccaaaaggaggacggaaaacaggaacgaagaagcgcacatgatagtaacaaataaatatgatatgcaattatcctatcaatttccattcataataatcgatcagaatttctaattccccaattattctttcactttttcatg

SEQ ID NO: 114625 - DNA, 339 bp, Heterodera glycines
  Promoter: Source sequence=SeqID_22803; Location=479..817; Strand=-; Gene=SeqID_53503
accggaaaatcggtcagtggaaaatgcgtcagtgataaaaatactttaaataaagttgtatggcatttgtattgtaatatagaaataaacttctataagaacatcgttctgcattctgaacgccggacccgaactcgaacaaaaaatcgaaaagtcaaaatttcgaaattagagtttttcttcaaaattggtttaaatacacggaaacaaactaaaagccatcagtctttcaataatagatcatgtatgccgttttgaacaaaaaatgctaaattcgaaaatttggactttcgagtttttgttcgaattcgggtctggggttcggatttggccgaaatg

SEQ ID NO: 114626 - DNA, 1003 bp, Heterodera glycines
  Promoter: Source sequence=SeqID_8045; Location=117..1119; Strand=-; Gene=SeqID_66819
aagataggatattttatttcgaatctacagtggataaattataaaaagtgcaatacggtattaatttatttagttgaaagtctattttcatcacttgtttatgtataaaaaatgctaaaatatgtatgaaatatgtacaaaaatcctcaaatatgtaaataaaatttttaatggttattttttggaaaaaaattcttcgtaaaaagtgaaataggcacaaaatgccataaaaatgaccaaaataggcttagaatcacagactaggtcgtttcggcgccagcccatgttttttgggtataacttttttctttgtaagccaaatcaaacaaacttggtatcattcgaaagtccttcacatgctctactagccttacaaaaaaaaaccaaaaaaattctagcctttaaaaaattattaagaaaaaacttcaaaaattttgacttttttgaaattttcatgtataacttttttggtatttgtctaatcgtaaagcaataccttagaaaagcttcaaaacatgttaagacttcgaatgataccaactatattagatttggtttagactaaaaaaagttatagtccgaaaacttgggctggcgccgaatcgggggctccgaaaagaataaaaaacgccggtttccgaggttcaccaattcaactgattccgatcaaattcattcaaattgttgaatttcgaaatttctttttttattgcagaattgttggttttcagtaaaccgatttagaactcaaaaacgaaaattgaactttcgacttagtgttcgaattcggacccggagtttggaatcggtcaaaatggacgccggtttcgtgatcagcgacctctaaaaaccacaggaaacttgtttttatgaaattaaaatttttgaacgttttcaaaaaagggcggggacaaactcaataataaaaaattgtttcttagccctttatttcaatttttattttttgctaattggcagtgagcaggaattgcgttccatgatg

SEQ ID NO: 114627 - DNA, 209 bp, Heterodera glycines
  Promoter: Source sequence=SeqID_370; Location=1433..1641; Strand=-; Gene=SeqID_84703
tttcaccaagaatgaatgttataacgactaatttcacttttatatactcaaaagttgggccacgcccatcatttagttactgattagccccgcccactctcacctaaataattcacctgactaaaaaccgaaatcattttaatttgtctgtccaaacccaaaatcatccttcattaattcaaaacaccaaaattattttatacaaaatg

SEQ ID NO: 114628 - DNA, 334 bp, Heterodera glycines
  Promoter: Source sequence=SeqID_5552; Location=1..334; Strand=+; Gene= SeqID_58428
ataagaatgttgtttactttttagtttttcatcgtaaaacaattttatgtccaatttaattttcacgcactattcgattatagacaaacataaagtacaaggcgaaaatgaaaaatgaaaagcacttgctgcgtttcataactgttcttggccacagaactaatgagcggcaaattcgctttaaaaatcggtaattacattttaggtgtaaacaaaaaattgtggcccccattcttttatggccaaacgtatcgctttttaacagatattcatttagtaaaaaattagaatattatttaattattgttgctaattttaaagattgataaaaatg

SEQ ID NO: 114629 - DNA, 79 bp, Heterodera glycines
  Promoter: Source sequence=SeqID_896; Location=269..347; Strand=+; Gene=SeqID_63486
tttgctgccgcccttttcactgcctctccctcgcgacgaacaacacaacgaatttatcaaattttacctcgaattgatg

SEQ ID NO: 114630 - DNA, 654 bp, Heterodera glycines
  Promoter: Source sequence=SeqID_11589; Location=1307..1960; Strand=-; Gene=SeqID_75034
tttctcggtctcggttcccggtaaaaatctccttctcctacaccccttatactcatggttttcctatcgacaaaatatgattcctcatttttttcttttgaattgacacatattttatcattttaaaagaaaatccgtgcaaattaagctagcaatctcaaaaatcagtgtttttttgttgaaaatctgttaacaaatcacactcaaattttcaaaatttcctccggcggcgcctatcggcaccaccggaacgcttttatttcccaaaaagttttttgcaaagagcgcgccgaaaaagtgatgtgaaaagcaaatctgaatttctaatattattcgataatttagtccaaaaatgattattgtttgaaataattgaaataaatttggtttgaaatattgattaaatatattataatttagttttgcgttaacttttgggttttataaaataaaaaaccaaacaaaaaattaatttttttttgtatttttttttgggaaatttcccggttggtcccagtcccggcttctcaggtcccggcaagtcccggtcccggttttggcaaaaattcccggtcccgtacaactctagttagtagtttaaaaaaaaagaaaaaaagttataaattaacaaaaaaattaattttctcagaaatg

SEQ ID NO: 114631 - DNA, 1003 bp, Heterodera glycines
  Promoter: Source sequence=SeqID_24776; Location=57..1059; Strand=+; Gene=SeqID_45881
tgagcaccttttgcctttcacatcatgctctcattcagtttttcaaaatctcttcaaattttttcaatgactatggtatgaatagaataaattgctcattagtagggctacaatttttaggtgctaaaaactgcaaaaatagttagtttttaggttctaaaaaaacctcaaaaataggtgctaaaaaggaaacaggtgccaaaaaccttcaaatttaagggaaaaccgtaaaattttatccaaaaagcaacaaaattaagcaaaatcagtattaactttaaataaaaaatttttataaagaaaaaaaagaaaaattttgaagacgaattttggaatttttttaggggtgtatttttgaaaatttcggatcgtttcttagggatgtatttttcgttttcagttaataattttggccaaaacgccaaaatagttaaagagttttttaaaaactttttagatgctaaaaactagaaaatagttgctaataataacccgctaatcgcgccttatgaacaaaaaaaaatgttttttcttattttctcttaggcaaaaagtgcttttccgtcagcccctttatttgtttgaatgtgttcatttggtttattcaatcattcataaatttaatcttaatttaatctttgtttaattctaaaaaaataggcaaaatgaattcaatttgagagttttctttctaattttggcaatttaatacatttgttcgccgattattaaattaataaatgttttcatttcgtttcttttgattattaaattaatttttgttttatttttgccaataattgaattttataacgaagaaacgaaaaccgactaaacaaattgcttatttatttggtccgttggcactgatttctgtcaaatatgttcatattattgtttttaatagaagaaacaaactcgaaataagaaatatgaattaaataataattagtaataattaattaaattagttaaatgaattttagataacttcgcatcaatg

SEQ ID NO: 114632 - DNA, 567 bp, Heterodera glycines
  Promoter: Source sequence=SeqID_3742; Location=1769..2335; Strand=+; Gene=SeqID_51698
tgcgaactttgcagacgcgttttaaccacctaaaaaagcgaaattgaaaaaaaaaattgtttcaagaggcattgtggtcagaatttttcggccatgccccccaaaaaaaacggttccaaattttcaatggatcaattgtttttgttttttgagaaacccgtctctttattagcctttaaaatttgaaaaaatggtttcattaacagctagcattttgctcttatctttttctgttgaaattattttttttttcaaatttggtacggaaatacggactgggtcggttgggccccgccgattggccccggtacgattgggccccgccgattgggccccatagagcagtcactacatggacaagggggggggggtcagaataaaagttatattgtcacatgttattgtttgcgtgtttcattgcatatttgtaaatatatttggtttcatatttgttttctaatttttttatattttccaattcttgattgcctaactaaaataccattaattcagcttattatttaatatattaatatcacgatggaaaataatatcttatcgaagatg

SEQ ID NO: 114633 - DNA, 93 bp, Heterodera glycines
  Promoter: Source sequence=SeqID_8136; Location=4661..4753; Strand=-; Gene=SeqID_67092
tcagcaaatgtagaaatgaaaaaatgaaatagtaatgacccgtgttaaataaaaaaaaacctttaattatttaggtaattagtttcatttatg

SEQ ID NO: 114634 - DNA, 55 bp, Heterodera glycines
  Promoter: Source sequence=SeqID_2291; Location=3548..3602; Strand=-; Gene=SeqID_78938
tttcctaaaataaacattttgccaggagagtgctgcgttcgtttacggtgccatg

SEQ ID NO: 114635 - DNA, 433 bp, Heterodera glycines
  misc_feature (6)..(6): n is a, c, g, or t
  Promoter: Source sequence=SeqID_31560; Location=1350..1782; Strand=-; Gene=SeqID_61891
ttgtgnataatctgggaacggatttatatgtcgctaaaaaactgccaaatatgtacatattatgtagcaaaatcccccaaaatatgtaccaaaaaaaattaaaaaaaagagcaaaatatatgccaatatatgccaaaaattgaaacaaaactgcttaaaaatatttgaatttcccaaaaattcaattattttatcagtttcggtagcataattgaaaatcaaaatcataaatgcctttaggcgttaatttaatttcaacgtgtcacaggtgatgatgataggaggcgacagaaaaattttgaacatttattagcattttgcatgaatttgaaagctaaaaaggaactttcaaaaaaaaaaaattttaatcgccaagtagtgccaaaaactgccaaaacccaaaatattttttatgagctaaaaaatcgctatg

SEQ ID NO: 114636 - DNA, 265 bp, Heterodera glycines
  Promoter: Source sequence=SeqID_13915; Location=1053..1317; Strand=-; Gene=SeqID_77866
aaaggtgtatcatgttttgatcacctacgaaaataaaaaaagtgggtaataaaactattcagaaatgatgatatagccgcggcgttaagtactctccaccgacacggatagtcttgttttctcacatctacgcgatgctttttagctgaataagatcgacactataagcagttcattgatggaaatcgtagaattctacactgctggtgtaaaatagtatgtgttggctttaagacgtataaatgttctacatgatgcggaaatg

SEQ ID NO: 114637 - DNA, 459 bp, Heterodera glycines
  Promoter: Source sequence=SeqID_3482; Location=1886..2344; Strand=-; Gene=SeqID_84857
tttaaaattatttaaattaaatttttagaaaaaataattgtcaattgtacatacattacggtaattactttcccttctgaaaatcttttatttgtgcgaacaacaagcgcatggtttatggcccattcgatggcaaattgggacagtttatgcaactgattctcattttttaccgcattttccacataatttagcacagttttgttgccttaatttaggattaaaaatatttttatttgttttttattaaagttttttaaaatttcctaaatattttggaaaatccccatgtaaaatacaaaaaaaaaatgttaagataaaatgccgaaaattgactatttactgttgtcaaaaactagtaaaaaaaatatggaaaattttttaataaaaatttaatttttaatcacccgaaattttccccatatttttaaatattttattaccttcaattgccacatg

SEQ ID NO: 114638 - DNA, 899 bp, Heterodera glycines
  Promoter: Source sequence=SeqID_7595; Location=401..1299; Strand=-; Gene=SeqID_65336
aaatttgaaaattggaatttttagttaatttgtttactaaatgtatcaattagcgttttcacagtgcgtgacttgaaaatgggtcagtgaatcagaatatcttggaaaaaacgagacccggtagtataatacttatatcttgattggtatctaaacaagcttacaacaacctatttacagtataatttttttagggattgggtaaatttcaaatttctttagactttaaagaaactttgaaaaaattcagaacgaagtttttaaacaatttcgaccttttataaatgctacagtactttaatttagaaatactgtattattgacttatttttccggtaacttacaataataaaatgtgtttaagataagttttcaagtccatttacacttacaaatttgcatttttattttttgtctgtttatttttcaaaatttgcttctgcccaccgattatcacataacgcgagcggagtttgataattatgaaaatgttaacgacaattactacgacgaaagtgagaataaattggagcaaaaaccttggaaaatggaaaatcaccttaatatgaaatttgaaaattaaattaaattaatttatttaaattttacatcgacaaatttccgttccgtctcatagctgcacttgaaagaggcggtggatgaaaattgaactgtcacagaatcatgcgcagtttttcgcagtgcaaaaaagtgatgggaactgatcagaagcaaaaggaacagccaggcacagatcactttccatcggttgagccccgaatactgtagcggaaaaggaaaagggcacagataaaatgccgaaacatttttatgatgtaaaatgaaatagaaatattcgactaaattatttccatttaaataaaaattaccctcaaatg

SEQ ID NO: 114639 - DNA, 644 bp, Heterodera glycines
  Promoter: Source sequence=SeqID_28757; Location=132..775; Strand=+; Gene=SeqID_59330
tctctctttcgattcacaaacgacacacactctctagtgcattaattgttcttttacatattaattgtgaatgacgcgacgccgcacatgatgtcatatttacagccgaataataacgggtcagactgctgctttattattaccatttttgtgaatgtttttctctttctttttgtttgcttgttttcatggacacaattatctacttattacaatactgtaattcaatgagagtttgactccgcatttaaattgatactccgatcgattaaaatgtgtgtaatgaaatgaaaatgcaaataaaataagttgccgaggatcattttgcttttgtcctattccattggttccgtgccaatttctctgccaatgaaagcaaatttccgtttcatttaccatatggtgtgctgttgaaatggaacttaaaaagacaaataatttatatctggcgaactgtttaaatttaaaaaaatcgcaaattttttttatcgaaggaaaaaaaacattaaagttaaacaaatttacctatgtatgtatgtgtgttcacgcaattaaaagctataactaacttaaccctttatgtgcactcgtatgataatttcttatttgagctttttgtattaaaataattttgctaaaaaatg

SEQ ID NO: 114640 - DNA, 151 bp, Heterodera glycines
  Promoter: Source sequence=SeqID_4027; Location=8222..8372; Strand=-; Gene=SeqID_52877
tttaatttttgttagagaatttaggccgcatatgcaaaacatacgaaattcaaaaaccttaaatatgtgccaaaaaagcaagatagaaatgtataaaaatatgtaaaatttaatttttgtctttatttagcaataaattaaacaattaatg

SEQ ID NO: 114641 - DNA, 1003 bp, Heterodera glycines
  Promoter: Source sequence=SeqID_7961; Location=1413..2415; Strand=+; Gene=SeqID_66514
ggtgtgaccatctaaactgcctattaccgaaaatctttgtggattttaaggctgatagagcttatgtagagttttataatgatgccaatattctaggattttgtcgacaatgaaaaaatgtctcattccaaaaaactcgagctggcgcctaactccgatactgaaaagacccattccctgaatacttaaccgaatataaattgtaaaggaaatgaaatgaaagaaatcggatttgtataggcaaaaagtggatggttgtaaaccgcgagacgaaaaaaggtttaattgaacaccacacgactgagactgacaaaagcaaaaataggtttgccaagtcctatccgtgcaatagtcaaagcagttaaaaatgaatatacctaaaataatgagtagtatgaaattagtatgcactaaaaatgccaaatatgcactcaaaatacctcagatatgcctaaaacccgaaaaatgcccaaatatggacgaaaatatgcttcaaaaactaccaaaaatggctttgaaccctcaaaaaatacagaaaattatgtaaaattcttaattgactttcaaaacataaaaacaatggctaaagagagttttttagagaattacaaaaattttgggttttttgtgaagcgcttttcttgtaaaaattacaaaaaatgcccgaaatacatatctctaaaaaagcaaaaatggtaaatatgcatttattctcgaaaatccctacaatatgcgtttataagcataaaaaacctccaccaaatcaaaaaaatttaacgtagaaattcccttttttattgcataaatagtaaatgtgtgatgatcaaatggaaaagtaaaccggaaaagtgcttcttttatataatggaggatagagaagaagaaaatcatactcctttttttgctaaattttttgtttcttttttggtcgtcatcattataaaaggaatgcattttctcagtttcgaccattccattcctcattcaacaacaacagataatg

SEQ ID NO: 114642 - DNA, 304 bp, Heterodera glycines
  Promoter: Source sequence=SeqID_5405; Location=2131..2434; Strand=-; Gene=SeqID_57915
tctttactttgatcataccttcttgactctgtctgatcagagggtctgccctctctctgatcagagtcccaattgggaaaattcgaattaaatttttgattcgaaaattacttgactcagattttcacttttggaacctttatttttcttgagtagctcgacccataaaatttgtttttatttggattctgttcaggagttagtaattgggcccaatgtatgtcaaaattcacgattgccggcccaaaaaacttaaaaataaatttaaaatttttttttacaggcaagtggatttgaacccatg

SEQ ID NO: 114643 - DNA, 555 bp, Heterodera glycines
  misc_feature (48)..(48): n is a, c, g, or t
  Promoter: Source sequence=SeqID_31483; Location=657..1211; Strand=-; Gene=SeqID_61816
ttggccaaagcggcgcactccgttaccccgaagacccttagagaatantttggaagacgccgccgaaaatttctcggcactttacaatgttggtgtgacgccgtagtggaaaaccgacacgctcaattttcgattgaaaactttgaaaagcaaaatgcaagtgtaaaaggcttcaaaattttgtattgtggccttattaattggtttccgacctcaaccctttgcctgaaccatttaatgccaattcattttacaaaattaatgtgaccatacgacgattcaattttgggctcccagtgaaataagtttattatttatttagtaatcagaacgccaaaactttgcaaaacaattcgcaacacaatctttcctttgttgcgtatatggtgttggttctcccccccccccccccatcctgctaatttgccttttcgttttaattttgcgcagcaatcatttattgatttgatattttttggaaattttacccgttttaaatgcttacaaatattttatttaaaatgccgaaacaattaaaattttatttagaatatg

SEQ ID NO: 114644 - DNA, 293 bp, Heterodera glycines
  Promoter: Source sequence=SeqID_27070; Location=1919..2211; Strand=-; Gene=SeqID_57788
atgatcatgaacattatatttatcaatcattccgaattctttgtttatttaaaaattaaacggtgaccctttttattttttctggcaaaaaaaaaaatcgtttttacaaaattttcggggttttgccttttttggttctaaaattcacaaaaaattatatgtattaaaactgaaacgctcactttgaatggagagaggggccttgcaaattttcaaaatgcaccgcttttaactttacataaaaaaaattataaatttttttttaaatccaaaatttttatgccagaacaatg

SEQ ID NO: 114645 - DNA, 770 bp, Heterodera glycines
  Promoter: Source sequence=SeqID_9417; Location=1..770; Strand=+; Gene= SeqID_71339
attaattataacagattcttaaaccacagtaatcaaaattgggctaatcttttcaaatgtacagtaatttccctatgcttttgattttatttggtcaaatttgagtgcattattggttcaaaacaatgggttagcaataaaaagagtaaatgttggcattttatgattaatgtcttacttttaaccacagactcattaattcaaatgtgacattagtttcaattactaatttctgggaataatttcaggttttctgttcgcatctgactgacaaattggactttgttgtgagcctcggcatctgcaaattgcctttgaagcccaattaagtgagtccaattaatcaatgacatccaattatttcacacattgggggtgagtgattaattaattaaatggtgtgtacccatgcattttggcttcaatttaatgcatttattaaatttcaaaaatggtaattacagtaattttttttcttttcgataaaatcaaatctgtgacaatcaaatttaaaattttgttttctctctctaattaatcaaccaatccaaaaaaaataattttgtatcaatgatatgataatgcttaacatatatgtctataatcttttgtttttataattttggtgcatttctaataataattgaagtttattgggataaccttaaatagtgttttcttcttaaaattttttggggattattgatcattggcacttattaattcaaattaattgcgtaattatttaattattataattcattcagatg

SEQ ID NO: 114646 - DNA, 122 bp, Heterodera glycines
  Promoter: Source sequence=SeqID_15841; Location=513..634; Strand=-; Gene=SeqID_80172
ttctgcgttaatttttcatatcactttttcatttttattttgcttttttcgtttgttaatcatctcacacatacatttgtagcctttcctatattttgtcacatttatttcctttttaaatg

SEQ ID NO: 114647 - DNA, 1003 bp, Heterodera glycines
  Promoter: Source sequence=SeqID_5933; Location=136..1138; Strand=+; Gene=SeqID_59724
aataaattatggagacgaatttttgggaaaatttttcatttcttatgggttattttctgaaattttggtcaattttcaggggtatattttcttaaatttttgggaccgattcttattggtgtatttcgtttttattgcactgtttttttgtgaaatttatattttatttaaacattttttctttcgaaaaaatcttctttcaacatccttctccattttaaaacataatggaatataagtttttaaattcttattatttttattcttctttatgttcataattcttcaattgcaaaaggttgtattattttgattccaaaaaataattataaattatatttttataaattacctgaaaaagcatcagtggaaaattcacatgaatcttttaccaccataattattttcaccgtttaaaaaccgctaattggccaagaccaaattaacgtaatcgtccaactgctcttataattattaaaataaatattattatttctatattttctttatgcgttatgtgcaggcattttttttggcaacctagatctttccttgagctgggtttccttgagttttttaccccgaactcaatccaggccaaatattcaaaaaatacgggtccaggcacaggctcggcacgaattttctggatttttttagggtttatttcaagtgaccaatgttttatttgaagttatcaaaaaaagattaaatagatttacataagattcaatttgtacttttatatgttcctaatcaattaattgttatccaagtccaggtccaggattttccaaaatgtcgtacactaattaacaccaaacgcagttttttaaacctaaaacccaaaaagacatttttataacgagaattatgtcaagaatactgtgcaacagcacaatttgtgctggtgacaacggttaagcattcgtcgtagcattggttggttcaacaactgtgtgtgaatatgaagaagcataaaaattgggaagtgtgatacatg

SEQ ID NO: 114648 - DNA, 1003 bp, Heterodera glycines
  Promoter: Source sequence=SeqID_13567; Location=111..1113; Strand=+; Gene=SeqID_77469
agggattgattgtccaaatctatattttacttaatataatttatttattatattaaataataatgaagtatgtaaaaaatagggattgatcatcagtaggattgtccaaatctatattttacttaatataatttatttattatattaaataataatgaagtatgtaaaaaatagggattgattgtccaaatctatattttacttaatataatttatttattatattaaataataatgaagtatgtaaaaaatagggattgatcatcagtaggattgtccaaatccatattttacttattatattaaataataatgaagtatgtaaaaaatagggattgatcatcagtaggattgtccaaatctatattttacttaatataatttatttattatattaaataataatgaagtatgtaaaaaatagggattgatcatcagtaggattatccaaatctatattttacttaatataatttatttattatattaaataataatgaagtatgtaaaaaatagggattgatcatcagtaggattgtccaaatctatattttacttaatataatgtgtttttatattaaatgatgaagcaatatttaaaaaaattgggattaatcataagtgtgccaattttggcggatgtttttgttaagtaataaattttttattgaaaaacaaaaactatgacttacaataataaaaagcaatgtaaagattttatttgtcgaccaattcaattaaaaaattaatatgccgataacttatttaaaaattttaacaattatgaattaattaatacatcaaatagtaaaaaattaatgtagaatacgacccattattaatcagaatcccctattttcggttttaataataaataaaaatatattttaaataattttaaatttagaaaatttaaaaaataaaatgcaattgctcttcacattcccaattctgttggtcattctgtttgcaaacattgaccagaactaacattttgctgatg

SEQ ID NO: 114649 - DNA, 81 bp, Heterodera glycines
  misc_feature (30)..(30): n is a, c, g, or t
  Promoter: Source sequence=SeqID_22644; Location=1770..1850; Strand=-; Gene=SeqID_53316
ggaaaatttccgggttttgagggtcaaaanagccaatttgtctgttgggggacgttctattagaggttttttggaaaaatg

SEQ ID NO: 114650 - DNA, 248 bp, Heterodera glycines
  Promoter: Source sequence=SeqID_8408; Location=1739..1986; Strand=-; Gene=SeqID_67961
aaaaaaattgaaaacttcaatgcaatatattaacagaatttgtacaaaattgctaatttttttgaaaaaaattcaaaaaaaaaatttccgtaaatttccgactttttatataaaatttcggaaatcggaactcggaattccgaagtccaaattttttttcggaaatcggaattccgactcccaaaaatgtcggaaatcggaattccgaccccaaaaaggtcgaaatcggaattccgactccaaaaatg

SEQ ID NO: 114651 - DNA, 368 bp, Heterodera glycines
  Promoter: Source sequence=SeqID_38566; Location=883..1250; Strand=-; Gene=SeqID_67342
tttttttataaaaatttaatggagccaaaatccggcgctatttgcaaagatgtgctatttgaatttgttgtcgcatttttacgaccggtgtctctaataggaggtctggcacaggaagatccaaatcaaaattgaggaattgacggatgaactggcagaggaaacccacagaagaaatgtgacaagaagaggcaaaggagttgggaaaggagaacgagcgctttgagaaccccccggagccgccaagagagcgcaggcctttctattccagcgccgtggcgcgctttgagtgccaaagcgaattggactcagcgtcgaaactaagaggaagagaagaaagaggggacagagaaaggaacttgggaatg

SEQ ID NO: 114652 - DNA, 943 bp, Heterodera glycines
  Promoter: Source sequence=SeqID_26933; Location=563..1505; Strand=+; Gene=SeqID_57670
tttttgctattcgaaaatatttgtaaagaaaaataatttatttgagaatttttttgaatggattgctcaatatgaagaatttttaattaatgtgaatttttttattatttgttaattttattacatattagctaaaaatgaagtcaataaatgtccaattaattgtaaaaaagtaataataaaattttgcaaaaattatatcttttctcgtttttcattctttaaatctattgaaaacttataaatattaagaatgcaaaaagatatggacacaaaaaaaaataattaaattacacaaaaccattctgttatttgcttaaatttcaaaaaatttctaactgatataaggaattttttttttaaatttccaataatccattggactggaagcattttgacttacgaatgttgttataaccatgattatatgctgtgtaaacaaatggacaaaacgctacaattgcggcaataacttttgaaattatgtttagaatttgttatgctggtcaattaatatttttcgtgacattttaaagatcagaaataaatgtaaataaacagattaaaattcaaaagatttgacatctctttatcttgaaaattccgtcataaaaattttttcaacttcattaattctaaaaaaaataattgaccgaaacaaaaataaatgggaaagttaatgataagcaaaaagtaaagtgtgactggttcagcttattatggagaaaaacttatgtgttcataaaacgagatggatggacgacggccggggctttttctgacaaaaaacctcggtctgtgtgcaaaagcaactggtcttttagcgcatgaaaaaatgagcgaagagcccccgggggtgagagtaattgcgatcaaaaaaaactcctaaaattcgcgtataaattgcgacttcccatcgcatcgcataaataataaaatcatg

SEQ ID NO: 114653 - DNA, 94 bp, Heterodera glycines
  misc_feature (58)..(58): n is a, c, g, or t
  Promoter: Source sequence=SeqID_35594; Location=1..94; Strand=+; Gene= SeqID_65123
tgatttctgtaattgaaaatcagttacgcacagccctacccttaccgaaaaaaccagngatctccgatcacatatacaaaatctaaaaaaaatg

SEQ ID NO: 114654 - DNA, 552 bp, Heterodera glycines
  Promoter: Source sequence=SeqID_4516; Location=2983..3534; Strand=-; Gene=SeqID_54737
agtacggtagcacagttcacatgctcgcatcaaattttttaaattttcattagagcattaaaaaaatgactattcgcatgaaaatcctaatttttaaaacattaaaaatttcaagcaaaactaggttaaagtaattttttcatttgaaaaaacactaaattgatccacttcttgtcattttataagcattatgggggtgggctttgagtaggataaatcgactaaatgatcaattattcaggatcttgagtcaattctataaaaaaattctaggatttgaggttaggcagtgccgaaaactttttaaatttactggattttatcagattttggaaatatttggatttttgaaaaaaaatcctcaaatttacccaaagatctcaagaatgttcatactcattttcaaagatttccaattgagtataaatcagaatatggcccgaccccctgggttgtgatttttttgaaacataattttagcagtattcatttcggttttttagcgcataaatcccagccccaataaaactattattattaatccaggaaatg

SEQ ID NO: 114655 - DNA, 1003 bp, Heterodera glycines
  Promoter: Source sequence=SeqID_3038; Location=6699..7701; Strand=-; Gene=SeqID_82891
caagtgtccttatttctctagcatttgtccttattttgttaatattcagtaaatgaaaatatctcaaattttcttaattggttttttaaagattaaattagccatttttttgctgcaaaatgaaaccgtatcggatttttggccataatcggaatcggcgatttaatcggaatcggattttgtctggctcggcacatccctgctgtgtatgtgtaaataaaaagttattgttgttgtttttttacgtcaaccaattctttcacgcattccctttcgatctatgtaaatttgtaaatcgaagtcgaccgcaaaacagtaaatttagttagttttaccatttttgatagttttttgggaaaaacaaaattattacctcatttatttattattataatttccatattcaacaatttttattgcaattttttcttagaaatttcaatgtcgagcagtttgcaggaccggtttaagctgatgttgagcacgggcgatggggcggacgttcactttttggttgggaaagaaaaggaggtgaattgaacacaaaaaatttaaaaaagagaaaagctccagtggtagcacgcaacaattatttagatggtctaaaagtcgcaattatacataaatctactcttaagtcgataatttaagcactaagaacgggaaaagaacgaatggcgttgttcaaatgctaatttatacgctggacacacataaagcgcgcgtcgctttttaaaaatttggaggtgtggccgcatggtcgaaaagtaccaaaaaatgatactttctgacagactgaaatgagtgaggcctctgaaatttatcttttgggtttaaaacttcaatgataaattcatttctattccgagttttttatttagcttttggtagcacacaaatgcgtgatgatgttcgcttctgatgtgtttgggtcgatgttccgttttgatgataaaaacgcaaagacaaaaagtaaaaaaaatcgaaatattttttaaaaatg

SEQ ID NO: 114656 - DNA, 193 bp, Heterodera glycines
  Promoter: Source sequence=SeqID_41292; Location=659..851; Strand=-; Gene=SeqID_69456
aaaatttttagcggtgcctatctgttccgccgttctcctatttttatgtttacaagttcggtctctaacaattgattttctttttatttttttaattcaaaatttcgtttttttctttcaaaatgtccataacatttacatatgttttattgttcattgaatttaagccatttcattttatttccaccaaatg

SEQ ID NO: 114657 - DNA, 569 bp, Heterodera glycines
  Promoter: Source sequence=SeqID_3896; Location=1..569; Strand=+; Gene= SeqID_52330
attcaaatgcacgaaatggtcgttcgttggcagtcgtgcgattctccattcaaaatctattggccgttgtccatcgctctttcattttgatcgtcttttgtgaccacgagtcgctgcagtgtgaattttggtgaaaaataaattttcgatttttgttcgaatttgggtccggggttcgaaacggatgccggattcgtgatcagtggccccaaaaacccaaggagagatgttttaagcgattttaaaatttatttattttttttgaaaaatagggggtacaaaccaaagtattcctacattttttcaaaaaatgcacccccaagaattggaaaattttcttaaaaattcttcccacaatttttttttagttaactatttcgagattttccgtcactaaaagtagcgactctactctgatgatgatgcagtgctggatggagtcggagatgggaacgaattgttcatttattagccccttttactgttgaattgagtttaattttttttttggaaaatgtgccaaaaaaattatttaaaaaattctatttatcccccctggcacataaatg

SEQ ID NO: 114658 - DNA, 393 bp, Heterodera glycines
  Promoter: Source sequence=SeqID_14455; Location=1..393; Strand=+; Gene=SeqID_78499
ttcttggtatcaaaagaaagcttatttgtcccgggaattcataaatccaagaaaagagcaaacactcgacaacaagaaaaaaaatacaacgagaaacactaaatttaacttatttttttgagtatattcaaaaattatttttggtctgttgcttcgagcccagaattttgatatactcaaaaattctatagacttagatagttttaatttaatattaaaaaagtaggtattgattgaccgagttagaattatggccaaagaaactgaagattgggctcataaaagtcgattggactcctaaattgaaaatggagtcttggttttatgaattcaaactactttttcctgtatttaaagcatttttttttcgttgttaaaggtccaactggaatg

SEQ ID NO: 114659 - DNA, 192 bp, Heterodera glycines
  Promoter: Source sequence=SeqID_40606; Location=910..1101; Strand=+; Gene=SeqID_68882
ttgagaaaataactctgaattacaattttgggttgggccagattcaaattcaggcatatttaaattggcattttattcgtgtcactcgggactgaaaatttcacttgacccaaggctcgagactgccaaaaactcaagaccgagacgtttttttaattttttttttactaaatgatttttttagtaataatg

SEQ ID NO: 114660 - DNA, 123 bp, Heterodera glycines
  Promoter: Source sequence=SeqID_21840; Location=985..1107; Strand=-; Gene=SeqID_52474
tgcaaatcagtgagaaattcatttgggaatgcggtattttacaatttaaattaaaaactaaaattttattagtcatttattatttccattaaatttttttaaaggcactccgttgggccgatg

SEQ ID NO: 114661 - DNA, 104 bp, Heterodera glycines
  Promoter: Source sequence=SeqID_34770; Location=1236..1339; Strand=-; Gene=SeqID_64479
ttaaaaacaaaccattttgaaaaaatcaatttcatttagttatataaaggataattaattttatgaataaaaatatatggattatattatagacacaaaagatg

SEQ ID NO: 114662 - DNA, 484 bp, Heterodera glycines
  Promoter: Source sequence=SeqID_2025; Location=1807..2290; Strand=+; Gene=SeqID_77373
tgtatggagggggagaaacagcggataaaggcgcgggggggggggtcaaattcggcaggatttagacggacgaatcccaaacttgaaataggccaactcgtactgtgtttcgacaaataacgttgtaaatttaaccaaattaacatttttgatgtcataactgccctaaacttaatttattattgaaaaaagttatggacacaaaatttttttttactatttttggtcaactttttcgtgtaaacaataaaactttcttaagttttgcttgtagattaaaaagcttaagggtctattgaagggtaccaagaatgtttaattcggtcgattttgacagaagttatgacgatttttttgtttttttaaagcagtgcgagttggttttttgccaattcttacccttccaatcagatccagaaattgtcaaacaaaagataggatttctgcaataggtacggtatcaaaaaacgtatttgcacagatg

SEQ ID NO: 114663 - DNA, 141 bp, Heterodera glycines
  misc_feature (114)..(114): n is a, c, g, or t
  Promoter: Source sequence=SeqID_8692; Location=3053..3193; Strand=-; Gene=SeqID_68863
tgattatagagggctgaactctgtaacaagtaaagatgcatttcctttaccaaaccattgatatagcccttgttagcgctcggcggaaaaaagtttttctcggtcatcgatttnatgtcaggatattggcagataagaatg

SEQ ID NO: 114664 - DNA, 259 bp, Heterodera glycines
  Promoter: Source sequence=SeqID_6225; Location=1..259; Strand=+; Gene= SeqID_60784
aaatcaaaaattgttcggagataatgctatttttggacttctctcgccatacctaagccgcaaaaaaaatatgtaaaaacataaaaatccgggccctagcgatcactgatctgcaacgcataaaactatagtgaacaaattttcacgaaaagatgataataagaccatatctgggacttagaacttgtatcaaattaatagattaattgttggttaatctctattacgactaacttcaatcgtttctcagcaaaatatg

SEQ ID NO: 114665 - DNA, 644 bp, Heterodera glycines
  Promoter: Source sequence=SeqID_28757; Location=130..773; Strand=-; Gene=SeqID_59331
ttttttagcaaaattattttaatacaaaaagctcaaataagaaattatcatacgagtgcacataaagggttaagttagttatagcttttaattgcgtgaacacacatacatacataggtaaatttgtttaactttaatgttttttttccttcgataaaaaaaatttgcgatttttttaaatttaaacagttcgccagatataaattatttgtctttttaagttccatttcaacagcacaccatatggtaaatgaaacggaaatttgctttcattggcagagaaattggcacggaaccaatggaataggacaaaagcaaaatgatcctcggcaacttattttatttgcattttcatttcattacacacattttaatcgatcggagtatcaatttaaatgcggagtcaaactctcattgaattacagtattgtaataagtagataattgtgtccatgaaaacaagcaaacaaaaagaaagagaaaaacattcacaaaaatggtaataataaagcagcagtctgacccgttattattcggctgtaaatatgacatcatgtgcggcgtcgcgtcattcacaattaatatgtaaaagaacaattaatgcactagagagtgtgtgtcgtttgtgaatcgaaagagagatg

SEQ ID NO: 114666 - DNA, 94 bp, Heterodera glycines
  Promoter: Source sequence=SeqID_3053; Location=1201..1294; Strand=-; Gene=SeqID_82983
tgtgagaacatggagagagaggcggacggatgcaattgaccacgattatattttattgatgccgagctttccttatcattccgttcacaaaatg

SEQ ID NO: 114667 - DNA, 96 bp, Heterodera glycines
  Promoter: Source sequence=SeqID_1516; Location=1431..1526; Strand=-; Gene=SeqID_74147
tttttccattatttaatttccattttttaaaatttttaaaacttttgcaagattctgactttggcacattttgccacatttaaaaattgcaagatg

SEQ ID NO: 114668 - DNA, 90 bp, Heterodera glycines
  Promoter: Source sequence=SeqID_11688; Location=400..489; Strand=+; Gene=SeqID_75171
tttcagaatgtcaagctctaatgtgtaccagggatggcattccgagtccccaaaaattttcagaaatcggaattccgggtgtcaaaaatg

SEQ ID NO: 114669 - DNA, 73 bp, Heterodera glycines
  Promoter: Source sequence=SeqID_4403; Location=1172..1244; Strand=-; Gene=SeqID_54330
cctaaaaaaacatacctatttggggccatttaatgcggcgcattttgacattttataacttttcttataaatg

SEQ ID NO: 114670 - DNA, 176 bp, Heterodera glycines
  Promoter: Source sequence=SeqID_19578; Location=666..841; Strand=+; Gene=SeqID_84317
aaaattagaaattaaattaaattgaataaaattttcctttaattaaaataaataaatattaatcattttttataataaatttccctgttttttaaagctgttcggtggaattgccggggaagttaagcgcttttaaatgtaaaaattgtggaaagtgtttgcaatctttggatatg

SEQ ID NO: 114671 - DNA, 315 bp, Heterodera glycines
  Promoter: Source sequence=SeqID_14629; Location=2368..2682; Strand=-; Gene=SeqID_78716
ttgctaaaatttttgattgtttttccaaattattttctcagagacttaaacatataaaatattatataatttataaattgctacgcaaatgtttagtgatttattgtgaaattgattaattccccccggatttcctatgcggaaatcaaaaaatattggcttaggagtaataaatggttgttgttttcatttgatgcattcattcattcagtcttcactttctttctttctccattttttttttgtttatgaattacaataaaataatataaaaataaaaatttaatttttagaattttaatgtttatttctatg

SEQ ID NO: 114672 - DNA, 403 bp, Heterodera glycines
  Promoter: Source sequence=SeqID_14215; Location=1732..2134; Strand=-; Gene=SeqID_78233
ttttatggtcaaattttgtggcaatttgttaaattttagtgtgtttaaactgaagataattattccttttattacataaaactacaaattcgccatcgccctgaatttgtgcaccttcttgcagaaacagcaagcatttttgtagaaatcatcgcaaaaagaatgaatgcgaagagaaaaaagtgatcgtctttgttgaaagtactctgacatccatttttaatttaattttggaaaagttgcctatcaaatttgtcaatttgacgcattgcctaaacaggacgtatcaattcaaacggcgataaagttcgtcagatcaaattggcataaaagtgaagcaggaaactgagactgtccaactgctcagacgaagaaaagatgacctgtctattattaaaggatg

SEQ ID NO: 114673 - DNA, 158 bp, Heterodera glycines
  misc_feature (101)..(102): n is a, c, g, or t
  misc_feature (121)..(121): n is a, c, g, or t
  misc_feature (128)..(128): n is a, c, g, or t
  Promoter: Source sequence=SeqID_29176; Location=1..158; Strand=+; Gene=SeqID_59717
gcatttgaataagctgaaagctcatgcacaggtgcttcgccgtctcgcccgcacacgctgctctcgctcagccaaaaagtttttgctacagcacgagatgnncctcccagctattgtgggnctcatgncgtcaattgctcttccgcttattgcggatg

SEQ ID NO: 114674 - DNA, 89 bp, Heterodera glycines
  Promoter: Source sequence=SeqID_35737; Location=989..1077; Strand=-; Gene=SeqID_65220
atttaaaaaatacctaattttttcggggattgaatttggcggagaatgaggacgatgatgatgatgatggggaacgattgattgtcatg

SEQ ID NO: 114675 - DNA, 265 bp, Heterodera glycines
  Promoter: Source sequence=SeqID_1302; Location=4421..4685; Strand=+; Gene=SeqID_72088
attatatttaaagaatttgttaaatataagtaacaacaacaaaaataactaaataaaaatgattgatgacaccgtttttagttcaaacgacttaaagttaaaattgccttttggaatggtcatcagtggaccgtcgagtagtggcaaaacaacatttttgttaaaatttttaagagagagaaatgaattgattagcccacaaccaaagtcagtgctatattgttatggacaatttaatgatagtattcctatactacaaaaaatg

SEQ ID NO: 114676 - DNA, 555 bp, Heterodera glycines
  Promoter: Source sequence=SeqID_16969; Location=1..555; Strand=+; Gene=SeqID_81394
acaaaccctatctttttggtatcattcgaaagcgcacagtctaacgaagctaaaatatataaaaccgcagcgttcaggcaattaccaaaaaagatttgattaattaagtaattgctgattattttcgtttgtaactttcttgaaatgttagaattctcttgttttctcgtattattacattattcagactttgcgctttcgaatgatacaaaaaaggtagggtttgtcaacatgaacaaagttattgtataaaaacccgggattgtcaattgattggactcataaagtgcattagagccgaaagtttttccttgtaaaacatagtcccgctggtcgccgccacgattatatacatatgacactcattttgccaaattcgaacaaatcccatcgaaaatttacttcttccgatacttacttattggagttccacataactgttttaaacatgcgaaaatttgtccaaaaacttaaaattaattccaaaaaaacgcatgattctaataagcaataattttttgttattttttacagtgtcgtcaagagttcaaaatg

SEQ ID NO: 114677 - DNA, 86 bp, Heterodera glycines
  misc_feature (25)..(25): n is a, c, g, or t
  Promoter: Source sequence=SeqID_45403; Location=1..86; Strand=+; Gene= SeqID_72701
gcatttaattaaataaaattattanttcgctataacaagctaattaatgcaaagattctgcgcatgccatcgattcgattggcatg

SEQ ID NO: 114678 - DNA, 584 bp, Heterodera glycines
  Promoter: Source sequence=SeqID_8933; Location=504..1087; Strand=+; Gene=SeqID_69704
tgatatgaatagccggccgagaaaaactaaaaaaaaatctttttttaatcatacgcaacgaattatttacaggcaaaaaaaagtaaacataaatttgtattttatttgcataaaaaatatgttgatcattttggtgttcctttttatggatgttattttcatgatatggcgaggatttttagaagcgaaatcccccagaagagatgccttaactaggagtgaaaaaagtcgaaaaaaccatgttgtttttccaaagataaaaaaaactgagaaaatttaggactttcaaaaacaaaaataaggaaaaaatacaaaacgccaaacaaaggaacagttcgaaaaaaaatttcatttcttcccaaatattgatagacagaaaaaaaatggaaaaaagcatcctagaagcttcaaaataacctagactagaaaatgcaaaaaaggaagaaaatactgtaaaattttttttttatgtttttcatgaatccacaatatatatttttttggtgaaaatattaactcaagtatttttcagagaattacataacgggtaaaatatcgctgaattgttttttttcattataatg

SEQ ID NO: 114679 - DNA, 460 bp, Heterodera glycines
  misc_feature (31)..(31): n is a, c, g, or t
  misc_feature (33)..(33): n is a, c, g, or t
  misc_feature (42)..(43): n is a, c, g, or t
  Promoter: Source sequence=SeqID_13190; Location=927..1386; Strand=-; Gene=SeqID_77013
ataattaaagtattatacctctaaaagggangnagcagcagnngagagacgaagaaaaaccttttaaaaagcagaggaacgggcagccaaacggacgaaaagccaacgggagaaaacggaagacaaagcaaacaaatttgaaaaaaaaaacaaaactgaaactctaaaaaaaccggcgaaaaatgggaaccaaaagaatgggaaagaaacggaaatgaaaaaaatgaaaaggaaaacagcaaaaacaccgaaaatacataccaaaatcagcgcgaaactctgaaaacgattttggcagcgattggcgacggaaacaatgggacgatggaaattttggcaaaaagtataatttaatcatttaaacatttattttttaattaattttcaattcatcacagattccaatggcgacggttcgtcgcgcagacgaagacgcaaaaagcgtgccaccaccaacatg

SEQ ID NO: 114680 - DNA, 392 bp, Heterodera glycines
  Promoter: Source sequence=SeqID_26192; Location=1298..1689; Strand=-; Gene=SeqID_56940
ctctcccgccactctttctcttttttgcttctcccccccattcaatttgttctccccccccccacccctccccgctggcccctccgatgcattctcgggagaggtatcattctcgaccttccaaacaaaaacattaaaaatgcaatttgttttccctgtcaaaactatgtctgatttggctgatctataaacgtgatgataacggattctctactagtaattagcaactatttaagcgccagtaattgtttttttttcataggttcatttttccaaattgtgtctcatcaaaattacaaacagtttccatttagcagctatcaaagcatagacattcaattattgtcctgaaccaaattcggccacccaaaatcattctttttttaagaatg

SEQ ID NO: 114681 - DNA, 356 bp, Heterodera glycines
  Promoter: Source sequence=SeqID_15899; Location=664..1019; Strand=-; Gene=SeqID_80241
ttaagaaattgacatggaaaggaaatgacgaaaaataaatacactaattgatcgataattagtgatccaaattaatttttgtatggtatggtgtttacgaaaataaacgcataaaactagaaagaacacacctacacagaaacaagggaatttagttttgaaattgcaaaagaaaaagtttggcaatataatttatttttttttaaatttaaaagttggcaaataattttattttttaaagaatttgttaaaacagcttaattttcattttttttttacttagaaacattgaaaacataacttttctttttagtcatttcttctgagcaaatacctaaattcgaagtctaaaaatg

SEQ ID NO: 114682 - DNA, 411 bp, Heterodera glycines
  Promoter: Source sequence=SeqID_12011; Location=1..411; Strand=+; Gene=SeqID_75537
ggtaagtgagtgttcccagggacctttcagctcggcgttaggcctcgttttgtacgtcgaacggcacgcacagaaaaatggcaacaaaaccattaagttcgccaccatcgctgcccctgaattgcccaccatcatgcgcattcaacgacggcacatgtctgaagcgatggcaaacgaactgcactcgcagagcttggttcaaatgcagcttgtgaccatcaatcgtccgcaaggagtgctcatttcacagcactacttcctgcccatgggttttcctttcaaaaatggcgacgaaattttggcattcaatgccaaaataattgccaaggtcgacccgaaagccggatttatgcatatccttttgacagcaactccacatgggaacaaattggatttggagagcgagttatg

SEQ ID NO: 114683 - DNA, 484 bp, Heterodera glycines
  Promoter: Source sequence=SeqID_31902; Location=1..484; Strand=+; Gene=SeqID_62212
aaattaaaatcaatttaaataaaaatatcgcatttaaattaaatttatttaaaacaatatcgtttttaaattaattatttgttcatttccaaattctcatattcctaaactatgaggatcgcttagcggccaatagatgctttttgcacgccccaaattatatctcccactagagccagcgttgaaagcgcccccggcgctttcacagggcccgcagggccctggttcaatttaatttaaaaatgcgttttttatttaaacatattttttatttttaaggtattgccagaagaagtttaacatgctgtatgtttaaaagaacaatttatattttctcagttttataggaaattgaacaatttgtaaattcaaccccccgccaaaaaattttttttgttgctaaatttattaaaattagaggcagtgaatcggtttcaattctcggtaaaacacttcgcacatcgttactataaaaaaaaacatg

SEQ ID NO: 114684 - DNA, 87 bp, Heterodera glycines
  Promoter: Source sequence=SeqID_34050; Location=398..484; Strand=-; Gene=SeqID_63944
ttcccaataacatttccgaaatggtatgctttttatgaattatccactatactaacaattaatatttagttttcaaaaatgcacatg

SEQ ID NO: 114685 - DNA, 210 bp, Heterodera glycines
  Promoter: Source sequence=SeqID_38018; Location=1160..1369; Strand=-; Gene=SeqID_66959
tttattaatccattccgatcagaaggaataaacgccgagagggacggacggatttatgggaaccaaaagcaaaattcccaatttgatttcattttttgaattaattattattaattaattcgggaattgaatggtcagttctttttttattttgaattcgaattttaaataatttttcaaaatttagcagaattttctgagtttataatg

SEQ ID NO: 114686 - DNA, 97 bp, Heterodera glycines
  Promoter: Source sequence=SeqID_25346; Location=1..97; Strand=+; Gene= SeqID_56095
tttacaccaggttttgggactttacagagtgacaccccacccagcaacaaattcatcaccagctgaaaagctattcggtcgcaaattgcgtaccatg

SEQ ID NO: 114687 - DNA, 556 bp, Heterodera glycines
  misc_feature (8)..(9): n is a, c, g, or t
  Promoter: Source sequence=SeqID_4000; Location=1872..2427; Strand=-; Gene=SeqID_52768
gcctgcannggtcatgagaaagcaattaaaaatgaattaattgaaatgaaaaagaaattaatagttaataattgaagcaatttaaaaataattaattgataataaaaaagcaattaaaaaattaattaattgataatgagaaaaagcaattaaaaattaagctaaacctattaccgtttaaattttgaaattaattattggtaatgagaaagaaataaaaaataattaaaggtaaagaaaaaacaattgaagcatttaaaaaattaatgaattggtaatgaaaaaagcaattaaaaataaattaagccaaatgaattgccatttcaattttgaaattaattaattacttcttcagaccgaaaattatgtgaagaaaatgttcaatttaatttcgaacttacacgccctcatttggaggttaaatttccagaaattacccaacagattcacgtcgaccaatgcgaaaattttcaatcgaaatatttggttaattttggaatgttaagtaaacaataaaaaataatatataatttttagtttaccgtattcacaaatg

SEQ ID NO: 114688 - DNA, 107 bp, Heterodera glycines
  Promoter: Source sequence=SeqID_3251; Location=2132..2238; Strand=+; Gene=SeqID_83920
aaaccacggtcaatcaccaccaaaaccatcgacagaactgaacaacttctacttggtgcacagttacgtgcttgcggagaagttcaagcagccaggggaacgcgatg

SEQ ID NO: 114689 - DNA, 844 bp, Heterodera glycines
  Promoter: Source sequence=SeqID_10410; Location=673..1516; Strand=-; Gene=SeqID_73604
tttgttcttttttttattcttggtaattccattcattcaattagagagagtttttatttagcacactaaaaaacatttattgacttatttgaagtggattggaagctttggcctctgattaggaacttgatcaaacataaagtcaccagcaggaagttcaagtcactaatttataaatttagaaattaattttaattttttgaacatattttttgaccaaaattatttttctagttatcaaatcgtaccaaaacgaagcaatgtctgatcactgatcaggcattgatccgattgctcattaaaaatggttgttttccctttcctcgctctcgctcttcattctccattaaattataaattttttaaatttatctgagattaatcctcctctgactctttcattttctttgcatttatttaattgtaatcccttaattgattttccccttttcattgttttgctcggactcaaaagttagcttttccagttttacatttttcctaatttggctgaatttataaaacgtgaaaatagcggtttacctcagcacttgggccgggccccacgcaaaaaggccccaccatgtttttggctataacatttttcttgttcatccaaatctaacaatcttggtatcattcgaaagctcttaagatgttaaaagctatttctaacctattgatttgctatcaacaattgctaaaaaagttatagcatcaaaatagcaaaaaaaaaaaaaagtcaaagttttgaaattttttcttaataactttttcaaaagtcaaaaaatctttttgcttttttaaggctaataatactcataattcggcactaattattatg

SEQ ID NO: 114690 - DNA, 97 bp, Heterodera glycines
  Promoter: Source sequence=SeqID_41607; Location=294..390; Strand=+; Gene=SeqID_69691
agtgaatattgaggctatttaatctcagctttttgttgctctgatcagatctttaattccctctccgataactgcttggttttagatagtaatcatg

SEQ ID NO: 114691 - DNA, 643 bp, Heterodera glycines
  Promoter: Source sequence=SeqID_12635; Location=1..643; Strand=+; Gene=SeqID_76308
agtcactatcttgtgctgacacgtaacccatccgggcaacttcaggtacggacagtcggatctcaattgtttccaaagcgcttaaattattttatggagtcatataacgatgcaacaagtcaaccgtttagctacctggttataaatatgcatcctaatgcacaggaaaatgaacgtcttactagcaaaatattcccggacgaacgcagagaaatctatttaccgagcgaataacgtattacactaaccgcattggctatataaagacatgaatgtagaaaaaatccaaaatgtatcaatttagtccttacgttagggaaaatacagatttttttaaaaagcttgcggccactaggtctgataaacgaaaaaacgagctactacagggagcatcagcagaccaaatacttgcccttgtggaaatttgcgcaaatattttaaaatttaattttcgtttaaattcaagccagaagcgacggttgtcacaatacgcggactattacagggccatagcacgcgctcgcagtgagaactcagctcggcaaaaacttcaacaagggagcggaattgcccttggtgctattcttgtgcctgttctcagcgttttagcccaacatttgtttgaaaaaataacagcataatg

SEQ ID NO: 114692 - DNA, 468 bp, Heterodera glycines
  Promoter: Source sequence=SeqID_22191; Location=2274..2741; Strand=-; Gene=SeqID_52852
aatttgaataattgttggaaacgatcggaattggtcgaagaattgggcttttaattgggaccgggacctttagcctttggagcgggaatttggaaaactctttataatatcaattccaaacaaatcaaattatacaattcgaataaaagcgtcggaggagatgaagaacaaatattttagaatcggagagaagtgagaacagaacatatatttaattaacaaatgagaagaaaattaaaataaaaaatgagaacataatgccaaaataatttaaaatcacaaacaaaaggtcaaatattccaacatgcccgctccctgacaaaaaagcgtcccctgcttttgacggacggaaaggctggggtcgaacagaacagtcgctcaacggtttcgatttcgcaactcggcacacgtccaacggctcggatttcgagattgattcgaagtcgacgaattgtggcggtcaaaatg

SEQ ID NO: 114693 - DNA, 578 bp, Heterodera glycines
  Promoter: Source sequence=SeqID_3727; Location=10148..10725; Strand= -; Gene=SeqID_51645
ccgaattcgaacaaaaaattgaaattttttcaaaatgcagttttctggggaaaagcttcgagttaatttgaccactatttattttgatgcaaaacaatgctccaattatttaattgaatagaaaatacgcaattttcttgtaaatttggtcgattttaacgtgtatttttgaaaaaaaaaatttttttttttgttcgaattcgggtccggagttcgaaattggggaaatccaagttcagattcataatcagcaccctcgataacctgcagaaactaattatgtatgagcacaaaataaataagttaaattagaaacccccacattctttaggattgccgaatttgtaaattgatttgtgccatcaaacacgtgccctcctctgtttttcagcttcttcgaccacaatgtgctcactttccttcgccgttttgcccgttttttcagcaaatgtgaaacaaaatttgacctttccactgcaagcattcacattccggaatgcgttgtgctcaacatttggacactgctcaatgacaccattcgtgtgatgtatttcaacacaaacacttttcgtcaaatg

SEQ ID NO: 114694 - DNA, 435 bp, Heterodera glycines
  Promoter: Source sequence=SeqID_17698; Location=1146..1580; Strand=-; Gene=SeqID_82227
tactgtgcgctcatatatcgtagtagtgttctaactggtagtgatatgctcctgctatttgctgcgaacgaggcagtatcccgcaaattttggagtacgacgatggctcccaatttacgagccacgagatttgctagatttatgcccgcccacggtgtgagtcacctgttttcaccgccgaataatccagtgtccaacggtcaggccgaacgtttcgtggacacgttcaaaagaacatttggaaaattgacaggggagggagccccaagcaaagaaatcattgaaactttcttgttaagctatcggacaaccccgaatgactcgttgccaaacagcaaaacacctgctaaatgttcctgggcagaaaacccccgcacaactttggatttgttgcggccgccaccttaacaaccgatcgacagagatgttgaaatg

SEQ ID NO: 114695 - DNA, 1003 bp, Heterodera glycines
  Promoter: Source sequence=SeqID_3449; Location=2197..3199; Strand=-; Gene=SeqID_84718
tcggaccatttcttaggagtgtatttttcgtttttattgcatttttttaaggattttttcaaaaaccctaaaatatttgcctaaaaattgagtccctagtattgattgaaacgattctaagataatttttaattttgaatatttttcgtattatttaaaaaaattcttaactattcatttatttaaataaatttgtttgcaatttagtcaattttatttatttattttttaccattttttagttttcaccaaaaaaaaaattaaataaaaaatcattttttctaaaaaaaagtaatcaccaacagaaataaaagtgtttttttttttgaagttactacgcattgctgaaacgaatttaagttaatttgttagtttcggatatttttcgatttaaaaaaatattacgtatttatttatttaaacaaaatttatttgataaatttatttttttaccatttttttagttttcaccaaaaataacgcatgaggggaagaagcttcgttggatgtacattcgtgaccaattggtggccaatggcatggcacattttgtcggcaaagatgactcatacatgcgccaaaagtgggcggacatgaagcgacggaccattgaaaaactcagccgaatgggcaaaaattcacgtgccaatttgagcgaagtagtgtgtgccaactttgtgatttaataattggtcaacagagtgccaaccaacaataataatttttgaaagaattttacgtgccgtggcaaatttttgagggttttttgcttcaacaaaaaacttaagcttttaaggcaaaaaacaaacaaacaattttctatcattaataagcctttaataacttttatggtgctagtgcgttttataaatccgccatcttacacatttttttattttgtttccatgcgcgttttataaatccgccagcacatttttttgcatatatctttaataatattaaaattttatgcaataatttcagctatattttttacaaaatg

SEQ ID NO: 114696 - DNA, 249 bp, Heterodera glycines
  Promoter: Source sequence=SeqID_6317; Location=1007..1255; Strand=+; Gene=SeqID_61129
ttaattaaatatctaactaaataaataatcaattaattagttaattaatcggcagttacttttgcggaattcgtcgcataattcgatagctaatgaaaaggatagaaaccccaaaaagagcagacaaaataagccataaaacagtaaaatatttttggagatgcgaagaaatgcttaaaaagaggaaaaatgaattaaaataaaaaataaaatgaaacattaaaagtgtcaaattaccgtgggaaaatg

SEQ ID NO: 114697 - DNA, 65 bp, Heterodera glycines
  Promoter: Source sequence=SeqID_12947; Location=1..65; Strand=+; Gene= SeqID_76701
agattttgttcgcggtcagtttccggaatggaaatctggacgtcttgaaaacgttgaaagacatg

SEQ ID NO: 114698 - DNA, 274 bp, Heterodera glycines
  Promoter: Source sequence=SeqID_26339; Location=827..1100; Strand=+; Gene=SeqID_57084
attaatttgcaatttttcgtcttaatttctgcttttcagttacatcgatcaaaatgtcatcgcatttctccgccgttttcaccgttgtattttcgccgtttgtttaacggatttgttcattttcacgggcaatgttagccttttggacaacatttggccaatgttccgcaattctatgtgtgcgatgattttgaataccatcgcttttcgtcgtttgcgtcaattggccccgtcacttctcaacgattgttcattcaattgaaccacaaaaatg

SEQ ID NO: 114699 - DNA, 215 bp, Heterodera glycines
  Promoter: Source sequence=SeqID_39533; Location=1..215; Strand=+; Gene=SeqID_68086
ggaactcattgagaagcttcaacaagccaacgacaaagttgaccaacaaatcgcagaggaacaccaattgcgaaatgaagtccttcagatggcaccgcgcgcgatgaagaaatacctcgacacacgctttgaacgactggtgcacaatttagtcaaattttcaaaaattccgttttaaattttagatgaatgccaaattggaattcccccaaatg

SEQ ID NO: 114700 - DNA, 384 bp, Heterodera glycines
  Promoter: Source sequence=SeqID_38161; Location=1..384; Strand=+; Gene=SeqID_67061
aatagccaaaaagttacaaaaaacgtcagaaaagtagtctttctaatgcaaaaaggtcctgaaaaattaggcaaaactaattataatcaaaatcccttttttaaacatttattgatttgcaaacaatttaaaacgattaattttaacgaaaaagagacacgtttcagaagtgttaccccgccaggttttttttcagtcctgctatttgaatcctaatggtataagaagtttcagtaccgtctcgaagatatacttactttcgcaattttcttcgcgaaaattcaaattttgccttaaaaagtgaaaaaagtcataaaaacgttcaaaaaaatcataaaaatcgcaaaaggaataaaaaagtttaaaaaaaagtcacaaaaaatg

SEQ ID NO: 114701 - DNA, 159 bp, Heterodera glycines
  Promoter: Source sequence=SeqID_15140; Location=415..573; Strand=+; Gene=SeqID_79330
tcatcaatcaccggccgctcacattcgaatccgatcaagagccttacgtttcacttcgttcaatcaacttcctcataccatacaaccaaacggagaacaactttcccgttatcaacgaggatcacaaagatccagactacgaaccaacacccagcaatg

SEQ ID NO: 114702 - DNA, 136 bp, Heterodera glycines
  Promoter: Source sequence=SeqID_5682; Location=560..695; Strand=+; Gene=SeqID_58896
aattgttccccatttttgcaggtatttcgacggtgaagtgatcattttcctgcaccgaattcgccgcctcttctccacggacgtctctctgcagttcaacattcggccgacggaatctcgagcttggaaaacgatg

SEQ ID NO: 114703 - DNA, 68 bp, Heterodera glycines; identical to SEQ ID NO: 110414
  Promoter: Source sequence=SeqID_36810; Location=399..466; Strand=+; Gene=SeqID_66029

SEQ ID NO: 114704 - DNA, 123 bp, Heterodera glycines
  Promoter: Source sequence=SeqID_40887; Location=654..776; Strand=-; Gene=SeqID_69118
aagcactgcggtgttcgtgcactcacagttgatgcctatcaggcacaggagtgcgatgtcatcataatagtgacaacaagatcaaaatactccgaggtgggatccggaaggacggacaacatg

SEQ ID NO: 114705 - DNA, 1003 bp, Heterodera glycines
  Promoter: Source sequence=SeqID_7275; Location=1988..2990; Strand=-; Gene=SeqID_64323
gaaagttgtgaaaagaattgcgcacaaacacatgtcaacagaaaaatccgcttgcgaagaaaaaccaaaactaaaaattaaataaaaaataataaaaataaattcatgcaacatttgagaaaacaatgccaaacaaaatttaaacaattgtttttttacaaatatatagaaattccaaattttcctggttgcgtatttctttttccttccatgaaagttgaaatcaatataaaaagcataatattaaatactatcttctttttataaaatttttaaatacatatgacgggctaacgtatacggagcttttagacccccgtaattacgggttacggatttccgtaattgaaaaccctccgtaattatgggtttccggcccatcacttttctcgggtcggttgggtcctgaaaatatttaaagaaaaagtgccgaaattcattatgcttgctggctaactgacttatgcttgatggtgatgtaaatgagtgcactatttagagcaatgctttcacataaatctgataaatgcaattaggcacaaaagttgagaatttaataaaaaaggttttattatttatccggccaaaaaatctgtttaaggatgagtatttttaattctttcataataattatttttatattttataaaaaatacatattttaataaattaaccaatcgttttatgaaaattttcatttcaaaataattttttaattaaaatgatgccactaataattttttgatgaatatggaaattgatgttggcaaataaatgaagaaatcaccggaaatggaaaaaacaaaaatttatgaatgaaaaatgaaaaaaaaattcgtcaacataaaaaatcgaattctatcggcatcttttccactctctctgtttggccaactatttaattaaataattcgaaataaaatttggcatcggagcatataaaaagcaattgaaaatgccgaaaaacatatcacattttcatttaaattatcctcccaaaatg

SEQ ID NO: 114706 - DNA, 885 bp, Heterodera glycines
  Promoter: Source sequence=SeqID_32217; Location=1..885; Strand=+; Gene=SeqID_62538
cagttaattattgaaatagttacctaattataattcctttaaatttccattttataaatacattcatttaaaaagcagttaattattgattattcaatatattatatttcaaaagaaaataattaaaattttccctttgctttgtccaaatattattttgcatttaaatgatcaataaaataaagatattatcaataagtaactgaaaaaatctacaacagattccattccaaaaagaaataggaggttaatatattgggatttgcttctttgctttatatctaacaaacgcaaaagaattacaaatttctaagcaattttataaatttttcgattaatggagaaagtggcccagcagaattattatttaggattcaaaatcatcgtctttggcaagtgctgcccaaaaggagttggacttcatccatcgtgttttgttgggcccacaacggggcaatttgacgggaacgcccaccattttggcgcgcgtattttgccacatctactgcgtggggcatattttggtgccaattttgtatgagattgtctagttgggtcttcgccggtccacacgtactcggaaattggctgctcaaatccaagattggctgaataagataaataataacgaaattcaaattgaatttaatttagcaacttttttgatcccctccaaatagtcggccaataatcgatgtgccaaagtggtcgcactgatcggcaaaagcggcgaatcggcaaaaagacgtgccaattccgcccaatattcgcccacggctttatgcacctgaattttaaagaattgagttcgaaatttgcaaaaaaaaatgtttgtgaaacggaccgccaattgattgttgtcgaaaatgtgttcgttgacaaatg

SEQ ID NO: 114707 - DNA, 584 bp, Heterodera glycines
  Promoter: Source sequence=SeqID_8933; Location=502..1085; Strand=-; Gene=SeqID_69705
ttataatgaaaaaaaacaattcagcgatattttacccgttatgtaattctctgaaaaatacttgagttaatattttcaccaaaaaaatatatattgtggattcatgaaaaacataaaaaaaaaattttacagtattttcttccttttttgcattttctagtctaggttattttgaagcttctaggatgcttttttccattttttttctgtctatcaatatttgggaagaaatgaaattttttttcgaactgttcctttgtttggcgttttgtattttttccttatttttgtttttgaaagtcctaaattttctcagttttttttatctttggaaaaacaacatggttttttcgacttttttcactcctagttaaggcatctcttctgggggatttcgcttctaaaaatcctcgccatatcatgaaaataacatccataaaaaggaacaccaaaatgatcaacatattttttatgcaaataaaatacaaatttatgtttacttttttttgcctgtaaataattcgttgcgtatgattaaaaaaagatttttttttagtttttctcggccggctattcatatcatg

SEQ ID NO: 114708 - DNA, 365 bp, Heterodera glycines
  Promoter: Source sequence=SeqID_32765; Location=1..365; Strand=+; Gene=SeqID_63011
tgacgtattatgtgtatcgacttgccaataaataaatctttaagcgaattgtctgtctgttggccaatttttattagctttaggaaatgatgggagtgaacagtgagttggagagatgccacggcataaattctaattataaaaatgacaatttccacatttaaaaataatgcttttccacctcataatttgattgatttgttataatattttcatctgctcgcataagcattctttttgaaaaggcaaaaaaaaattaataaaaaaaattatttacaataagcaattcctttttcgtcagcttacaatgttggctttctccttatttcctaactttttgcttctccttttggcaatttgccatg

SEQ ID NO: 114709 - DNA, 342 bp, Heterodera glycines
  Promoter: Source sequence=SeqID_4918; Location=3511..3852; Strand=+; Gene=SeqID_56192
atacagcgaaaggctaaaatttctaaaactttccaagcttgaaaccaggaggaaatatcttgatatcataacagcctttaaaactatcaaaaatactactcaccttaacccaaaaaacctttataatttttcaaataggaaaaagtcaccttttcctattttggtaaccaaacgaaaaattaccaaaacagaacactcctttactaacagaaccacaaaacatctacaagaaatctgcaaaaattcagatatttcaatatcaaattcactgcccaccttcaagaaaaaagtaaaaaacattttacaagattaattttaagttggagatctgacattatcatg

SEQ ID NO: 114710 - DNA, 139 bp, Heterodera glycines
  Promoter: Source sequence=SeqID_24290; Location=1244..1382; Strand=-; Gene=SeqID_55011
gccgcgaagtggccgagccagtcgattttatcattcataattctataacacaatcgtactgcctagcgggggatgcgccgaaggcgctgaccccgctagtgagcaaaataagcagcttttaggcctaatcgagaacatg

SEQ ID NO: 114711 - DNA, 1003 bp, Heterodera glycines
  Promoter: Source sequence=SeqID_18759; Location=446..1448; Strand=-; Gene=SeqID_83433
tctaatgcgacttttgtgtcccatcccttggactcaatgaaaattcttttggaatgactctgagtgattgttaattgttaaggccgttccatctctgctcggcgacgaagcacccgctgacccggccacccaatagccatacacacacaagcaaatcatcgacgacctcactcctcggaaatggcccttccttcaatggaaaccttttcaaaattgacattttccgtcttaaaatttcacttttttatttcttctgcctatgttcattttttgtttctttaaagtggtgcgtagcaaaggaattctttttgtacaaattgtttttttttaactttttaacgcactgttttaccgccaattcaaatcccattgagacttcctagaatccgtcctctcgcttatctccgtccgaaattatccataaccaaccaaataaggatactcagcacatgcaggtcatttgattgtttagttcttttattgcatccgccttgcttaagtttccaaatttacaacaattttcggcactttctctcacaaagtttcataggatttgtgctggggtaaatgctccaaaatctttccggaaagtgccgaaattttcaagagcaaagtgcattttatttttattgtttatcagttatcacattactatcttattaatctcttgtaaatgaagaattaaaattctatattttaataaactatgaaaaaatatttatcaaaatttcaacagtttaaaatcatttccctaaaaagttgtaaatacctaaatcgtttcctttaacaatgttaaatttattgttatatataaattggcttagagatgtttgaccgcgtctttcttcgctttaatccctttaattgctcagcgttcattgggaaagcttctccagtcgctgtgttgcaggtgcttttttattctcataattgttattttttactagccacattttggggtggttgaaaaactcgaattctgttgctaacaaataaaaaaatg

SEQ ID NO: 114712 - DNA, 525 bp, Heterodera glycines
  Promoter: Source sequence=SeqID_33184; Location=298..822; Strand=+; Gene=SeqID_63326
tgggctcgagcacttgcaacaggcagccaaatcggtgaaggaatttgcggaccaactgcacccgttgtgcaagctgagctacgtggactatggcagggattgaccgggcacggcacggaggacagcgaaaatgccgaaaaatgcaaaattggaatttctcccaattttttttgatttataaaaaaatttcttttttttacttgcttattttgatgcaatttattatgtcattcatgatcatgaacattatatttatcaatcattccgaattatttgtttatttaaaaattaaacggtgaccctttttattttttctggcaaaaaaaaaatcgtttttacaaaattttcggggttttgccttttttggttctaaaattcacaaaaaattatatgtattaaaactgaaacgctcactttgaatggagagaggggccttgcaaattttcaaaatgcaccgcttttaactttacataaaaaaaattataaatttttttttaaatccaaaatttttatgccagaacaatg

SEQ ID NO: 114713 - DNA, 151 bp, Heterodera glycines
  Promoter: Source sequence=SeqID_19520; Location=369..519; Strand=+; Gene=SeqID_47589
actgaatgttttttcgcgttcatagattgacattgtgctcctgctgcttttacacggtgccattgttggacagacggatttcactggtgcaattagtctaattgccctaaaattattggattaatattcccttttttcaattttagggatg

SEQ ID NO: 114714 - DNA, 630 bp, Heterodera glycines
  Promoter: Source sequence=SeqID_7427; Location=1040..1669; Strand=+; Gene=SeqID_64786
agagctttggatcgaaaatgataatttggctcaaagacaggcattgttcacgattgaggcaattccgttttgtctttttcattaaataattttattaagttatggaaccaaactgctcgcatccaaaatggactatcgagaactaataattcattggaaggctggcatcaaatatgggggtctctcttagccaggaaacccccatttagcatttttgtgaggcgaatgagaaaagaatttgagcgttgggagaacatcgtcgaagatttcgaaaattcacctgccaacggcattcgtggaaaagggctcaaaagaaaagcaatttatgtccaacaggatcgtaatttgcaacgtgtttttgctgaatttctgcagcgtgctgacgacccactccgttatctccgtaccgtctcatatcatttagcagaaatttgaattttatttttaaaaatttaattttattgtcgaaacggtcattgtcgaaacgtcattgtcgaaacggtattgtcgaaagggtcattggcgaaacggtcattgtcgaaatgtccgggagccggattagaaatatgttttatgaaatacgaaataccctccacctctgccgaggccaaaatttttacggaaaaaatg

SEQ ID NO: 114715 - DNA, 1003 bp, Heterodera glycines
  Promoter: Source sequence=SeqID_11243; Location=619..1621; Strand=+; Gene=SeqID_74603
agttaaaataagtaatttaaaatttcagattccggaattttttaaacctaattataaggagttttcagtctatttaaaacgaagaagtgatgggtgaacggcgccgggaaaattcgccccattttttataagagttttcaattttcataaaacgtaatatttttttatctgtcataatataataataatttggctattttttgtaatttattttaggaaaattgattttattgattacttctcttttttcttttagcattataaaattatatttgtgaaagtgctttctttttaacaatagaattagttagaaatttccctactcattctattggtaaattaataattttttttcattttctcatttaatacaaattgaaatattttataattcataaataggaaatttatttactattgaatctataaatatttaaattataataattcgtgaaatattattttttgaaaaattataactaattctttaacgacccggtaatcggacccgggccccgcttttctgggcccagggactcggttcttgcccaaattcccggactcgaatatacgaacttaaaaacaagcatctaaaccaccaaataagcacggaataagcacagaatgataaccaagcacgaagaatttaaaaaaaaactaaaaatgccgcagttatttcgaattattattttttaaaatctgtaataggaaaatagatttaaattccaaaaatttgttagaaaatgtaaaaattgtaatcggaaattcctacaataaaaaaaagaaattttaggtttttttttttgtaaaaagtcttcattcataggggatggttttagagatgctttttgctctttcaaaaacccaattaagaataaaactaagcatctaattacaaataatatgaaatttaaatgcctctattaagcaagaaaatcctaaatcactctctattcataaatttgaagaactaccctttaaaatattccctttcaaagaaatg

SEQ ID NO: 114716 - DNA, 411 bp, Heterodera glycines
  Promoter: Source sequence=SeqID_19471; Location=1746..2156; Strand=-; Gene=SeqID_84189
gtgttggctgaatgaacatccacagttttggtggtgaatgacggcggcaatggactttgactctacttgaacacacctaacaatatcataaaccattcgcttttttggaactacacccggaaacttttctctttttgttgcagaattatctgccctatttaattattattttattgtcccactgacattacacagcatacgaatttgacaataaatttgatggtacaaatttgacatttttcgcttgaagttatcattctaaaagtgaactgtattatgatattggagttatttgcatttccagtttgtttgaacgtcctataattcgatctacataccatttatcctcttaaaacattaactatttattaaataaaatttagccgttaagttttctgtctaattagaatg

SEQ ID NO: 114717 - DNA, 81 bp, Heterodera glycines
  Promoter: Source sequence=SeqID_4126; Location=1336..1416; Strand=+; Gene=SeqID_53278
gctataaagtataaatgaatagttcctaattataagaagtaaatatttttctcttacggtaactatcgggatgacgatatg

SEQ ID NO: 114718 - DNA, 588 bp, Heterodera glycines
  Promoter: Source sequence=SeqID_13821; Location=409..996; Strand=+; Gene=SeqID_77757
atcacaacagtactgatcagaagcatacatgcacaaggggtgtctcagcccaagggccatacgacagacgattgggacagggggggaggtgtctcgggaccgattttccatacgaaggtccaaatttttctccggcgtcgacaccttttttttttttgctattcaaagtaccttttttgcgacgcgttttttccaaaaaaaaacttttaggaagggggtggggcgggcgggccgatagccgccgggaaaatttttgaattttgacaccccttgtacatgtatgcagctcatccctccccccgaatcagttctacctcccaaattttttaaaaaactaaaaaaaaatgatgaaaatcacaagaaaaaaagtgaaaaaaatttcaacaattttttgaaaaaaaactttttgttagcaattcatcacaaattttgcaaaaaaaaattgctatagaaaaaatttttcgaatttttttcttgtaaattttctcataaaaaaatttctggggggggggaaggcgtagtgcaccttcctcgaaaacaagttacaaagaaatgaattggtttcgtattctaaaccggaaaatcatg

SEQ ID NO: 114719 - DNA, 52 bp, Heterodera glycines
  Promoter: Source sequence=SeqID_42574; Location=1..52; Strand=+; Gene= SeqID_70435
tttgaccgaacgcaaagatttgcgcccgcgctgattttaaaccgaatgaatg

SEQ ID NO: 114720 - DNA, 103 bp, Heterodera glycines
  Promoter: Source sequence=SeqID_17778; Location=1373..1475; Strand=-; Gene=SeqID_82319
ttcgtcgattcacatcacatttattcagcgcttattctcctctaaatttcatttctaattttctgggtctttccaattccatcacttttttggcttcagcatg

SEQ ID NO: 114721 - DNA, 68 bp, Heterodera glycines
  misc_feature (13)..(13): n is a, c, g, or t
  misc_feature (43)..(43): n is a, c, g, or t
  Promoter: Source sequence=SeqID_11880; Location=1791..1858; Strand=-; Gene=SeqID_75391
gtcgtctttagcnaactcatttaaatgtctgtcatttcccttntagttcggactttgcctttgaaatg

SEQ ID NO: 114722 - DNA, 134 bp, Heterodera glycines
  Promoter: Source sequence=SeqID_18306; Location=2073..2206; Strand=-; Gene=SeqID_82898
atcggtttgtctaggaaatttcgattctcgagagccctcgtttgggtgttcctgggcttctgttcgattccggcattttattcatattttaccggcattcagttgccgacattctgccatttttcaccgaaatg

SEQ ID NO: 114723 - DNA, 473 bp, Heterodera glycines
  Promoter: Source sequence=SeqID_2116; Location=4488..4960; Strand=-; Gene=SeqID_47175
ttattagcacaaatttaattcgcctccctgaaatatgaattcgaagtgcttatttttgtgggttcattttcaatttcaaaaaaaccagcaaaatagggatccagcagggataaatcccgcaatctgcggactggaatcccgcaaaatcccttgcgggatccaatcccgcaccgggtcaatttcaactagaaataatctatgcacataaaaagtttgttttttttattagcgttagtgtcttacttcattcaattctactacaagtcaacaaaatgacaaaaaactaaattaaaaatttttttttaaatatcgaaggtcggttcttgcgatgcaccccaaaaggtcgcttgtcgaagagtcgccgggattttttggaccataactttttatgatagttttttgataattaaactatttccaaataacccataatatatgaaaaacaaattacagatattcgaaaaactgctatg

SEQ ID NO: 114724 - DNA, 1003 bp, Heterodera glycines
  Promoter: Source sequence=SeqID_10601; Location=200..1202; Strand=+; Gene=SeqID_73833
ctgcaaagaatgcgaaaatcggtgggaaaaatgaaacaaagtgacggacggcggaggggcggcgatggcaccgccgaagaagcgaaggaatgcggctcttttcctttgtgcatcgatcgccaactttcgcttagctttgcttctgcccaaatgacactgaaaatggacgcagtcgcagtgccaccgcccattcgtttaaaatgcctgctaattaacacaaaacgggggtgggagagggggaacaattaaagtaattaggactaatgagtgtcttggatggacgaggaaaagcatcgatctgttgggatggatttgaacagatcaggtgggcctttgaggcgatcaatcactttcagtccttcccccccccctcccctcccatcaatcattcaatggaagaaaagtgttcgaatttcaataatttgatcaaaatattttgacttttctcaacattcccccccccccttttccccctttccccccttttccctttgattcttttgttttctccccctcccgcgcccctccggtcgcatttgaattgtgatttatggtataaattggtgtttttgtggtgtttgcctccttaattttgtcattcattggaaggtttttcggttggtcatgcgactgatcagccgaagcaaagcaaattcagcccaatttctcttaatttgattccgttgcgcattttgcaaaaccgtcgttctctcccattttagacgaaattttgtcaattttttattttgaattttagagtgacaaatttagaaaattgggagggacagaacggaagaaagggaagggaagggaaggaacgggacggactataaaaagagagaaacgcacaaattaggcaattgctcacattatgcgatgtgctctgtgtgtgctcacttttcacttttgcttgtgttttgtgtccccgcggagaatataaaaggccctttaaatgcattcgttaagaaaccaaacaaaaatcactttcacttttcgaaaaatg

SEQ ID NO: 114725 - DNA, 308 bp, Heterodera glycines
  Promoter: Source sequence=SeqID_2167; Location=4124..4431; Strand=-; Gene=SeqID_78227
actatgagcttaaatacatttttattgtaaaacggcactccctaaagatggcaaattgatgttggcatttgccgacaaacattgaaaaaaaacacctgcaaattacaacaatttccttcctttcaaaattaaatgtgcttttttacaaaaaatttttgtcggcaaatgccaacgtcaatttttctttcactttggcttccattttacaataaaaatgtatttaaggctccaaaaaaatatccaattccaacatccaaaccaaccaataccattaatttcataaatccgaagaaatccctccaaaaatg

SEQ ID NO: 114726 - DNA, 137 bp, Heterodera glycines
  Promoter: Source sequence=SeqID_20391; Location=1201..1337; Strand=+; Gene=SeqID_50911
tctgaactattaacatatatttttaaacaaatggaaaatttgagtctgccgatgccgataggctgataatattaaacattttacagatcaaatacaaattttcatctgctttcaatactttctctcataataatatg

SEQ ID NO: 114727 - DNA, 213 bp, Heterodera glycines
  Promoter: Source sequence=SeqID_42993; Location=1..213; Strand=+; Gene=SeqID_70773
gaaataccaaataaatgccgaggagggacaagtgatcgccgcatatattgtgggcaattaaataattattaatttatttaaaaaatgattttacataatttatcagtcggttaattaattgataactaactaattgattggttaattaagaacaaagctcgcgcgcgaattgccttaggcgaagcgccagaccttccgattgcctccggcatg

SEQ ID NO: 114728 - DNA, 388 bp, Heterodera glycines
  Promoter: Source sequence=SeqID_1627; Location=1503..1890; Strand=+; Gene=SeqID_74943
ggtaactgaaaaatgaattgaaaatgaccagttcaaattggcaaaaccatgcgtttcggtctcaaaaaaaatttttttgtaaattttctgactcaaaactttgtttaaaaatacatggaaacaaagcgaaagtcatcactgtttcaataaaatataatttcaactatttttggattaaaaatggaaatttgttagagcttttgttcgaattcggattagaattggtcgagagggatgccgaattctcgaaacgtgtttttagaaattacaaaaaaaaaaaaaaaaaatttctgggaccagtaaaacacattgttgccgtttaattgcagcctcaagacttaaaaaagtgaaacaaaaataaataaacttataatttaagcttgccatg

SEQ ID NO: 114729 - DNA, 260 bp, Heterodera glycines
  Promoter: Source sequence=SeqID_17120; Location=149..408; Strand=+; Gene=SeqID_81557
ggtgaccaagttttgtagaaattaattaagattttttaatcaggaccacccaaattacaacacacctttattcttatgttttaaatcagtgtacaatacactcgtttcgggaaacagttgtaggtatgcgcaatggggctgctatttgtcgagagcagagcgaaagccgaattcatgttctaaaattattaatttgttgtgtctaatgatttaaattaggcagaacaacattttgctttcagaaattgtctctatgaatg

SEQ ID NO: 114730 - DNA, 585 bp, Heterodera glycines
  Promoter: Source sequence=SeqID_11756; Location=2861..3445; Strand=-; Gene=SeqID_46983
aatgataaatcgtgaaaaggttttagcgggatagtgaataggcttaatgaggcgctctgtgagcatattaaacgtaaagatattgaaaattgacaagtatctgaagctgagaaaggaccacaaaaaagagagagattagccaatgaggatgttcaatttcaatatgacagcattgatcaaaaatttattgtctatctttccgctgctgtctcccatatagatttgtcaaaacacctcgcatatgttctggggtttaagaatacaaggctatttcacgcggaagaggcgacttatatgccggatttgacgggaggtgtaaggcagctatacatttatgcaccaaatttaatcgaaacacaattatcggcaaccagatggccccactcttaagaatagttaacgtcgtcgatgacccaggatcgattagtgaagttatatatagcacctagtttttcatcgtctacagtcgaaacgaatttcagaaattacaattgaaattcacacaccgtttggtgaattcgttaaatttcactggggaagttgtattcttacattacattttaagaaaagtatattttaaaaatg

SEQ ID NO: 114731 - DNA, 222 bp, Heterodera glycines
  Promoter: Source sequence=SeqID_36471; Location=1..222; Strand=+; Gene=SeqID_65770
aaaacgttcaacatcatcaaggttttgaatcgatactgagcggggcacaactgggagcggattgatgcgaaagctgaaggtgttttctggtaaatctgctagttgtgtaaagcagctgcaacaggctctgtcggcatcacttcttttgcagtagtattaaatgtcgtttgtttggtaattgttttgttcgcttcttcaagatgaggtggagatggttgtatg

SEQ ID NO: 114732 - DNA, 57 bp, Heterodera glycines
  Promoter: Source sequence=SeqID_3226; Location=943..999; Strand=-; Gene=SeqID_83769
ggtgggactaatcacaattaaatgatctaaaattcatttgttccgtttttaggaatg

SEQ ID NO: 114733 - DNA, 478 bp, Heterodera glycines
  Promoter: Source sequence=SeqID_18023; Location=736..1213; Strand=-; Gene=SeqID_82596
attcccttctcaagcgagtcgaccaggtcccgcttcctctttttaatccaactgaagcattttttgccattttgtccaaaggtgatcaaatggctccgtctcgacgagaacgaacggcccgcgtttttggccatttattttgagcagccggactcggccatgcaccaggcaaaagctattttaaaaaattcaaaaaagcaattaaaattaatgacaggaggggccggattcggacgcggtcaattcggcattggtctttagtgggtcttttgtttcatttctgtccttttcccttaagatttatgtggacgcgatgatcaattatctgatgcaacaattggacaacaatgtcagtcttttgcttttccaatggatttgccattcattcgattggccaattccttttaagggctttttgggctgtatcaatctgatcattgtgtctgaccacggggcgcaaaagctgcgtgatgacatg

SEQ ID NO: 114734 - DNA, 1003 bp, Heterodera glycines
  Promoter: Source sequence=SeqID_2944; Location=2975..3977; Strand=-; Gene=SeqID_82466
ttcattaattgttgaaaataagttaagaattgagaaaaagagttatcaaattcaaatttattatcaaaacttagcgaaatataatgaaaattcaaaaaaaatattcaacaaaagttcagtttaaaaaatccgtaatccgtatcaaaaaattgtacggatcaggatccggactacggactaggcacacatacggattacggacttacggactaaaaatccggaaaatccgtactccgtaaaaatccgtatcggcctaaaaaaatacggattacggactacggatctgtaaaaatccgtatacggatacggtccgtacccgctctctattaaaaattactcaaaaattttttccaaaagacccacaaaagcaagtatatgaatttttgcccaaattggacaaactgccggactattcttctatattttaaacctttttaaattaacttgaaaaatatgaaattatttgaatttgtgaattcagaaaatcccgatcacgtgcaaccttaatgataaaaacttttttttctatttataataaacttattcatatatataggtgtataaaatctcatttcttgcattttttttaaacagcgacaaagagaggaaaagccttagtcagcaaaagaacagcagacaggtgaacaaacacacctcgaacaaaataagcatatgctttatcgattgtatggttttaaagggatgaatgagaaaaaaattttttggaagtcgcgcacgcttcgtttggtgaggtgggaaaagagagaaaagattgatgaaagagaaggacgagagaaagggagggaaatgcgacggggggggggacgtttcatcgaatgaaatgggctgtggtgcgatcagctcgcagcagaagcacacacaaccaatgatgatgagaatacctagattgtattttaataaaaatgatcctatctaattacttagtaattccataataataaattacctaattagtttagataccgtaacaatctcaaagatg

SEQ ID NO: 114735 - DNA, 83 bp, Heterodera glycines
  Promoter: Source sequence=SeqID_21384; Location=845..927; Strand=-; Gene=SeqID_51997
cgtaagaaattttttattacttttgaaattctcaaatttagcgtttcaaaactgacgcagcctttgcacaattcgccaaaatg

SEQ ID NO: 114736 - DNA, 844 bp, Heterodera glycines
  misc_feature (90)..(90): n is a, c, g, or t
  misc_feature (201)..(201): n is a, c, g, or t
  Promoter: Source sequence=SeqID_9231; Location=1860..2703; Strand=-; Gene=SeqID_70695
ttcccccttctctctcttgctcttcccctctctctctctctccattttgctctttttctctctccctctactttttcatctccatcttcnccacttttcttctccctcctcctctctcccgttctctcttccttattttcatcctcctcctcctcctcctcttatccggttccccattttcgtcgttctgttccgccttcnccttccgccttcggcggttgtcccgtgaccaaaggtcggcctgcgcccgcgccaccccccaaaaaacgcggcgctataaaatgggcgtgcaaatcgcatcaaaaagtgtccgttccgcgccaaaaatcgcttcaccaccattcatccgtcctttcattcattcgtttattcgttcggttgttctcccaccccaatttatttttctgcaaaaaatttctgtgccctaaatttttgtaaaaaattaaataaataaaagggaaatgaacattatgtatttctttttactatgtatttaattaaccatatttatttgtggaataaaataaattttcaactatttttttatgttttacttaagttttatgaataaaattttaaaataatgattccattccttcatcccaaaaattctctttcaactaaaaaaaattacaaaaaatttacgagcttcaaaaaaagatgtgcggcaaaatgttaaaaaattacttttgaataatttaaatgacttaattcgctttgtatgttttcttctttttaaaacatttgtggctttatttaaattgatttaaattgatcaaaggaaccaaaatttatttaaataaataattaaactttaatactttattaaatttaattttcgatg

SEQ ID NO: 114737 - DNA, 306 bp, Heterodera glycines
  misc_feature (69)..(69): n is a, c, g, or t
  misc_feature (239)..(239): n is a, c, g, or t
  Promoter: Source sequence=SeqID_4548; Location=1..306; Strand=+; Gene= SeqID_54853
aaaaatgatcaacaaaaatttggtgaacagtagtagtcacaattatgggttttattttgattttgtttnggttgggattataaaattggtaaattccctcggggctttttataccggcaaaattcaccacatttttttggaggcgttgttcattacgtaataaaaaaaaggtgccccaaaaccgcgtccccaattttggtaatcgggcgaattcggcggcgccgtcactgccccccccnccccaacaaaactgcaaaactggtcaagaattgtgctcaatttggtggaaaatttgttgtggcgatg

SEQ ID NO: 114738 - DNA, 396 bp, Heterodera glycines
  Promoter: Source sequence=SeqID_27486; Location=715..1110; Strand=-; Gene=SeqID_58177
aaccattggggttactctttcgggtttttaatgaaattgctctcctgggtttgcgctatttcgaccaattctgaacgccttaaccccggcttcgaaacaatggtcgaaaattcaaatttttcggatttttttttgtttcgaattcgaattaaggaattcagaattggtcaaattggatggaagatctatgatcagcgactcctaaaacacctggaaaaaagttttcgtggcagacattttttttgtaaaatttgctccaaaagggtcccttttcctctggtttttttaaaatttttcatttaaatttgcccatttttgaaatttttacttgaaacaatgcatttttattgagtaaaaaattaaaatatttatatttgcatattctattgacagatg

SEQ ID NO: 114739 - DNA, 61 bp, Heterodera glycines
  Promoter: Source sequence=SeqID_13453; Location=2464..2524; Strand=+; Gene=SeqID_77341
agttagcaaagggaagagggattaatcgcaatcagcttaattaccaccgatcattccaatg

SEQ ID NO: 114740 - DNA, 367 bp, Heterodera glycines
  misc_feature (98)..(98): n is a, c, g, or t
  Promoter: Source sequence=SeqID_29592; Location=1464..1830; Strand=-; Gene=SeqID_60069
atgcatgtgttgtttactcttttgatcactcctcgtacgcagggttagtgcatttttttaaagatgcaaaaatttggggtcgctgactacattaagtntttgctttcggatgataccatggttctttgggtccgagtccggcatttccaagctcgaattcgaaccaaaagtcgtaaaatcaaatatactagttttagatttgtgtctaaaaataattaaatgaccttttaccgaaaaataatgaccttgattcgtttccgatttgcttaaatgcatgacttttaaaaacaaaaaatttcgaaaagtggtggggacaaagtacactattaccacattttaagcggtcgtttgtctacgtgggtcaatg

SEQ ID NO: 114741 - DNA, 1003 bp, Heterodera glycines
  Promoter: Source sequence=SeqID_9046; Location=221..1223; Strand=-; Gene=SeqID_70094
cccatgccaaaatggccaaaattttcgtttggcgatgaaaaaaaataaattttcgagatcggacgggcccgacttgcatttgcgcgcccggcaaaataggctttttttatctggcggcccgggcccggttaaaattgtccatcaggaatggacttttatgggcataaatttctccagttaattgtcctatatttgaaaaattttataattttggaaattgcgggattaatcccaccggtatgcgtccagctaaacttttgggtcttcattccacagaagaatccgcaattttaaccgggccctagagaatatggatggctaagtccttcttcagaagattagttgctttttctttgctgtgtccttccacccaaaaagactaattttcttatctttctatgaaattatgcctaaaaaaaattggacaccaagcggaaaattggacactgtcggaattttggacaccaaaggaaaattggacactaaattcctcttttaaaatataaacccaggaatttaaatattcaatatgcacaatgattgatcaaatgtggcaaaaaagtgtacaaaattagacgatgattgatcaatgtaccaaaaaatgcagaaaaaatgggaattccgtaaaaataaaaacttttttcgttatgaatgtatgatggctttctgctgctgatgctacaaataataatacataatttatttcaattaaaatttttgtttatttatttttaactatttattttttatcaaatagtgtccaattttccggtgtctaattttcattggtgtccagtattctagtgtccaattttcggtgtccaattttcggtgtccaatttatcgggagccgtcaaagacccggcttaagaaattccaagggttttccggtctcaatttgggagtgaatattttttaaattaacttctttaatgactatttttattcgtcctttattaattttgaccaattccccgtcatccatttcagtacattcccaatg

SEQ ID NO: 114742 - DNA, 326 bp, Heterodera glycines
  Promoter: Source sequence=SeqID_26; Location=7569..7894; Strand=+; Gene=SeqID_82133
aggaattcattttaaacgtatgcgcttttttcacactgttaaaataaaagttcattttaaatttatgtgagaattatatcgaattgttggggcggtgggggggggggttcagtgttgaatgtggtacgggactcagtactgaatgcccaatcagcgatgcactcacacggggctctgttaagagtgcccattcttttcaaaattccgtttgcgcaatttgaaacttaaaatgggccgggtttcacagacggctggctgtatataagcagctgatcaatctgacgtcctccatttcattctcaaaaattttttcccaaataaaaatg

SEQ ID NO: 114743 - DNA, 969 bp, Heterodera glycines
  misc_feature (31)..(31): n is a, c, g, or t
  misc_feature (117)..(117): n is a, c, g, or t
  Promoter: Source sequence=SeqID_14992; Location=1..969; Strand=+; Gene=SeqID_79147
tttgggttttagtccatatttggccattttntggaaatttcacaagaaaaatgaaaaaaaaacgaaaaaatacacccctaaagatcaactttttggaaatttttaaaaattacaccncacaaaacacgaaaaatttgagttttcgtcgtcattttggcattttcaataaatattttcgtcatttttttgcgaacatttctttttttttaatgagaattttttcgaaatttggcaaacttggaggtgtttttgatacaacgaacaacaataaaaaatatgcatttttaagttttaaaccccattttttggttgtttattgtactttttaggtttatttaagcaaatattaaatatgcacaccttttttgggatttttgggggtttacaacatatattttggcattttttatccatattttggtccatatttggccatttttggcctttttagtccatatttcgggcttttttagtccatatttaatgtccatatttcgcgttttttagtccatataatttacaacccataattaacagatttgcagaaaaaatggacaaaaatcatactttttgagtcatttaatcggatgaaaagttatttctaaaaatatttggcattctgtcttttgtaattgtcttaaattttttggattcgaatttcgaaaagcactaaatcaatttctcggttgttgtggtctcggcatatatcatcattttgacaaaaattgcctaaggacaaaacgccaaaaaaccccactaatttaaaaattttgccgagattttcccttgtaaaaatggaagagccgatctcgagttaaaaacacaacttccaaaaaataaacagggattcgatagagggggtcaaaatatgggcctatgcaaaatttcaagaaaatttcaactgcagaaaaattttttcaactgggtgaatatttcaataactttccgacacttttacagttaaaaatg

SEQ ID NO: 114744 - DNA, 221 bp, Heterodera glycines
  Promoter: Source sequence=SeqID_4144; Location=878..1098; Strand=+; Gene=SeqID_53359
ggaattccccgaaaattggcactcacaatcagctgctggcattgaattttgtttgccaataattctaccaaaattggtactcaaattgctgagacatttaaattttgtttttgccaattccttctccgccattccaatttttttttctccattcgggcaataaatgtgtgtaattatttccgtttgttcacacctccccccccccccccccctcagtgatg

SEQ ID NO: 114745 - DNA, 70 bp, Heterodera glycines
  Promoter: Source sequence=SeqID_25770; Location=1..70; Strand=+; Gene= SeqID_56511
aaaaaaagcgaaagcaaaatttcaaatccaattttttttattttttattctttcagacaaacattgtatg

SEQ ID NO: 114746 - DNA, 327 bp, Heterodera glycines
  Promoter: Source sequence=SeqID_20468; Location=1..327; Strand=+; Gene=SeqID_51003
atttttcctaatttattcaatttggtatttttatttaatattttcaaaataaaaaataaataaataatttttccctctaaagaccatacgtgaagttttaataaaaacaaaaataaaatatttttacttaaaaaatatttaaaaaatactttaatgaatatgaaataataatgattaatttgtgaatttaaataaacataaattaaagtttcttttaaaatttcaaaataatatttaaaaaaaaacaggaattggccttcaccagtgcaactgacaaaagaaaatttactggaaaataattttgatcataaaatttctatggaaatg

SEQ ID NO: 114747 - DNA, 312 bp, Heterodera glycines
  Promoter: Source sequence=SeqID_23800; Location=1504..1815; Strand=-; Gene=SeqID_54500
tttttttttgctaaattggaaaaaaaatattattacaataaaaaaaatgaacaacaaaatatatataaataaaatggggttggggagatgaccaacgactcgttcggtggtcatcacaatcgatgggccagcattttttttatataatgagcgacgagcattaccccccccccccctccgtctctcttttctctctatcacactatctcatcttcactccactcagcatattctcctcccctccacagctttccatctccccgccaatataactcttacatcattatgcttccaatttagtcctgcccaatg

SEQ ID NO: 114748 - DNA, 352 bp, Heterodera glycines
  Promoter: Source sequence=SeqID_2719; Location=1199..1550; Strand=-; Gene=SeqID_81257
tagaggatacatagggctatcgaatgacaccacaattttggattttaaatattaattattttttaattttttttataaaaatgcgtcagttacagtctaattcatggttatgaaaacgattacatttcattaaaaatcaaagtgaataattcgaaaatgacgatcagtagtaccacgtgattttctaatgatttgtttatgccattacaaacggaagtccgcaaaaaataatacaaaacaggaaatgaaatatataatgtaacaaataatgatttgccatgcatatataaatgtgatatgcctatcaaaaaatcataaattttctgccaaataaattacatcctccaaaatg

SEQ ID NO: 114749 - DNA, 720 bp, Heterodera glycines
  misc_feature (108)..(108): n is a, c, g, or t
  misc_feature (159)..(159): n is a, c, g, or t
  misc_feature (183)..(183): n is a, c, g, or t
  Promoter: Source sequence=SeqID_28872; Location=1..720; Strand=+; Gene=SeqID_59449
aactcaaaaatgttggtataaatggtactttactaaaatgctttcaaaattatctacaaaatcgtacatttttcgttagagttggctctgcgttttctgatgaattcncatgcttaagtggtgttccgcagggatcaaatttgggtccgcttttatttntaatttacatatcagatcttcctnaatttttgtaaaactgaaaatgttgaaattaagctttttgctgacgatcttaaggcctattctattctctcaaaaaatactatttctccactccattcttttataagtattaacaaatttcgggaattactgtgaattaaatggccttaaaatcgctcctaataaatgcatagtttcacatcttgggcctaaaaaccccaatgaattattactttataaataatattccaattttaaaaagtgaaaaaggtgaaccagttagagaccttggcatttatgtttcaaatgacttaaaatgggaaaaacatatagaatttattaccaaaaaagcaataagaacatcttttgctttactcaagtcacttaaaacaaaaaacccaaaaattcttataaatatatttaatgtttattgtcgatccattttggaatttggttctccggtttttaatccatatatgaaaaaagacatcgatgctcttgaaaatgtccaaaaaacatttttacgtattatttttagacgtaataataacaaggatg

SEQ ID NO: 114750 - DNA, 293 bp, Heterodera glycines
  misc_feature (45)..(45): n is a, c, g, or t
  misc_feature (67)..(67): n is a, c, g, or t
  Promoter: Source sequence=SeqID_7528; Location=1590..1882; Strand=-; Gene=SeqID_65126
atggaagggcacaatttgtgatcagtcggccgaaaatgcagaganagcattgtaaaaataaatttanaataaaaaataataattaaataaaacatttttagaaatcaaagctgtccattgcataaaaatccctgcaaaaatggtggccaatgtgtaagtgtgaaggacaatcagcagaatgggggtaattttatttttagtaatttattttaattaatgtttttgcaaatttagcagttcatttcgaatgcatttgcccaaagaatttttcggggacattgtgtgagaatatg

SEQ ID NO: 114751 - DNA, 190 bp, Heterodera glycines
  Promoter: Source sequence=SeqID_26523; Location=768..957; Strand=-; Gene=SeqID_57261
ggtgagtcaaacggtggcgagagggacggggaggggaagggggaggacatgacacggagacacggaaaacgttggcatcatgcccaaaatggcccgccccattggaactcattaatttattctttttgcttgaaaggtctctcgggcggatgagtttcttttgcgttggtcaaaactcagtgaggcgatg

SEQ ID NO: 114752 - DNA, 126 bp, Heterodera glycines
  Promoter: Source sequence=SeqID_32223; Location=649..774; Strand=+; Gene=SeqID_62551
atttttgctcattgtcagtgttggagtgggctgcctttgcgtgactcgtaccaaaatccgaaaaaacgcgagcgcatttcgacgattcttcccgactttctcgatgatcccgaccacgggtcgatg

SEQ ID NO: 114753 - DNA, 296 bp, Heterodera glycines
  misc_feature (92)..(92): n is a, c, g, or t
  Promoter: Source sequence=SeqID_15218; Location=1177..1472; Strand=-; Gene=SeqID_79420
ttattttgctaaagagaagagtaactaaatttttatttttgaaatcattcaattgcactaacaaataaatgttctctattagctgtaacttnttctaaagtcgccaaccttaacataccgtataccatacctttttgcctcacgaccctacggttacggtagggacaaactgtgctttgattgggtgcttctgttccaagttattcggatattatatcaattaaatccatcaatgttttgagtcaaaatttatttaccccccccccctccgtttttgtaggcatttcgtagaaatg

SEQ ID NO: 114754 - DNA, 491 bp, Heterodera glycines
  misc_feature (22)..(22): n is a, c, g, or t
  misc_feature (119)..(119): n is a, c, g, or t
  Promoter: Source sequence=SeqID_44275; Location=499..989; Strand=-; Gene=SeqID_71774
aaaatgagccatcatatttgcnggattataaatcattaatttgaaatccctcattaggtgcttggacaaatgctgcttctgggggacccgcaagtgaagcaatatgatgatgttgactntacaaaattcattcaaaatgaggtagatgtaatattatgatccatccctaatgggataattaaaaataaatatctggctgacacggcagcaaaaccagatcttgaactaatgagcagatgatgaaaaataattatgaaattcggacagcagtaaaaatggaaacctaaattaaactcttataaaattagaatgagcaatttgtaattaaagcaaaaaatataattgaatgctctaattcttcaaaatcttttttggtccaattttattagccgccccaaaaacgtttcgattggtgggctctgccgaagggaactgctccgttggattgtgctcgtctgtttgccaaagataaaaaatacattggcaaaatg

SEQ ID NO: 114755 - DNA, 73 bp, Heterodera glycines
  Promoter: Source sequence=SeqID_26944; Location=1203..1275; Strand=+; Gene=SeqID_57688
atgattatgcggctttgcttacgcagacgaggcagaggcggcacacggcgctggcgacgaggcgggcgcaatg

SEQ ID NO: 114756 - DNA, 1003 bp, Heterodera glycines
  Promoter: Source sequence=SeqID_830; Location=5406..6408; Strand=+; Gene=SeqID_62335
cacaataaaaacaaatagaatatataaatatattttttttgcagtttttttacacacctagttattctaatagagtattaggttaagtaattaaaatttgttatgattagaatgttatattcaataggtatatagatgctgaataggagcaatgggtattttcttatttatctatgaaaagttactttttttttatctcgtgcagctgtccgtttttgatttatgatactaatgtcacattaaatattttgtgtcataaagtgattcattaaaatcaaatatttatttaatttcttattttaataaaattcatttatttatttcataaaatttatgcttacggtggttatctttataatcatttattccgtcttgcttagtgtttattactttttaaatagtttataaaaatatttttaacagatttgctatttagtataaaagtctttcaatcttgggtgaagtaaccggtttaagattgtcgttatactataccaatttttatgtattttcaattcttatttgaatgttcaatggtgttctgtttttatattttgttaattgattatcatctcatcacttaaaacatattttcatatgtaaaaaaatcttccatttcagcaataagttcattgtaactcgaaatattaaaaaaaaaatttaattatatattaataattgctctttatgtaataatagttaaaacacttttaataattatcaaatttttatatatccaatttcataaacttttgaaaaacaattttttatgcaatgattattttagttttaattcaattttcaatctaatcagtaaaccagttttaaatcgcccgtttatctgaacagcatgtgcttcaacctttaaatttaatttttaattaaatgttaaaaaatctattataacttttaatcatgcacattggttccacttaattcttcgtgccattaatcttaattttaataatttttatttaatttaaaaaatatatttaccaaaatg

SEQ ID NO: 114757 - DNA, 294 bp, Heterodera glycines
  Promoter: Source sequence=SeqID_22814; Location=995..1288; Strand=-; Gene=SeqID_53520
aaatgtcgatcgatgaccgatttgttgatagtgatgtggatatatgatctttttttttgggacatttaaaaaattggtgatgaattttgtcaaataaatggtggtgaatattttgaaagggcagaatttaaaattgatttaaataatagttaaatatggcggtgttctcatgttctgcaattttattgattggctctaaacactcagtgaggtggggatgaggcctataaaaataaactgaaattgacttccgctcattttccgttttcattcttgaaattttccgctaaaatg

SEQ ID NO: 114758 - DNA, 145 bp, Heterodera glycines
  Promoter: Source sequence=SeqID_25036; Location=1255..1399; Strand=-; Gene=SeqID_55769
ttttacatgggcaaatttcagcacataaattgtgccgacaacaaatttggattccgtgtcatggcccggtctttgtctgatcaatttgtttatgaaaaagctgtccaattgatcaatattgactggacaaattggagacaaaatg

SEQ ID NO: 114759 - DNA, 849 bp, Heterodera glycines
  Promoter: Source sequence=SeqID_929; Location=2821..3669; Strand=-; Gene=SeqID_64290
ttttcaagtcaattaggtgagggatttggaaaaatttttggttagtagtagataatattcccaatcaaattatcgattgattttcgcccgataatttgattggagatttttttctctgacatccccttccacaaacccaaacctattggatggggttgagaaagagaaaattctgtatttgctctaattatcccaccaatctccattaatccctcagtctctaattatcccccagtctaggaggcgtttgaaaaataatctctctatcataatcacacagtctccaattatccccagtctatgaggaggttaaaaaataatcccccatgggggataattagatcaaatacggtagttagataaagagagaaaatagtgagggaggagagtgtgcgatagaaaaatagaaaagtgagagagagagagagagaaaaaatgaaaagaattgtgttagagaaatagagaaaaatcggtagccattaaaaataaattaattgtgctattttttgcccggctaaaaaatatcaatactatgattaataaatttgtagaattgtttttatttttaaatgtttataccatattttaaaatatgtttaatttatttatattttcaggtattaaccataatttttggaaaaaaaatttaagcgcataaacaagcgcaactttgccaattcgtttgtggcgcgaggcgccgtgtttgccaacgcgttggtttataaggtttgcaataattatcattaatttatgtcacaataattttcctgaattaattgtcaggaggttttttgcacactaaacaattgttaagcgggggcgaaaccaagcgaagtgaggcagcaaatg

SEQ ID NO: 114760 - DNA, 1003 bp, Heterodera glycines
  Promoter: Source sequence=SeqID_7184; Location=3375..4377; Strand=-; Gene=SeqID_64073
tttttcacttcgttcgttgttatttcatcgcttctttttctgcaccgcttgcttgtcaaattttcgaattgtggccactggccagaaatggtttcccaacatttgagcaatctaatactattactcaccgccaactatttttctgcgcaattccggcttagaaatgagaaatttatacatttccgaaaatcaattttaattttttaaattttttgggtataggtgagggaagagagttcggcggtgtcgataggcgccgcggggaaattttttgaaaatttaatgcaattttttaacaagttctgtccaaaaaatgaccaaaatttgcgatcttgggctaattttaagaaaaaaaaataggagttttggggggccggcggtgccgataggcgccgctgggggaaaattttaagaattttaatgaattttgttaggaattagccaaatttttcagaaatttcctcttttaaatgaaaataaggcactaccccaaatcagaacatttcttagaaaataagaacaaatacacccctgctctaataggcgccgccggaaaaatttttgtaatttttaatgcgatttcttaacgattttgttcaaaaatgacaaaattacgattttgagccaattttttaaagagaataagaaaccgccgaagaaaaatttgaatatttaactgaatcttgttaagattttgcatattaattcgcttcaaaaaacatttctttcaaaaattatcattaaaaatctaaatttctccctgaatccaaaaaataagacgaaaataaggacaaagagcttaaataaggacaaatcttacaaataaagacatttaaaatttgtaagatttggaccctcaaaataaggacaaatcttacaaataaggacaaagggtaaccctgtactaatgaattacatataatttttattctccggcgtggacattaaaagtaatttaggttcttttttaacagaaataaataaattttcgtcttattcaatg

SEQ ID NO: 114761 - DNA, 323 bp, Heterodera glycines
  Promoter: Source sequence=SeqID_8717; Location=1..323; Strand=+; Gene= SeqID_68945
atatgtaaattaaaattaaataaaaataataaataataccccccctcagaaaaaaccaagacattaggatgaaaaacagaaagtggaaatagttaaaaaatatgaacaaatgaaaaacgaaaatggcaaaatgaaggacagcgaaattgccaaaaaactgaaaatttgccctggaaaattattggagctgagaaaggaatttcagcctaattataaaagtaacggcggaataaattaattgtttttaagtgatgactgatgactcatcctaatttattttccattttctttcccttttttaaaaagcgcgtgctttttcaatg

SEQ ID NO: 114762 - DNA, 353 bp, Heterodera glycines
  Promoter: Source sequence=SeqID_20858; Location=1..353; Strand=+; Gene=SeqID_51440
aaaaagtatcaatgataataatatttaaatttaattattattttaaatattatttgctaaatatgaatcataacttagcttaaacttagtcaaattaatgaaactcttggtatttggcgatagctctatatattctttgaattatatgattaaaaaatctagcaaaatttttacaaaaagttgtaaataaaaaaatttcgttaaaatttaaactcaataattgaaaactcattaaaaaattttattttaacaaaattatagagaaatctttgggctatccaatcatataaagaaaattataataggttgtttattaaaaagttactaaggaattcacgctcattattcacatg

SEQ ID NO: 114763 - DNA, 767 bp, Heterodera glycines
  Promoter: Source sequence=SeqID_19040; Location=1..767; Strand=+; Gene=SeqID_83774
ctatcgttatataatattttcaaaatgttcttagagagcggaaagccaaagactcgagaaaccgagaaaaaaagtcaattctttctcgagactgaagaattgtcacaacaatttcctctgaaaaatttgaacatgttggaattcaaacaggtcaatgatctaaatgagatatgcaaaattcctaaaaataataatttttaattagacatgtaaatgtaagccaaatgctccatttcattttataaaatccctcaatttttaggtgttcaacttcaacccatttcccatttccatgctccgattatcttaaaattaaaacttacgactcaaaaacttctataattttttttttctaaaataacttcaatatttattttgaacattttcacactcaatttttctgatttcgaggcataactttaaatgaaaatattgtaattttttgattatgactaaatgttttccttatttacattgacttaattgatttttagttatccatttaattataacgcaataatattcattagtggaaagccaacaaatgcttcattttgacaaaattattatttatacaaattaaatgcttttgcttatattaattttgtttaattttttttctgaaaatcaaagtcagccccaaaacggagccaaaccgaaggattccatcgatggtggtaagcaaaacggacggaatattttgttaaaattttgtgaattaaaaatttgtaaaagattaccagaaaagggacgacagcggaataatg

SEQ ID NO: 114764 - DNA, 551 bp, Heterodera glycines
  Promoter: Source sequence=SeqID_414; Location=680..1230; Strand=-; Gene=SeqID_51756
tttttatgatttatggcagaaaacaatgaaaaaaaaacttgatttttagaacatttttgatcataatttttcggaacccgtcagttgggcgctcacggttgggcgccagcacgtttttccaatttagcttttttatttgttattcaaatccaacaatcttggtatcattcgaaagctcttaacatgctctattagccttacaaaaagcggatagattttcaagcctggaaaaatttttattaagaaaaaacttcaaaatttcgagtttttcgcaattttcatgtatacgttttttgttatttgtctaatcgtgaagcaatagcttagaaaaagcttctaaatacattatgctttcgagtgatatcaaaaatgttggatttggacgacatagaaaaaagttatagaaacttatagtggaaaaacatgctggcgcacaaacgtgagcgcccaaccgatgagcgcccaactgacgtagaccgtaatttttcgttttttctaagctatttaaaatccatcgaaatctgtctttaataattttgcccaacaaaatg

SEQ ID NO: 114765 - DNA, 506 bp, Heterodera glycines
  Promoter: Source sequence=SeqID_7982; Location=1..506; Strand=+; Gene= SeqID_66589
cccaataaatatgcacaggtagtttgacggaatgagaaaaatggggattccggtttgggtgcactaaatccaccccgtatcgttttttgataatatttgatagagaaattttgcaaaccatttaaaaaaattatggttccagctccatttaattttaaggttggcttttgagacatatgaccgtttcgcagcaaatacctgtgaatttgcgcaattatatctcaaagcggacaacgactggtggttagtgttcaaaaggatcgaacggcgaattttggtgttgtttattttgcaaactgtgactacgtcgatcgttgacattgaattttacgtggaaaatattgtgaattctgctcctttcaagattctctttttcccttaataattcataaaatgacaaattattcaattggatttgcttccgttgtctctgagactttcgtttgttaatatttggtaaaattttagatgattttacaattaattttttaattaatttgacaatg

SEQ ID NO: 114766 - DNA, 290 bp, Heterodera glycines
  Promoter: Source sequence=SeqID_82; Location=2618..2907; Strand=-; Gene=SeqID_63763
ttttttggtcaatttgcaaaaatccctccgattcgatcaaagtgtcggcattttcgtcaatgtaaaataaacaatggcaggcaaaattctaaatttgaatgaaaataaagtattaaaaaaaattggctcgattgagaataaaaataaatgaaaaaaggaacattatggaaaaaatcgatgcgataatttccgcttttaaacccaatttggaaatatcaagttaaattgagagaagtttttctctcaaatttccttactatttttctcttctctgcccgccgctaaaaatg

SEQ ID NO: 114767 - DNA, 636 bp, Heterodera glycines
  Promoter: Source sequence=SeqID_37857; Location=1..636; Strand=+; Gene=SeqID_66838
cagctttcttctggctcctcctcgtccgcgtcgggtgcagcagcgggacgcgacgtgcacgtgcggacgccactgaacgacccgcggtcaccgtttaagccattggcttacacatcttttgagccggagaaacaggcaaatggaaaaatttatcaaaaaatgatgtgttttaattaaaactcttcatatttcatttaaatgatgtctttagtggagttcttccatatttaacatttcgagatttcttaaatatctcagtattttggcattatgttcatgtttcgcacccatttctgctggcatttaaaaaaccaaaaccacttttcgattagatttttaactgaatttttatgcattttaagagattttgagaatgaattttatatccatataatccaaacctctgtcatatctgtctaaagctaggcggtccatgataagtgtattttaatttgcattatacaatttaagatttaaaaataaacgtacctaaggcttgaattaaattttcttgtcgcattttttcaattaattcaaataataacaataggtgacaaattttccaagtttcaattttctcaggcacaaattcgtcttgaaattggctcaaacggcccctccggcatccgacgaatg

SEQ ID NO: 114768 - DNA, 473 bp, Heterodera glycines
  Promoter: Source sequence=SeqID_1780; Location=1..473; Strand=+; Gene= SeqID_75907
ttaaatttactcaatttataagaaactaagattttttctataaataaataaatattttttaaaaatttttattttttgtgtaaaattttttttagattttaaagaaaaaataaaatttcatttttatgtacatataagaaaaaattttctagaattttgaaaaatgacgtaaaaacatacaaaaaaaaaaaaaaaaatttgcataacattgttgtgtatgtgaataaatattttcgttattttttttttttgtttgatcggacgattttatggaagggttactgataagataaaaataaaagtgacagatgcatggaatgaaaagaaatacataaaaagcttaaaagataaaaataattaatttttttgctgggataaaattcggattttttgtgggatccaaaaaattgggcgcgaggaataaaaacagaaatttatctgcccaattaatcaaagcaaattaatgagaaatg

SEQ ID NO: 114769 - DNA, 100 bp, Heterodera glycines
  Promoter: Source sequence=SeqID_777; Location=943..1042; Strand=-; Gene=SeqID_61018
tttagcagatggagtgagtgtgtcatttatgtcgacaatccaacaactaacagcatcatataatttatctgaaatcgctacgattgtgccaaaaaaaatg

SEQ ID NO: 114770 - DNA, 442 bp, Heterodera glycines
  Promoter: Source sequence=SeqID_14644; Location=1873..2314; Strand=-; Gene=SeqID_78738
gcggggccaactcgccgcggcgctatctcgccgccgtccaactcgccgcggccaactcgccgcgccttgtttttgactatctcgccgccagattttttcgttaaaaaatacatttaaaacattaaaactatgtctcaatataatacatttcatcaaattttctctccaaactaagatgattcaaattgaaagctaacgcaggaaagaaaaattgcagaacgatggattcctcggcaattgtgaagattattggtcccacaaaaaaacaaaagtcatcacagtgatcaagaggcgtgtggcggaatgcatggaattgccttctcaataccggtactaatttagtatgtaaaaattttgaagtcccttaaattcagggttctgatttttgccaagaattcttacgcaaattgggcgcaagcaatgacagaagtgttcgcagatg

SEQ ID NO: 114771 - DNA, 1003 bp, Heterodera glycines
  Promoter: Source sequence=SeqID_4843; Location=696..1698; Strand=+; Gene=SeqID_55923
aggtcccggcaagtcccggttttggcaaaaattcccggtcccgtggcaccagggctggacgtaactgattttcagttacggccatccgtaatccgtcattacggcgattttttcagttacggccatccgtaatccgtcatgacgggggtcaaaaaaggccgtaatttggcgtaatccgtaatacgtaattttcaacaaaaattttttaatttaaaaaatccaatttaaaaattgttaagattaatttatgatcagaatatctgcttgttttttgaggtgaaaatcccaaaatagtttgtttcgcggtgtgctttttccaaaaaactggggaatgtggggggggggggggtcaggcggcgccgaaaggcgccgccggaaaaattttttaaaaattttatgcaatttgctataagattttgtctaaaaatgactaagattttggagctaatatttaaaaataattaggaatttttggggcgggcagtgccgataagcgccgccgaggaaaatttttttcagaattttaacgaattttgttaaaaaatagcaaatttttagcatttcctcttttcccctttgctagcctcccccccccctttatgtatgttaataatactacaaattaccaagaataagtcagattaaatcgaaatatgggtagccttttaataaaaatagaaaaaaaaaattcattttataaaaaataatcttgcaagaaatccgtaatccgtaactccaaaaaggccgtaatttccgtaatccgtaatacgtaatccgtaattacacgtccagccctgacccggacctacctttaaaaaaaccggtccgggtatcgggtaccaggtcttgaaaaaacagggtatccgggtctggccctaccaaaaaaattttttttttttgtgggtttttatttttgcatacactgtaactcattattaagcaatgaaattatattcagaaattcatcaacgacacatcgccggccaattattttgtcgttatg

SEQ ID NO: 114772 - DNA, 384 bp, Heterodera glycines
  Promoter: Source sequence=SeqID_20048; Location=2143..2526; Strand=-; Gene=SeqID_84826
aggtcctgaaaaaatatagaagaaggtatataaacagataggcatctataaatatttatacggagaagtcacattttagttttacgatcttgaaatttattttgatcctatatttgttagggggtcaatacgaggcgagcgtctggggttcaaatccgcttggctgtggattgtttaccgtaatttgaaaacatctgctaacctacagactccaagctcagaaaaaaaacatggaaagatccgggaagagattttataagcgtgattttagaaattcaggatggtgtgcagctgcaccactatatctctttttaattacccgtatctaattcattttttatagcaaacaagttacaaagctgtcagacaacaacgtcgatcatg

SEQ ID NO: 114773 - DNA, 325 bp, Heterodera glycines
  Promoter: Source sequence=SeqID_41446; Location=332..656; Strand=-; Gene=SeqID_69562
gaattcatcccaatatttttttattcactttttgaaatacctattttttcctgcaaattttattatcttagttatttaattatgctattctgataaatagttagtgaattatgtgttgtgcagccttaaaaatgtaattttctgactttttcactaattttcggcttggcgacattttgactcattttagcttgggcgacatttcgacgcggcgacattatgacgcggcgacatttcgacgcggcgacattatgacgcaacgacaccagaaaatttgttttctaaattaaattaaaaaattcgactgataaacacaaatacaatg

SEQ ID NO: 114774 - DNA, 202 bp, Heterodera glycines
  Promoter: Source sequence=SeqID_43308; Location=1..202; Strand=+; Gene=SeqID_71007
attttgcaaaatctttgattttgtctttgatttttcatcaactacctgattttaaaaataaaaacttgacttcaagacattcaatagctcattcgaaagctcattttttaataacattttccttcacttttagactttctcaatgtgaaattgaatattggaaaaggaataaatctgttaacttttatttggagttagaatg

SEQ ID NO: 114775 - DNA, 55 bp, Heterodera glycines
  Promoter: Source sequence=SeqID_22015; Location=1..55; Strand=+; Gene= SeqID_52650
atcccacacatcgagctcgaggcggcgctgcgatccgcctacagagttacccatg

SEQ ID NO: 114776 - DNA, 254 bp, Heterodera glycines
  Promoter: Source sequence=SeqID_12033; Location=1721..1974; Strand=-; Gene=SeqID_75560
tcagtctcttcctctctctttttccttttgtttccgacgtgcaattggtccttgtttgctttacatttatttatacagcaattcaacgctttttgttgttttattgttttgtaaaaaccaaaattaaatttatgcatcgctttctgaataaaatttattccattaaacgagccctaaatgagtcaattttttccaccaatcattaaaatttatttttaattttttatatattttattaatttgaaaaacagatg

SEQ ID NO: 114777 - DNA, 1003 bp, Heterodera glycines
  Promoter: Source sequence=SeqID_10023; Location=643..1645; Strand=-; Gene=SeqID_73074
tccttttccttatttgtccttatttggtgagtctgaatctttgcagtcgaaaattcctttttttccgaatattggacatgcttttgacttttgaaattttgttaatttgtttcccgataccgctcattctcagatttgcaccgcaagactagtaattaaaatccaacccaacctcacaaaaatttataattttttggacaaaatctaacggaccgtacttttttaattttaatgaaaaattagtttaatttattttatttttaataatttaaataattcttaatttttctttaatattttatccaattaatttctaatggaattttttttcttcccccaattttggtggtccatttggccacaaatatgctgtcaatcatcattcgcctatgctaatttttcgttcccatatttatgcggtgacgaggcgtcaattagcatttttcaaataataaatctttgtgatcacacaattttttggccatcgatttcccaggctgtgcttcttccctttcttcgtcattctttaatttttcatttgagtatttttttcttagaattttcctatttttttttcaaaatgcactcggaccaagagtcttgaatgctttaacatttaatgttcattttcgactaggcttgatttaattttttatggctttttatttttcaatttattcggtatcaatcttcccattttcacgcgatgtgtgcttctgttattcaaaaaatgcattttccccctttttttgcgtcccattttctatggccaaatcatcaccagaattttatgggcatatgtgatcaatcaagcaaataacttctttgcaaagaagtttttattttcataatcaaaaatttttggctgctctaattttttcaaaatccacaaaaaatgaaaattcaatgatcattattaggactgggaatatattaatataaaataaaatcgcaaaatatggatcaaaatcgcaaaatatgtacataaaattgcaaaaatatg

SEQ ID NO: 114778 - DNA, 638 bp, Heterodera glycines
  Promoter: Source sequence=SeqID_9836; Location=1600..2237; Strand=+; Gene=SeqID_72856
gcattttttaaacaaataacgtcctaactttgctcaaattagtaaagtttaaacttcttgatttcgatagctattagcttcaaaatttcatcaagtttaaaaaatgttatactgatttttggaatttgttgattattgttttctgaagctggacagaatgtttaacatttcgcaggctaatagatacttataacgacagaatgaaaaagttaaattttgttgatttgagcagttaagttttgttgatttgagcaaagttcttagaatgatttgtttaaaaaaaaattacaaaattggcgattttacgaaacaacccatcactcaatatatggtattatttatatggtagcccaatattttggtaattttccaggaaaccctaaacgtttaaagttaacctagaatgcctaaacaaaaagccattgttttttaatggactccacctcaatcgatggcttgtccaaaactcggtccatcccactttctcatggtgcacaattagacgttcatgctcaaattcgtcaaagagttcggctaaatataaaagaatattaatataaattagtgtaagagtaagctctaattgccataattagattttcaaataaaaaactaccaaggtttgcgctggagccatg

SEQ ID NO: 114779 - DNA, 353 bp, Heterodera glycines
  Promoter: Source sequence=SeqID_16166; Location=1109..1461; Strand=-; Gene=SeqID_80531
ggtgggtatcggtagggttttccaagcccactgaaactaaagggatgacatttttacccctccaaaaatggtttgaaaatttagtccatttcaaatttggcccaattcttagcaaattctacaaaattttcataaatttttccgagcctgtcgtttgtatcggctccggaaatattcaacttttgcaactttttaaattttttggaatatctgttgaaaatcgcatcgcaattcactggctcggtatttttccctaaagttttttgaaaaaagtttacattagcaattttttcggaaaccagcggggcaattccccccccccccccccgaaatgaaaaaaatttcagaaaatg

SEQ ID NO: 114780 - DNA, 622 bp, Heterodera glycines
  Promoter: Source sequence=SeqID_548; Location=1244..1865; Strand=-; Gene=SeqID_55915
tttaattaattaatggacacaaatttaatagttttgaggttttctcatcccctgccgcttcctgaagacatcttcaccactttgaatggaggccgaattttttcgcaaatcgactttcgggatgcttatctacaagtcgagctggacgaaaattataaagagttgtgcacaattgccactcatcgaggaaattttcagtaccaacgtttgccatttggggtgaagtctgcccccggcattttccagtcaattatggattcgatgttggctggttgtgcattcgcagttgcatatctggatgatgtgatcgtggtaagccgatcaccagaagaacataagaagcaccttcaagaggtctgcaagcgaattgccaagtttgggttccgaattaagccagagaagtgctccttcttcaaaagggaaattaagtaccttggcttcatcattaataagaatggaagaaggccggacccagccaaaatacaggcgatcgctgagatgcctgtgccaaccaatttgtccacacttcgttcgtttttggggatgataaaccattatcagcagttcgtgaagaacatgcgtttcatctgccaacctttggacaatctgcttaagcaagatg

SEQ ID NO: 114781 - DNA, 51 bp, Heterodera glycines
  Promoter: Source sequence=SeqID_31089; Location=1131..1181; Strand=-; Gene=SeqID_61462
atttttcagttgcgcgagttgaacaaatgccaaatcgatcgtgccaaaatg

SEQ ID NO: 114782 - DNA, 414 bp, Heterodera glycines
  Promoter: Source sequence=SeqID_40683; Location=1..414; Strand=+; Gene=SeqID_68938
attataatctatataatcatttacgaaattttgttctaaatttcgatcatcctatgtatccatgtcctatgtttgccaagttctgttgctttaccgtatccctacctaatgaataatttaattgaaaaattttgtattattaacattgtgcaattttccaatttcattcatcgaaaatggttttgaattagctaatcaatgatgattagcatcgccaaatgctgctcttcctttttgcataatcatttcacaaaaattttttagatattaccatccaaaaaaaaaaccctgtccttcccagtccacccattaaaagtatttttttttaattatttaattaaatttaaaaaaattaaatgtaataaaattcacttgcacacatattcagcagaactccccaagacagtagtaatg

SEQ ID NO: 114783 - DNA, 274 bp, Heterodera glycines
  Promoter: Source sequence=SeqID_13771; Location=443..716; Strand=+; Gene=SeqID_77696
atctaattttttcacaaaattcttagaaattgttgtgtcataatattacctaaaagttttaaaataatattttaggaattaaaaaattttttgataattcttttttgaaaaaaataaaagtcacaaaatgaccaacttttacgttaaactttgaaaatttaattggaattttggagatctgtggaaatttttgggatttttacggattttttaagaaaaattagcaaatgataatattttttaatttaaaattcaagatattaattaaaaaatg

SEQ ID NO: 114784 - DNA, 127 bp, Heterodera glycines
  Promoter: Source sequence=SeqID_3927; Location=2254..2380; Strand=-; Gene=SeqID_52478
ttctggcactatataaagttaatttttgcattttcttccatttgtttttaaccaatatcctatgtatgcatgtaacaaaattcattttatgttccagtgacaattgtacatacaatacatcattatg

SEQ ID NO: 114785 - DNA, 68 bp, Heterodera glycines
  Promoter: Source sequence=SeqID_26350; Location=783..850; Strand=-; Gene=SeqID_57090
ggtcaaccaattagggggcaattaatgtgaattcaaaaagtaattaaatttacaaattgcagggaatg

SEQ ID NO: 114786 - DNA, 441 bp, Heterodera glycines
  Promoter: Source sequence=SeqID_42585; Location=549..989; Strand=-; Gene=SeqID_70441
gtaaaacgaaaaactctgaaatccttaaaaaaattcacgacaaaaaagatgctttcagaatgatgaaaattttctcacttttttttggtaattttttttttttttgtttaaaaagtcattttttagtgaatgtttgcctagtcaggaaacgggagagagaaatgcggtcgggttgggtttggcggtcacttagtcaatggtcgatggacggagttatttggagacggaaggacggattggggagggatggaacatgaggaagaaatggggaataagacaagatgaatttttgcactgcaaattttcccatttttattcaataggtatttttgaatttttcaatgttttcataaatatttacgggccaggacgttttcgcgtgagggccgttttcgcgtggttgcatataaaagagaattcataactcacatttatttcatg

SEQ ID NO: 114787 - DNA, 438 bp, Heterodera glycines
  Promoter: Source sequence=SeqID_43870; Location=1..438; Strand=+; Gene=SeqID_71449
ccacaattacaacttgattaactaccgatatcattaaaaacatatatattaaaataactggtgcgtgaactgtcggatctgcgaatgtgataaagcgcttcgcgcttcttgagcttcgctacctaggctgtgaagcaattcaaattgatcgaattggttggagagatttttttgaatttttaaaaaaattattaggagtttttagtccacatcgaggctcaagacgggcgcttcgcgcccgttttttaaatttgttaaactcatacgggtgcttcgcgcccgttttttttagcttgttaggccacttcgcggcctcagtcgggcgctttttagaaatattttcctaaaagcatgtcatgccggaaacttcttttctaattttatacattacatttttattgccttctttattcaatactaatcttttaattaagaatg

SEQ ID NO: 114788 - DNA, 259 bp, Heterodera glycines
  Promoter: Source sequence=SeqID_3087; Location=1588..1846; Strand=-; Gene=SeqID_47523
agcgctattaatggcagagggggggtgattaacggacaaatggacgacagaggagagagaggagatgattgatcaaggacaaatggacgatagaggggagagagagaggggatgattgattaatgataaatagatgacaaaacagagaggggatagaggggatgattaacggacaaatggacgacagaggagagagagagggacagatgatggcaaaaatgaaatagaaagggagggggaggatgacaaacaaacaatg

SEQ ID NO: 114789 - DNA, 631 bp, Heterodera glycines
  Promoter: Source sequence=SeqID_12862; Location=3101..3731; Strand=+; Gene=SeqID_47086
atgtgatgtgatgccctctgagtgatgatattattacacttatgtatgtattgtatgtgattaacagtctctctctgttcatttgccctgcttttgttcactgtacatatgtgtatatattgtcattcaccaattactgtatgtatattgtatatatgtgatgtatcgagcaataaattttcaatgccatgttccatcataatttctgctgaattcgaacgtttaagataagcagggcttcaatctgtgtttattttctgatttggaggatccaaatctgtcaaaatactaatgtacttatttcttctccaaaattgataaaactgataatgggaagcaaaaagcataatatttgacttttgttcgaattccggtccggggtccgaaattggtcgaaatggatgccagattcgtgatcagcggctccgaaaacctatggaaacatgttttcatgatttttgaaaacaaaattattttttcgaaaaaatggctgggaaatttgtctataaaaggacgagaatttggcatttccaatcatttcaatcgttccctttattctcatttgctattcttccctccacttcttcgactacaacaacccatttcaagtgcacaacagcgtggacgcatg

SEQ ID NO: 114790 - DNA, 1003 bp, Heterodera glycines
  Promoter: Source sequence=SeqID_15156; Location=1576..2578; Strand=-; Gene=SeqID_79350
tccgtcacgtaatcagtcaacaacagtcggagattcatttgaccgaggaaatttcggcgaaagggggaatttgggtaactgactcattcattgaccattcatttctgcggtttcggatttgggttgggttggctattgtctgtaacggaagcgatagaaacacatttccagaaattgtcgaattgggggggggcgattgcatgataataatatatatatatatatatatatatatatatatatatatatatatattaataaagctggtattaaaaaccaaaggcaccgggagacccgtttaggttcataaatttttataaaatatgccttatcgtaaaaaattatttatatttgttttcggagttctgtttacgacgaatctgctatcctttcaacaaattgctgaattccttaactctaattcgaaataagctaaatgattcgaaattggttgctgtcggtttcgtgaccggcgacctcaaaattaccgctggaagcatatatattttcacgacattttatgtcaaaaaaatgtaaaccaaaaagaccttccctttggtttatgataaaattcaatgtgttcttctttaagtagcaccgaagctgtttaaatgacataataggttatcctttttgagcttttaatgtggctaagatttttgaaaatagagaaaacgcgtttttattggcatttttcaaatatttggcataatgcttttcaaagtctgatttttttcattcataaaaatttttttgtggaccaaatacatatttgcgaaaagcattacaacccgagatcgtgtcgttgaattaaactttaattaaactcaagaaaaaaacatttaatattttagtttcaaaaatgcttaaactcatttttttcaaaaaaaaatttcctattttctgtttatttcaagatttcaaccatatgttttgcttttgttatttgtaaaaatgtgacaaacttttgtactgctgaaattcataattcccttttcagatg

SEQ ID NO: 114791 - DNA, 729 bp, Heterodera glycines
  Promoter: Source sequence=SeqID_26028; Location=346..1074; Strand=-; Gene=SeqID_56782
ttggcaatcagcaatgtcacaacagttttgctgccaaatggcgtgcaaaagcattggtgaggggggggggggggtgaaaagccgcttcttcggcagtcgtggccatttgacactcttcgccctccttcagccgttgctgataatatttgtctattttcatttcataatgtgttgtaatgtgaaaaggcagcagctgaagctgcgctcaccttttgacctcatctccttcccttttctcctccccccccacgcgtccacttggcatactttccatcattttcaacgacacttccccgccccttccttcccacttcaccaacaggtgcctccctcttaaattgaatgcacatattgccacacgaagcggtgcttttatggattagaaaagggagagagaatgggcaggggagggaggtaccatttaaagtaatgggccaccattcattccattctcttgaactctttttaattttgtgcgcgaagcgttgtgattattttcagcgtttctcgtgcgattttcttattcttgttttttccatctaaacacaggccccttcaaatttgtttctaaacacatattggtatacatatgcgacacttaatctacacaattttccatatgttcctgtttttttttcaaattttgcaatataaaaaaatgtcctccattaaatggtttccatcattttactcataatcaattaaaatttctccctttaaacagcaatg

SEQ ID NO: 114792 - DNA, 659 bp, Heterodera glycines
  Promoter: Source sequence=SeqID_2422; Location=1079..1737; Strand=-; Gene=SeqID_79639
taccagattgctaaatttaatttttgggccattttttaagaaatcggacgtattaccaattttataaaagtcataattctgtaatcagaaatttttataaaaaatgccagtaaaaatacattataataagcacatgaaacaacaaaattcttcaattcaatttacaaaattaaattaaattttatggttttaaatgactatttataaattttgaatcttttcaacgcatgcagtcataataaataatagaaaactagaaatacttaaagcaaaattatgttcataatttgtggatttgtgttaattttgtaaaaaatttttattttaaaattttatattatttttaatcttttgtatttttatacaaattcttttttgctcatgctcacccaatgcaattgaaaacattcaattcaatgctgacattgttcaatttgttaatgacaatttttgcaactttccctttccaattttttggaaaattccaaaatttttttctcaaaaattgccaatattatacaaaaaagtaaataatgaatgattggcaggcatgcaaaaaggaaccaggaaaataatacgtgaccgtacatgtgtccgtaaaatttattaatgggtaataaaatgctgatgattgaacggcacattttctgcgcagaatg

SEQ ID NO: 114793 - DNA, 265 bp, Heterodera glycines
  misc_feature (41)..(41): n is a, c, g, or t
  misc_feature (142)..(142): n is a, c, g, or t
  misc_feature (163)..(163): n is a, c, g, or t
  Promoter: Source sequence=SeqID_41761; Location=703..967; Strand=-; Gene=SeqID_69819
ttttttttaccaaaatgtcataaaaatccaataaaaaatanatatgtaaattaatttattatattttataaaaaattttacagagtgtacgccgaaatttgtcgcagatcgatcggcacatattttaaccaaattttccacncaaatcgatatgacaaacatntaattccggaaccaaatggagtcactgtggcaattgaattagctcttcaagtaataataataaaaaacaaaaatttatttaatttttagactttttacgatg

SEQ ID NO: 114794 - DNA, 165 bp, Heterodera glycines
  Promoter: Source sequence=SeqID_35200; Location=1..165; Strand=+; Gene=SeqID_64808
gaattattttttaaataaaaaattctctcgaaaattctagtaaaagtgccagaagataattgtgccactttttcacaaagtgccaaaagataattgtgccactttttccatggtgttctactcacattgtgccaccgccgaagagggcaatttggcgggatcatg

SEQ ID NO: 114795 - DNA, 105 bp, Heterodera glycines
  Promoter: Source sequence=SeqID_40898; Location=1539..1643; Strand=-; Gene=SeqID_69131
tcgaacaaaaaagcagtggtcaacaaaaggcagtggaaccgcaaatgaaaaggcagcaccagaacaacttaacagcgcaaagcccacggcaaacaactcacaatg

SEQ ID NO: 114796 - DNA, 173 bp, Heterodera glycines
  Promoter: Source sequence=SeqID_39963; Location=135..307; Strand=+; Gene=SeqID_68412
ggtgagaaaaaagcaaatgggaaaagggacgaaaaggtcggacaaatgagtgatttttggccattcctttcaattggcacacatttcttatcaaaaaacccaaagtccaaatgtattcaaatttagcagccaaattgttggtggaacatcattctttcaacgggacaaaaatg

SEQ ID NO: 114797 - DNA, 208 bp, Heterodera glycines
  misc_feature (19)..(19): n is a, c, g, or t
  misc_feature (77)..(77): n is a, c, g, or t
  misc_feature (102)..(102): n is a, c, g, or t
  Promoter: Source sequence=SeqID_11301; Location=1..208; Strand=+; Gene=SeqID_74680
ctaaaatttactattgccngaatagataaaattattataattgccttttatatgagttggcattgaccaaaaataanttcaatgggatttggcgtcaaaatntaatcctaaaagttccaaattttgaaatgcctttgaattttaatgccaaacgaaaaaacaatttttagtcaaaacgacaaatttgccctccggtgatgatcaaatg

SEQ ID NO: 114798 - DNA, 166 bp, Heterodera glycines
  Promoter: Source sequence=SeqID_12616; Location=1697..1862; Strand=-; Gene=SeqID_76275
aacttgcacctattcacatttttgtgacattgtttagacgctgccgagagtttgtgccgggtacgaacagaacaaaccgttaccacagatgcgatccgaccctttatggatgttgggaggtcctttttagatcacttaatttttgctattttaaatttaatttatg

SEQ ID NO: 114799 - DNA, 201 bp, Heterodera glycines
  misc_feature (60)..(60): n is a, c, g, or t
  misc_feature (68)..(68): n is a, c, g, or t
  misc_feature (83)..(83): n is a, c, g, or t
  misc_feature (113)..(114): n is a, c, g, or t
  Promoter: Source sequence=SeqID_33023; Location=825..1025; Strand=-; Gene=SeqID_63220
ttggcatttaaaacacttttcttgcaactgtcgaattttcaatcgtttcagctttcaaanaattcccnacaaaagtcaatttncaagcagtgagtcaaaaaattcactttaannttgtgaattcgtaattttaacggtgtaccagggccaattcaaaagttaacagaataaagaaaaataaaatttcagtgcttccggatg

SEQ ID NO: 114800 - DNA, 92 bp, Heterodera glycines
  Promoter: Source sequence=SeqID_35929; Location=48..139; Strand=+; Gene=SeqID_65385
tcgcatatcgccgacttctttcaacgaccaagcggctgcaatgctcccccgagcttctcgatcgctattccgccgaattgacacggcagatg

SEQ ID NO: 114801 - DNA, 1003 bp, Heterodera glycines
  Promoter: Source sequence=SeqID_1735; Location=122..1124; Strand=+; Gene=SeqID_75573
atttatacgatattttaattactaaaatggttttaactggataatcaaacttaaaaagcagaaacagaaattaaacacaacttccaaagcttcgttatttgtatttcttgcatattaaatgataaaattaattaattaattttttttttttttggagcgagtattaatgacaaactgacacataaatccggtttgaccaactctcttgtgttcatccgctgctaattgctcatttttttcccgacaatgaagatgcgcaatgggttttttttgcagaatcccacccaaatcttcgcagatttttgctgcaacttttttttggcgaattgccgaaggcaatttgttccgctaattgcttttatccttcggaaatgcgtgcaaaaagcaaattagccaagatgagcagaaagtaaataaaggagatttgcgaattaatcactggatgattcctgcattcgtctcactgcccaattcgatgacagatgcgtcggcacttttgatggatggactggacgacttattcgtcttcgggtaatcgcctttttgcggaacagcgccgcgtcattattttactaatgagcagcgtaattgctattgtcatatcatattgttgggtttttgtctcgtaaaaggagcacgatcagcagaccgaaacaggaaatggtcggagggatctatagctcaaaattcgggggatttgatggatgacgtttgagcggatgaaacatgccttaatgttagtgaaacttcaatttgatgagaatcaattaaaaatgatgaaagtaataaagattggggcgtgaatcgtcggcccctaaaaaatgactgtccattgaatttgattgattatttgggttgaatgagcgctaaaaaacaaaaaattaaaaatgaagaagcaatgctcaacttcaaaactgcttataaagcacggctagagcaagcacaaattatcaaacttcgcttttccatcaaattcaaaagtcgccttcgtttgtccgccatg

SEQ ID NO: 114802 - DNA, 304 bp, Heterodera glycines
  Promoter: Source sequence=SeqID_30469; Location=1..304; Strand=+; Gene=SeqID_60871
caagttgtgtatttgatgagtgccattgaaggcgcccccaaatcttgcaggtgttttaatttaaataccgagagggcggaggggggggggggttaagtatattcataatcttttttttctatccaataaacttggcatcattcaaaagctcttgacatgctcaatcggctcaagaagcacaaagatatgccgacaaataaaaaaagttataaaaaaaatttgctcaaattcttacctttttgcggttttcgtgttgcagctttttataaaaaaatttaatcgcttaaattaatttctagacatg

SEQ ID NO: 114803 - DNA, 346 bp, Heterodera glycines
  Promoter: Source sequence=SeqID_11638; Location=1..346; Strand=+; Gene=SeqID_75086
atttgcgcaaccatcggacaaagcaggagaagaatttggacgaaattgacaaactgaaggtgtgttgcgttgttttgtggacatttttaggggagttaaaaaaatctttttgtaaattgtaatttaaattataatttagaggagagaaatgcgttgccaatatttttttataaccatttaattttttagaatccttaatattggcacagggaagggcggcttgtatgttcagattagcaacaatttaaaaaaaatgattttatttttcccactctttgggcggggggggggggggggggtcgaacgcagaaaaattgcaaatttaacagtttgattcgctgtcatg

SEQ ID NO: 114804 - DNA, 410 bp, Heterodera glycines
  Promoter: Source sequence=SeqID_258; Location=1212..1621; Strand=-; Gene=SeqID_79951
aatcattagtttcatactgtataaacaaagatatcaaattattttaatttctaatatgtgggttatgtttggaattgaaaaaatttgaggaatttttagtaattttttggtgcttgaaaatgcgtaaattaattaaataatgaatttcatatttattaaatggtatattctctatatttaaaaaatacaaaaataatttttgcaaaaggttgccctcccgtggtgtatttgctgctgaacaaacgaattcggaacgattgtgccaactttggccgtgccattttccgttttttgcgcaattgcaacaacaattcggtgtcaaatgggccaattgccatggcatggacggcaccaaattatgccgtgaacaatgtcaacaggaataataataataatatgccacaacgatg

SEQ ID NO: 114805 - DNA, 93 bp, Heterodera glycines
  Promoter: Source sequence=SeqID_27497; Location=1..93; Strand=+; Gene= SeqID_58187
gctcgtctactccatgctgaatttgataccatcaagcgggggcgaaggcagactccctgctgtgcaaatggcgccattcacacagagcaaatg

SEQ ID NO: 114806 - DNA, 1003 bp, Heterodera glycines
  Promoter: Source sequence=SeqID_1232; Location=5220..6222; Strand=+; Gene=SeqID_70319
aaatttggtgtatcgaaaaaagtgcaaaatctgcaaagtttatttttactaaattaactcataacttcgcaactaaattgcacaatcttggtatcatacgatagcccttgaattgcgttattagcttgtcaaatttcaaaaaattttatttaagttttccaaaagttatgaccattttttcctgttttttggcttggacttttgaaaaaacttaatgagttttttgaaatttagtaagctaataacgcaattcacgcgcaatcgtatgataccaaaattgtgcaatttagttgccgctaagaaaagttatgagttgatttagccaaaagtttagcacttttcgtcgatcgaccaaccacgtaaatcaacatctaatttatttttaagacagaggcgaataatatcaaaataaatataggggagggaccacaactgatgagtaaaaaatagctttttaggaaacctctcagtatgaaaattttgaattattcgaaattaatcgaaaaatcaaataaagcattgatcagattttttgtgtcgtgatttcggctttattaaatcttcaaacagtcggtcaaaagcccttttagttgttgcgcgatgagcacatgcgcgcgctgcaacggatggacttgggcaaatcagggggaggccgcttttcggactgtgaacagtggaaagtgatgtgaaatgatgccataatccgttatgaggataatgaaaacaaataaattagcacttataccgtttaacttgcacgatttttgaaaattttggtatttcaaagtcatgaaaccattctctttacaaaatatgactaaatgacaaagtccgggcgctcggcctatctgaatgagtccattgttttatcagtgatcaaatggcatgccgctaatggaaatttgaattaaatattaatttaggcaaaaaatcatatattaatggattttacaaaaaaaaaatatttatttatgtagatttttagtgaaaatgccaaaatatg

SEQ ID NO: 114807 - DNA, 702 bp, Heterodera glycines
  Promoter: Source sequence=SeqID_19538; Location=772..1473; Strand=+; Gene=SeqID_84270
ttgatacaaataagttaaaagaaagttctgtagcattaagtattgtaatataaaagtaaaattctataataacattgttctaaattccgaaccccggacccgaaatcgaaaaaaagtcgaaagtctaaatatccgaaattgaatttttggtccaaaatcgatttaaacacatggaacacatggaagtaaactgaaaggccatcaatcaatccttcaatatgaaaacatttacgcattttttaaaccaaaaactcaaaatttaataatttggattatcgacttttttgttcgaattcgggtccgtggttcggaattggcagaaatggataccggatttgtggtcagtgacctccaaagcccaaggatttgtttttttatcacactaaaatttcattgacgcattttcctggaaccgtctgtacaatgtgatatgaaagacagagcccattgggcctggcgcagagtgggccaactgcttatatgttagacaaatttaacaaaatgtataataacaattttttatgttggccaaatccaagaataaatggtttcattcatgtaataatatattcctttgtgaaggcctattcataaaaatatacattaatccatgttattcgaaagggaattttcgtaaaatttaaatgcacataatttgtataaatcgttcttttttattaaaatttgaaggtaagaaaaatg

SEQ ID NO: 114808 - DNA, 80 bp, Heterodera glycines
  Promoter: Source sequence=SeqID_41041; Location=1..80; Strand=+; Gene= SeqID_69260
aaaaaatttgcagtcaaaaaattattcgaatttctccattttgtttccataatttccgaaagttattcggtatcataatg

SEQ ID NO: 114809 - DNA, 80 bp, Heterodera glycines
  Promoter: Source sequence=SeqID_45009; Location=1..80; Strand=+; Gene= SeqID_72401
cgcactttttattatttaaatcgaaatttagaatactcatttttggacgtgagtcgaatggtcggtgggcgaatgaaatg

SEQ ID NO: 114810 - DNA, 812 bp, Heterodera glycines
  Promoter: Source sequence=SeqID_1540; Location=857..1668; Strand=-; Gene=SeqID_74335
atacggtgcgcgaccaacactacaggcagtctaagaaaatgatggatggatgcctgttttttttttgaccaattgacgatgagtgagtgatgttatgagattttggctaaatgattttgtggcgttatcaccatatgttttcttcttttgatttgaaaaatatttgacaggaaaatttatttgttgtctcttgcattttggtccatttcttgtcttacccgaaggcttttaaagtctctggattttataaattgaaaaaatgagagattggaatttaatatttccaatgcacattttggagcaaatttaaaaaacatttctcgattctggattatttattttattggcattatgataatcatggaaaatagaatggaaacaatgttggtcttttatgctttgcttcattcattagttgagcttttccgttccgttgtttcttgtctcattcattaggcccaatttgagtaaaacatatgctggcaccaaacaattctcgggcttgttcaattccacaaggctaaatcactattaaatgtgccgttcacccgttcgcttactcggcacagtctctcagcgggtcaaatgtgcgtccgtgccgtgccaccgctgtcgttgcccaattgttgtcccaccagtgcagacacgctgagaaacagctgtgcaccaccgcctcgcggtccgtcaggcagcaaaaaaagaaaaaacatcgactttttgcaaaaaacttgcaggaaaatctttaaaataaatttttttttttaatttcaagaaaaatataaaaaaatttacagcgattttttgagaaaatg

SEQ ID NO: 114811 - DNA, 894 bp, Heterodera glycines
  Promoter: Source sequence=SeqID_13392; Location=864..1757; Strand=-; Gene=SeqID_77278
ggtgatgcttcatctcgcccatcctagtgaatgaagcacgtcccgaataagcatatccgcagagagagcttcctcagatcgacaacgcatccacggcaatttttcagaaaacggaaaaacggcaataaaatttaatgattattgctacgtttcagtatgggctggcaggatgagacggacaatatacctatgctttttggcttgttaattagcctaaatttcaaataattttttgcaaattttaaaattcatatgattggtagtgctgtttcagatcgaaaattcccggagactagagaccgagatttggccccgagactagagaccgagacctcgagtcgagactcgtgaccgagagtcttaaacagcactaatgattgggcgatgccggcgataaatttccgtttttttcgttggtgcctgttctgcctgtaatttatgtaaaacgtatccaggaaacctttcaacttttggaaacaaccacccacccaaccatttttgggcgtattcctttctgatcgagaccggaaaactatttggggaacaaagctgaaaaaatgcataatccgtcatgacggatttgcaaaaaagccgtattttctgtaattgttgacatatgctattgaagtgttagctaagtagtaaaatgtatagataataaaaattttaaatcaaaaaagcccccaaaaacataaatttcttgaaatttctcccattctctccccttttagaaagtcgtcttcgatcacttaattccttagtttgcccccaaatgccatcattttcgacatttcttcggcatttttctgtcccccctcatccttccgttacaaaaatttcgcctaaccaaatttcggagttttaaaattttattgtccagccatttttccgatg

SEQ ID NO: 114812 - DNA, 1003 bp, Heterodera glycines
  Promoter: Source sequence=SeqID_3436; Location=1200..2202; Strand=+; Gene=SeqID_84675
accctttccctgcttgtgcaaattgggagccgctcccgtggtccccgcaattgacacactctgtattctttcctttattatttttatggctcaaaaaattatataattttgaaggtattccaataaaagaaaagcaggaaaatcaccaaattatgcaaatataatataaacgttcaaaatggaatgatcacatgaaaaatggttttatgtaaaaaaaaatgtcaggagaaaaaccaaatggggaaagaatcggtttatgaatgactattttgaaaagggtaattttatattgtacatttgccctacccatttttcaaaaaaaagaagtaaattttatctagcttaaaataagtccatttccgggtatcgaaattcgtttacgaaaaatgtgccatggcaaaccttcctataaacaaaaaaatgatgataaaatgacaaattgtcttcggaatttttgcccacaaaatattgagttaaagcaaattaaaatttttattataaacatatgaccacccgaaaacggagtgtgtcagacaaaggcaaatgtaattcgggcattaaccggtatttcgcctaatgattggtatcattgtaaagcccattaaaaatgctacaaaacgggtaagattgtaggcctataatagagcttactaaaattttataaaaaattattattggaatcggaaaatattataaacatacagtcatggtcatatgtttaggaacacctcttttttttgaataaattctttgaaaatattgcttctctggattgaaagaaaaataatcaataatctttttaatgcattttgtagcattttttctgggctatccattggtaccacacatttctcgtttgctttattcctttttgtaaaaatttgtgttttcttccatatagtcaaatttcggggtggtcatatgtttaggaacacttcataaaattcatattttctaacaatagaaatgcctaaaaaaattcaggtaagcataactttggatg

SEQ ID NO: 114813 - DNA, 517 bp, Heterodera glycines
  Promoter: Source sequence=SeqID_11899; Location=573..1089; Strand=+; Gene=SeqID_75411
aaattggaagtgaaagtgacggagcccggaagtccagcaaaaattttttttcctctgaatgtttctctgttcagcactttctagtcgtgttctgttcttacatttttcatcaaaattccgggctccggtgatgacgaatagtcggggagatgggtgctaatggacggagtgcgaaagtattaaaaatgaatgggaagatgtgataaatattatttctatttatttttatctgctttgtcttcatcaattgactaacttacaattagtctgtttattgtacattatcatggaaaggctgtgttcaatcattaatttctttcttctatttcaattcaatttgtgtccgatttcaaaattccgagaaaactaattccaaatcaattgtttttagactgaggacttccattttctcgtgatcataattatcatgattttggatgtaaacttacatttttctgaaaaatttttatgttggtgttttttcaactgattagttaattttgcagccctaatcatg

SEQ ID NO: 114814 - DNA, 590 bp, Heterodera glycines
  Promoter: Source sequence=SeqID_27640; Location=650..1239; Strand=-; Gene=SeqID_58320
ttttatttttcacaagaaattttataaattttcaaaaattttcaaaatatgttataaaaatttgaaattatgtacgaaaaatttgccgaaattttggatttttttttgagaatttccgaaaatttctgtaaaaatccacaaaatatgtaaaaaatgtatgaaaaagtccaaaatatgtaccacatatgtataaaaccccgaaatatgtaaaaatatgcaaataaaagtccaaacttttgagtatttcagggctcagattcgtacttggatgccaagtacataccgtatatactctttttatatgccatggtatattatttttcaacctcctcagaagggggtagataattggagattggtagactaatagagactggaaattatttttcgatgatttatttagtggaaaatttttgaaatttattttgaacatgtcgccaaaaaatgtcatcgcgtcaaaaaaaaaacatttttattgcatttatgttaaagaacttctgaaaatgactccaaaatgacaaaaatctatcattttcttgcttccggtatgcataaaaattggaatttttaatgaaaagttaagcaatatg

SEQ ID NO: 114815 - DNA, 101 bp, Heterodera glycines
  Promoter: Source sequence=SeqID_2158; Location=1..101; Strand=+; Gene= SeqID_78144
ggaattcaaaataaggtaaaggaagaagacaaagcaaagggggttataaaaagtgcagattttaatttagccactaattattattttcagactaattgatg

SEQ ID NO: 114816 - DNA, 428 bp, Heterodera glycines
  Promoter: Source sequence=SeqID_3985; Location=2226..2653; Strand=-; Gene=SeqID_52702
ttgctctgtaaaaaatgattaatttatataaattaatttatgatttttttgaccgttttgaattcttcacaaatgctttttttcaaacctttttacattaattctgaccgtaagcaattctgagtttgggacctcaaaccgatatttaccaataaaagaatatttcaacaaaacatattgatgaagaaataaaaaatgttgaaatcacaggaaagaaaccgaacataaaaatggcatagacaaatcaatggaaaaatggttggcattggcataatttccggcaaaaaattttggaaaaacatttccaatttcaaagaaaatagacgttttttggaggaatataaaagccaaaagaaagccaagcgaaaatcatattcgaaattattttaattaaattaattaattccctttcccaaacattcaaaatg

SEQ ID NO: 114817 - DNA, 205 bp, Heterodera glycines
  Promoter: Source sequence=SeqID_9686; Location=1076..1280; Strand=+; Gene=SeqID_72349
agtcagtcacttaggttcaagcgttcttcctcccgtaaaattaatttcgaaattccttttaatgggaaattttttaaaacgaaattccatgcactttacttttgggtctaccgtcaattccgtattcttttcctcaaccttatttttaagccatttcagcaatcattcttgctttgtttagagccgtgatcagttcattgaaatg

SEQ ID NO: 114818 - DNA, 212 bp, Heterodera glycines
  Promoter: Source sequence=SeqID_5713; Location=302..513; Strand=-; Gene=SeqID_59003
ggtatgtcagataaataatatattttttaattccttggtcatactgatgactcgttgagagttttattttttgaaaatatgacgaaaaaattcaaattttttgtgtttttcaaaaacaacctattgttattatttggaaacaaataattgctcttaattaccccacccccgccggtacattaagttcaattaaggtgcactttctcaaaatg

SEQ ID NO: 114819 - DNA, 75 bp, Heterodera glycines
  Promoter: Source sequence=SeqID_26534; Location=472..546; Strand=+; Gene=SeqID_57273
aaacgaagtgcggtgcgccgtggccattttatttttcaaataatttttaaatttaatagatattccagaaaaatg

SEQ ID NO: 114820 - DNA, 1003 bp, Heterodera glycines
  Promoter: Source sequence=SeqID_5124; Location=925..1927; Strand=+; Gene=SeqID_56999
atttcaaaaaaattataaatctgcaaatatattattgttttattataatttttttttcattaattaacatattacatcactttccaattgatttaataattatagggtttttatttttattgctatagcattttttcagttttttatggaatttaattttttgtaattattttatttggaatatccttttttttctttgttgatgatttgctttttatgtttcaaagtgaaaaaattatgaaacttgccttcatataatataatattgcttctcaatttcaagcgtaaattttcatttaatttaaatatttttattgaattacatacgttcaattcactaattgcataatttatgctcttattttatgattttcctttattaaaagataaagatttttgtaaattttatatttggaatatcgctttttaacaaaatattttacaaccttaaattatagcgcattaagccgataatgaccagaagtgtctttttacgattagtaaaattttttattaatgcgaaatcttggcttgtatttaaaattgtgctgtgattggcctatcgaacgcttgccctattcgaaattgagcctggcgtggcatttgagggatcccttacctaaatatgcctgccgtatttcttgtttattgggattgcgttatttttcattaaaagatctgttccaatcctgcagtggaattctcaaagcttgattttttataactccgccagataaactaagttttatctttatcttcaagttcaaaaattaggcttctttctaaggtcaggcatctgactccaagaaattagtccttttttgagatatatcccgaccccgatgccatttttgaaggaaaaagttaatttatctttgccataagtttttgaatttgtagttaacgaattgtttcgatggttgaatagtttaatgctgaaaattatttattttttaaatgacattaccatactatttattataattaatttttgttctagatg

SEQ ID NO: 114821 - DNA, 98 bp, Heterodera glycines
  Promoter: Source sequence=SeqID_24622; Location=1157..1254; Strand=-; Gene=SeqID_55361
ggtacaaaaatgatgaaaaggaggtacaccagtgatttaaaagaggtacaacagagattaaaagaggtacaacagagattagaagatttacaaaaatg

SEQ ID NO: 114822 - DNA, 235 bp, Heterodera glycines
  Promoter: Source sequence=SeqID_1667; Location=1713..1947; Strand=+; Gene=SeqID_75208
attcttttttctcgttttgccttttccggttttcttttgtatttttatccttttttattattgactggtaaatcaacattaaattacatgttaataattttctttttttgcttgtatatttgcatttattttttattttaattgactgtttttatttaaaggcctttttgtcatttcacaagtttttttgcgcacatataacattggtagctaacactattaacaacggacaatg

SEQ ID NO: 114823 - DNA, 80 bp, Heterodera glycines
  Promoter: Source sequence=SeqID_17331; Location=1655..1734; Strand=-; Gene=SeqID_81811
ggtaaatccgtaaattttgcttatttctgatttttttttaaatttagcatagaacggtgattggtgtgcctcaattcatg

SEQ ID NO: 114824 - DNA, 157 bp, Heterodera glycines
  Promoter: Source sequence=SeqID_176; Location=232..388; Strand=+; Gene=SeqID_76512
ttttttaacaaccaaatgcctgtaatgtttgcaccaccaaatgtgcagtacccaaacactgcaataaacccagagcgccaaatcgtgaatcagcaaaaataggcagcaacaaatttttccacaacagacaagtctaagtggacttgaatacgcaatg

SEQ ID NO: 114825 - DNA, 410 bp, Heterodera glycines
  misc_feature (33)..(33): n is a, c, g, or t
  Promoter: Source sequence=SeqID_21399; Location=1..410; Strand=+; Gene=SeqID_52010
gcaggaagcagttcaggcaagttgatcaatttnaacattctaagtgagagattttttatttgccggtaaaaatcaaaaattaaaaatttttatggcccaaaaacatggtcagttttaaattgtaaaaatctatttttttaaattaagttggccatcgacttccgcacccattgtcaacgcgattatcccatccaaagctgtcgcgtcgcattctcttgccggttgggaattaatttaaattaataatttaccaattttttgtataaattttcaactactaatgcttcaaataaatttttactttaataatttattttaaatttagttaaaaaatatatgatttgaattgtcattaaaagtaatattttgtagatgttagcaatgttcaggacgcgtacattcgccgtatg

SEQ ID NO: 114826 - DNA, 97 bp, Heterodera glycines
  Promoter: Source sequence=SeqID_22209; Location=951..1047; Strand=+; Gene=SeqID_52880
ggtactgtattcaggcaacaaatacacattgaaccgatagtatagataattaaattaccaattggtttcgccagatttggccatccctgacacaatg

SEQ ID NO: 114827 - DNA, 217 bp, Heterodera glycines
  Promoter: Source sequence=SeqID_13528; Location=1445..1661; Strand=+; Gene=SeqID_77426
agtatgtacttggcattcaagtacgaatccgagccctgaactattataatgcgaaaaatactaatattttaataataaatttaataaatcagatttaagcaattgtttaattcatattcattcattatggattcataatcactgattatttttaatcattttttggcaatttattaattaaagaattggccatccagaaacaaaaagtcacaaaatg

SEQ ID NO: 114828 - DNA, 117 bp, Heterodera glycines
  Promoter: Source sequence=SeqID_43147; Location=332..448; Strand=-; Gene=SeqID_70889
accgggataaaaacattcgaatcaattaaatagcttctgagataataaggtttatcataaaatttcatttaaaaataaaccctcaattattggtatgaacgatactttccaaacatg

SEQ ID NO: 114829 - DNA, 115 bp, Heterodera glycines
  misc_feature (22)..(22): n is a, c, g, or t
  Promoter: Source sequence=SeqID_12119; Location=1..115; Strand=+; Gene=SeqID_75687
aaaattatataattaattcacnagagatttagaaaacctcgaaaatcccttatggcctcggaccaatgatttcctagaatttataaaatttaatccataaaaatttttagaaatg

SEQ ID NO: 114830 - DNA, 125 bp, Heterodera glycines
  Promoter: Source sequence=SeqID_23882; Location=1..125; Strand=+; Gene=SeqID_54571
tgaactttcgttgtttctgtggcccatccatctatccatcattgttattctgtttttcccacaattgccaaattattggccaattattaattaattaattaatttatttagcctttccaagaatg

SEQ ID NO: 114831 - DNA, 411 bp, Heterodera glycines
  Promoter: Source sequence=SeqID_634; Location=3838..4248; Strand=-; Gene=SeqID_57827
ttgaattacgttgttgttagcggcggcgatgaagaaaatttgggcagaaaatggcgaggaataaaaaggattgaatagcaaatttattgggcaaatgattcgcattcgtgaaaaattgtccttttatacaaaattttctttcccctcccacatttttcgcaaattttttttttgtttatgaaaatcatactaaaacatgttttccgaggttttcaggctcgctaatcaaaaatatgacatgtatttcggccaattctgaaccccgaacccgaattcgaacaaaaagctttttaatccgttatttttcaaaaattgcttttgctaaatcccttttttctccgctataaaagcgccttcgtctcccccatttttgtgcattaacattcattcattcacatttctcccactatg

SEQ ID NO: 114832 - DNA, 711 bp, Heterodera glycines
  Promoter: Source sequence=SeqID_15008; Location=1..711; Strand=+; Gene=SeqID_79162
ttagggccccgacttttagtgacgaaaaatcgcaaaatagttaactaaaatagtgacgacaaagtgccaaaatagtgacaaaatagtgtaaaagtccaaaatagtgacgaatagtgacataattttcagccaaaaattaagcaaaaaatttttttattcactgattgcagttgcaaatgaagtaaatttactttctaataatttcgtggcaaatattgacatttttaaaccaaaattttgtcaagaaaaaaatttggtggacgaatttttaagaaaatttttctaaaaaattttaaggtcgattcttaggtgtatctttgaaaaaaaaattttggtcgattcttagtggtgtattttttggttttttggcatttttgttaataaattttactaaaaatgtcgaaatagtgaaaagacaaaaagccaaaaaaagtgaattttcactatttgaagtgacaaaactccaaaatagtgatttccagtgacgaaaaatgacgtccaaatgaaaaaattttgacgcagaaatgcgttttttgagctcctttcttcaaaacaactgagcaaaaaaaagtttttttcactagaaatcggtgccctaattattgtatattattttttgctattttccattaggcatttctccgtgccaccaccacttcttctgcctgctgctactttattcattttttgaatccgtcgacgccgcacatg

SEQ ID NO: 114833 - DNA, 116 bp, Heterodera glycines
  Promoter: Source sequence=SeqID_5462; Location=1679..1794; Strand=-; Gene=SeqID_58137
acgtttaccagaattttcataactattctggtgtttaacagaattttcagaacaattctgatgtttacaagaatttacagaacattctgatgtttaccagaattttcagaacaatg

SEQ ID NO: 114834 - DNA, 95 bp, Heterodera glycines
  Promoter: Source sequence=SeqID_25781; Location=680..774; Strand=-; Gene=SeqID_56519
tccttcacctcccccgccctccctctcctcccgcgcttcttccgcatttttgaatatttacattatgtatatacatataattcattttagaaatg

SEQ ID NO: 114835 - DNA, 235 bp, Heterodera glycines
  Promoter: Source sequence=SeqID_2091; Location=1..235; Strand=+; Gene= SeqID_77801
aaaaatgatggacggaatgagggaaaagaggagaagcataaaggcttttatatgaatgatgttctaaaagtgatggaaaaattacctaatgcatatttacaaccaaaagttttccctcaacagtctgggtggtatataaataggcaaaatgttaaggcatcttccatttgactttttcaaacggcagaatttgcctcgtcgctcatcactccgtcacatttcctttgcaataatg

SEQ ID NO: 114836 - DNA, 843 bp, Heterodera glycines
  Promoter: Source sequence=SeqID_10364; Location=1255..2097; Strand=-; Gene=SeqID_73543
cgtccccggggacggtgaggggggaaggtcgaaaccataattcaaatgggtaaatattgatcatatggcccagagccgaaaatggtcgaaatatataccaatcgatagcgctaggtctatttgaaattcgaaaatttaaacttttcttctgaccattttttcaattcggtcgttcaaatcgtttgctttttttgacaatctttcagtggataatccgtctgcaatttttttgagcaaaatcaaaaatcttgcgaaaattattgttatattttcataaattcttaatctttctagttactttatacttcaattaattgaccatctggtgaatgaaattatcatttacttcttttaaaatgcttatttcataatatttataaaataacccaaaatattaatttactttttgagcgattaaattaaatttccaagtgattttaaataaatctgggtgttttaaaaataaatttccttacggattatttactgacggatttgtccttctccattttttgactatcctccggcaataaaagaaaaaaataattgttcataaatgaggatgttgggaacttcttttttttgctcctttggttttagagtcatcattttgccgaaaattagtttaaaaaaatgtaagaaaatgaaggaataatcatttatttttatttctctcttttattttttattatttattcaacagaattatattcttataaaaagataaaatataagcttgttttatcaaacaaaaatgtcatttttgaccaattcaataaattatggagatgctttcacacaagcagcagcaaaaggagggtaaaattgagaaaaggaaaaatg

SEQ ID NO: 114837 - DNA, 120 bp, Heterodera glycines
  Promoter: Source sequence=SeqID_11147; Location=2627..2746; Strand=-; Gene=SeqID_74493
agttagccctttaatccccaacatgacaaaaatgacaaccctaatgtattaagcaaagtggacatccgcgaaaatgcctttctcgactgtgtccctaccgcccctaaaaatgaccaaatg

SEQ ID NO: 114838 - DNA, 101 bp, Heterodera glycines
  Promoter: Source sequence=SeqID_13857; Location=384..484; Strand=+; Gene=SeqID_77804
agcaaaatggtggcagggaaagtccatcgaaacactgtgaaatgcatcggacatttgacacgattagaaccaaccccgaagtgattttcctgcaagagatg

SEQ ID NO: 114839 - DNA, 326 bp, Heterodera glycines
  Promoter: Source sequence=SeqID_28883; Location=1..326; Strand=+; Gene=SeqID_59456
gtacgattttgaaattgagtaccaacaaacattggagttcggcctagccgatgtgctttccctacttattgcgaaaactccgatgccagaagacgacataattttggccaaactctctacgagtgctacaagatgaaatttctgcgcactcagtggcccgacaaaaagacgatgcggaggacattgtcccttttcaccgacggagagaagcgttgtcaatcgagaatgattgtttgatgtatgccgaacgggtcgtgattccaaaatcacttcaaaaagaagtgctgcaacgattacatcactgacacccgggcacaaaacgcatg

SEQ ID NO: 114840 - DNA, 96 bp, Heterodera glycines
  Promoter: Source sequence=SeqID_3604; Location=1320..1415; Strand=+; Gene=SeqID_51059
actgaacgaagcaaaggctactaagtaaagaactttgttgcaagtaataacttcgatatatccggatgcacaagcgtagattaaggcagtattatg

SEQ ID NO: 114841 - DNA, 561 bp, Heterodera glycines
  Promoter: Source sequence=SeqID_1411; Location=1724..2284; Strand=-; Gene=SeqID_73354
tcgtggactatacactttttcaattatttaattattagaaggaattttacattgaaaatacaatttagtttcgagactttccattaaaaatttgtggttaaaattagggttaagccccgaccctcggggagcaaaatgtcggggaacgggaaggaaattccccgaaaaaatttgtcggggatggctgaagaaattaaaaaaatgtcggggagcaacaccttcgtcggggaggaaattttcataaaaagtctaaaaaaacacaaaaagaaaaagtccagaacaaaaaagtcttaaaaactcatttaaagatacttccatcttatttcaagtgcaatttacgaatttcgtaattccccgaaacatgttgggttaaccctagttaaaatgatcagaaaaaagtcaattttttgagtgatggggacggcgcacacactaattaaaaattaaattatctctaattagactgacgacaacgcattccttgcctttgtgaaagggcctaccgcgtttgagcaattttgtgcggacaaagaaatcacaagcgcacaaagcaaggaaatg

SEQ ID NO: 114842 - DNA, 625 bp, Heterodera glycines
  Promoter: Source sequence=SeqID_10200; Location=219..843; Strand=+; Gene=SeqID_73318
atcgtttcgtaaaataagtcaaaaattttattgaaaaaataattgatcaaccacttttaattttgtaaatatttcgaaaattttaacatttaattatttgaattttactacacttaaaaataataaaatttgattttttcattgctttttaaaaccaagattaattcacatacaaaatctattaacaaattgcactcaaattttctaaatcttactaggcaccgcctcccccctccactaaaaattttggaaaaataatgcggcaaaatttgaaaatttgttagcatatcatataacataattttaaggaagttttggagaactttcaaaaaaataaaaaaattataaattttatgaactataattttaaaaatgtaaaataaattgattccgaataattctttttgattgcgtaaattttgagaatgaatcaaaaaattttcaaatttttcagtaaaaaaaaattggtgttttgcgtttcgtattttattttaaaattcgttttttcgtatttcgcacttttttcgatttgcaataacgcttgattgtatcgattaatataactgtttagtttagaaatattaatattgcataaaaatttgtcaggttcggaaattatgctatg

SEQ ID NO: 114843 - DNA, 178 bp, Heterodera glycines
  Promoter: Source sequence=SeqID_21675; Location=361..538; Strand=+; Gene=SeqID_52284
ggtaagatgccaatgaggatatcatccatacaaattttttaatttatttttgttcgaattcgggtccgggatccgaaattggccgaaatggatgccggattcgtgatcaccgaccccaaaaaccccttaaaacctattttcattaaaaaatgaataatttataggcatttgaaaaatg

SEQ ID NO: 114844 - DNA, 452 bp, Heterodera glycines
  misc_feature (142)..(142): n is a, c, g, or t
  Promoter: Source sequence=SeqID_3258; Location=1..452; Strand=+; Gene= SeqID_83938
gtatgtatgcatttttggtgcgtaaaaaacgagtgtaagcaattccgtacatttacataatctataatcagcaaaaaaaggaatcacataaataggagtgcgactctttgttgactttttttaaaatttattatgtggtccncaaacggaaaaataccaaaaattatagattaatggtgtcagatgtcaaatttgatgtcatgttcattctacgccccaataagccctgagtacatgccagaatagaaaaaaaaattttcttgtcctcggttcaaaattgaacagaatggatgccggattcgttctcaatcagtgacaacggaaactaattttgtttggaaagtgaaaaatattgtggggcctatgctgcatcatttttttttgtgggaccaatgttcttaaatatgtatataacttgaggtttacttatatttacccgccaactgaaaatg

SEQ ID NO: 114845 - DNA, 94 bp, Heterodera glycines
  Promoter: Source sequence=SeqID_8756; Location=823..916; Strand=+; Gene=SeqID_69124
aatgaaaatgaaattgaaagaaataaataattgaagaaacaattaaattaaattaaattaaacgacaattaattatttaagcagtggcaaaatg

SEQ ID NO: 114846 - DNA, 316 bp, Heterodera glycines
  Promoter: Source sequence=SeqID_26119; Location=367..682; Strand=+; Gene=SeqID_56869
ttttgaggaaaatgagctgaaaatgtgaaaatttcacaaagatggtcgtgaaaataataagtcggagattattggcgctatcaactcaatatttccgcaacgctgttagagtttatatttagatgataattagctgaaatttgagaatttcacaaggatggtcgtgaaaataataaatcagagaatattattaacccgatccttctacaatattgctgcagtatttatttagagattaagtagctgaaattgtgagattctctatttacatttcattatcactttgaaattctcaaaatttcagctcattatcatg

SEQ ID NO: 114847 - DNA, 634 bp, Heterodera glycines
  misc_feature (25)..(25): n is a, c, g, or t
  Promoter: Source sequence=SeqID_41314; Location=404..1037; Strand=-; Gene=SeqID_69471
ttttatcattcgttttttattatgnctatataattaatattttaatgattgtccaattattgtttttttttttgcaggatttcgtcactgccacaaaagcggagcaaattcccatcgaattggtgctgttgctacctttacaaaaaatttttgaaattaaaaaaaaaattggtagacctcaaaaagggacttccgttcctaccccttagagattatttattataaatgaaaaaacaaaaattataataaaaaattattatagtgaaataaatttttaagcattgccaaaaatcaatagacagcactggtaaaagtaaataaattgcattattataataatataagttaaaaaatatttaaattataaaaagatgaagaggttagggtaataagacttataatcgaattttattttttctcttgaagtcaaaaattttaattttttattttacacaaattcttaataaaacaaaatacgataagataaaaaacagatccataataaataccttaagaagggatcagccgaattttaaataattaaatcctcctaattttaaatgggttttctctattttctaattaattttctactcataaactttttaatttttaggcaccgatgaataaaatg

SEQ ID NO: 114848 - DNA, 608 bp, Heterodera glycines
  Promoter: Source sequence=SeqID_7213; Location=1178..1785; Strand=+; Gene=SeqID_64170
tccggtggcactggcaattaattttaaatttttgtaaagtaaatgaatttttaatgatttgaataagcaattttttaagtattgcgtcaatcatagattagaccgcattccggcattttttggcgccattaattcgcattatcgcaggaaaagtgccggtatttcgtattttggcattttttagtcgccggtcttcgtattttggcatttttttttggcaccgctatttcgcattacggcaccaagtgtgttatttcgtatttcggcactttttttggcaccgctatttcgcagctttcaacctcattaatattaatcttttattaaaattagaaaatttttaatgtttttggaatcaattgggaataatttttttaaatttaataattagaaataaaatattttaaatgaaaaaataaaattaaatatgcagaaaaaaatcatcattccatgaatgctttaatgtgcgttttacatattgccaattttaaatgtcattgctaccggttggcggatattggcacgtcccaccgatggccaacagtggtggcacactttaaaaaaatattttacaaagatttttaatggcactgtactctcaccaaatg

SEQ ID NO: 114849 - DNA, 216 bp, Heterodera glycines
  Promoter: Source sequence=SeqID_3964; Location=1192..1407; Strand=-; Gene=SeqID_52606
tatttgcagcatatgctttatagcgcacattataatggtttattttatactacgtttctttctttgccatgctttttattttcgataaaactggtgaattttattgtttgtcctttcccaaagtccaagtttatcttttcactgctttatcttgaaggatttgaatgttttatcatttaactatttcagttcagctattactattaagagaaaatg

SEQ ID NO: 114850 - DNA, 714 bp, Heterodera glycines
  misc_feature (29)..(29): n is a, c, g, or t
  misc_feature (241)..(241): n is a, c, g, or t
  misc_feature (276)..(276): n is a, c, g, or t
  Promoter: Source sequence=SeqID_12705; Location=1..714; Strand=+; Gene=SeqID_76387
acaaaaaatgttgctgtttgccggtaaanaatggggaaatggataaatttgtgaaaaatataattgaattaatatttttttaaatctctcccatataattttgaattgtcaactcccaaatagtgaacattttttaattattttaaatgtaaatgaagtttcatttggattataaaatgtataaaattaaaaggattaaaaaaaatactcccatattttacattaaccaaactcccaaatntagaaaattaaaaaaaaaaattttcatttcccatntaaaaaagcctaaaaaagcattaggtttacagttggtacaaatttttaaaaagataaaatttcgatttttttttccacggcgacgacgactgtcgacagaaggcctgggctgggctaagctcggctttgcactcgaaatcaaagctcaaaagataaacttaatttttgaaagtcgaagttcgaaagctcaaaatatgaaattttaaagtttgatgctctgggttatcaaaacatttttccataaaattaagcgcttcgtaaaatagggagcaatttctcgaggattattcatgatgttttttttttgaaattataaaaaaatttaccaattcattggcaatgtgtaatttatgggagttcgcaacaaataaattttacaaaatttgaattatttagcaggcaaaaaaagctcttaacgccaacaatgctaatgagatg

SEQ ID NO: 114851 - DNA, 866 bp, Heterodera glycines
  Promoter: Source sequence=SeqID_1182; Location=1540..2405; Strand=+; Gene=SeqID_69406
aattagagaccggaaatttcaaatttacggatctatgcgcgggattggaactcaaaactttttgtgggggacgggatctcgctgaattaatcccgcaaaaagttcgcatttttacgatagcctgtacgggatttttaataaaatttctcctactggggtaacctttttaaccagggttgccagatctgaggatttatcctcattttgtggctttttgataggtcaatgaggatttttttttggaaaatgaggatttgaggatttttgtggctttttgagaaattttgaggatttttgaggcttttggggaaaatcctcagaagcttttaaattttgataaattggcataatgtttggtaattatttaatttgaattttggtttttaatagagtatcaaacggaaatctcacccaaatttagccagaaaattacaatttttttcgaaaatccacaaaattatgaatttttatgcatttaattattcttcacgcctctttcaaaaaatctctacctggaaacctttttaagattttctccgattgcctagcaaatttggcgcaaaaatgactaaatttcgctctttattgataatcttttaaaaacaattttttttgagagatttttcaattctttgccattttcacgtcttgcccattgtaagttctgaccatagtttgattttcattaactccaaaaactcgaagggcattttgtccagaaacgagaagtcagaagcattttctggcttcctgctacgcctttggcacagacagcaaagcctttttctgtacgggaaatccaaattttaaacgttctaaaaatgaaaaatatttaaatttaaatatgtatttagaaattgcaaatg

SEQ ID NO: 114852 - DNA, 478 bp, Heterodera glycines
  Promoter: Source sequence=SeqID_22470; Location=1..478; Strand=+; Gene=SeqID_53143
accattcgtccgagcagcacttccaattgcttaaccatggaccgccgtcgacttcgagcagttcggaccaagaaacagcggagcagcaagaccaatttggaagagacaaatttattaacaacgcaatcagagaagacgaacaggaggaggaggaagaagggagagaagaaggggatgaacagacgaagaagggagatggaggaggggagaagagaggcgggggcagccgaaagagacgacggaaacccgagggtaaggggagagaaaatgccggagggaatgacgagaagggcgggggagagaatgccgagggggggggagacgaaacgaaatgccagaaaagggtgtaggggaaaagcggaggagggggggggggggtcaaaaggcaattgggaccaatgcaaaagtcgttctgatcagtcagtgcctttgtgcttaatcggcttttccaatcacagccaaagacatcgtccgaatg

SEQ ID NO: 114853 - DNA, 454 bp, Heterodera glycines
  Promoter: Source sequence=SeqID_6280; Location=116..569; Strand=+; Gene=SeqID_60995
tcagcagtagggggcctgggtcagttcggcacataaattacacaacttcaaaattacccacagctttttaaaaattaagaaattagtattctcaacaaacaatatttattattttataggactttgttaaaaattaaaaattttgcaacaaattgtttctttattttaaaattttataatacatttttcaaacacatttttgttacaataagcaaatatatgtgaaaatttataaaaaaaaaactcaaaatatgttgatatgagtttattttattaatctccacttggcaacctgggtttttcctaaacctggattttcctgaatttttgcccagtaaatccaggtccaggcttttttcaaaatgccgacctctaattaaaacaatcaaagttatgaattgcaaaaaattaattaaagttatggattgcttgattggccactacgaccacaatg

SEQ ID NO: 114854 - DNA, 258 bp, Heterodera glycines
  Promoter: Source sequence=SeqID_28779; Location=1..258; Strand=+; Gene=SeqID_59352
ttaaaaacgggcgcaaagcgcccgtcttgaggccgcgaagcggccgaatgtccccaaaaaaattaaaaaacgggcgcgaagcgcccgttatgaggccgcgaagcggccgaatgttcttaaaaaacgggcgcaaagcgcccgtcatgaggccgcgaagcggccgaatgtccccaaaaaaattaaaaaacgggcgcgaagcgcccgtcctgaggcttaacagccggccgcgaagcggccgaatgatcccataaaattatg

SEQ ID NO: 114855 - DNA, 152 bp, Heterodera glycines
  Promoter: Source sequence=SeqID_3129; Location=958..1109; Strand=-; Gene=SeqID_83322
agaaaatcctcaatcacttttttttgaacttacgcaatttaaataaaaaattaatttaccattttgcttaattgattaaaataattagttttgattagaatttattttaaattaaagaaaataaattacaaaatttcagtcagacaaaaatg

SEQ ID NO: 114856 - DNA, 166 bp, Heterodera glycines
  Promoter: Source sequence=SeqID_19053; Location=1..166; Strand=+; Gene=SeqID_83791
agtaaaaaactgatttccatattatgtatgcaatacgtcgtgaatcacatttaatttttaaaatatttttggaaaagaaaaataattgcgtaataacatttaatgcgaataaaacattaaataaattcatttaatgcaataaattcaatttccaaaagtaaaaatg

SEQ ID NO: 114857 - DNA, 353 bp, Heterodera glycines
  Promoter: Source sequence=SeqID_2860; Location=8427..8779; Strand=-; Gene=SeqID_82007
tttttcgtcagatttggcattttttgaaaaaattggtaaaacaactttcattttttgtgcgctttttattattttttggaaatttatgctcggtaatatttttcacttttctactgaattttatcagatttggaaaattcaaaaaatattacttaaaaacttgaatatttatttgaaaataaatgcttcataattccgatatttttcaaaatatttccacttttttcctgattttttttgccaccaaaaaatatataattagtttggttaggtcataaataaatagaaggaatagcgttgagtaataacacaaaaattagttgcttaaagccagtctgacgtcatttcaaatg

SEQ ID NO: 114858 - DNA, 219 bp, Heterodera glycines
  Promoter: Source sequence=SeqID_38731; Location=1..219; Strand=+; Gene=SeqID_67455
tccaagtccatcgccaattgactaagtgaaccgaaccctgcaaaaacccaaacccgagccccaacggccctccctcgttttcctgacttggcgctcctggccgacaccgaactgcaccgccttttggaagactccgaattgctctcgccgattgcacacaagaagcaaagcgtggaaaagccgtgctgttcgccgtctctcttcaattcgccgaaaatg

SEQ ID NO: 114859 - DNA, 68 bp, Heterodera glycines
  Promoter: Source sequence=SeqID_18187; Location=1970..2037; Strand=-; Gene=SeqID_82774
cctggcaggtcaaagcaattacctttatgccgattgtttttttaatgacggtgacttctttttcaatg

SEQ ID NO: 114860 - DNA, 123 bp, Heterodera glycines
  Promoter: Source sequence=SeqID_116; Location=736..858; Strand=+; Gene=SeqID_72234
gaaagacattttaatcagatcaacaatatctcgaattccatccaaacccaactaaacacactacgagaaacaaattctcaaattttagaagagcctgatataaaaatttggtttgacaaaatg

SEQ ID NO: 114861 - DNA, 1003 bp, Heterodera glycines
  Promoter: Source sequence=SeqID_6608; Location=536..1538; Strand=+; Gene=SeqID_62191
tttgcagagtatgtcaggaggaccaggaattttatgaaaaccaggaacagaaaagtcgggagcttgaccaagaaaaaaatatactcaaaatttatgtaaactaataaataaaatcagtttttcacaattgaccaaatatttcatgaaattctgaatcaggggagaccaaagttgcattatgtatgatcattgatcaaagatgcagttccgccccaaaaaactttgaaattcggaagctgtaagttttttcaaccaaaaattttgttggtaatttgggaccgatatttcctttaattttaaagttttcctaaaacctttaattttggtggtacctacgaatatattttactgcccaatattttcccaaaattttttggtggatagagagggccggcgctgctggagaaaacttgaaaaattcggctttattagttaatagattttgcgctcaaatatgttcatttttgggtttttggcagaaaaattttataacaaaattataataaaacaacgttttcttagtaatttcattaaaaataagaagttccattgatcacttccgaaaacctgtttgaactttaaacagaaaaaatatttttcacctttcaatccaaatctccattaacatcattcatcatcacttcactttttttgattcactcaacgcaaaaacattaaaactccccgagaaattggccgaaattttcaccccctcaaaaattggataaacattaagagggaattctcgttcccgccaaaattacgaaaattaatttggcaattattgccgtgggaaagaaaaccgataaatatttttgtgtatataaatagagttgttatcatgagaaaagtaataaaagatacaaaattttgtatacttagtcaagcgattaatggaaaatgcaatttttatttatttttaataaaaaaatttgatgattttttttttgttttttcatatatagaattaaaataaaaatatattttactcgtttataaaatg

SEQ ID NO: 114862 - DNA, 1003 bp, Heterodera glycines
  Promoter: Source sequence=SeqID_14663; Location=1126..2128; Strand=+; Gene=SeqID_78765
gaaaattttaaaaattcttgttttattagccccactctgctttgactggccatatctcgccagggagtggcggtagaccctttgttgatacatttgaaagggtagagcgcgcctagctcattcgaatagcatcaaattggtttgcatttgtcccgaaacaacccgcttatgacacgtctaaagaaaatccgttaaaatttgcattcacaaactccattttttcattggcaaacgtgtaaagcaaacccgaaattgataggaaatatatattgctcataataaaagtacaatttttatttgtcccacgccattttctgggaaaacttttccgcgaaaagccgaaaaatttccatcggcctcttccaacggcaacagatgcgtttcaaacaattgacaatataattatgattgaagtcaaaaagcctctatagaaaatgatcaataataagttgttataaatgttcacgaagtacctttcttgttattgacaacacatctccattcaatttacaacagatacataatgtattgggatatgagcgaacatttagaagaattatctctacactctgtcagtcacagtccaggaagcaaagacaacgagaagctagaacactgacaccacggactcgcccttccgccaggtgccgtccccccgtcctttatggccatttgtgccatgaaattcccaattgttggcccatttttcgttgttttttggtttcccattaaattcgtttgtttttctcttttaggaatcttactttttctgggccttcggtgtccatgaaccgggtctgttcaatcttttgttgttgtttttcgactcattcgatttccacagattgttttgccgcggttgacgttgaaagtggcaaatcggccattttcccgcccaaaatgagtccggacagtgcaatttgggacggaaagtccgttttttcggaatttcaattttactttttccttaattttatttttgcagaattcagcccgaaaaatg

SEQ ID NO: 114863 - DNA, 71 bp, Heterodera glycines
  Promoter: Source sequence=SeqID_14251; Location=1548..1618; Strand=-; Gene=SeqID_78268
agtggactaaagaatgccgaaaccccaaaattaaaaaatgtatggagcgacaccaagagcaattgagtatg

SEQ ID NO: 114864 - DNA, 178 bp, Heterodera glycines
  Promoter: Source sequence=SeqID_25194; Location=1935..2112; Strand=-; Gene=SeqID_55932
tgcaggtcagaatgggccaaatggctcgcaaaaaatgcttctcatcaccgttttatttttcattttctcatcggcacttttttttggaagcgttcaatctgcatatgtcaagtttattgtaaataaaccattgaacaaagacactgaaaaaacttgcaggatgctctaaaccaatatg

SEQ ID NO: 114865 - DNA, 705 bp, Heterodera glycines
  misc_feature (99)..(99): n is a, c, g, or t
  Promoter: Source sequence=SeqID_4877; Location=1..705; Strand=+; Gene= SeqID_56046
tttattatgcttactctatttgcatttgctgttttatggcaataaattcatctcattattacaattaaaaatattttttcgaattgtttttgtttgggngtttcttccactgcgaaaaaatcactcccttccccccctcatcagtctcggctttatttagtgtaaataatggcgttttcccagacggcccatccatcttttccgccccaggccatcggccaagcgacgatcgatcggccgacccggcggcgattgcttttgcttcggctttcgctcctttcccccccccccggcgccttccaattccgacgagagatttcttcactcaatgtccaattcatctgcataagtcatttttgaaatgaatgcccaattaaagccaatttcggcttttcgttggctttttttgtgctttcccccattaattacccccaattagggattgatttccatgtcccttctctttggtccccctctttttcttcactgttgccttttccttctccgttccgccgtttccgtccccgcggtgcccaaatgttcgcagcgattgttcgaagcaaagagcgacccgtcgccgggctctaacggctttagcatcgaaattcgagaagcgcccccggggatggacggggacagcgacgaattgcaggtgaaaaacgcaacaaatatttttggcattggcaaacggaacgccaacgaatg

SEQ ID NO: 114866 - DNA, 71 bp, Heterodera glycines
  Promoter: Source sequence=SeqID_30928; Location=217..287; Strand=+; Gene=SeqID_46237
ggtacacaaataaataaataaaattattttaaagaattgtgccaataaattttattataaaggtcatcatg

SEQ ID NO: 114867 - DNA, 1003 bp, Heterodera glycines
  Promoter: Source sequence=SeqID_10841; Location=1129..2131; Strand=-; Gene=SeqID_74111
atatgaggcgtgtttttaacttttatttatttaattgtaaaaatttttatttagttttttataactttattgaaaaataattaatacattgttttgtttatacaaaatttagtttatcatgccatattcaaacgtgtaggagcagctattgctaactttatttacgcaaggtgcttgcgcgttttataaaaaccgccacctagtcgcgttttataaatccgccagtcgcgttttataaatccgccacctaacaattcgcgttttataaaaccgccagtcgcgttttataaatccgccaaaatggaaaggcgcgttttataaatccgccagtcgcgttttataaatccgccaaaatgggtttgcgcgttttataaatttgtcaatatgcaaataaccaacaaaaatactaaatttatttttttttaatactaaatagatcgataaaaatatttttatgtgacaatatgtgccagtcagactgcaataatatttgccaatattacagctgaataaaaacaaaaatatttgttagtattgcaattatattctataaaagcattaaattttaaattaatacccatttcattttattttttattttataaatgaaagctaaattttatttattagcttatatattactagtatgctgctgctcaaaactttttcatggaattagttttgaggaattaacatcaaacaatcacgccaaacccttaattgatcaatatcttcgaaaggaaataaagactaaaggagaattattggaaaaactggctgaaatcggagtcgacctaagcttgagaagcttggaaagatatatttcaaaaataaaaaatagaaaatcaacagaaggaaacaaagtagatatggaaaatgccgaagtatcgcaatgtttttcaaaatttgataacaaatttctttttatcattgggcatgaatccgaatatcgaaaattcaataaacaaacgagagagaaggcgtaatttatttgtactgtatg

SEQ ID NO: 114868 - DNA, 650 bp, Heterodera glycines
  Promoter: Source sequence=SeqID_8603; Location=1..650; Strand=+; Gene= SeqID_68662
attttttgctcgcaattcatttttggtccattttaaacaaaaaacttttttaagaaattgcgccaaaacttccaaaaaacactcttcaatttttagggccagactgggcaacttttttcaataattaaaaaaatgcatttatcccttcccggcctgattaccaatactgaatccaggatgcagacttacttaaagttccgatcaaactcttaaaataatttcagttattaattatatttgtgtgtcgtatgctttattttgtgtaaacaaattttttttatcagtacacgctcttagaaaccaggacattatctgtttttgcttaattattttacaagcaaaattgggataaattcaaatcaggacatatatgaaaaatcaagacattttcgatttttttattaatgccaaaaaagagaaaaaaattgagcaatattaaatgaaaatttttcattattataaaatatttcactattatttatttcaaattgtaaaaatgcatttttggcaattattattttttatattttgctttgtttataaaattgaatccgtcaaaatccgaacaaattttgatgaaatatttggcgacggatgggacaaaaatgaaagtgaacaaacagtgaaaattgaacaaaatcagcaaaatg

SEQ ID NO: 114869 - DNA, 1003 bp, Heterodera glycines
  Promoter: Source sequence=SeqID_1313; Location=4005..5007; Strand=+; Gene=SeqID_72331
catagttcgtttctcagctttacacacatcaaaacgcagaataattagccgagaattaattaaaatgctatcgctaagttccgggtttttcataaaaaaaattatattaaaaagaatatatttaccgattattttatcataattttatttacttaatgaattttattgaaacgtacattttttattactttcagaaccaaagtttcatttaaattaaataattttaaaaaaaattaaaattttagactgattaagattaatttaacattttttgagcttattattaacaaaattttttggcgaaataaaatggcgactgatacggtaacgacaccgtttttgtccgtccattactgtatgtgctgtggcaaattgcacaataaaaacgattcattggcgtgtgagggtgacatgttgcgcgaatattgggacgactatttacacattcaatgaatgtttttattaaatttgcaaattcgtgttataaaaattggaaatctttatttattttcttttaaaaatttcatttttctttttgcactgtaataaaaaaaatcaaaaaaaaatttcaatggactgaattttgactgaatattttgatggtttttcttttgcaaaaataaaatgttttgattatatttctatggttaattgccataaattttttaactgccattaaacggtaataaaaatccaataaattcgactataaatttatctctaaaaatgaataaaaatgaacaaaaaatactggctaaattcagattcattctaaatttaaccaaaagaaataaaatgcatattcttttttctctttttatgattaaataccattaattttaaaactttcataaaaaggtaataaaaaagccaataaattcgactataaatttatctctatagatcacctcatgaattttcatttttaagatgaaaaaatgaataaataacagaaaatttactggattaattcattctaaatttaatcgaaagaaacaaaatg

SEQ ID NO: 114870 - DNA, 79 bp, Heterodera glycines
  Promoter: Source sequence=SeqID_3726; Location=81..159; Strand=+; Gene=SeqID_51626
ggtcattcacaactttgagaaagcattttaatcatattctattgctccttgctgttcaggatgccggtgagtacaaatg

SEQ ID NO: 114871 - DNA, 566 bp, Heterodera glycines
  Promoter: Source sequence=SeqID_11198; Location=1486..2051; Strand=+; Gene=SeqID_74550
tttttttgttgactattttcggaagattgggcatatccttcaaaagttgggcagcattttcaagccataattaatttaattaattctaatttaagttaatttattaattctcatttaagccatgctcgagaccaattatatcttaataaaacattgtccactcctccaattatttttcattaaagctgcatcagtgcggcccaattagtccccaattaagcggtaacggctgtcgatcacctccaattatttctcgattaagacatgccccgcccatgtagtacgacatttgcgggttgaaaggttaaatctgatttgactcggcgcttattggtaccgacagactcaaaaatctcataaatttaaaaattaatatttggaagaatccaaaatttgaaaaagctaagggtaaatgaaaattttattttttcaataattgtaattattaattttttgtgaaaatattttaatttaataattttttttatttaattataagaaaaaatctcatcatattgaacattcaaattttgattttatttttttagaaagtcaatcctcaaatg

SEQ ID NO: 114872 - DNA, 141 bp, Heterodera glycines
  Promoter: Source sequence=SeqID_12052; Location=1..141; Strand=+; Gene=SeqID_47012
ttgaaattatttattttggcttttttattatttattttttttgaatgaccaaataaggatttactaaacattttagaaaattgtttttcgaatttcgtttttcctaatttgtaatataatgcttggttttagatgtttatg

SEQ ID NO: 114873 - DNA, 559 bp, Heterodera glycines
  Promoter: Source sequence=SeqID_21280; Location=1..559; Strand=+; Gene=SeqID_51876
tttttccccggaatgtttttttccaacattttttgttttccttatccttttttccttttggaggtttttttttgctttaaaaacctttttttgtggcgccttttttccaaaattttctgggacagaagggggggggggggttccggcggtgccgacaggcgccgccggggaaaaaatttgaaaatttgaatgcaatttgttaacagattttcatcaaaaactgcctaatttttgcgattttaagccatgcgacgactttttttgtttataaaatgggttttttttacggcgcgcttttaaaaaaatttttttgaggataggggggtccggaaaaatttgtaatttttaatgcgagttgtttacagatttttctccaaaaatgaccaaaatttgcgatttttggctaattttttaagaaaaatagtgacttaatgccataaaatttcaaaaattctcaaaaattacatttttaaatgacataatgccataatttaatcaaaatattgttgaaaattacaaagatttctcaaatttctttgtttttaaacttttccaaatg

SEQ ID NO: 114874 - DNA, 133 bp, Heterodera glycines
  Promoter: Source sequence=SeqID_2019; Location=6090..6222; Strand=-; Gene=SeqID_77351
gaaatttatcaccaatttagtactaatcaaaggtaattaagcatagtagttattgttaattagggtacttaacagagtggtagtagggaaatattgttatggtaattaactgttaattagccacttgtcaatg

SEQ ID NO: 114875 - DNA, 60 bp, Heterodera glycines
  Promoter: Source sequence=SeqID_592; Location=1..60; Strand=+; Gene =SeqID_57060
cacatcttcaaaattaacaacaacgacaactactgtcttttttatgccttggaactgatg

SEQ ID NO: 114876 - DNA, 689 bp, Heterodera glycines
  Promoter: Source sequence=SeqID_12675; Location=2213..2901; Strand=-; Gene=SeqID_76355
ccagcgattttttggctataacttttttccttgtcaaccaaatccaacattgtagcattcgaaagccataaatgtcttctattagcctgcaaaatattgaaaaatttcgttatggttcagaaaagttatggccagaaaaattcaaaaaagcaaattttccaacctttttggccataaatttgttcaaaattgacgaaattttttggatttttgcaggctaatagagcatttgaagggctttcgaatgataccaaaaatctttgatttggatgacaaagaaaaaagttatagtccaaaaacttgctggggcccaaacgtgccaactgacgtagaccgtcgtaggattgccgaaagacctcgtttaaaaaaatatgcgaaatgatgaagcgatccgtcaattagtcatcgattttgacaataaggaaaacaaaatcgatgatgatataattaatcacattcatacattgcaataccgcctatggatgaaacttggaagaataggacttaaagagtgattaaacacatgttttttttaatcaatataattgttgaaatttttttggggtcacttaattctgcgccgcaaatgtcgttttgattgggcgccgcaagtgtcggcgccgcaaaagtcgttttgactgggcaccgcatctgtcggcgccgcaagtgtcgtcgccgcaagtgtcatg

SEQ ID NO: 114877 - DNA, 97 bp, Heterodera glycines
  Promoter: Source sequence=SeqID_5628; Location=824..920; Strand=+; Gene=SeqID_58699
tccgccacttttctccccctccaatggtcggcgtcataaagccgtgccaacgttcgcttcgtccctttcgcccccggcgccgcccatcggacggatg

SEQ ID NO: 114878 - DNA, 95 bp, Heterodera glycines
  Promoter: Source sequence=SeqID_14907; Location=968..1062; Strand=+; Gene=SeqID_79067
tgtgatttattgaatttatttattacgcatttaaaatttgttaagtgtaaattcaattccccattcattttaaggtgtcgttaaccgatcgaatg

SEQ ID NO: 114879 - DNA, 149 bp, Heterodera glycines
  Promoter: Source sequence=SeqID_5182; Location=4849..4997; Strand=-; Gene=SeqID_57181
aatttatgcacaactaaattttattctcccttttcctttcctttccttttccttcccttcccctattagtgaatcgattaggaataaaatttatattaaaatttattttttagctttgatttgttctacaatatttgcttccttcaatg

SEQ ID NO: 114880 - DNA, 306 bp, Heterodera glycines
  Promoter: Source sequence=SeqID_23103; Location=1014..1319; Strand=-; Gene=SeqID_53813
ttattctctccaccgaccattcgccattttttataattttattattattgtctcttggtaaataaatatttgttggttttattcactcggacaatacacaacaaatttggcgcagtcagcagtcgtcttcaaccaacaagacggactgcacaccacaaaaataatagtccctaggcgggtgaggtctgcatatattgcagttaattcgccgaaaaaccaacagacctaagaaaggttgcggttccgcaataagcggtttttcaactttggactctcaaattcggcaccggcaaacatttcggcatg

SEQ ID NO: 114881 - DNA, 361 bp, Heterodera glycines
  Promoter: Source sequence=SeqID_14007; Location=1602..1962; Strand=+; Gene=SeqID_77978
aaatgatttttaataccatatttagccatttttgaaaattttactttgatttagcgaatttgaagaaattttaaactcaattttgaaaaatttatgtccatattttgacatttttgccatttatgtccatattttgaaatttttgccattttatatccatattttgctatttttggtcaatattttatggccatatttcgcgattttatatccatatttttggatgccctataatatgtatttaagaaaatagggtcctactttgttagacttcaaaaaaaacactatttttatttcattttcttttatttaagccctttaatttaagaataaaatgctagaacccgttcatcagcggatg

SEQ ID NO: 114882 - DNA, 81 bp, Heterodera glycines
  Promoter: Source sequence=SeqID_27193; Location=852..932; Strand=-; Gene=SeqID_46034
ggtccgttattacaaatattaataaaataagaaatccaacaattcaaggtcaatcgggcatctgtcgcttgtggaccaatg

SEQ ID NO: 114883 - DNA, 57 bp, Heterodera glycines
  Promoter: Source sequence=SeqID_29341; Location=293..349; Strand=+; Gene=SeqID_59853
gctttgaaagggccgctgatagggcaggactcaaaaaaattgattttggacacaatg

SEQ ID NO: 114884 - DNA, 58 bp, Heterodera glycines
  Promoter: Source sequence=SeqID_13792; Location=655..712; Strand=+; Gene=SeqID_77720
aaaagaatttgttaaaaaattaaggcgttaccgtgccgaggcggagttggccaaaatg

SEQ ID NO: 114885 - DNA, 971 bp, Heterodera glycines
  Promoter: Source sequence=SeqID_1740; Location=5648..6618; Strand=+; Gene=SeqID_75630
tttttatttatttttttatctccgcaaaaaaataaaaatttttttgtttcatctaaatcccatcttggcttgctgatcaatcgggctgggagtttcagttttccaaaaattttctgcagcttttttttgatgagaaacccatggaaaacaattttattttcatctaaagccaaaaaaatcattattttggactttttgccaactaaaagaattacgtcacttttttggacttttgcaaatttttttgtcaattttgctttttgaaaaaattcttcaataaaaaggcaccgcttttttgacgaaaaaataataagaaaagtttgacttttcagtgtaaaataaaagtttattaagtttcattcaaaagattaaacttttttttaaaactcgaatgagtgaaaaatagtttttaccgtttaatttatttcatagaaaattattattttaaattttaattatgtaattagtgatgcccccgttccgcttctcctcgcccttaccctggcatgcaaagtgcacgcttggaagcggcaccgcaagtcctgctggtggtaattggccgcctccgttgcgctgaagccgcgcgtctccgccaactcgcggtcaatgtcaatgcttcgcttggccgcctttgagcaggcggcgtggaaatgaaagtgcgaatttgtggcgctgaagtgaaggaacaaagagaaatttagcaaattatttaattcgattcttttttcattattattttcaaagcgatgcaattcattcataaaaaatattaattgaaagcccaattaatttgatcggtttgtgtcttcgattcaaattatcatttgcttttaggcttttcccgggtatttttgcttctctgtccgatttattccaattaaaaatgccctctttattttatactttaggcaattcattgcgcgctcaaagtcctcgcggtgtttaagacaaatgtgcgattggggcgaatg

SEQ ID NO: 114886 - DNA, 1003 bp, Heterodera glycines
  Promoter: Source sequence=SeqID_12997; Location=2330..3332; Strand=-; Gene=SeqID_76767
atatttctttagctaaaagagatatgtattatttaaataattaaagtttgtttattattatttttaatcttgaatgtgttataagcaaatttttcataattttcacgttgcttgcctttcacgactcccgctttgctcataacgaagcttacttgcctttttcttggcctcactttcaattttctcagaaaattcaacctatttttggttttttcttcttttgctacaaaattttgtaagttaattattttattattcattaacattataatatgcatttcttttacaattatttggactgcttaatttcttttttcatttttaatcgattatttttaatgagattatttattgtcaaaaaagtttttttttaattatctccacctggggttatgagcacaaaatcaaatttatatgataatgattttttgaattattaattgtctaaaagcaacgttcaaatttatcatccatcattcatattgttttttcggcaatttaggggccatcctatgaacttaattttactctaatgatttaaaattttatttcatgattgatattgaaaatttaaaaattatttaaagtttataatttttaataaaaatttatttgaattgtcgcctaaaataaaaataaaatttatttaaaaaaataataaattttggcataagtttttgagcaaattttccattcatagggatgtatttttcacccctatttattattaccaaaaaaccaaaaataggaattcatttacaattttaaaatttaatactctaaaagttgcatgtgttcaattatacaaaaattatttaatattttactattgtatttgccttgtacgtagggttcagcggtaccggtaccggtaccggtaccgaccggtaattaccggtttttttggtactggtaccggtaccggttttttcaaaaatcaaagtatcggtaccggtttgtctagtaccggtaccgccggtaaaaatttgcactggtaagaatg

SEQ ID NO: 114887 - DNA, 191 bp, Heterodera glycines
  Promoter: Source sequence=SeqID_45568; Location=1011..1201; Strand=-; Gene=SeqID_46824
catcaaaagtttttgagctgtgccctagtaatccactgacggacactccctaccactttaagcttcactccagccaaaactttgttgatttgtccaaatgttatttactaactgaattccgaattcgcaaagaaaatgagcatggtcaactgattgacctcgcagctgacgaagttgctccgatccagatg

SEQ ID NO: 114888 - DNA, 871 bp, Heterodera glycines
  misc_feature (27)..(27): n is a, c, g, or t
  Promoter: Source sequence=SeqID_9318; Location=607..1477; Strand=-; Gene=SeqID_70984
caaattgcggcactttcgcaccgcccngcgcgagtcgaacgaattggcctaaaactaacgaagttgttgcctttaaaatgcacgtttaattaacgaacaaaaacgagatggaaatgactaaacagacttttggccaatttgatcttagctgatgagaaggatagaaggataattatattaaaaataaatttaattttataaaaatattttaagaaaataaacaattcttatcattttttatttttacccttaaattcgtctcaagaaacggactattattaatagtcttctcacattcattaagtattatgtaattattggatgccattactcatcattagaattgatcaaaatatcaattaatttttataaaattgccctctttacagcaaaacaattgtttttgtgattgctttgtaaggatcgaaccttaacaaaaaaaaatgagaaatttggccataaaatgcatgtaattctccgataagtcaaattccattgtttatgacatccgtagcacacattttgatggttgagaaagaatgaaagaatgaatgataaccaacgaaatgaaaaaaaggagagaaattttgggatggaaaagcgaagagccgacgaaaaatgaaaggaaaaatgaaacgaattgggggggggggggcgggggtgaccctccccatggccaaaagggtaaaagcggcgatcatttggcggttgggcccattcattcattcattcactcattcactcattagcagcagaggtggccccattcgttcagtgactttttgaactcttcgcccattgctacgcaatttggccaaattgaattaatatttgccttttttatgacattttatgatttttccagaaaatg

SEQ ID NO: 114889 - DNA, 413 bp, Heterodera glycines
  Promoter: Source sequence=SeqID_12329; Location=479..891; Strand=+; Gene=SeqID_75924
gtattaattcacaggaaccgcgagactcacgcacatccctcacgccgtaccctcttcttatttctaagaaaacttttacaatttttgaaaattaaaacttccataattttaagtatttttcaacagtttgatgggcggtgccaatcctttaaaattaaaaccactcaaaaaaagaagcagccaatgctcaaaacaaaattaaattgaatttttgttaacatttgatttggttagttttaagccaaggttatgccaaatataaacggggctttttacgaaacagcctagcagttagagcataataagcactacttttgtcgcttttgtcctttattctcacatatattaattaaaaattgataatgtgcctaattatttgcaaagaaaaattgtgtgcttaatcattcaaaatg

SEQ ID NO: 114890 - DNA, 65 bp, Heterodera glycines
  Promoter: Source sequence=SeqID_385; Location=1447..1511; Strand=-; Gene=SeqID_50943
agtaaacaatttgattttttaataaattaaagcgaaatttattattatttttaaattttcagatg

SEQ ID NO: 114891 - DNA, 1003 bp, Heterodera glycines
  Promoter: Source sequence=SeqID_6088; Location=5631..6633; Strand=-; Gene=SeqID_60291
tatataagaattaaagtgaaaataaaaatcttcacatgttataagagttgaaacacagtaatttagtattaattagtaaaaaaaaaatacttaaaactctttttcaaattataattctatgaattctctttaatgaataataaagatgtaaattctagcccataatttattaaaataattataaacattaaaaattaatacaaacatatatttaaaattttacgtaaaaaaatttttctctgttttttcccaattaatatactaattaaaactattgtgaatataaataatagacacaataaaatgcaaaacaaacaaaatgaaaggaaatttgaaaaaagtaacaattaaaatattttaatagttttatgtgtttataatttttatttttatttaaataataacactttcaattaaattttttattttataaaagtaataaataacagtttaatcattatataattaatgaactttctaagatattaatttgaaaaaattaattcaatatcaaaactgaataataaattattttagcaaaaattaaaaacaaatcatttttgataaatgttcgggatgggcctgattatttgatttatttattatgttggcattccgtcccatttagttgtccattcattcatttattttgttcccttattttcccaatcaatatttgaccctgttcgcccttgtccttttcttttgaataaatattattttattcctcttcggactttggggcgtaacaattggcgacgcctcgacaaaatcgaactttgtgcagccaaaacaattttgatttgtggcttgcggattcttttgaaatcagagcattttttgcgctgctgtttatagtatctaggcgatacttattcagctcatccacgcgcacccacttgattagtagcttggcgctgctaacaataagtggtgaacgacacttcacttaaaacgagtactctctagctgaggggaaagtccacgagctgtggttaatatg

SEQ ID NO: 114892 - DNA, 195 bp, Heterodera glycines
  Promoter: Source sequence=SeqID_10431; Location=861..1055; Strand=+; Gene=SeqID_73630
aaccatgaattatggcttggtgaattggtgcccacttacaaaaattgagattatgtttatctgagatctataagaattttacaatctcgagatctaagaatttaccaatatgtgtttttaaagtacccataaattaaaatggcacaatacattaagaaaaatttcggtatttttaaaaattgtcatgccgaaatg

SEQ ID NO: 114893 - DNA, 1003 bp, Heterodera glycines
  Promoter: Source sequence=SeqID_15173; Location=1125..2127; Strand=-; Gene=SeqID_79370
ttttagagttaatagaacgccaaaatagcaacttaattttaaatttaaatagtcttttctttttcgaagaaaaaataatgaattcgcttcgggcgccggacttttcgacagaaatatttagaatttcaggaggggacttttcgacagtaaagagtaataagtttttaaattagaggtgtaaatcgtaaaattttatcgaaaaagcaacaaaattaagccagatcagtattgagataaattatttttaaaatcaaaaattattaccaagaaaataaatagataaattttggagagtaatttttgagaaaatttttctttcttcttagaggtatatttttgaaaactttaggggccgattcttaagggtgtgttttctgaaatttttcattgtaaaaaatgtaaaaatcgtatccctagtaataatgatttaacaatacattttagtatgttaatttaaaataaatttagtaaaactgacaagcaatataattcattttaataagaattagttgtttttgtgtttctgtcgaaaagtcctttgctgtcgaaaagtccgggagccaatggacaatgccaaaatgcccagtatgtaattttttaaaaattactaaaatttacaaaaagttgtaacaaaaaagctcgaaaaatttggctcaacaattttgacgctaacttttttgaaactcattaaaatttttagaattttttgcataataatataaataataaatatatatttcattgctacaataaattataagagaaatacaagtcattgtatctataataaaacgtaaaaatttattttaattgctattgtatggctatggccagaattatccacctttcatgcaatgtctataatcaattataattccttcagagaaattttattttttacaatataattattattattggttatataatatttgtttgatgcaagaaataaatttgaaataataaattatctttcatatttttttagaaaattgcaaaaatg

SEQ ID NO: 114894 - DNA, 710 bp, Heterodera glycines
  Promoter: Source sequence=SeqID_23294; Location=1303..2012; Strand=-; Gene=SeqID_54002
ttgtaattagagaccggacaagagggtaggtcgaacggtttcggttaaaaaccgaaaaaaaccgaaaccgaaaaaaaccgaaaaactcaaaaaattctcggtcgaacggtttcggttaaaaacccgaaaaaaaccgaaatcgaaaaaaccgaagaaaatttttcggtttatttcgatttttcggttttttttgaatttgtaaaatttaatgaataaatttttatttgtaattaatcttttacgagatataaaattttggaccattcggaccgggacaatttctccgtaaattcaataatggtaatgattttagtgaaaaaaaaccgatgttttgtttggtttattctgataaaatgtagagtaatttaatcaatttttaactgctgacttcctgaaatataaatagcagaattacattgttttttttattttatatatttgcctataaaaattttcttattttaatttaggaaatttccgaaattggaccaacggcaaaaatcgacgcagttcaactaaatccacttttcgtttcaaatggcgcgaacccaattttcacacttatataccaaaaaggtgtattgatattgtataatttcttgccttttttacatttttttaatttaaaaatataaattatgaaagtttttaaatacaataaaatgcaaatttttctaattttaatattttgcatcttaaatttagatatg

SEQ ID NO: 114895 - DNA, 77 bp, Heterodera glycines
  Promoter: Source sequence=SeqID_6074; Location=210..286; Strand=+; Gene=SeqID_60225
aaagcttttcaaatatattttcttaaatttgtttttttggatattttagccctgtgcttttgtgaatttttgaaatg

SEQ ID NO: 114896 - DNA, 95 bp, Heterodera glycines
  Promoter: Source sequence=SeqID_11324; Location=4196..4290; Strand=-; Gene=SeqID_74709
gattgaagccctgttttcataatacgaagttatctttaaaaaaaagtcacaaacaagcctttttatttagctcatcaatcatcactcgcagaatg

SEQ ID NO: 114897 - DNA, 622 bp, Heterodera glycines
  Promoter: Source sequence=SeqID_1061; Location=4951..5572; Strand=-; Gene=SeqID_67032
tttatagataagtcgaaaattcacttaataattattattttaaaatagggaagtagtacttatagattcagatgtaaaagtagaaacgttgtaacaaataaaattttcgctgacccacaaaatgtccagcccacgaaatgtccaagtctcgaatttgagttttttattattcagatgggcctaaggttaggcaaggggtaatataaagggtatattcgtattcagcgaccccgaaaaccctaaaaatcctaaattagactcattttgtttttataaattttgaaacattttggacatttcgtgggtttttactcttttggacatttcgtggcttggacactttgtgggggtgccaaaatttttcataaatttcatgattattttgaaaaaaattaacgaaaattgtcattagagcgattattttttatcgattacaacaatagaggactgtcgcaagaggagttctcctgctgctttttacatattttgtaaaaaaaatctcatttttagcttaatcaaatttgttggattacatataataagctttaatgtattttattctttttttatttttagccttccttttttattgtgctcgccaaattgacactagcagagaatg

SEQ ID NO: 114898 - DNA, 372 bp, Heterodera glycines
  Promoter: Source sequence=SeqID_34896; Location=1..372; Strand=+; Gene=SeqID_64586
tgcgctactaacttgctaaaattgaaaaatttaattaagtttttcagaaggtatacaattttttcatttttttggctagaacttttgaaaaacttaataaaattttttgaaatttagaaagttaatagcgcaattcaagggctatcgtatgataccaagaatgtgcaatttggttgcgtctgagaaagttatgagttgatttagtcaaaaatttagcaaattttgcacttttcgtcggtccaccaaccacgggcgacgaattgtttcctgctgctcttccacatttatttttttgcgctgttcagaaaccgcgaggcgcacttgcgcattttcctgcacaatttgcactttttgctgtccaaacaacagatg

SEQ ID NO: 114899 - DNA, 133 bp, Heterodera glycines
  Promoter: Source sequence=SeqID_571; Location=5945..6077; Strand=-; Gene=SeqID_45949
aaatgttggcacccccgcgaagcctataaataggtatgataatttgagtttttcactatcaactacattctcaccaccaaaattcaaatttttgagagaaacataaataacaaaaaaaaaacagtagaaaatg

SEQ ID NO: 114900 - DNA, 533 bp, Heterodera glycines
  Promoter: Source sequence=SeqID_4261; Location=1..533; Strand=+; Gene= SeqID_53805
atcagcaactccgaaaaccccaaaaaaagtgtttcttatgacttttgaaaacataaaaaaatttggaaaagggggggggggggacaatctgaactattaccaaaaaaacaaccgccattgctatttttagtatcatatttcgccagagtcatatttttaactttaattggctaatcataatgatgtatttgtatgtacaattgtcactggaacataaaatgaattttgttacatgcatacataggatattggttaaaaacaaatggaagaaaatgcaaaaattaactttgtatagtgccagaaaaaacatatttatgcaccttcataaaatcctaaatgatgaaatcctttaagaatgtgcgcttttatagacgaaaaaatctgacattggaggcaaaagagaaaaaccatttgtcagtgtaaaaatgtgttataaatagcgactgtttccttgttttgcatcattcatttattctcttggccaacaatcaaagcatcgaacacaacaaccaacaactacaacaacaacaatg

SEQ ID NO: 114901 - DNA, 1003 bp, Heterodera glycines
  Promoter: Source sequence=SeqID_24312; Location=103..1105; Strand=+; Gene=SeqID_55036
aattaaattaatgaaaattttcaattatttcaaacaattaatcatttttggactaaatcatcgaatattaatagaaattcagatttgattttcacatcactttttttcggagcgctttttcaaaaaacttttgggaaagaaggggtccggcggtgccgataggcgccgccgggggaaattttaaaaatttgggtgcaatttgttaacagattttcaacaaaaaaaggttggtttttgcgattattaagctcaatcttacatttggcataagaagaattgtgaattttgtcaaaataaaaccaagtagagtctttttcgttggtcatttggtctaaattacaaagaggaaaattgtctataaaatgaacgatgaatgtataaatattttctgattgcatattccatttaaatgcgcgagaaaattggaattttggtcgttttcaaaattttataccttcaaatctaaatattcaaaaaagaaaatcgcttcaataaattttctttataaaaattttgccctaaaaaatgcgcggcgcgccgcgcacagaaaaatcccgcggtcgcggatcgcgcatcgcggattcaaattgccgcggtcgcggatcgcgcaaaaaaaacgccgcgaatcgcggatcgcgcatcgcggatcgcggtcgcgtcccagccctctctccacctaaccaactttcatttggaaatcccacggtcacacggtcatctggggaccttcctttgtaagagtcgtattttccgatcctgaatgaaaattaggtatctcgaaaagttttgatttttcgaaaaaggtttaatattaccgatttcggtatgcgagtaaaatctaggggaaaagggattaggtaggtataaatgtttgacaaaactttgtcacaaattgcaaattgctgttgtgttgttttcattggataacgtttttatttgttccactattgtgttttaaccacattcccacccctcctagcattaaacctcaacgaacaaaatg

SEQ ID NO: 114902 - DNA, 301 bp, Heterodera glycines
  Promoter: Source sequence=SeqID_30480; Location=718..1018; Strand=-; Gene=SeqID_60883
ctttttcatgtactacttttttctcattatcttcttgcatttcctgtgtttttgcttgtttggttcgttttaatacgatggcttaaaagtcacggtcacctctcgcgcagcgaggccgagacagtaatggaagaaatgaaaaatatcccccgacaaccaccaatattttttgcggcaaaatgacgcagaggttagagaaactgctcttcagtatgacaaaatcaataatgactcatgctgacggagcattctcaaagcgactcattcttcatcgtcattcatttttacaacacaaaaaatg

SEQ ID NO: 114903 - DNA, 190 bp, Heterodera glycines
  misc_feature (161)..(161): n is a, c, g, or t
  Promoter: Source sequence=SeqID_18789; Location=1..190; Strand=+; Gene=SeqID_83465
agttttaaactaacgaccaaacaaaaaagaaggttgcacaatacgccgatttatagagaaatgttaaatctcgttcagagaaaacggcaagaaaaaggatagaacaggggagtggtatagccctgggagctgtcttgatacctgtcctgagtgttttagcncaacatttattagaaaaaataacatcatg

SEQ ID NO: 114904 - DNA, 840 bp, Heterodera glycines
  Promoter: Source sequence=SeqID_9574; Location=992..1831; Strand=-; Gene=SeqID_71938
caaaaaagtaaaaattttcagtaaatttttttgaagtcttaagctattttcttaacaaaattgcattaaaatactcaaaattttcccggcggcgcctattggcaccgccggacctccattttaccatatttttgaaaaatggagaccaaaatggcaaaaaatagtaatttttggcgaaaaacggctaacaattttgtaaaatacaccccctaattcgggctttcaaaaaacgaaaaatacgcccctaaaaatcgactgaaaaaagaaaaatacacccctaaaaatcgaatttttcacttcagccccccccaccgaagccaagggtctgaattttcgataccattcgattgctctaagtgttttctattagcctacaatatttcaaaaaaattacattaactttaaaaattggttatggccaataatgctggtttttgagtccaacttctttgaaagtcaacagaaaaattttaaagtctaatagataacattttgggctatcgaatgatatcaaagaataaaatttgattatttttgaacaaagttataattattttcaccaaaattttccatttgatgttttttgagtaacgcccattacttttttagtaacgacccagcatcatcaatcagtattgtgataaaggattttaaatttgacgatcaacattgatcatttaaaaatttggtctaaatagttctgctctggaatcctgatctcaagtccaccattttgctcttccaaaattgattagtgtccaaacagaggtcattaagtaagtgtcaattacataattgtttaattaagtagcacataaaatttaaaatgatgtcattatg

SEQ ID NO: 114905 - DNA, 698 bp, Heterodera glycines
  Promoter: Source sequence=SeqID_4312; Location=1..698; Strand=+; Gene= SeqID_53997
tgctgatcggataaagaaaataaataaatgcaacggctgtcagctgtgatttgtgctgactgaatgcttcccctgtcttttgctttgcctcttctcttccactcactctctcccctctatttctctccttcactcccctctctctcctttctctcactcccctctatgtctctcttcactcccctctctctctcctttctctctctccccctctctttttctctcttcccaccctcaaaatatgttcgtttctttctccctccctctccattctctcccattttccccgtttatttgttctttcctttttccctcttttcttactacgagttcaatagcatttctgaactgatttgatctgctgattggatctttccgttgattttgttctcttcctccaacatggtgttgatcgccagccgcaatgttttggccggggtcccggaaggcggcgcttccgcggtgatgcgctccgaagttccggcaccgcacgcggtgagtgactgttaccgtagtgcaggtgcctgttttttcgactgtcgcacgccctctctccccttctctctctacttctctctctctctttcccccttctctctctctccccttctctctctctcttgtgctctctctctctctcttgtgctctctcatacgtccgtctgatcagctcggccgttcgcgctcgcttgccgatg

SEQ ID NO: 114906 - DNA, 143 bp, Heterodera glycines
  Promoter: Source sequence=SeqID_6107; Location=2144..2286; Strand=-; Gene=SeqID_60374
tttatgcaaatattaaaaagaaaatttggaaagtccctacggaaacgaaatcaaaaacgccgcaagggaaacgcgtaaaaaaagtaaaaaataaatatttaaaaataaaaattaataccaaaattaaggtaacaacaaaaatg

SEQ ID NO: 114907 - DNA, 849 bp, Heterodera glycines
  Promoter: Source sequence=SeqID_2899; Location=1..849; Strand=+; Gene= SeqID_82254
ttaccaaaaataaataaatatttttgataaatgctaaattttaatttttgcttcgaagaatgataattaatgtcgccattattaaaagtgccgaccagacaaagccggcaataaagtgaccagtccgggcaactccttctgctccggtgaatttcacacttttcactcccaaaaaagtgaaattccaaaaaattcctaaattgattaaaacatgctaaatttggtcacaaaccattggaatatcaaagaatggtcattctgtacagctacgaacataaaagtgaattttcaaaattttgagttttcgactttttttcgaattcgggtccgggatcccgaattggttgaaatggatgccatattcgtaatcagcgaccctgaaaacccccataaacatgtttccaagacttttcagaacaaaaaaaaacccatagaaaagttagaaactacaaagaaatgttgggcaccttggcatttatgctttttcttttcttttttcttattttacctccaagaaagaacacaaagtcccaaaaagcgttggcgcccccgccgaaattgccctgctgctgttgcgaaagagcgtccgttttttcgccggcggaattcgacggaccaaccacaatttgcctcacatcttttggaaagtgaaaaggtcgaagaattaaaagcggaactgatcaaaacggacagatctgctgttcaactcattgtcagttaccagaaggattgaccggcggcggaagcggcggcgcactttcattggccattttttgctgcaattccaacagtttctggcactttcccttcgcttaccgccttttcggttggcatttcgtcgtgcgaatg

SEQ ID NO: 114908 - DNA, 190 bp, Heterodera glycines
  Promoter: Source sequence=SeqID_25552; Location=1097..1286; Strand=-; Gene=SeqID_56293
tcatcgtattatgtcattggacaatcaattcatttgattttacgtcattttaatgctgccaattgattcattcaattgacgtttttcttcgcattttgctaatctttaaatattataggctattttcatttatattatttttattattttattttttataattttataattttatttaatttttgagatg

SEQ ID NO: 114909 - DNA, 1003 bp, Heterodera glycines
  Promoter: Source sequence=SeqID_13410; Location=1089..2091; Strand=+; Gene=SeqID_77300
tttttctctcgttttctccgcttttccctccaaaaatcgatttccgctcccgtcgtcattgttcagtgagcctcaggcgaggaaacgactgaagggggagcagcacagtcggggatttcgtattcatcgtcgttgtcatcgtcccttgtatttcttcctcgaatgctccttatttttgttttgttcattacaataaaaataaaattgtcgcactctaattgcattaaggtcatttcctcacctttgcatcaattaaaccccattttttggttcattttccatttcccccttatatcatatttcggcataattttaattttgcattttatttttagattatattccaattttgtatattcatttcgtatatagcagcagcaacacatcccagcgtttttatggaattccctgcgtcaacttctgtcaggcgactgttttggacgtagtccgttacctttagtgttccttcaacttttcgccattttcttatgcgccagtagaaacatcatcgccgtcgcactccatttggcccgtaaagccagcacaaatagcggaataccaaatttttcgtctgatcatcgccgactcccttttccccgaaatattggaccctttaattgacaacagtcgagcatcccaaaacaaaggagcaacagttgccaataggtttatactttcaagattgattattcaaatttaattaaaatccaataattaattttccattcttattgaaatatgcatatgaaaaggaaacaaaacgaaaaaattattcgttcaaagccaaaagctgccattcagaaatcgacaacttcattgacttgagagtgcggtgggcctttggcgtgtttgctgctgtttcttctcaggcggctgcacaacaacagtccattcattcattcactgatccgtgcgcggggcagaacccaaaattgttggccaatagtgcgtcgcactaatcggcaaaacgggccgactaacgggcgtttctgtcgggccaatg

SEQ ID NO: 114910 - DNA, 342 bp, Heterodera glycines
  Promoter: Source sequence=SeqID_6703; Location=4252..4593; Strand=-; Gene=SeqID_46291
atcaaacaatttcaattgttttatttaacgatttctgcctccattttaattttttatttcctaactattaaattttgatttgtttgaaaaaattcttccagccttataatgttttagtttcattttctatttttatccattttaagagaccatgatttcaaatcttcccgggcagggtgggattggatcttcaaaagcagacaattcctttgtccgccttttcccaaccggtcaaattgggttttcccaaaaatcaccgggcccattaaaaacctagcccgcctctctctatttttacattacaaatttattttgttttagccacaaatagctctgataatg

SEQ ID NO: 114911 - DNA, 871 bp, Heterodera glycines
  Promoter: Source sequence=SeqID_28475; Location=1..871; Strand=+; Gene=SeqID_59091
gtttttagtgcacataaaagcatatttaggggttttcgagaataaatgcatatttggccatttttgcattttgagagcatatttcggtaatttttggcaaattttcataagaaaaatgcgaaaaaagcgaaaaatacacacctaaagatcgactttttggaatttttttaaatttacacccttaaaaatcggaaaaaaaattaaatttttgtcagaacttttggaaaaaaaaattatgtttttagtatatgctccgttccataattatagaaccaccattttttttttgcgttttacccacttcccatcatccgatcaagctgaagctccttagcccttgttttggtgttttaaaagtcaattcttaatttatacacaatttttggcattttttgagggttaaaagccattttggcagtttattaaggcatattttagtgcatattttatgtgcatatgtatttggcattttttagtgcatacattttgaattagcgcgcaaaaaattacgccaattacgctatttggcgaaatgagcaattttgtctaacactaggcttgacccatagtagtgaggcgccctttttaaatgaactgattgttagattcgtggtcaatcttcccgaaaacccactaaaataatttttatgacattaaattggaattttttaaactagaagctagaagcatcgtcccacttaattgtaaacaagaaaaattccttttttactttaaattttatttgaaatctcgacgttttaaaaaaatttggacatggacctcggaccgtgttggaacagaaaatgattttcctattttaggtagtctataagtgataatttatcactgttaattattatcattaacaatg

SEQ ID NO: 114912 - DNA, 592 bp, Heterodera glycines
  misc_feature (147)..(147): n is a, c, g, or t
  Promoter: Source sequence=SeqID_27651; Location=1..592; Strand=+; Gene=SeqID_58328
tcccccattaatagttaaaagtagcgcacaatcagcaaattattcatttaatcactttcatatacagagattattcaattggcagaaaattagattaattctaaaaacacatgttttagtttgtttgaatttcatattatatatganagtcaagaaatgaatttaaaaatttcactgtaaaggagaggattttattttgatttttcaaaaaacattataaaaaagtcattaaaaactctctatgttttgagaattttaactggtaactttgcaaaaacacagttaaaattaaaaaagaattattttaaaactcgtgagtattttttcatattttttttgaacatggacaaattggcggatcatgaagcgtttgttgagcactgatgatgcgggcggatgtgcactttttagtcggacaagacgatgagcaagaggcgagtttttttaatacattttaattgaatttattattttacaatatttcgaaaagtttatcttttaataatttaataattatattttgaattaatttaaagcttctgccagcgcgtaaaccattttgagagttgcgtccgatgtgttcgatgcaatg

SEQ ID NO: 114913 - DNA, 858 bp, Heterodera glycines
  Promoter: Source sequence=SeqID_2463; Location=1..858; Strand=+; Gene= SeqID_47303
ccagattcaaacagtagttgtacagtgtaaaaaaacggcctgtccctaaattttttcaccttttttaaaagctattttagcggtttgggcgtgtggcaaaatttttgatgaaataacactaatccgtcaataatttatatcatagacaaaaataaaagtcagattctttttctgcatgtaaaattaccctagaaaaaatgtatttatttattttactatttaaattattaaataaatttacgttaaccacaactcgagttgtggttaagattccttaagaaagattaaaccacggttagatgagcataccggttggaaataaaccacggttaacttgcgttaaccgtggttaagaagggagtaaaccacggttaactcaaccgtggtttatccttaaccacggttaaaaagggaaggacgagcataccggttaaggatttttaaccacggttaacgccgttaaccgtggtttagctctaaaccgcgagacgagcataaggcccctgggtaattcgcctgtccacctttgcatttctttctttctctgcctttgaatttttgtgtcttgcgtttgtgcacttttcttttttcttttctctgccgcacaaaaaaaaagagcaaagaaaaaaaaaatgtttttcctttgaattttcgtgggtccgaaacatgaaatgtttgatcctcccttttgtacattacatgcgcattttattgtattaatttgtttgctattgactcggcggaataaaattttcaaatgactataataataaaaaaaaacaatttttattgtattttgaaaagcaaaaatcccaaaatttaccgccatagttttcagatttttttcccactaaaatg

SEQ ID NO: 114914 - DNA, 198 bp, Heterodera glycines
  Promoter: Source sequence=SeqID_29442; Location=1..198; Strand=+; Gene=SeqID_59943
ttatcgtagccaatacagtcggatttcgcattagcattataggaggaatattgcctaaattcaattattaaaaatttaattattagtttgagtaaattacctaacccaaacattggaatcattaaaatctttgccgccaaacgatactcaatgaaattttgtccagaaaatgttgtatgtataaacaaacaaaaaatg

SEQ ID NO: 114915 - DNA, 361 bp, Heterodera glycines
  Promoter: Source sequence=SeqID_230; Location=1..361; Strand=+; Gene =SeqID_78826
ccgactccagcaaatgcaacggttgctgcgaccactctatttgccgcaccatcatcatcatcaaccaatttgtcaatattggtggtggtctgtattgttttggttgcggttttgtgtatcgcacaggtgggtttcatttgattattttgtaattttgataataaatttttgtgataaaggcagtgcgtttcgcactgaaattgcgccaatggttggccaagcgtgccttcaaaaagaaaatgttgcgccgcaaccgtcaaagtatgtttggaaatttttatataaaacttaatcaaaaaaaatgtaatttctttttttttttacaggagcgagcacaattcgtcgctaccccaccgcaatg

SEQ ID NO: 114916 - DNA, 1003 bp, Heterodera glycines
  Promoter: Source sequence=SeqID_12248; Location=1787..2789; Strand=-; Gene=SeqID_75819
attcaattttcatctcaaatttcacctagaatttgcaaaaaaaatttcccggcggcgcctatcgacaccactggatcgacattaatcctgtagaattgagtcaaaaggtgtgacatttggtcattttttggtcaaaatcagttaattaattgataaaattttcaaaaaaaatttcagacggcgcctatctgcatagacggacccctttgttcctagtttttgaaaaaattgcgctgaaaaaaagcatttttgaaaagcaaaaaatagtcaaatttattaaccattaacagatttgatttccgatctctttttaccgtctgaaccattcgaaaaatcttagtcgcctttttaatgcatcccgccagcccctaaaatttcttgtcaggtttttttttttggaaatttcattgaaatttttcaaaatttctaggaatccgcaatcctgcgcgggatcctgcaaatttaaaatgcatgattgcaggatttgcaggattaatccggccggatccggccctgcaaaaatttttgaattccaatcctgcaacaggatccgcaaatttgaaatttccgggctctagtggcttgacaccatagtggatgaaggaatcgaatactgtcccaagaagggatgggggcagggttggaacggattcagatattgaaaaaattgggcctcggaattccgaaaattcttggggcctcggaatgacatccctggtgatagagcggaaaaaggagggtgaagaatttccttctccgccggcgttgcaagggatcagacggaggagagcgaactgatcgagagaaaatggatgagatggagaagagaagggcgggaggagagaagttggacggatgggatgctcttctcttctttagctgtaatctccttggcttttataggggagagcggactgtcaagcgaaatatgcggctgatagtaatgactgcctgatagggatgtgcgagaaatgattttaccgagaaccgagaccgataaatg

SEQ ID NO: 114917 - DNA, 143 bp, Heterodera glycines
  Promoter: Source sequence=SeqID_42739; Location=1..143; Strand=+; Gene=SeqID_70560
ttgcccaaaaattgtttatctcttgtttctccggtggatttgaccgcaaagtggctacctgcttttgccgtctccagcatgctctacctcacactcacacaatatttgaaatgctagctaaaagaattcttgcccaaaaaatg

SEQ ID NO: 114918 - DNA, 266 bp, Heterodera glycines
  Promoter: Source sequence=SeqID_18519; Location=1..266; Strand=+; Gene=SeqID_83141
gtgtgttcacatatgacacaaatttgtaaaactattttatacaatataaaaagaatattgtaataatattatatttcattatatattgtgcaaaaatgaaaacaaattttaaatgcttaattctagtgaaagttcggcatcggcagtgcttttccatgttcgtcaaagctttaagccgcttccaaaaaatcggcgtcctgaacaggtgccaaaaagggcagcatttttaaaatgccattttactttcaattaagttgtacgctatg

SEQ ID NO: 114919 - DNA, 80 bp, Heterodera glycines
  Promoter: Source sequence=SeqID_25618; Location=1161..1240; Strand=-; Gene=SeqID_56367
agggtcaaaatcgctttttacatcaattcctggcccagcgaatgcgcagtgaaggggttttggtgggggggcatgagatg

SEQ ID NO: 114920 - DNA, 1003 bp, Heterodera glycines
  Promoter: Source sequence=SeqID_3685; Location=72..1074; Strand=+; Gene=SeqID_51444
ttgggttgaatttctgttcccccgggggataatccaggggcaaacactcgaaatcagcgattggcgtgggaatgggcgccgatcagagccgattgggcaaaatgtgacgagggaatggccaaaaaaggcacagtaacagcttaattttaatgtttacaggcaacgtttatttgttgtattttgtgtaactgttaaaacacagaattattattaattaaactccaaaatatggcaatttataaaatgccaaaattggcggcttacaccgaattttggtgtcaattaaaatcacacagattaataaatgtttgtttaaatgatgacattctgtgacattcgtagtccaaccgatctgctgatcagctgctgatcgttgttttgatcacattttgtcgcctctgtccgaatttttttttatttacccaatttgcgaacaattaattaattaattattaacgagtaaattttaaacaaataccacacgcatgtgttttcatacaataaaattatttaaaaaatggcgacgaaacttgaaatattcgacataataatctttgtttgatttgtttaacttttatttatttttacaattcatttttaaaagtaattttgactatttgttttgctaattaatagtcaaaaaatgaattggcttttcaaaaataaattaatagttttaaatttaaattttcttcattcgatttcatttttataaattcataatgtgtcaaatttatccagttaatttatcagttaattcttttctcatcacagatgtgcaaatagacacttttttaattgatgattttattaatcggtaccaaacttaattaatgaattgtccgtttttccttctccgtcacttttttgctgctgactttccccaattttcgcctttcctttcctatggtttcatctccgtttcttcctcaggcactttcattttttctttgccttttgtccttttccaatgctcaaaactccttaatgggttacggttatg

SEQ ID NO: 114921 - DNA, 282 bp, Heterodera glycines
  Promoter: Source sequence=SeqID_31344; Location=1041..1322; Strand=-; Gene=SeqID_61717
tctaattcaaaattaaagaaaatgtttcatttagaaatggcggaaacatctcactttggtggagaaggattagaaacgctgctgaatacagtggaagcaataaaagaaaaaactcaggaatttttttaattttagaaaaataaaattttgaaaaaaattttaggagtccgacagtgactacgaatcagcaaacgaaaacagtagcattgtttgcaaaatgttgacatttttaatttacttttaaacattcagattcgagtgaaccgtcattagcggatgatg

SEQ ID NO: 114922 - DNA, 361 bp, Heterodera glycines
  Promoter: Source sequence=SeqID_26931; Location=466..826; Strand=-; Gene=SeqID_57665
ttttggtttaaaggggtcagttaatcgatggcatagcaggggggagggggtcttcacagtggcaaataggaaacggggcggcgtcgcattcctattgcttcccatttttacataaattgttcacaataaaaagcataataatttttgttttaaataattctttttcttttttagctcaaaagcttcccagctcgttcacaattttttattgatggcggacaaaaatttgtcagcaattgatggtaattttttctttacattttcaatggtctataatttttttgttttctcacaagggtgtctgcgcattgacaccaattcgccaaatggagaagtgtccgcaccaccgctaccaacgatg

SEQ ID NO: 114923 - DNA, 510 bp, Heterodera glycines
  Promoter: Source sequence=SeqID_2403; Location=4515..5024; Strand=-; Gene=SeqID_79547
tcgtcgaaacgtccagccaccgaacaaattttcggtcatcatcataacccgataaaaaccggtcaaaaaatcgccgggttccgggccggattgcattttcaaaaacgccgggttccgggcccggcctctcaaaacccggtcaacccggattttccctaaaatcgccgggcccggtaaaacgcggtagggcttggcgcggctcagtcttagaaaaaacccgtttttaggggtaaatttaaaaaatatatatataaaatttttcttatgaaattttttataaattctcaaaaattcccaaaatatgcaaaaaaaaataaaaagaaaaaattgcaaaatacgtactaaaaattccaaaatatgtacatatgtaatatgtaaaaaaatcccgaaatatgtatataagaaattttttacgaatttacccagattttcgcattttttcgcccgcaaaaattttgtgtttaatgacttttttctgacataaagtgaatagaaaatgtttataggatg

SEQ ID NO: 114924 - DNA, 60 bp, Heterodera glycines
  Promoter: Source sequence=SeqID_6679; Location=659..718; Strand=+; Gene=SeqID_62462
tgtacggcattggcacaattggccactctctaattgctttggcatttctcgcaggacatg

SEQ ID NO: 114925 - DNA, 57 bp, Heterodera glycines
  Promoter: Source sequence=SeqID_2108; Location=3941..3997; Strand=-; Gene=SeqID_77900
gccgcaaatcgtgcatgataacgagtgcaatatggcaaacaaaagttgcaaaccatg

SEQ ID NO: 114926 - DNA, 380 bp, Heterodera glycines
  Promoter: Source sequence=SeqID_28790; Location=1..380; Strand=+; Gene=SeqID_59368
gttcggggttcggaattgatcgaaatgcttgccggattcgtgatgagcgaccccgaaaaccccccgaaacatgttttcatgatttttgaaattaaaaaagaaaattcgaaaaatgttcgaattcgggttcgggattggaaataggacgaaatggaggtcggattcgtgctcagcgcctcaaaacacccctagaaacattttataagaattttcagaaaaaatttaaaaaaaaaattttcgggaccaatgatcgacatgattgccggcttggtctaggcctatgcttcagcttaggcttaatattttgaattttgtccgtgttcgggattttgaattcccaccctgctttttagacttagctcaacaagagctttaaaatg

SEQ ID NO: 114927 - DNA, 385 bp, Heterodera glycines
  Promoter: Source sequence=SeqID_14636; Location=270..654; Strand=+; Gene=SeqID_78725
tttttaattcaaatttgagtctccacattctgacggggatatttctaccccccccccccctcgtccgtcataagggggcggcagtaaaagaggtggggtgtgggcaccgacgaagggggaaaaggaaaaatcttaaaatttgaacaaattttctaaaccaaattcattaaagtcgcaaacttcacccggcggcgcctaaaatcactatttcttctttttttaattggttcaaaaatcataaaatttggtgcgaaaagcaaaaaaaaaggtcgccgctgggaaaattttggaccttcgtgtcgaaatttggccctggcgcaccccttgcgcgtatattattgcattcgggagctattttataagtagtattaatggtcagataatg

SEQ ID NO: 114928 - DNA, 118 bp, Heterodera glycines
  Promoter: Source sequence=SeqID_23894; Location=1..118; Strand=+; Gene=SeqID_54585
ttctcttaaatttttttgaacccaattcaaaaaaggaaaaaaatttgcagtcaaaaaattattcgaatttctccaattttgtttccataatttccgaaagttattcggtatcataatg

SEQ ID NO: 114929 - DNA, 527 bp, Heterodera glycines
  Promoter: Source sequence=SeqID_7478; Location=2241..2767; Strand=-; Gene=SeqID_64944
gatttgcgaatttcttgttcctttatttgttagagatatggtgaaaataacatgccaaaggaagagaaaaagaaaaatgtatattttctaatccgaaaacactaaaattttgttaccgtattcttcgattattagacaaaggtcttctatttccaacccctcgcaaaggggtcttataatcgaaaaaatatagtaattttcctgttttattgctatgcaaagtgaatttaacatataaaaaaagtaaatactatttttctataaaaaatgaagtgatagtacgccaaaatgaaaaaaatgcaagaaaaagagaaacaacgaaatagtacaaggtttttctcacagtggagttgaccaatagcccataatgtattcgccatttgcctccattcattagggaggtgcgagatctaggttttttggtctagcttctcaggaacatttgcttattaaaaaactattatctttcatttcctgtcattgagtaatcaattcttatttattttataagaagaaaactgaaaatg

SEQ ID NO: 114930 - DNA, 104 bp, Heterodera glycines
  Promoter: Source sequence=SeqID_30343; Location=1188..1291; Strand=-; Gene=SeqID_60768
atttaagttaattggtttaaaagattaaatatcaaaaaaataaaataatttacataaaaattatttgtcctttcttgattagcttatatttcaatgttaagatg

SEQ ID NO: 114931 - DNA, 169 bp, Heterodera glycines
  Promoter: Source sequence=SeqID_8030; Location=666..834; Strand=+; Gene=SeqID_66752
agtgcgccatcggcttcttttttccttctcataattccctttttagtctctatttcggtgaaagactgggcgtaaaatgtggcgaagtgtacgacgaaaggggcgccacttttgagccgaaacagcccatgctgcagttgaacagaagcgacggaccaacgggagaatg

SEQ ID NO: 114932 - DNA, 91 bp, Heterodera glycines
  Promoter: Source sequence=SeqID_2132; Location=692..782; Strand=-; Gene=SeqID_78014
aattttggaatttggcttttcgctgccatcgacatctgtcacaccaatcggcgatttggtgctgttttcgacaacaccaactgcgccaatg

SEQ ID NO: 114933 - DNA, 269 bp, Heterodera glycines
  Promoter: Source sequence=SeqID_21774; Location=1065..1333; Strand=-; Gene=SeqID_52377
ttatctttttagaaaatataaaatattttttcttcgatcagatgttagtctcctgatcaagctaccaaatgaatttgattactgatcagtcagggggtagaccaaattgttggccaatttgggcaaaagttttatatgtctcattaattaattggtctcccaaagggtcctcctcatcctcctcactgcctgtggactttgcccaaattgtgatggcccccaatgggcgaaatgacgagaaatttgtgggacgacaatgggaagcaatg

SEQ ID NO: 114934 - DNA, 416 bp, Heterodera glycines
  Promoter: Source sequence=SeqID_11866; Location=1680..2095; Strand=+; Gene=SeqID_75363
tttggcgcgtaaaatgtaaatatggctattttaaaatcttttttaattttaattttaaattttaaaaattttctaccagtttcgaattttttcaacagtttttcttaacgctgtattttctacaacattttatttataaaagtacaaaaaatttttgtatttacgaatattaacgttaaaaagaagattgttccgaccaaaaacgagttattgtggatattctcacaaaaatgaaaactgttaaaatattcaaataaatataagccctagtcataatgataaatacgatcaattttagtattgttcaaaataataacggctccctaaaaattcacggttttgacgaatcgacaaatgacagcgtcaacattgcggatattttccctgttgtgcctatcgcaaaacacacaaggatg

SEQ ID NO: 114935 - DNA, 1003 bp, Heterodera glycines
  Promoter: Source sequence=SeqID_15548; Location=390..1392; Strand=+; Gene=SeqID_79830
ataatttgtaatctcaccaatgaaaaataattaattacatggagcaatttgtgactgaccctccaaatttcttacgccacaaaaaatcagaaatatctatataggtatgtatgtgtttggaaaaagttatttgtatgtgtcaaattttgcttaattcccggtcctccggggtactggtcccggtttttgaaaagcctaggtctcggtcccggacgaaaatcgaggtcctcaggtcccggtcccggttttgccaaaaaaaaaattccaggtcccgtgacaccctactagtttaaacttctgctacatacgtctattcaattgtatgttggccagttggaccttgaaattctcaaaaaagtgaaaaaaaataaaaattttgaccaaaaaggggtgaatttaatttaacatacaattaaatacatatatagtacctttttttttagcttttttatacaaattaattatgacagcaaattttttttttgtgaaatttatctgaacaaataataaaaatgtacacataaaatagtgtaattattctaattttggatccattttattcgctgtgctttccttcctttccctttttaattagtatatctaaatggttaacaaaaatagacaagccttccttcatttcaatggatacaaagatgcttatcgatgtggacaaacaattcaaacacaaagcgcttttaaagttggatgaatctttccgcaaatacaaacataaaactaaccgatttattttttgataaaatactatcattatttaaaaaaatatttgaattaattttcattcaattaagaaaagtctttgttaattaatttaatttaaaattaattattaaaaaatttttttaaaaatttgaattaatttgggctaataggtaaattaattttccctttttgcatgtttaggcttttaaaaaaaatatattaaatttctacgacaacataagccgttaaacttgggcaatttgacaaggcaacaaataaaatg

SEQ ID NO: 114936 - DNA, 290 bp, Heterodera glycines
  Promoter: Source sequence=SeqID_1914; Location=1919..2208; Strand=+; Gene=SeqID_76758
aacagttacagtaaatttaaattatttatctttttaaatttatttgcctccattttttcatacatttatttttttttgtttaccgcataaaatcatttactcattgttagtctcatttaaaactaaaagatttctttttaaaaatttgtcattagaaatttgcaaaatatttttaaaaatttaaactttcatatttggagttaattaatcttctctttttttgtgtttttgacaagcgccgcccggaaatctttttttttgcaattttcagcaacaccgctcggaaaatg

SEQ ID NO: 114937 - DNA, 137 bp, Heterodera glycines
  Promoter: Source sequence=SeqID_9709; Location=4135..4271; Strand=-; Gene=SeqID_72443
ttttcgatcgctgtgttaagaatcaaagaatcaataattttaaatcaattttgttctcctttttatgtctctgaactttttgtgtgtacaaataaatgttcaatattcggcatttttgttctaggtgaattgaaatg

SEQ ID NO: 114938 - DNA, 125 bp, Heterodera glycines
  Promoter: Source sequence=SeqID_24884; Location=1219..1343; Strand=-; Gene=SeqID_55631
attgtacttgtggactggtttgatattcgtgagcaaaaacgacttatggtattgcgagcttcatctgcagaacgcggtcgttatgctactctatatgagaaagtgttaccaatttcagagcaatg

SEQ ID NO: 114939 - DNA, 526 bp, Heterodera glycines
  Promoter: Source sequence=SeqID_28070; Location=1..526; Strand=+; Gene=SeqID_58725
gtatttttcattttcttgtatttttattgcaatttttctcaaaaatgccaaaatatgtgcaaaatatgtgccaaaccccaaaatatgtgctaacatattttatgtgccaaaacgccaaaatatgtgtttttatgtttttataagtcgctctaaaccaaaaattgttcggagaaaatgctatttttgggcttctctcgccataactaagccgcaaaaaaaatatgttaaaacataaaaatcctagccctaataatttgtgatattcactttgttcgaaaaatgagtggataaattttttactattattaaataaagagaataaaatggacttgagtgtaacggagaacctgggaacaaaaaaacacagattatcacacttttggcaaatgcagaaacacaaaaataattaaacataattttaccagcttctatggaaacagtttcgaaaattttgatttttaaaaatcgtgaaaacatatttaaggggttttctaattaaattcttttttttcgaccgaataaaatg

SEQ ID NO: 114940 - DNA, 505 bp, Heterodera glycines
  Promoter: Source sequence=SeqID_3291; Location=1181..1685; Strand=-; Gene=SeqID_84082
cttttttcatgcctttttcgcgattttcgtgccttttcatgcctttttttcaatttttgggtgcctattatagtgcctgtttcacgatttttggtgcctttttatccgagctctagtgatcagtccaatttaatttaaatatttctaaattttttgaaattagaataatttgtaaaatcaaaaatttttttaccaagaaaaaaagtttaggggattaattttgagaaattcttttttaatttatttttgaaatttccggtctattcttacaaattagaggcgtatttttcatttttattgcatttgttaaggaatttttcgaaaataaaaataaacgctaaaaatggcgaaacaaacataaaattggcgaaatgaattaggtaagcacaaaagtccaaaagctttttttaatactttaacaaaatttaattcatttcgttttcggcctaaaccacaaaactaattaacattaagctggaagcaaacaaaggaatttaaataaatg

SEQ ID NO: 114941 - DNA, 535 bp, Heterodera glycines
  Promoter: Source sequence=SeqID_11482; Location=1782..2316; Strand=-; Gene=SeqID_74893
ttgcgacgcgccacggcccacggaagggcaactccctgcaacttctgattgtcagtattgggtgtgctcaaggtgaacaaaaccattaataacaatgacaaaagccatgggaaatctcggaaatgctttttagctcaatgtaacataaatattctaaattgcactgtgttccccttggcccagtggttagtccctttgttttgtctgtctcggttcgacttgcccccacttcccaatttgtctttgtttcccgtttctatggcatttgatgctttcaacttagttgtagctcaactgtgccggtacttcacgggtaaattgtgatttattcggactgagtgcagaatataatgccggagtatattcctctgaggtgttgaactgttagaaatattcgtttgacatggcatttagtgtacatttttatattttttgggattttccctttcgtgattaagctaattatattaccctgccccttcctttttagctgtttgtggcgtaactttcccacccatttgtcgtgccaaaaatg

SEQ ID NO: 114942 - DNA, 1003 bp, Heterodera glycines
  Promoter: Source sequence=SeqID_15252; Location=457..1459; Strand=+; Gene=SeqID_79458
ataaaatcaaaaaaggaatatcttatcaagggtgacgcggcggtagcattagagtacgcgaaaatcagacaatggtaaagattattttaaaaataaattttgagaaaattgtatattttcaggaaaattccgaggcgcaacaatatgagtaaaaacggtactagtgcagttggtacgtcataaagaaaagttttaaactcgtataaaaataccgggggtttttttcgggggagaggggcgcgtgtttataaaatcacacaccctccattccagactaaattcagaagctccgcggacatcaaattaacacagtgtaaaagtcaaaaattctcaaaaaacttttaccaaataaatatgatcaacaatatgtcaaaaattagagcaattaattttcgcatggacaattttttacgtcgatttgattatctaaaaaagttaaagcacagctattccactgaaatggaccaattaaataatcattgacaaatcacaggatgaaattattgatacaagccatagatttgtcagttacgacgtcagattcttgatagaaagtgcatccattgttgggaaaatcatgacaattttacgaggggtagaaaacccgaaaatttcaataaaatagcaaactttaggaattaaaaaattcaacgggagatcgacaaaaaaatttaataacatatgccaatatttttttccttaacatcatgccaatatatttttttcaaacttaaagtgacaaaaattaagaatttttgactgcatcatataccggtaaaaaaaccggtcaaaagttcgccggacaggtttggcattttcaaaacgattgttttccggttcggcctcacaaagccagtcagatatgttctaattttttatttttgatcaaattttattgaatgttttacatttttctttattaaatattatttaaaaatttcgcgattttgtaaataaatccccacctattcatctccaaattttcagatttttcaataagatg

SEQ ID NO: 114943 - DNA, 1003 bp, Heterodera glycines
  Promoter: Source sequence=SeqID_21410; Location=232..1234; Strand=+; Gene=SeqID_52019
cctgcaaaatttggagagattatatcgattttagtgcgctaggttcgatgaaacttttaaaatatacgcctaaactttttggcctgtttaaaaaggaattaaaaatttttaaaaattttattcatctcccttttgatagaaaaagcatcagagtgccttaattaattttttttaaataaaaaaatttgactagaccaatcgaaagctaacggtcgacctaatggaaaaaaatccccgaaggagagaatttaattaattccattccttcgggggtccgtgccgggtgccgcggggtaagcagtgctggtttcgtttcatcacggcccccatccttttgactagtcagccagcgttgcttaacttgtcagatcggacgggtacgcatgattccaattttccaagcaccccaccgaaagtagaacgaaataaccaaaatataaggaaaatattttaaaaagatgttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatggagaaggcctgcaaaatttggagagattatatcgattttagtgcgctaagttcgatgaaactttttaaaatataagcctaaactttttggcttatttaaaaagcaattaaaattttttaaaaattttattcatctcccttttgatagaaaaagcatcagagagccttatttaacttttaattaacatttggtgcgtttcagagcacgttctaaaaaatatttatgaattaattttgcaaaataataaataattaatgaaaaagtcagaatttcgaaaaattttaaaaacaacaagcgttggcatttttcaggttaagttagtcctttacaatg

SEQ ID NO: 114944 - DNA, 65 bp, Heterodera glycines
  Promoter: Source sequence=SeqID_23742; Location=1..65; Strand=+; Gene= SeqID_54441
atttgtcgcttctaatttgtctgttcaaattcatcctttgggatccaattggtgccgagaagatg

SEQ ID NO: 114945 - DNA, 279 bp, Heterodera glycines
  misc_feature (7)..(7): n is a, c, g, or t
  misc_feature (31)..(31): n is a, c, g, or t
  Promoter: Source sequence=SeqID_25059; Location=1..279; Strand=+; Gene=SeqID_55790
cgaaatnttgatttccaatattgaaatatantgaccactatgtctctaatatttggagaatattctagatttcagatacgaaatttgtagaattgttaaaattctaaaaattgaatcttaacctttttggtccatgatccgaatgatcaaatatttgaggaattccccaaattggatcgggtccgtgcagtatttttagattgcgtaaatttaaaaataaaaatttgtttaaaaaatccaaaatttttcctttttaagggatgtgtgatagtgaaaatg

SEQ ID NO: 114946 - DNA, 127 bp, Heterodera glycines
  Promoter: Source sequence=SeqID_8784; Location=753..879; Strand=+; Gene=SeqID_69216
ttgtgtttgggtgaacggagaagaagaatattaagttatgttttagttaaatggcctaaaaatgaaaatttaactaaaaaatgaatgctaaaataagaataaataaataaatgtttagattaccatg

SEQ ID NO: 114947 - DNA, 455 bp, Heterodera glycines
  Promoter: Source sequence=SeqID_2339; Location=3954..4408; Strand=-; Gene=SeqID_79219
tgtggtgctttcggttcctctaaaaaaattcattgttttcgcgaaattcaatgggttttctggcttttcctaatttcttttattgttccttttaaattaaaccatttttattttccttaaatttttttagagttaaactataaattatttattttttgtagagtgccacgggactgggaatttttggcaaaatcgggaccaggacttgccgggacctgagaagccgggaccgggacggggacctcgattttcgtccgggaccgggaaccgggaccaacagggaatttttaaaaaaattcaaaaaaattttaaaaaattcaaattttaatttatttcaagtgaaaataatacaaatttgttaacagattttcaacaaaaaaggctggattttgggattactaggctcaatttgtacggattttcatttaaaaaatgataaaatatcaaccgaaatg

SEQ ID NO: 114948 - DNA, 167 bp, Heterodera glycines
  Promoter: Source sequence=SeqID_11362; Location=2940..3106; Strand=-; Gene=SeqID_74755
ggtcgatcaatgcgcagtgaaaaaatgttcatttgtccctttccccatttattttcaataaattcccttaaaatttggttgccctggcaacaaaaatgatcaattaaaaaacccaaaaaagcggcacatttcgagaaaattttatccttcgcgcagctgacaaaatg

SEQ ID NO: 114949 - DNA, 304 bp, Heterodera glycines
  Promoter: Source sequence=SeqID_27752; Location=545..848; Strand=-; Gene=SeqID_58421
actttgatgttgtcatatgacaaaactgatagcgtatttttcgctcattatcagcacctttgacaactcatgagtgaaataaaaaatcgtttaaatcgggcattttatattatctctaccattaccccacaaaaataaataatacgtaaaaaattaacacccccgcctttcacagaaattggacaccgtccgttctctccgtttacgcgcgttggagcgcggtcgggaggccgaattgagtgcagcgcggctgaatttgcatgagttagagacgacggtggtgcggcagcaatgcgaaaaaatg

SEQ ID NO: 114950 - DNA, 659 bp, Heterodera glycines
  Promoter: Source sequence=SeqID_937; Location=976..1634; Strand=+; Gene=SeqID_64515
agcgacgacggcacttttgctgcttatcgaatattttgaatctctgctgatggatggatttgataattaatgttcttttttttctttaaaatgattaaacttttgtcgattttttctttcgatttgacggatttttattcgaaaattcaccttaaatttatttaaaaaaaaatattatttggtcggattaaacagtaatttgcatctgttgtatatttttacatgcacaatttgacttagttttttttgattatctacagcaaatttcattgggttcttttgtgacatcatttgatgaacagcaaagaagaaaatgattaatcgaattttgataaaaattcataataattttatttgttaagcgaatttaactgaattttcaatggcatcgcccgccaaaaaaaagaaaaaattttcttccgccgaccatttcttaatttcttcaattagtgaaaatcagcagcaatcattgtcgggttcatcatttgagacagcatttggagaagaacagaagcagaaaatggaaaagcgaattttgaagaggaaaatgtgagaaaaaatattattaaatttaaagttaatttaacacagtgttatggccataacatacatcacaacatgggaaaagcggataaaattctaacgtattaaaaaacatg

SEQ ID NO: 114951 - DNA, 1003 bp, Heterodera glycines
  Promoter: Source sequence=SeqID_10509; Location=1846..2848; Strand=-; Gene=SeqID_73734
ttcgtttttgatttttatttcttattttagcgggatttatttatttattattttttgattataattttaaattattgagtaacttttgttctcgttcgtatatcataataatttaaaaaattacttattccattaactcgcttaatgggaatatctgaatttatatgaaaattatttggtaatttttgcgcaaaattagcttgcccaattttgattttgtaaaagaatgaaaatttcaatttttttgtactattgttgagattttcattacaaaaatggcgcttgaattttgcgtttcctcctgtttttataacatatataaattttatatgtttgttgcttattttattgttttatatatgtatttattttaaattttccaccacattttcacatttggattaaatttaaataattatttttatttatcatatctaattatgtattttattgaatttgaattataaaacgcatgaaatttaagaataattaaattttaaaaataaaagaattggtgactgttcagcaaaaataattagattttaattagagatcggatacggacgggatccgtacacggatttttacggatccgtagtccgtaatccgtattttaaaaattcaaattttaattttttttttaaagtaaaaataatatataaaaggaatcttaaccacaactcgagttgtggttaacgtaaatttatttaataatttaaatagtaaaataataaataaattttttctagggtaattttacatgcagaaaaagaatctgacttttatttttgtctatgatataaattattgacggattagtgttatttcatcaaaaaaatttgcacacgcccaaaccgctaaaatagctttttaaaaaatctatgctaatattgataatacaaacaaaaaataattattataataatttaattatattttttttaatattaattatttttcaatttcacgataaattctcttaaccacggttgagttaaccatg

SEQ ID NO: 114952 - DNA, 1003 bp, Heterodera glycines
  Promoter: Source sequence=SeqID_6312; Location=577..1579; Strand=+; Gene=SeqID_61106
gagactgggagattatttttcgttgatttatttagtggaaaatttttgaaatttattttaaacatgtcgccaaaaaatgtcatcgcgtcaaaaaaaaaacatttttattgcatttatgttaaagaacttctgaaaatgactccaaaatgacaaaaatctatcattttcttgcttccggtatgcataaaaattggaatttttaatggtgaaagatggacgaaacgatcacgaagaagcctttttttattttttttaatattaattttaattttaaaagtttttagttttttttggcttttctgatgattagtgtcgctacttttagtgatttaacgaatttttttgctcaattgttatgaagaaaggagctcaaaaaacgtattttttcgttgaaatttttcgattctgatgtcactatcgggcactagaaatcactacctattttggcgcttcgtactaaaatagtgaaaatttactatttcgacatttttaggaaaattccttaacaaaaatgcaataaaaccaaaaaaatacacccctaagaaacgacctaaacattttttcaaaaataccactaagaattggaaaattttcttaaaaattcttcccacaatttttttttcttgacaaattttgattaaaaatgttcagtattttgataagggaatagttcaaaggaaaagtacctcatttgcaactccaattagtgaataaaattattttggcttaatttttgactgaaaattaggtcactattcgtcactatttcggactttttgccactattttggaatttttactcactattttagttaactatttcgagattttccgtcactaaaagtagcgaccctactctaatgatgatgcagggctggatggagtcggagatgacaacgaattgttcatttattagccccttttactgttgaatgattttttttggaaaatgtgccaaataaattattaaaaaattctatttatcccccctggcacataaatg

SEQ ID NO: 114953 - DNA, 189 bp, Heterodera glycines
  misc_feature (47)..(47): n is a, c, g, or t
  Promoter: Source sequence=SeqID_3162; Location=2006..2194; Strand=-; Gene=SeqID_83485
tattttgcgcgttggcaaacaaaaaaaaagcggcaaaaaaaaaattnaattaatttaaaaaagctctattaaagagcatcaaattaattttctcattcaattctatgattttattaccaatttaaataaatttttattaaatctaaatattttatttcgaaaaaaaaattcttcataataataaaaatg

SEQ ID NO: 114954 - DNA, 107 bp, Heterodera glycines
  Promoter: Source sequence=SeqID_19070; Location=832..938; Strand=+; Gene=SeqID_83814
ttttttatccgcttttattaattggcactcatcaacaggcaattaaaaagactaaaaggtgtccggacaatgagatctaattaggcaaaaggggcggggcgtaaatg

SEQ ID NO: 114955 - DNA, 173 bp, Heterodera glycines
  Promoter: Source sequence=SeqID_15026; Location=1013..1185; Strand=-; Gene=SeqID_79189
ggccaccgtttattgctttttcggtcattgttttttgattgtccatgcaataaagcagattataggctgactgttggcatgtatttttctacggatttgacttaatcaatttgtattccgtttttatttatttttaaaaatttaattttaaatttacttttgaagccaaaatg

SEQ ID NO: 114956 - DNA, 257 bp, Heterodera glycines
  Promoter: Source sequence=SeqID_42292; Location=1..257; Strand=+; Gene=SeqID_70217
aagccaatatcaaatcgacacacaaaaccatgaatgaacgaatgtatgatgaataatattaagtaaaaattcaattcagtaaataataaagcatgagaaaggtcagagaattgctggacggtcaaacagaaagagggggaggagagaacgggggggggggggttaattatctcataattcagtgctgtacgatttttatttaaatattttttttataaataattttaaaaaaaactttttagattttttaaaaaatg

SEQ ID NO: 114957 - DNA, 155 bp, Heterodera glycines
  Promoter: Source sequence=SeqID_5497; Location=1304..1458; Strand=-; Gene=SeqID_46053
tctttgttctccctcatttcccccgccccctcccctttttggcgaacgtcactttttcattttaaatattccttaaacttcgctcgcctttcccctcattcaacgggccattcgaccgtgaagtgttcttcatttctccaaactgttcacaaatg

SEQ ID NO: 114958 - DNA, 464 bp, Heterodera glycines
  Promoter: Source sequence=SeqID_6641; Location=1..464; Strand=+; Gene= SeqID_62305
cccacggtcacaattcacggggtcaattcacggtttttcgtgaaaaatttacactggataaaattgaaaatttacgaattacatattgttttcatagagaaatttggtcattttttgggcaaagttgctaagaaacagagcaaaattttcaataatttccccggcggcgcctatcctatcggcaccgccggctccctcccctattcctgaaacttttttgaacaaagccaactacctatattgtgcgaaaaacaaataaaaagcaaggtttcaaggatgatcccatttaaataaaaactcattaaatttcttttaaaaaatcgctcgaaataaagttaatgtctcacaaaagcattttaaaaaggttggaatcgatttagaacgcaaaatgatgagaaaaatgcaaattataggcgcgcgtgccaatgcacacttcagtacccgattttttttactgaaaaatg

SEQ ID NO: 114959 - DNA, 78 bp, Heterodera glycines
  Promoter: Source sequence=SeqID_20492; Location=998..1075; Strand=-; Gene=SeqID_51033
taatttttgccatgaaaaccgagtcatgtacaatttctgctgaaggtgctgcgcgattgggaccgattggaattgatg

SEQ ID NO: 114960 - DNA, 334 bp, Heterodera glycines
  misc_feature (12)..(12): n is a, c, g, or t
  Promoter: Source sequence=SeqID_22956; Location=1..334; Strand=+; Gene=SeqID_53653
cacttagaggtnatttggtgaagattcggtgatcgcttttgatgaatgggctgagtggtttactgattatgttggagctgtaggacgaaattggaatgaggatgagaaagttgctcgatttaaaatgtcattaattgggacaccaagacaactttttaaacaattaatccaagcggaggcagctgcccttaactcagcgattactgggattaggcaaaaattggactcaccccaaagacgggaacttactaaaaggacattggcactttgcaaacagagagaaaacgaaactgtttcagaattccttaagcgccttaccccgcttgttgaaatg

SEQ ID NO: 114961 - DNA, 389 bp, Heterodera glycines
  misc_feature (44)..(44): n is a, c, g, or t
  misc_feature (48)..(48): n is a, c, g, or t
  misc_feature (54)..(56): n is a, c, g, or t
  misc_feature (59)..(59): n is a, c, g, or t
  misc_feature (76)..(76): n is a, c, g, or t
  misc_feature (81)..(81): n is a, c, g, or t
  misc_feature (84)..(84): n is a, c, g, or t
  misc_feature (87)..(87): n is a, c, g, or t
  misc_feature (104)..(105): n is a, c, g, or t
  misc_feature (110)..(110): n is a, c, g, or t
  misc_feature (118)..(119): n is a, c, g, or t
  misc_feature (158)..(158): n is a, c, g, or t
  misc_feature (161)..(161): n is a, c, g, or t
  misc_feature (163)..(165): n is a, c, g, or t
  misc_feature (170)..(170): n is a, c, g, or t
  misc_feature (182)..(182): n is a, c, g, or t
  misc_feature (185)..(185): n is a, c, g, or t
  misc_feature (193)..(193): n is a, c, g, or t
  misc_feature (198)..(198): n is a, c, g, or t
  misc_feature (202)..(202): n is a, c, g, or t
  misc_feature (222)..(222): n is a, c, g, or t
  misc_feature (227)..(227): n is a, c, g, or t
  misc_feature (232)..(232): n is a, c, g, or t
  misc_feature (238)..(238): n is a, c, g, or t
  misc_feature (267)..(267): n is a, c, g, or t
  misc_feature (276)..(276): n is a, c, g, or t
  misc_feature (297)..(297): n is a, c, g, or t
  Promoter: Source sequence=SeqID_35770; Location=465..853; Strand=-; Gene=SeqID_65246
aactgatgacaagctaatgtgatcttcctgggtaattcttttcntttnagtatnnntgnaaagttctttgaggttntgatnagnttntgaaaaaaaagttaagnntaaantttttggnntgtttaaaaaggaattaaaaatttttaaaaattttattnatntnnnttttngatagaaaaagnatnagagtggntaaantaanatgtaaataaaatttggtgngtttnagagnattttntgaaaaaatatttatgaaataaaaaaatngattttttnaagtgtttgtttggggtattnaaaaaattatggggagaaaaaatgaaatggagaattaaagtagaggatatagggaagatatttttttttttttaggaatttggataaatatg

SEQ ID NO: 114962 - DNA, 129 bp, Heterodera glycines
  Promoter: Source sequence=SeqID_24075; Location=958..1086; Strand=+; Gene=SeqID_54770
ttttattgatccctacagtgggatttcaaaatatgaaaaacatgtacagtatttttgcactacggtattttattgcttttcttttcacagatcaaccactgtccgtacgcgtttttctgccgcgaaatg

SEQ ID NO: 114963 - DNA, 221 bp, Heterodera glycines
  Promoter: Source sequence=SeqID_8444; Location=2045..2265; Strand=+; Gene=SeqID_68094
cctgaattttggtgtgattgaggggggaggggagcagttcacgcggtacaaccatttccccaattgagaaagttttcaaaaaaattaatacaataattataaagataaaaagtgaaaaaaaagtatttgaatattaagtcaaatggattgggctttccttttgagacaaacggtgaaaatttattatggtccaataaaaattcaaattttcggcctaaatg

SEQ ID NO: 114964 - DNA, 109 bp, Heterodera glycines
  Promoter: Source sequence=SeqID_4729; Location=3077..3185; Strand=-; Gene=SeqID_55549
aaaaaatgatagatttgcatttttttattatgtacctggaaaaaacagtccattaaaatattataaaaattaatttaattttttttcagtcactttctcactacaaatg

SEQ ID NO: 114965 - DNA, 277 bp, Heterodera glycines
  Promoter: Source sequence=SeqID_27032; Location=326..602; Strand=-; Gene=SeqID_57764
tttattttcagatgtcaattttggcacaaaagttaaccgaattgcaggaggagaaaatgatgatcagtgaagaaaagtcacggtccgcagaatgttcttttaatttgattctaaattcccatttcattgcttaggctgaggacagacaacgccgttttgcaggagagagtccatttgcttgaggagcatttgcatgccaccgaacaaaggcaagatattctcacatttcgtaatgttttttcaaccgatttctttgtttcaggtgggcagaaaaatg

SEQ ID NO: 114966 - DNA, 63 bp, Heterodera glycines
  Promoter: Source sequence=SeqID_14211; Location=1..63; Strand=+; Gene= SeqID_78224
ttggcaccatcactcgatttaggtgcagcaaaacaaattctgttggttttccccaacctcatg

SEQ ID NO: 114967 - DNA, 75 bp, Heterodera glycines
  Promoter: Source sequence=SeqID_4344; Location=1..75; Strand=+; Gene =SeqID_54119
tcatccaagtgggcacggattagagaatgaatagacaaatgatttgacaattgaaaggcacccatcggaaaaatg

SEQ ID NO: 114968 - DNA, 80 bp, Heterodera glycines
  Promoter: Source sequence=SeqID_651; Location=2112..2191; Strand=-; Gene=SeqID_58114
aacagaatatattttttaaagcaaaaaacatctcataggctcccaacataacagcaattgccggccgttcccacattatg

SEQ ID NO: 114969 - DNA, 60 bp, Heterodera glycines
  Promoter: Source sequence=SeqID_30176; Location=1..60; Strand=+; Gene= SeqID_60613
ttatttcgcttcttctttgtgttttttgtgattttcgacagtaaattgaattcgacaatg

SEQ ID NO: 114970 - DNA, 92 bp, Heterodera glycines
  Promoter: Source sequence=SeqID_31111; Location=1843..1934; Strand=-; Gene=SeqID_61490
atggacctaaaaaggttcgcgaaaatttgctcgattttgttaatgaaaatgctgcaacgaatattttaaacaaattgaacacttttgaaatg

SEQ ID NO: 114971 - DNA, 562 bp, Heterodera glycines
  Promoter: Source sequence=SeqID_12693; Location=482..1043; Strand=-; Gene=SeqID_76377
atttggactttcctctccgtgcgttttgcttggattatttaagtgattagtgcgtctttcttctcaagattacacatttacgcttaaaaatgctcgccaatggtccgttttgaccaataaaatcaccgtcgactaccaaaaagtgctcgtcgctcagccttttatcaccgaaactttcgcccattcgctcactccgtggaaagttttggacggaaaagtgcggagaattctctgcttgggtcttcgaggttcagcagtgaacagtttcttcgccaccttatcaacaaaagtcagctcattttacgctttttgttctctcttaccgtattagaacaattcatacagtatgaggttactgtagtcgaaccaaaccctgcgctgcattacatagccaagaaatggttcgcctttgaggagacggaacaccaccgcattcttgtggaaaacccggcgttttacctgacggcacgatcaagattaattgagcacccaaaaatgggtaggcacaaagatactgtaattttgtacttttttctactaactgaatttttccggtgaaatg

SEQ ID NO: 114972 - DNA, 67 bp, Heterodera glycines
  Promoter: Source sequence=SeqID_11068; Location=2400..2466; Strand=-; Gene=SeqID_74405
ttccccgatgcgattggtgatgatttggtggaccaaatgcaactgttggccaagcgttgtccaaatg

SEQ ID NO: 114973 - DNA, 1003 bp, Heterodera glycines
  Promoter: Source sequence=SeqID_13017; Location=1528..2530; Strand=-; Gene=SeqID_76793
ttttgcagagagatagtgcaaatttctattatttttttctttttcttttcattttattttttaaattttatttatgttaacaaaatttttttttagttggatttaaaatgttttcatattttaattcctaatcttggacggtttgtctgttaggtattagtccaatttttaatgaaggcaaataatcaaaaatataattattgttttaatcacttaaacaatttaaaaattatgttttgtatagaattcaaatgctttattaatatttcttaacaaaaaaaaattagtttaaatttggataattaaaaaattaatcaattattagtgatgtcaaaataaaaaaatgattaattcaaatattagtcatgtcggaccatatcagacgattggattgctgataataataataagtcaatttgttatttgcaatatatttttctaatacttttattttttaaatgactcatctttgaccattcattatcttttttatcttttctatttaatgggagtgcaaaatacataaaagtccccctgacaaatgtttattttatgcattgtgaatgtgggaagaaaattaatcggccgatgcctgctgctgctcatcgtgatgataaacaattaatccgcgatattcggccgaaaacagagagattttgtgtattaatttatttgtttataaagcaagcatcaatttcatcgtttaataattaattattttctcgttaaaatcagaattattatttctaaattttaagccaacaaatgcgtatttatatttgagtatttagtgtaaataacataattagcacctaattaaggctattaagcagttattattgaattatattttaaaatgagttctaattattatgttgttaaataaatattatattttttcattaaatttctttctaataagaacgtttaaaattaaaaagtgaatctgaaaataaaatttggacttttttataaattatttaaataaaattattttagaatg

SEQ ID NO: 114974 - DNA, 1003 bp, Heterodera glycines
  Promoter: Source sequence=SeqID_13813; Location=267..1269; Strand=+; Gene=SeqID_77748
aatttttcaaaaaaatcattttttcgtcgaattttctcgagaatattgaataaatttaaattttctcaaaaatgcaagatgcccatgaggatagcatccatacaaattttcgaagttcacataaatattcttaatgagtttaaataatctttctgtttagatgattttaagatcactttatgtatttgaatttggttcgacccaaaaactcgaaatttgaaaaatttaaattttcgaatttttgttcgagtaatgtgtttaaaagttgaaccaatgactttagttggacaaaaatttttttaaagtttcagggggttttaggggtcactggtcacgagtccggtagccatttcgaccaatttcggacccagaaccggattcgaacaatttttgattttgcatatgctttatatatattatatatcaatcgattcctctaattgtcagttagaagttaaattcatgatttgtgaacagacaaatttttttttggacgacaacgtctcaacagacagacgaacccaaatgaaggcagcgaaccaaaaatggaagtgtgttgaaactacaaaatattcagccttttatacccttttgagactcataaagctatttttgcaaatttgtagtttttgcgggaaatgtatgtataaaagggcgtgcgtttttccttttgctgtcatttctcatccccattgtcttcctttccctctattttgcgctgcatattcatcgtcaaattgtgctgccgacattttctttgactcccaatggtgcatttttttgttcattttgtctgtgtattgtttttgtttgtttttcaattcgttttccccaattaattaagtctgatgatgttgctcttcccgctccttccggtgccgtcgatgactttgcgcagcgcatcagccaattcttcgacttcatccacggcggaaacatcgaccgattgcgtgcgctgatcgactcgctgagcgccgatgagctgaacaccttgctgcagatg

SEQ ID NO: 114975 - DNA, 369 bp, Heterodera glycines
  Promoter: Source sequence=SeqID_19872; Location=340..708; Strand=+; Gene=SeqID_84630
aatttgattggttgtacatttttaaattaccgttgtttaagctgcgcaacggatgcccatggttcaacccgcgaatggcaccacatcaattatattcgcaaccacaacaaatgcacagccaatgccgcaacagtcgacccaaaatgtccattttcagtcagtgatttttcaattttccatgctttttcccagaatattcacgcatttttaaaagctttaatagccaacttcgtcagaaatgcatttggaatggaaaaattttttgatttccttttaaattttccgtttacccaccccccccccccccgcttcagacgcatccccagccaaagttcattcgtcacccattcgtcctcccccactccgatg

SEQ ID NO: 114976 - DNA, 392 bp, Heterodera glycines
  Promoter: Source sequence=SeqID_3937; Location=896..1287; Strand=+; Gene=SeqID_52524
acacaaagtgacgcccggggaaggggtggggtttgaccatcatttttaaaaatcttgccaaaaatactaaaataaatccgtctgttttttccatttgtgcctttcctctcatttcctccgcttcagtgagccccgaagtgttgcgcgcccgtcagttggcctttcggcggacgaatacggacaccggcggcggtgccatcgcttcggcgttggtccgactgaaagcactgaacgaaaggacaccgcaaaaagcagaagcgagcagcagcagaaacaatatttgcgaacggccgacgcgcaatttcaattttccgctcgcccgcgtcttaccgcagccgaggaaaacgaatgcaaacagagaaagggagggggaagagacagcactgacaatg

SEQ ID NO: 114977 - DNA, 891 bp, Heterodera glycines
  Promoter: Source sequence=SeqID_12354; Location=1654..2544; Strand=-; Gene=SeqID_75951
aattaattaatcaattaattaatcgattgattgattgatgcgattatgtgaccgaaaatgatgtgatgttacattgtgttattgttattacttaattaccgtatatgctctaattatagcccagtctctattaatcccccattctctaattatccccccttttctgaggaggttgaaaaataatcccccatgggctataattagagcatatacggtatgttattgtttggatgtgtttgacctttgcttgctcaccgcaaattcgtccatttcctttgtattttatttatatgtaattacataactcattaattgtgattaatcgttgataaaattgctgatgataaaatgtgacgcaacacaataaatgccatggcacaacaattttagccaaaattttgaaaaaatcaagtccttgacgaaaaataaaagcaaaaaattgtttgaaatcgggtttgggattcgaaataggtcgaatgtatgttcggcacacatccgaccaatttcagtcgtaaacaggcactcacgcgaaaacgtaccccacgcgaaaacgtcctggcccccaaaaccgggaccttggtactcagttgtgcgctaccaggtcccggtcccgtggcactctattttttaccatagaaaaagtgattttgtaagaaatttttatttatttattttttcgggcggaacaccaattccgaaagattaccaacaaaaagatacaaaaacttcatcaattccttttcatgactataaaaatgtttgttttttcgcttttcctcgcatttgaaaaaaaataaattttctaacgcaataattctgcaattattcttccctctgtgacgacgacatcattcggagctcggccaaaattgtgttaattgccaaaaaatg

SEQ ID NO: 114978 - DNA, 1003 bp, Heterodera glycines
  Promoter: Source sequence=SeqID_6112; Location=6055..7057; Strand=-; Gene=SeqID_60407
caccggcccttaattttggcaatcatcgtctccagagaccaaaattcattccgaataattcctgaaatatttatttttttagaccaaccgcaaaattcagattaaaatgccaaaaaccaaaaatctttctttactcatttcccatgcctgcgggccggacaaaagaatttcttgcaaaagattgcttataattttgctgatattgagttcgaacgcccaaattgtagagtcccctcaagaaaagcaaattaaaggaatttcagtggataaagaaatttgtgaccatttttgtgcccatccatgccagccgactaatttaatatttccaaccgaagaaaggaatacaactttgggatggacttgtggacaccttaagccaaaaattgtccctcaaagttggtcctcatttttttcggaaaatgcttggacaattggcggcatcatttttactcttgccggcatttccttttgtgtaattcgcgcatatttgtggtcaattgaacccgattcaattgaaattaatgtttgaattttcttttctttaaatttgcaatttccccgcttttgactgcgtctttaattaattccatatgtccaaagttttgcatttgtcctgccatttttttttcttcgtgccaaacatggcagccgacggaaagcaattcatctcccgtcccctcccccatttttttgctctcccgtcgcgacattagctttttgcggcgatgactctcccctgccgttcgggaggaaaggtttttgccttttttccccattagctcgccgctgttgtaacatttgaaaaaataaattgcatttttgctgtaacgcccgcccatcgtccactcggatccctcgttattaaggccggctcatccgtcagaaaagccattcttgccttcattctcatttttcctccgctccttatttttcattttttccattttccattttcttttttcaatttttatttttatttttcagtttttcatttgtttagatg

SEQ ID NO: 114979 - DNA, 845 bp, Heterodera glycines
  Promoter: Source sequence=SeqID_17289; Location=911..1755; Strand=-; Gene=SeqID_81768
cttaaaatcgaaaaaaccaaattaggtatgtgaaatcagcagattcctttttaaaaagtgaaaatcaaatgaaaaaacacaaataaaaaatttggtgatcaattaagagaaaactttcattcttaagacggctggcgcccatttgattggcgcccattggcagcgctcaaatggcgttgcccattttatccattcctgcaaaaacaaaacactccccgtccccgtttctttgcaaaacccaggcgacaattgcaaataaagtttgtttcaatcactcaaaaattatttgcataaataaaaaaattcatttttttaaattgcgaatcgcaaacatttgaatattctgtcagtgagtgagtctcttttgtgtgtttgttgtttctgcaataaagatttaaaattggaaatttgcaaattttaatgagactgactaacaaatgaatgaattgtgctcaatttaattgtttatttagctgacagatgagcataaaactgaagtatacaaaaataaattagcaaaaaaaaggtaaagaatttgcatataaaagcacaacggtaaagaaatttttgaaagcattgggcagccttaagaaataatgccaaaaaaaggcctttccaaatttgcaagtttttttgaacattttggtgattccatcgaacattttttggaattttggtcatggaattcgagtttttttcgaaaattagacccctataaaattaattttaattccatcgaacattttttggaattttggtcatggaattcgagtttttttcgaaaattagacccctataaaattaattttacccaaaaaattgaacccatccaactcagaaagatg

SEQ ID NO: 114980 - DNA, 574 bp, Heterodera glycines
  misc_feature (60)..(60): n is a, c, g, or t
  misc_feature (62)..(62): n is a, c, g, or t
  misc_feature (64)..(64): n is a, c, g, or t
  misc_feature (69)..(69): n is a, c, g, or t
  misc_feature (75)..(76): n is a, c, g, or t
  misc_feature (86)..(86): n is a, c, g, or t
  misc_feature (101)..(101): n is a, c, g, or t
  misc_feature (108)..(108): n is a, c, g, or t
  misc_feature (115)..(115): n is a, c, g, or t
  misc_feature (118)..(118): n is a, c, g, or t
  misc_feature (120)..(120): n is a, c, g, or t
  misc_feature (126)..(127): n is a, c, g, or t
  misc_feature (134)..(134): n is a, c, g, or t
  misc_feature (136)..(138): n is a, c, g, or t
  misc_feature (147)..(147): n is a, c, g, or t
  misc_feature (149)..(149): n is a, c, g, or t
  misc_feature (153)..(153): n is a, c, g, or t
  misc_feature (155)..(156): n is a, c, g, or t
  misc_feature (159)..(161): n is a, c, g, or t
  misc_feature (164)..(164): n is a, c, g, or t
  misc_feature (167)..(170): n is a, c, g, or t
  misc_feature (175)..(177): n is a, c, g, or t
  misc_feature (179)..(182): n is a, c, g, or t
  misc_feature (188)..(191): n is a, c, g, or t
  misc_feature (195)..(195): n is a, c, g, or t
  misc_feature (197)..(197): n is a, c, g, or t
  misc_feature (202)..(203): n is a, c, g, or t
  misc_feature (205)..(205): n is a, c, g, or t
  misc_feature (208)..(208): n is a, c, g, or t
  misc_feature (212)..(212): n is a, c, g, or t
  misc_feature (219)..(221): n is a, c, g, or t
  misc_feature (223)..(226): n is a, c, g, or t
  misc_feature (233)..(234): n is a, c, g, or t
  misc_feature (238)..(238): n is a, c, g, or t
  misc_feature (243)..(243): n is a, c, g, or t
  misc_feature (245)..(245): n is a, c, g, or t
  misc_feature (256)..(256): n is a, c, g, or t
  misc_feature (259)..(259): n is a, c, g, or t
  misc_feature (264)..(266): n is a, c, g, or t
  misc_feature (274)..(279): n is a, c, g, or t
  misc_feature (282)..(286): n is a, c, g, or t
  misc_feature (289)..(289): n is a, c, g, or t
  misc_feature (292)..(295): n is a, c, g, or t
  misc_feature (300)..(302): n is a, c, g, or t
  misc_feature (308)..(308): n is a, c, g, or t
  misc_feature (311)..(315): n is a, c, g, or t
  misc_feature (320)..(320): n is a, c, g, or t
  misc_feature (326)..(326): n is a, c, g, or t
  misc_feature (329)..(329): n is a, c, g, or t
  misc_feature (331)..(332): n is a, c, g, or t
  misc_feature (335)..(336): n is a, c, g, or t
  misc_feature (338)..(340): n is a, c, g, or t
  misc_feature (342)..(347): n is a, c, g, or t
  misc_feature (352)..(352): n is a, c, g, or t
  misc_feature (354)..(355): n is a, c, g, or t
  misc_feature (358)..(359): n is a, c, g, or t
  misc_feature (361)..(361): n is a, c, g, or t
  misc_feature (369)..(369): n is a, c, g, or t
  misc_feature (371)..(371): n is a, c, g, or t
  misc_feature (380)..(380): n is a, c, g, or t
  misc_feature (383)..(384): n is a, c, g, or t
  misc_feature (388)..(388): n is a, c, g, or t
  misc_feature (390)..(390): n is a, c, g, or t
  misc_feature (393)..(394): n is a, c, g, or t
  misc_feature (397)..(397): n is a, c, g, or t
  misc_feature (404)..(404): n is a, c, g, or t
  misc_feature (407)..(413): n is a, c, g, or t
  misc_feature (427)..(427): n is a, c, g, or t
  misc_feature (433)..(433): n is a, c, g, or t
  misc_feature (435)..(435): n is a, c, g, or t
  misc_feature (440)..(440): n is a, c, g, or t
  misc_feature (450)..(450): n is a, c, g, or t
  misc_feature (455)..(456): n is a, c, g, or t
  misc_feature (459)..(462): n is a, c, g, or t
  misc_feature (464)..(464): n is a, c, g, or t
  misc_feature (470)..(470): n is a, c, g, or t
  misc_feature (472)..(472): n is a, c, g, or t
  misc_feature (477)..(478): n is a, c, g, or t
  misc_feature (483)..(483): n is a, c, g, or t
  misc_feature (486)..(486): n is a, c, g, or t
  misc_feature (489)..(489): n is a, c, g, or t
  Promoter: Source sequence=SeqID_23305; Location=1271..1844; Strand=-; Gene=SeqID_54011
tatttccttccccctttttgtgtgcttttaggactccctgttttttccacgacagacgangngngacgngaaaanncatcttttgncgggcacaacacgcnacacggnccaaggncancnccgcannaacgagnannncgagacaancnaccngnncannnggngannnnaaaannnannnnacgggnnnnaaanancgacnnancangaanaagaaannnannnngacaacnnacgncaaancngaccaaagaanagncaaannnagaagaannnnnncannnnnaanagnnnngcagnnngcccangannnnnaaaanaagaanccncnnacnnannnannnnnnaaaanannaannanaaaaacgngncaaaacaanggnncaanangcnnaanacaaacncannnnnnnggagcagggagagnaaccanangaagngccaaaaaanccggnnccnnnncnccaggnanggccnnggccngancgnagggcttactgcagtaaattttgcctactatgtttttgttctgctgctgcttccgtcgacgcaggagagctcggtccgcgacatg

SEQ ID NO: 114981 - DNA, 99 bp, Heterodera glycines
  Promoter: Source sequence=SeqID_34732; Location=1..99; Strand=+; Gene= SeqID_64456
aagtgacccaaattgggcgagggctatcgccgcgcaaacatttttctgcccgacgtgaactgtgaacggagctgcgacagcacgtatcgcgacaacatg

SEQ ID NO: 114982 - DNA, 211 bp, Heterodera glycines
  misc_feature (33)..(33): n is a, c, g, or t
  Promoter: Source sequence=SeqID_15401; Location=1489..1699; Strand=-; Gene=SeqID_79663
atagttcttatcatgttcgtgaatatggttacncgtcccccatgagcattcattatattttcaattattttgaaatgtccttattttttatttctaaatgaatttataaattgtaaatatgactgataaattgttggttttaaattgggagcagaaaaaaagtatttaaagaagcttttttctggtcaaaaaactgaactaatttaaaatg

SEQ ID NO: 114983 - DNA, 846 bp, Heterodera glycines
  Promoter: Source sequence=SeqID_22075; Location=450..1295; Strand=+; Gene=SeqID_52720
aatattaaaaatttttaattttctttcttaaattgggtttatttatgagaaattttttagattattctataaaaatgctaaaattaaataaattcattaaaaaattcaaacaaacatgctttttaaaattaaggataaaatagataatcaataaaacttcttgaatacactgcatatttatcaaatattatttatatgcctagattagcggaagtataaatcgtttaaaaatgattgtatttattcgcacaaatattttagtaacaaatagcaaataatcattgtaatagacgaattatttatgcatttattttgtttatacccatagattagcataaataaatcatcaaaaaatattaatctattctcgaaaatatttaattaaaaattggccagcaataagtttttagcgcttaaatatttcccagaaaattgtttatgtaattaagcaatttataaaaatgttttttttcacaaaacataattttattgatatggtgcaggatatttagtcaggctaatagccaaaaggggtacagcgataatgagtttggatttttcgaatttttgaaagcaattttttgaaaagacatgaaaaaaagataaaatatcaaaagcaaaaaaaaaaaggataaaaaattgaaaattcataaaaaggctcaaaaatgtaaagaaagttaccaaaattcgacaaagtaataaatcaaattctacaaaattattttaaatatatattcaacataagatggataaaacaatgaatgttttatctctgtttaggaatcactcaaggtcaaatgcgctcaaagatgggcccatcaaattgttggtactcatcccaagatg

SEQ ID NO: 114984 - DNA, 433 bp, Heterodera glycines
  Promoter: Source sequence=SeqID_895; Location=2248..2680; Strand=+; Gene=SeqID_63485
aaaaattttcgtttttggtgttaagctgtgtcagtggaagacatcggagattttatcacaagaattgtcagaatcaatgcaaacacttaaatttggggaacataacgaatcgctgtttggaatgatgctttatcgtccggtattaggtatttcatttataaattacttaaatcctaataaatatacttaaaattagtgtcgaagttagcggaccgtcattgggctgccctacggaggtcaaatgaaatttcggtaaatgcgattttgtttttcgagactcattgtcagaatgattattccgaagaataaatttgtttttcttttttcgtttaatttgtccttaaaatagcaaattgcttcattaaatatcttaaagcataattcttttttattttttaatgaattgtttgatattctgtcatccgttcaaatg

SEQ ID NO: 114985 - DNA, 267 bp, Heterodera glycines
  Promoter: Source sequence=SeqID_13310; Location=2012..2278; Strand=-; Gene=SeqID_77159
tttgtcccaccttggcaatgtcgcacaattttaacatttgtcttccggttgacatacctttttggcaaatatgtcaatattcccctgctggttatcattgttggccatttgtccaacactctggcaattgtcccccgattttggccatttgtcccatttgattgtttcacttttttggctttaaaaatagcaaaaaatgcatttatgcacccaatttattgtgccaaaatgtttgcttctccacagttgcttcgaccaaccaaaatg

SEQ ID NO: 114986 - DNA, 887 bp, Heterodera glycines
  misc_feature (58)..(58): n is a, c, g, or t
  misc_feature (61)..(61): n is a, c, g, or t
  Promoter: Source sequence=SeqID_39985; Location=1..887; Strand=+; Gene=SeqID_68428
aaagcgcaaaaaaatcattcatttaaaattcctcacatttccttaaacgtcgcctcanttngcggcaatagcagcagcaccttttgtcgtaagtttgtgattgcgaaaaatgacgttaactaaaaattttatttagattagtttatttatattaaatttttgagtaacaaattggaaaaagcaaataaacggcgaccaaaaatttatgccaggagcaaaattggcactttttgatgccgaagggttcaaaatttgatgcaaaaaaaacaatgcgattcctcatcaaagtcaatgaaatggaagaaaaaaggccgaatattcgacgccatccgaaatatttgttcatcatttttgtttaggtcgtacgtgatttattcagacccatgggaaattctattttcattcaatcccggctttcttgtgggtctccgattttcggaaaaaatcctacgcgaaagaattttttgaaaattgtaaaatattggcattatgttcttatttgactcataaaaatgaaatgcttcaaaaaaatttatataaaaggaagggaacagtgcataatccaaccattcttcattcatcactatattttttattttggtaaatttccccttttgtactattttttcggccacaaaaacctttcaacaaaactggccaaataccaaagcgaacattttggtatcatttcatggtctttcaaaatgttgtaaaggcaaaaaaacctaacaatttttctctaaaaacagtaaaagtcggctatttgtcatcattcctctgacatcccaaccccatttttcaaaggcctcagtacacccaccacatattgtacatattatctggaaaagcctgatcatctccatccatccatcatcatcatcaccatg

SEQ ID NO: 114987 - DNA, 1003 bp, Heterodera glycines
  Promoter: Source sequence=SeqID_11345; Location=520..1522; Strand=+; Gene=SeqID_74729
agcatttctttacatataaaaatacaaacaaataaataccatagccaaattgagaaaaaggctatttcaaagggaagaaattcaatttataaatatatacaaaaattcaatgtcaatccctttgaaatacctaatctaatttatgaaaataaatgctatcataacagtgctgagaaatgtgaattatttgccaccttatttgccaattcatttaataatagtgaaaccgacccaaccaatccatgcttgggtaatattatagaaattgatcaatgctttatatcggatataaattttaacatcatcgagacccaaaatcttctgaaaaaacttccgaataaaaatggcacttctcccgataatattagttataaaattttaaaaatttgccattcttctctgtcaactgttattactgacttgtttaggatctcattagacactggttcacttccagacatctggaaggaatcaattgtttttccgctttttaaaaagggtgacaaaaataatcccgaaaactataggccaatttcattaacctgctcactttgcagggtaatggaaagaattttaagcaaaaatatttacaattttctattaaaaaacaaaaaaatttcggaatatcaatttggttttgttaaaaataggtctacaacgagtcaattaataacagttgtggaagattggtatgaggcaattataaatggaaaaaatgttgactatgctgatgatgttaaattatatatttgttataaagcaagaaccaaaacagaaattatgcataaagcattgcataatttatcagaatgggcaaataaatggcagatcagaatctcaattaaaaaaacttttgtacttcatttggggaataaaaaccccaaagaaatatataaaattgatggaaatataataaatgttgtggatacaattagggatttaggcataaatattgataataaattgcaattttccaatcatgtcgcacaaataataaagaatg

SEQ ID NO: 114988 - DNA, 692 bp, Heterodera glycines
  misc_feature (24)..(24): n is a, c, g, or t
  Promoter: Source sequence=SeqID_17898; Location=1..692; Strand=+; Gene=SeqID_82450
tgtaaattcatataatttataccnctactaataattgaccgaaatggttaaaagatattaaatatttaattttaattaattaatctttgttttttgctcagggcactttcctttttaattacctctttttgtaattcaaatccttccctgtcaaaggaaatctcaaaattgattatttaactaatgtttcccctttttcccaagtccgtccatttcgggcggataaaaattacaacgtaaaattattgcaatcactcggccaaggaaatttgaccctttaattcccgtgaataaagactactaaaccatatatttatgactttaacagaactttttcgatgttttttaattaatatttattttacagaaaatcctcttcatgacaaagtgccgccccgaatcaaaaaatgccgccacagcaaaatattatttccttgctcataaccgagttcccccttttcaattaaaatgataaagctaagaaaaatcccaatcgaacttattgctgaaagcgcccgctttgtacggttcaatcgaaaatgggcaaattgtcgcgtgtcacattcatttgaccactttttgcttgaaaagcatgggaattggttgaatctgatcaaagaattggtcgggaggaggaaaattaaacaatttagctaattagacaagcataaaactattcaggtgaccaaatg

SEQ ID NO: 114989 - DNA, 347 bp, Heterodera glycines
  Promoter: Source sequence=SeqID_14050; Location=1330..1676; Strand=-; Gene=SeqID_78025
agtaaagttttttgacaataaattttttaaataatttcccattggatccggttggcatttttaaaacttgaattttgaaaccagtttgttgctattcataaagagacatttttaagttcgttagagcttgggccaggctttgccaataggcatcactcagaaattttaatgaatgggataagaaaatagtgaaaaatttccgaaatacagattagtgacccccccccccctttaattttatatagttcgagagaaattgtgaaaaactattgaactttggtgctctagtacaattttggatatcaatgagcatcatcagtttcttatttcagttgctgcacttcatg

SEQ ID NO: 114990 - DNA, 1003 bp, Heterodera glycines
  Promoter: Source sequence=SeqID_19325; Location=1305..2307; Strand=+; Gene=SeqID_84063
cccttatttctggcaatcatagtctccagagaccaaaattcattccgaataattcctgaaatatttttgcctttctttcaaccaaacgcaaaattcatattaaatgccaaagaccaaaaatctttctctttttattttttcccatgcctacgggccggacaaaagaattgcttgcaagaaattgctaatgacctttctgctattgagtttgaacgttcaaatcgtagagtcccctcaagaaaatcaaattaaaggaatttcagtggacaaagcgatttgtgaccatttttgtgcccatccatgccagctgactaatttagtatttccaaccgaagaaagaaatacaactttgggatggacttgtatacacctaaagccaaaaattgtccctcaaagttggtcctcatttttttcgaaacatgcttggacaattggcggcataatttttactcttgccggcatttccttttgtgtaattcgcgcatatttgtggtcaattgaacccgattcaattgaaattaatgtttgaattttcgtttccttaaatttgcaatttccccgcttttgactgcgtctttaattaattccatatgtccaaagttttgcatttgtcctgccatttttttttgcttcgtgccaaacatgacagccgactgaaagcaattcatctcccgttccctcccccattttttgctcttccccgtcgcgacattagctttttgcggcgatgactctcccctgccgctcaagaagaaaaggtttttgcctttttcttcccattagctcgccgctgttgtaacatttgaaaaaataaattgcattttgctgtaacgcccatcgtccactcggacccgtcgttatttaaggccggctcatccttcagaaaagccatttcttgccttcattctcatttttcctccgctccttatttttcatttttccattttccattttcttttttcaatttttatttttatttttcagtttttcatttgtttagatg

SEQ ID NO: 114991 - DNA, 180 bp, Heterodera glycines
  Promoter: Source sequence=SeqID_16318; Location=1957..2136; Strand=-; Gene=SeqID_80708
ggatttccctccccccccccatgcttcatctgttgggaccaacagggctgaacgtaactggattttcaaaataggggcaaaaatgacaaactcaaatacccttcctctcatctaaaataccatcaattaaaggtgtacaagaagttgcaaataatagccaagtttggcgaattggccatg

SEQ ID NO: 114992 - DNA, 120 bp, Heterodera glycines
  Promoter: Source sequence=SeqID_16688; Location=1..120; Strand=+; Gene=SeqID_81085
gaatagacccccaaaaattttcagaaaattttttaaaaggcatttgatcactgatttaattatgatcggtcggtcatttcttattaattcacaatttgtcatctcctctcccaatcgatg

SEQ ID NO: 114993 - DNA, 602 bp, Heterodera glycines
  Promoter: Source sequence=SeqID_24323; Location=1178..1779; Strand=+; Gene=SeqID_55048
agtacgaaaaaatgtaatgatgaataagaagctatttaattataataaagttttaattgttggtttattttgttattcttttttttgtatagttggtgaatgaaaataaaattttaaaaagtaatctttcagcattaaaatattttccattaagaaaattatttcggataaatggtttgaaattatcatttgctatataatttatttatcaaaaaaattaatgctattatataaaattatttcgcaaaattgctttttgaagtttggatatttaatcttaaggagtttgaatttgaatcttttttatgctaatactacaaacgatgatattttggtgattggttcataaatttttttaataccttcaaatttaaagaaaagaaaaaactaataaggttcaataactatttatattattttttcaattaattaattaattatgaaataaaatagttaattcaaatttaaaaagaatattttttgatttataattgcgaattttcgtttttagttcaatttaaacgcttttggattctttttttttaaattttattacaaagcatcgaattttataggtttttatcaactttatccagcaaatg

SEQ ID NO: 114994 - DNA, 110 bp, Heterodera glycines; identical to SEQ ID NO: 98226
  Promoter: Source sequence=SeqID_32190; Location=509..618; Strand=+; Gene=SeqID_62514

SEQ ID NO: 114995 - DNA, 249 bp, Heterodera glycines
  Promoter: Source sequence=SeqID_36189; Location=1..249; Strand=+; Gene=SeqID_65573
tcggcaattgtgatgatcattggtcccgaaattttttaatttaattttcttttcaaaattttttaacacttttctaggggtgttttgaggcgctgagcacgaatccggcctccatttcgaccaattccgaatccctaatccgaactcgaacatttttcgagaattaaattttaaaattttttaaaatttcttttaaaacatggttcttacaaaggaggggtcggcaagtgaccgtgggatttccaaatg

SEQ ID NO: 114996 - DNA, 379 bp, Heterodera glycines
  Promoter: Source sequence=SeqID_41887; Location=1..379; Strand=+; Gene=SeqID_69924
ctgctgtcggttggtgccttatgtgctgctgccattggctgctgatgcttaaatgaacccaatccgatgcttactttccccctccgtcaatcgctccccccccccccccctcaatgcttaaatgacttttgtccgccgtccttcgccttaaccatccctctccctccaccccaccaaatgctcgaaatcccatttctttaggttgagacgggggaggaggaaaactgagaatggcaaaataagtctcagtaagccgctcagaggtgctcaaagaagcagcactacttggccaaaaatgtaaaaaagcaacttctctatttttatataaaaattgtaaattaattcaattaaggaataattttaggaatcattaagcatg

SEQ ID NO: 114997 - DNA, 510 bp, Heterodera glycines
  Promoter: Source sequence=SeqID_348; Location=1..510; Strand=+; Gene =SeqID_83553
attgtgcacttgacatggatgtgtggagggagtgtggtgatgatgcatttatttgtctgtgagtgacagacacaaaaaaaaagtgccgtcagaaaagtgaattcattttttttgccattgtgaatctgtctccatcattctctctctcaccctctctctaattgtccctaatgtgtattaattagatatatatgctccaagcattatctaacctattcagtgataatgcaacaacaaaaaatgaaatttgtagatgatatgaggctgatgtgtaattgacctcatcatttaaaaaatgttctcatcccttccttcctttcattcgcattaaatatatgcttttaattatgaaactcatattccctttaagaattaaaattgttttatgtgtattagacaatatgtttattaattagtcaattacctaattacattacttcaatcttattcaatttttcaattatatctagcagtgttaattacagacattcaacaatattttagcaaatg

SEQ ID NO: 114998 - DNA, 268 bp, Heterodera glycines
  Promoter: Source sequence=SeqID_21014; Location=806..1073; Strand=-; Gene=SeqID_51592
tcctgtaaaataaaatcctttttcagtgggttgaaaaattttagcttatttcataaaataagagcatatataatgaaatttaatattagttttaaaacagcttattttgagattgttaaagatattttccaagcccctcccctttttcactaaaaattttttgattttctatttttggtttagaaaattttgcagtattttatctgagatttttgtccatttatgcttaaataaatttattgtatttaaaaaacataaataatatatg

SEQ ID NO: 114999 - DNA, 59 bp, Heterodera glycines
  Promoter: Source sequence=SeqID_11679; Location=365..423; Strand=-; Gene=SeqID_75146
ttttggaccaattgggtgagcaaaacaaattcaatgggtcaaaaaataaacaaaaaatg

SEQ ID NO: 115000 - DNA, 120 bp, Heterodera glycines
  Promoter: Source sequence=SeqID_16201; Location=1..120; Strand=+; Gene=SeqID_80571
ttcggtgcaaaaggcgcccctgggtgccatcgtcgccagtcggtgccgcaaaacactttctcacgtgcagcacgagaagtagtagcaccgcggaaggtttaccgcgtggacgacgaaatg

SEQ ID NO: 115001 - DNA, 697 bp, Heterodera glycines
  Promoter: Source sequence=SeqID_9416; Location=2064..2760; Strand=+; Gene=SeqID_71338
atttccctatgcttttggttttctttggtcaaatttgagtattattggttcaaaaacgatgagttagcaataaaaagagtaactgttgacattttatgattaatgttttacttttaaccacagactcattaattcgaatgtgacattaatttcaattattaatttctgggaataatttcaggtttctgttcgcatctgactgataaatcggactttgtgagccttggcatctgcaaattgcctttgaagcccaattaagtgagtccaattaatcaatgacatccaattatttcacacattgggggtgagtgattaattaattaaattgttcgtacacatgcattttggcttcaaattaatgcatttattaaatttcaaaaatggtaattacagtaatttttttttcttttcgataaaatcaaatgtgtgaaaatcaaatttaaaagtttgttttctctctctaattaatcaaccaatccaaaaaaaaataattttgtatcaatgatatgataatgcttaacatatatgtctataatcttttgtttttattttggtgcatttctaataataattgaagtttattgggataaccttaaatagtgttttcttcttaaaatttttttggaattattgatcattggcatttttcaattataattaattgcttaaataattaaagttgtaattcattcagatg

SEQ ID NO: 115002 - DNA, 75 bp, Heterodera glycines
  Promoter: Source sequence=SeqID_33217; Location=453..527; Strand=-; Gene=SeqID_63346
cgcccctatgcaccgatcctcacgccattctcagtggatcaagtccaagtgattcacccggaccaagttgaaatg

SEQ ID NO: 115003 - DNA, 478 bp, Heterodera glycines
  Promoter: Source sequence=SeqID_2936; Location=1243..1720; Strand=-; Gene=SeqID_82429
tttgaataaaataacaattattatattaataaaacaacgactgtaattttagaaccgggaagtttggacactatgatagtattttcagtttatgcatccaatagacttttattgcgtacaattgattaaggtggaaaaagcctgttattttaatgtctgaccaacagaaacctgttaggtattcaattgcaggaaactgctgcattacgccaaaactccgctaattcaaaagttttggtaattttttagcattaacaaaagccactttaactatggcaaaaggggagtgcctcccccagtttgtccatttattatcgtttttattaaaccgattgttagcgattcacactccgtattcaatcgatatacctttcaatttgtctttactatgcttcttgctttgacttctgtggacacccgcaacgcacttttgtgcgccgccgttccttccattggcgccttcgtgggctcaacgatg

SEQ ID NO: 115004 - DNA, 215 bp, Heterodera glycines
  Promoter: Source sequence=SeqID_40128; Location=738..952; Strand=-; Gene=SeqID_68553
agcttgatgctgaggtctttgaaacataatcccagaaacttggccaaatttttgcgaagcttgaaatgttttcattacctcattttgtttacgtaattcattataatttttgtttttccacgttgaaattcaaaaaaataaataatgaatcactccacaacctaccaatttatatttatttatttctttttaagcaaaaatatatttttacaatg

SEQ ID NO: 115005 - DNA, 1003 bp, Heterodera glycines
  Promoter: Source sequence=SeqID_14922; Location=220..1222; Strand=+; Gene=SeqID_79086
ttcatctatttaattaaggggttaagtgaagaagggaagaaagaagtgattaatggccgaaaaaaggaaagaaaagaatgcattgagaggggataaacggggaaaaaagagcgaatgggagtggaaaagaaagaaatgaaaaacggatggacgacggaatgaacggaggaggggggggggggagaaaagtgaaggggaggagggaaagggagggggaaaggaaaagtgagagggaaaagtgagagagaaaagtgaggggaaagggggagagggaaaggcagagagaaaagggagagaagggggggggagggagcactcggctcattgctggtgagttgggcagctaacatttgcaattattttcccattttaatttaatttttcaacaaaaggtaaaagtgccaatgcctcgtcttctctcttccttcgcctttttcgttttgtcaattatttgttcgattgtcttcttcgaacccatccatggccaggacgtgtgtcgacatcagggcaaagagtaccgaaatggggacgaatgggtgggtcgaattaaaaaataaaccaattaatacataattaattaccaaaaccaaattaataggtattaattgacagattgtttccaactctttcattatgaattgcatcgtccattacaaccgatgggaaacaaaggttatttggccatgagacggcaatatttttcaaaatgccatattagctaaatgtttaaaaggtgtgaatacgggggaaggggtgacaagattcatgaagaaagggcgaatttgacttggagctcagtggaagagctgcccatggactttgtggagcgtgggatcggttcccacccgatgcctaacattttctcttcctattaagtcaaatatcactcattagcaatgtccaacaattgctctttctgccagatcatcgcctgtctgtcaatgttaggcgagagaatccccgtaaacggacagatcagtgatcagcacggagtgtggaaatg

SEQ ID NO: 115006 - DNA, 412 bp, Heterodera glycines
  Promoter: Source sequence=SeqID_7503; Location=1954..2365; Strand=+; Gene=SeqID_65031
tttctgtaaatttttattttttcggcaaatttttaaataaattttttacattaaaaacataaaatgaagaatattgatatacattaaaaggccattaatattgttggcatatcaattttgaatatgctgacataaagcattttccggtgttattaaaggcaaatatataaaaaatatatttttatgaaaaattttcttttataaaattaattgctatattttataaatgatttcataattattattttacacgtgaattttatatgttggaaaatgctcagaaatatttccgatttatgagacatgacacgattttttagcattggaaatccgccgtatgcactagataaataaaaatatttaaaaaaaatttaatttgcatttttttttgaaatttttataggaaataatg

SEQ ID NO: 115007 - DNA, 161 bp, Heterodera glycines
  Promoter: Source sequence=SeqID_42854; Location=774..934; Strand=-; Gene=SeqID_70661
ccttgaaaaaaaaaaaattatttaatatttataatgttttttcctttaatttgtccttaaaattaattaaccttattaaaccaattattttccgtaaatataaaaaagaaacgtacaacaaacataaaactgcatgaaattgcagcaaagaaacctagatg

SEQ ID NO: 115008 - DNA, 193 bp, Heterodera glycines
  Promoter: Source sequence=SeqID_26373; Location=1..193; Strand=+; Gene=SeqID_57109
ccccccccccccccattcgccgcccatgcaaagcccacccccaaggattttgggcgctctcgtgcatacctctaatacagagatatttatttgcattttgaatacataaaaaaggaaacgaggttgttagggcacatagccgggaggacaaaattttgccttttgggcaacagcgatgactcaccaccacatg

SEQ ID NO: 115009 - DNA, 79 bp, Heterodera glycines
  Promoter: Source sequence=SeqID_6404; Location=850..928; Strand=-; Gene=SeqID_61436
atttaaaattatagatagacagaaaaattgtgtaaataaatttttggatatactatagtcaaccccccggaaaaaaatg

SEQ ID NO: 115010 - DNA, 1003 bp, Heterodera glycines
  Promoter: Source sequence=SeqID_22663; Location=226..1228; Strand=-; Gene=SeqID_53345
ctaaactgacccggtccgataaattcggcatagaaaaatgcagaatttttttctctattgatttagaaaatttgaagataatctgtaaggcgaaaaaaaagttctatagagcgaagtaaatgttgttttttctattaaaaaaatgaagagatagtattccagagtgagagaaataacaaagaaaaagagaaacgacaaaatagtacaggctttttaaaaagtttttgccttaattgtttgatcattagggatagttttttttatgtaaatacatatttttttcctggattctccataacctaataagtaggaaaaacatgaacaaatgttgggatttttatttacatattttcggatttttctacatattacatatgtacatattttgaactttttcgtacatatttcgcaatttttcgtatatattgtcatttttttacatattttgaggatttttgagaatttatagaaattttttgtgaaaaattaaaaaaaatttttgaaaatgtatccctaaaaatcgaaatttttttttcaaaaaatgaatatcaaaaattaattcttgaaatgctataatgtgattctaagcctatttagatcatttttatgttaatttttgcctatttcaccctttacgaggaatttttttccaaaaaattaccatttaaaaaatttttatttacatattttagtacatatttggggatttttgtacatatttcatacatattttagcattttttatacatattttacttacatatttcgcgatttttcttacataaaaaactatccctattgatcacagtttaatgatgcattatgccatcatttgcattacactatttgggaggaaaggggatggcggaacttaatgacgagactatttttaaataaaattgataacatcgattttcccacgctaaaatcaaaaaaaaaaaatttttttgttcaatttgccttgaaatcagcaaaatgatgacaaatcagcacatctggcatg

SEQ ID NO: 115011 - DNA, 250 bp, Heterodera glycines
  misc_feature (55)..(55): n is a, c, g, or t
  Promoter: Source sequence=SeqID_31212; Location=1291..1540; Strand=-; Gene=SeqID_61581
catgagtatagattactttcagaaagtgtcaacagactttggaaaaatatattgncaatttatcaacaattttgagaagtgagttagaaatgataatcttcacgattcaaaccaatttttggtgctctaattaaccgcgataaaaacatccgaatcaattaaatagcttctgagataataaggtttatcataaaatttcatttaaaaataaaccctcaattattggtatgaacgatactttccaaacatg

SEQ ID NO: 115012 - DNA, 232 bp, Heterodera glycines
  Promoter: Source sequence=SeqID_2493; Location=1900..2131; Strand=-; Gene=SeqID_80057
agttcaggggcactttttatgagcaggagttggcacgcgtacgtaaggatgatgagacaagctaccgaatagagaaggtcttcaggaagagaagaaaacccgatgggtcagttgagatacgtgtaaaattcataggctatcccgagagggaatggatcgatgaatctcagcttgtataaaagcattcagtttgttcattattttttacatttggataaatctttttctaatg

SEQ ID NO: 115013 - DNA, 664 bp, Heterodera glycines
  Promoter: Source sequence=SeqID_7156; Location=3200..3863; Strand=+; Gene=SeqID_64003
ggtcggcacggcaccgtggcgcgaaaggcttgctcaaatcgagctgatttctatcgcaagatttttcgagaattaacttatcatatttggactggcgatgcgatctcgaaactttaaagaaggaagggcgggagacatggattttctaacaaaattgctaatttttggatcaactattctgggagcaaatgcatcaaaagggacaaagtagccaccctgatagtgctgctcaagaccgaagattttccgagaccggtccaaaaaaccctagttttttcgagtctcgagtcgagactgagactttttatcagcactaatatcagggatcatggaagagagtaagacgaaaaacgcgccaatagaaattggcactgaaacagttgggggagtgcaggatgccgattttgcatttaattcgtgcctttagtcatcattttgagagtacggcacaattatttaaaaattctcactgttttggacttttgagatcggcacccttacattggctccatttgcatcatttaatgatttaattcatccaattcaatatggcctgatcagtgatttctgatcagttttttgtccccgctgttcagtgagcacttttttgcccttccccaccgaattgtcctccaattcggcccaattgccctgcttcgacatg

SEQ ID NO: 115014 - DNA, 1003 bp, Heterodera glycines
  Promoter: Source sequence=SeqID_5188; Location=644..1646; Strand=-; Gene=SeqID_57213
atttgaaattggagtgattgggccccaatgaccctcgtgataaacccatgattttttcttttttcgcctttaattttatccactaaccatcagaacacagcgattgcctgcactgcttttgttgttctccgctcccttactcgctttgtccaacacgtcctcactgctcccacatgacgtgggttcccccgtggtacccacgccctaccaagctaccaactcaatcccttaactatatactaagtcagccgaagctccgcctctttttttgaattagcgggtaaatggtgctttgttgtacataataggaaaaagaaacaaaaaacaagaaagattgtgtcggtgggttgttttcagcaaaattgtgattgtgtctctcttacacatcaaagattagtttgtttcatcattttggtcctccgttgtttacatactttttcattagtttctttccgaaaaatatcgatattttttccttatgcattcttttctcttttttttggttttcctttttgggtattcaaaaaattttaagttctaattgtgaattttaggtccgtattttgatgttttttggtttcagttttactttagagtccagatcattttcttatgcacctaattacgttaatttattaatttttaaacaatcaaataaaacatatcgaatgggatttcaggtcgctgatcacgaataaatgccgtttgttgctaaatctgacttaacttcgttattattggaaactaagctgaaaaaaataaatagaaaatttaatttggtttgaatggatttggatcaataaatcgttatattcgtaatcattgatcagcgaaaaaattccgatcggacgcataaaaatgattcgacgcacaaagtgaaattgaaccattttttgtccatattagaaatttctcttacataataatcgtcctattttattgatattgttttttgagtgtaaattttttgttttattttgtatctttatttagatttataatg

SEQ ID NO: 115015 - DNA, 203 bp, Heterodera glycines
  Promoter: Source sequence=SeqID_7768; Location=5022..5224; Strand=+; Gene=SeqID_65881
tatgtattattctcctctaaaagcattggcccattcgccgcaagtgcacgtcaccgcgcattggctgttggcctccagcaaaagtgaaaatgacattgttttggtgggtgttagttactgtacttatttttttaaattgttggcgttttgattgtgccgtcaattcaattttttgcgacaggttggccatttgaaaagcaatg

SEQ ID NO: 115016 - DNA, 184 bp, Heterodera glycines
  Promoter: Source sequence=SeqID_270; Location=9170..9353; Strand=-; Gene=SeqID_80832
gccacctgcatcttttgagtcccgaggcggggaccggcacggctggccacctgcatcttttgagtcccgaggcggggaccggcacggctggccacctgcatctttagagtcccgaggcggggactggaatcgaggcggcatctcccattgccacacagcagccttaccacttggcttcaacatg

SEQ ID NO: 115017 - DNA, 1003 bp, Heterodera glycines
  Promoter: Source sequence=SeqID_13685; Location=292..1294; Strand=+; Gene=SeqID_77597
tccgtgccgaactcacaaagttatggagtgaaatgtgaaatattgttttcaccacaaggcattttttctgaaaaccggattcaaaaatctggggtttggtataaccgttttagaaatagcgtagaaaacagcttcgatatcaagaaaccaagtcaagtccagaaaggaatattttaaaacgatttcgttttgttttggcattatgataccgaataactttcggaaattatggaaacaaaattggagaaattcgaataattttttgactgcaaatttttttccttttttgaattgggttctgttggataaggaaccacaccgattattgattatattttccctttcactccctctcttattgtctctctcccgccccttgaccagccccataaatatgtctccctttccctcactcggggcattctcccattcattccaccatttcattattttatttatttattccctgctgtcctccatatttatttgtttaataaattatttatttatttatttgacaacatttgttttggtcgaagaccaaacatttttattgttgtagtaaatacacaacaatttggcgcagtcacaaacaaaggacctgctctacatcttcgggtgagaaaaggcatcaaattttgttttaaggaccaaaagccgagacggcaaaacaacccatcaaaaagccgggattggctctgagttttgttaaagccgagtcggccatttttcaaaaagcagtcaaagaaactgctagacaccaaaagccgggtcggcgctccgaattcgtctaaagccgggtcggctcatcaaaattcgtcaaaagccgggtcggctcagcaaaaattcgtcaaaagccgggtggctcgtcaatttcgtcataacgcagtgaaaagaaactgcttattcttctaaagccgggacggctcgacaaaatacaacaaaagccgagtcggctcgacaaattcgacaaaagccggttggctaatcaccaaatttgatg

SEQ ID NO: 115018 - DNA, 743 bp, Heterodera glycines
  Promoter: Source sequence=SeqID_19658; Location=421..1163; Strand=+; Gene=SeqID_84393
ttagaaagcggcataaacttttttcgtttaattctgaattatttttcgtgaacatgaaattgaccaaaatggaatttatttgtcgtctgagatgtgtcccaaaaatccactaaattattttcatacataattttattcccaaattattttttcttatttttgtttttttatcaagtttcctcccttccaaaagaatattatttttcctaaaagtttgcctaaaatccacaaatatttttgctcagtactgattatattatatttttgtgtgatcttccttgaaattcaaatttaatttttaatttcatcaaatgacttacatttgtcccccgttcaaaaatttatctctataagttgaatatttttaaatttttttactaatataatagttcaaacattgccttttcattttttctctcattcttttcattttataaataaatcactatatttatataagcgtcgcgtgtaacagttgcgtgatgttccaacatcgctggcatttcccacactttagcccgctgctttttatccattttaggtttaaaaagtgtgataaataagcacacttaaaataatttaaaaactgacgttttcttacggaaggatgcgaatgggtgtaaaaataatgaattcgctcgagtcatttaccgaaattgcagtggctaattttccgggattatgtcgactgggtgaatttgattaaaagactatgaaattaattttatatacagcaaaaaatg

SEQ ID NO: 115019 - DNA, 302 bp, Heterodera glycines
  Promoter: Source sequence=SeqID_11687; Location=1779..2080; Strand=+; Gene=SeqID_75170
ataataaaacgaaataataaaaaaccaataatgaaaaaataaataataattattaataaaaaatacatttataaataaatttacacacaaaggatcaaagattcagcaaaattaaatttaataatggcaatgggtccatcaaaattatccaaaaagtggaacaaataaaagatttaaaaaaattaattaatagattaagtgtcaaatcagcaaaaaaaaatggaacaaaaaaaaaattaagatattaaattataactaaaaaataaacaatttatatttaaaggacaaaaccgaaaagcatg

SEQ ID NO: 115020 - DNA, 125 bp, Heterodera glycines
  Promoter: Source sequence=SeqID_21628; Location=406..530; Strand=+; Gene=SeqID_52227
aggaaaattcatccaaatcagtggaaaaagattcctaggctcgctcaggtaattccaaaataaagcagaaaaaagttatttttggcaatttatgggtccccagagaataattttcagaaagtatg

SEQ ID NO: 115021 - DNA, 126 bp, Heterodera glycines
  Promoter: Source sequence=SeqID_18532; Location=296..421; Strand=-; Gene=SeqID_83158
tcgacgaaactgaaaagagtgagaagccaaatttgaatatacaggaaaaaagacacaaagaaaccctctctatccccctccctcaattaagcgatcacttccgatcaaaaaacgggtggcaaaatg

SEQ ID NO: 115022 - DNA, 905 bp, Heterodera glycines
  Promoter: Source sequence=SeqID_1556; Location=865..1769; Strand=-; Gene=SeqID_74444
tttctaaagctgtttatttgaaatttattttataaattcatgaatcaaaaaaatgtatggctaatgttaatttggcaccaatttttataccttccgaattcatcattctttccttcaacagttaattgctataatttattcagaaaaacatattcaaccccttaaattattatttgaaaaaattttcgttggctaaatcaagcaaaaataggaaagacaacacagaattaattttctatacaataattttctctttatttatctttttaataatttaaatttttattttgtgaaaggagaaaaataattgaattttaagacgaagaaattaaagaaaatccaaaaccaattagccgaattacaataaaaatttataggaaaaattatttttgtaagaattatattcatttcttaaattatcattttgcttatcaaattttgagaattttttccttaggcaaatcaaacgaaaataggaacgacaatatgtacagaattattattttctttttatatttcccttattttttgatgctaaatagggaaaaataattgaatttaaagacgaaaatattaaagaatttcaaattccgcttaaaaattatttttaaagaaaaaatattgtaaataaattttaaaagatttttactcttttaataatgaaattaattgattttaggcgtgaaaactgttttttttccgaatactcaatagtttatgatttcttttattactacgtaaatctatcaaagaaagaaataaacaatatacagttcacaagcgcgaaacatggatcctgaataataataataataataataataataataataataataataataataataataataataataataataataataataataataataataataataataataatg

SEQ ID NO: 115023 - DNA, 801 bp, Heterodera glycines
  Promoter: Source sequence=SeqID_9130; Location=1702..2502; Strand=-; Gene=SeqID_70341
cctgtaaaatgtgcggaaaaaacgaaaactacaattttgaacaggcctgatagcgtgacttgacgcagctttattcgtaattgtgccatcaacggctgacaattttcgttctgtgtcggctttcaacaacttcgtcgttggacctgttgagtcggccaattcctccccagccttcgaaaaaacaattgtcctcaattggccattccctttcggtgttttcactttgctgttgattccgttgccaaaataattcagatcaacaatgatatgacaaaaaacattaaaaataaaaacggggaaaatgagttaaaataaaaacttcgaaaaaatgattaataaaatatttcgagagaaaggaatcccaaaaataaaaatttttaaaatgaatattaactattttcgaaggaacgggcatgtaagcgcaagcaataatttattgtgaaagtatatttgttaatcatgtgaacattaaattttataaaaattagcatttaacatgtgagaaataatcaatgaaattcggttgatattactatattatcgactgaagcaacaataaaaggttcacctgcttaattattttaaatattatgttctaaacaaaattcgaactatgtccaaaaatcgaaacccaaacgaaatatattcagccatattaatttttttttaacagatcattgtcaattattttcttatgaataagaaaatttaaatctaaataaaaaaatagaaacaaaaaaattaataattcataataacttccaaaatatatttgttaaatgttttcagaattttgatatg

SEQ ID NO: 115024 - DNA, 200 bp, Heterodera glycines
  Promoter: Source sequence=SeqID_5590; Location=1..200; Strand=+; Gene= SeqID_58573
gacccactgggaactctgctggactgctccctcttttcatttcggggcagtctcaacaagggtaaggcatcaacttcttaattacgaagaagcaacgcttctctcgtctgtattaccatcggcgaggataatgtgccaaaccatgcccattctcccaatggtttttattaaaataggcaaataaaaatttaggattgatg

SEQ ID NO: 115025 - DNA, 506 bp, Heterodera glycines
  Promoter: Source sequence=SeqID_22496; Location=2821..3326; Strand=-; Gene=SeqID_53166
aaatttgaattttcgactttgttcgaattcgggtccgggatccgaaattggccggaatggatgccggattcgtgttcagcgacccaaaaaacctgtggaaacttgcttttagggcaaaagaatttttgaaaattctttttcaaaaaggaggggcaaactacagaattaccaaattgtctccaattcatccaagaaaataaacgaaatcaaaaaacaaaacctagaatttcttttgattaattttaaaatcttgattttttttaattctaaaaaattccttttgccattacataattttcatttaatttttgttagagcgcgcctctcttgcccgtcccagtgttttgctgattgtagacgttgagaagctgtcgcccatccgacttagcgcagccattgacgacgcaaaagccaaaaaggggttcctcttcattggcacgtcaaacgacaggaaaagagctgtggaggtgttcgccaacatcgacgagtcattgtgcaggaaaatg

SEQ ID NO: 115026 - DNA, 387 bp, Heterodera glycines
  Promoter: Source sequence=SeqID_2254; Location=1908..2294; Strand=-; Gene=SeqID_78753
actccctaaatgccaataatttcgaaaaattattatggcggttcgagagtctcggctcttgtttaaatggagaaatttatcggtttctttctctcaggaaatctagggtctcaaacctaaatattcatattatcctatttttctaatcttttctcttggccctaaccagggacggtccggggggggggggggggagcgacgagtacgtaccagtgatggcattccgaggcccaaaaattattcggacatcggtattcagactccataaataggaatttcgtaccagggattagatgaatatgtcatatagatgttttaaaaacacaaaacaaaaagggtttagatgactattccatatatttttagcaaaaaacactttggcccatg

SEQ ID NO: 115027 - DNA, 96 bp, Heterodera glycines
  Promoter: Source sequence=SeqID_28801; Location=594..689; Strand=+; Gene=SeqID_59377
cgtaattcatgatactgatctattatactatatcccctgaggggttgaaaatttaattttttaaaaatattgattctcaatttttagccaaaaatg

SEQ ID NO: 115028 - DNA, 1003 bp, Heterodera glycines
  Promoter: Source sequence=SeqID_25306; Location=329..1331; Strand=-; Gene=SeqID_56055
cattaacagatttgattcctgatctctttttaccgtctgatccattcgaaaaatcttggtcgccccttttaatgcatcccgccagcccctaaaaatttatttttaaaaacttcaggtattttttgatttttggaaattttttgaaatttaattgaaatttttcgaattatccaaaatcccgcaatcccgcgcgggatctcgcaaattttaaatgcaggatttgcgggattgcgggatttgcgggattaatcccgtgggatcccgtcccgcaaaaaattttggattcccatcccgcagcgggatccgcaaatttgaaatttccggtctctagtttacagtaaagtttaatttattttttttaatgttatttaatcaatagtaaacttatgtaacagtgggattgtacttaattgagtttatcgaggaattgatcgctaaaagatttaaattccgataattcgacgaatggatgcgctcagacccacatgttatttcatattttcatttgcaagatttttatacaattaaatttttgtgtatttcagtccaaggactctcatattaaaatttttaagtcactacaacactcgataggacaaattcagaaacattgttacatttctaagattggacaccccaaataaggacatttctcagaaatatgggcaaatcttagcaataaggacacatcttaaaaataaggaaactcagaaatggggacaaacattagaaataaggtcaaatctcagaaataagggaaaatcttagaaataaggacattagggcaacgttcatttgtttttattccaaagcagataattattttaaatttatttgaagcatcatgctaatattatctgtaaatttggctttctcttacatcaaaaattgttgtaaaagaattccattgaccgtattgtattattttctgtttttgtatttgctccaatgggatcagtacaggcgcatttggttggcattgcgccaatcaaaatcaaatatg

SEQ ID NO: 115029 - DNA, 56 bp, Heterodera glycines
  Promoter: Source sequence=SeqID_16276; Location=154..209; Strand=+; Gene=SeqID_80668
tttttggcacctaataaattttatgtgccccgcggggcggcacaatgtgagcaatg

SEQ ID NO: 115030 - DNA, 428 bp, Heterodera glycines
  Promoter: Source sequence=SeqID_39262; Location=481..908; Strand=-; Gene=SeqID_67869
taaaatttttttaaacatttatatatatttttaaataaagtaatcaaaattttctatattttgtttatcttttaaatattaaaacccagtttattttgatctgaacaaataaatagtcggaacaccaattttttttctttttttattcaaacatagcttcaataaaatattatttttattttttttgaattgaaaattaatttattttgaatttgtatccctttaatatatttgttcataatttcccctaattttaattaaatttagacaaattgtatctatcagaccatgtctaattcagcaatttgcaacacgacaagaatttttgtcaacatacaaaattgggtatttaattttaaatttgatttttcttatttaattaataaataatattttaaatacattatttttaggtggaattttccatg

SEQ ID NO: 115031 - DNA, 223 bp, Heterodera glycines
  Promoter: Source sequence=SeqID_13428; Location=2571..2793; Strand=-; Gene=SeqID_77319
tttcccaattatttttttccaattgacgtgccgttcttcttcagttggtcaattgtgccaccattcttttgtcgccctcgcaaaaaaaatgtaaaaaatttaaaatttttataaatcctaaaaattcttcaatttttcaaaacgccttatttcgatggatacggtagacggaacgtattttttttatcaaggtagcaacaccagcaacagtaataaaactatg

SEQ ID NO: 115032 - DNA, 490 bp, Heterodera glycines
  Promoter: Source sequence=SeqID_19842; Location=1617..2106; Strand=-; Gene=SeqID_84597
ttttcggggagaaaagccggttcctttgatcaaggcttcccattcagagttttgtcttccggtcaaatttttttttgaagttccaaaagataaagatcttgccaaaaaataaattgtgaaaatactattttacttcgttgcggttattgtgagattttcttattctttgctcatttttttcatgattatcacatgtgcgaaaatgcataaatttaaattttaatttttaaattaaaaaaaaaatgaaaataattacatttctaaaagggtattcaagggcaaaattaaaaaaaaattaatttacttaagagggattcgaacttgtggggggaaaaagtaaaggtgagagcacaacctctgcaccactaaacagcacaaaacagtgcaatagattattcaatttattgggataaaaaaagtttggcacgtcataactcggcactcgtacttatttggcagaaattgaaaccatttttcttaagaacccatg

SEQ ID NO: 115033 - DNA, 1003 bp, Heterodera glycines
  Promoter: Source sequence=SeqID_20508; Location=1825..2827; Strand=-; Gene=SeqID_51043
atcaatgtaattttttgatcctataattgaccgttcacaacttgcaaataaaaataaacacataaataagcaatattaaatttaaatgataattgagactattatcgcaaattattttttgaattattagtaagttttgtttccatcatcttcttcttagaacttgctttgtttttttatttttttccaaaaccaattttattaaattttttaacttgacaatttcacatacccaaacatttgatcgttataaatttttatatatttttatcgaaccgatgaaaattttaattctttgtgagataaaatagagaagaggtgcgcagttttgccagttaaataaattaattactattaatttttgttttttaagcgtttattttattcatttgctcccctcaaaatgatactcagaatccccaatcacacagggattctgaggtctaaacgatgtcaaaagtaaaatctgatcacgtattcgtgatcagcggcccaaataacccctaaagacatgtttttgggagatttttgtcgaaaaaattttttcactcaaaaatcctggccacccccctttggttccgaattccaaaatcactttgcgcgaagctctcgtatgagttcaacaaatttaaaaaacgggcgcgaagcgcccgtcttgagcctcaatgtggactaataacctctaataattttttaaaaattcaaaaaatctctccaaccaattcaatcaatttgaatcgcttcacagtctaggtagcgaagctcccaaagcgcgaagcgctttttcccagcccagatccgacggttcacgcacccgctagttatatatattataaataaagaataaatagaataaatattatattagtgtatatgttttataataatgaatcccaatattaagcgatttcatcactgactactttcttaattggtaagtcacacatctataaagaaaatattaaaatatttttaaaaaaacatttcaatttaaggccagatg

SEQ ID NO: 115034 - DNA, 86 bp, Heterodera glycines
  misc_feature (81)..(81): n is a, c, g, or t
  Promoter: Source sequence=SeqID_26622; Location=2248..2333; Strand=-; Gene=SeqID_46003
ccatccaaaagggaggatggcggcggacgttgggtgcccattgaagctgcagtggccgcgatcaaactcgtcgcgcccgcncaatg

SEQ ID NO: 115035 - DNA, 175 bp, Heterodera glycines
  Promoter: Source sequence=SeqID_6316; Location=2533..2707; Strand=-; Gene=SeqID_61127
ttcgtttttcatgtgatcatttttggtttaccgagaatatttgtgtaaactttttgttcgccaattacccaatgaaaagagcataaattacccccaaaagtaaaacattccctccctttgtagaaatgaattaattgctcaagaatgtttgatagactcaagaaatatttagatg

SEQ ID NO: 115036 - DNA, 1003 bp, Heterodera glycines
  Promoter: Source sequence=SeqID_9732; Location=2498..3500; Strand=+; Gene=SeqID_72519
gaataaaaattggcataatgtttgtaaattaattatttttaatagagaccggcgtgggatcctgcgcgggattttgcgggtcccagtcgggatttgcgggattaatcccgcgggatcccatcccgcaaagaattttgagttccaatccctcagcggaatccgcaaatttgaaatttccggtctctaatttttaagcttaagctatagcagataagcttggacacggcgattcaattttgggctccaagtataattaagttggttttttcgtaggtggtctgtgagttagtcaccaaaaggggggtctcaggttcaaatcctcctcatgttgtgtgttaatttcaatttcttcgtttaaagaagaaaggaaaaattattttccattaataaaagttttcgtgtcaataaaaatcatattcaaaaagcgttggttaggtacatcatcgataattttatgaaattttccagacttataactcgggcaataataggccaaatataataattttatattcattttaaagagaaaattctggagaatattgtaagttttatttgatttggctttaaatagcgcacttggctaaaaaagagttaaatttattgaaatttttactagggtcaaaaaaattttcctcgggtcagattttcttaaaattttgcataggcccatattttgaccccctctatcgaatcacattttattttttacctgtctagtttttaactcgagatcggctcttgtgtttttacaagggaaaatcccctaaaaaatttaagtatcgcaaagttttggcgttctgattacaaaataaataataaacttatttgcactgggagcccaaaattgaatcgccgtgtagagtaattaaagttctgcttcttcacacccagagaactgatggcaaattcattcatgcaaattatcattgttccttcataatatttgagcaaatctaatacatattatcttaaaatttatgcatttttaaattcgaaaatg

SEQ ID NO: 115037 - DNA, 511 bp, Heterodera glycines
  Promoter: Source sequence=SeqID_24895; Location=1244..1754; Strand=-; Gene=SeqID_55641
cgaaggacaaagagtaaaaattcaagcaataaaacaggcgttattgaggcaaaaaatgacgcatcaaaaagtgtgaaaatatacaaaattgccggtattgccaattttaaatataaataaaaattagattaataattgtaaggaaaaccgaacagaaataatttacttttacctgtggttaaatttgctaattggatcaatccacaaaactcgaagacttttatgttgtttttctcatcactattttatggggatacttaggaacagaagaggggtcgggcggtgcctatgggcgccgccggaaaattttgaagtttttgatagtttcttaacagattttgtccaaaaaagcatttaaatttatttttagagtgtttcctacttttttcagacatttcgccaaaatagtgattaaaaatgaatacagaaaacagagaactaatgcatattttcttttttccataattaagatgttaaagaggatgcttttcttcttgatcattatcaaatg

SEQ ID NO: 115038 - DNA, 157 bp, Heterodera glycines
  Promoter: Source sequence=SeqID_9448; Location=2133..2289; Strand=-; Gene=SeqID_71457
aaattattttttaactgaaaatattaattggaatttttcaatagaattagccccatggcaaaatggagtagtcgagcgtttaaatttaaacattaaatctgccttaagaaaaacaattggtaaaaaattaattgattttgacacatttcacacaatg

SEQ ID NO: 115039 - DNA, 564 bp, Heterodera glycines
  Promoter: Source sequence=SeqID_41164; Location=504..1067; Strand=-; Gene=SeqID_69354
tcttaaaggcctgacgagttatgtttcgacaaacatcctgtacaccataaatcgatttgcaaatttagtcgaactatataaatttttcaaaaaatgattcatcttttttatggttagcgcatatgtctctagctttatagaaacggtccccgaatctgcgaggaactacttttttgagaatttctatagattattattctgcatgaatccttcgcttaaattcccatttatcttataaagtcagattaaattaattactccgatttgttttagaattggtccaaatacgcttgctaatagcttttcttttcgaaaagagaggcgaggaaaaataaaggttgcatccaaatgtaatttttttttttacattgaagcatttggatggcttgctgtttacagttggctaagtcttctttgcaagaagtagcacaacttttgtttgggccaacgaccccaaaccattcgaatagcaatcgattgggctgactagactcaatatttgattacaaggaatacttatgtggaaattgtggtatagagcagaatccgggaaagccaaaaatg

SEQ ID NO: 115040 - DNA, 891 bp, Heterodera glycines
  Promoter: Source sequence=SeqID_12280; Location=1473..2363; Strand=-; Gene=SeqID_75874
aaaatgctaatttctaaccaaaaaattgctcaaatttatcattgacaataaaaaatataacatttgaacattttaaacgtgttttgaataaatttgtaaaaatgaggcttttagacccatctgcgagccctgacaaatcggttaacaaatcgtattaaaattacaaaatttttacctggcggcgcctatcggtaccgccagccccccttgttccccaaaagtttttttggaaaaagcgccgcaaaaaatcaactttggtttttcatgcttagaatttcacaaaatgcttatttctaacaataaattgaaaatacatataacatctgaacattttaaacgtgttttgaaaaaatttataaaaatgaggcttttagacccaaaatgaggcttttttgcatgccaaatgaggcttttgaaaattttaacctgggaaccctgattttacccagttaaaatatgcatttacatattgtgtaatttgacaccacaaaaaataatttcctctaaaaaatttatatattatttttttttttgcaaattgagaatcagatttcacagaaaataaataaaatagatagtttattttttggtacatatagcacaacacagaaactattttgaaaaacaaattcaacaatttatatgttatagaaaaatatcgaaataacattgagtcggagtcagcatttttcaggaattaatttatagatttgcaatttttttcccggcataccgattgctattgccggtcggaaaattcaaaaattgactaaaaaaaccctttaaaattactcattttaatgggcctaaatctcaataaatattaactatcaaatttttttgctaaaaaactaagacgccgaagatgtgtagagctaaaagttcgacatg

SEQ ID NO: 115041 - DNA, 64 bp, Heterodera glycines; identical to SEQ ID NO: 99473
  Promoter: Source sequence=SeqID_32494; Location=95..158; Strand=+; Gene=SeqID_62797

SEQ ID NO: 115042 - DNA, 1003 bp, Heterodera glycines
  Promoter: Source sequence=SeqID_4576; Location=3944..4946; Strand=+; Gene=SeqID_54953
ttgatggttaagcaaatcgaatgtttagcagttaaattatgattcactcttctgctgctgctctctttgtcggtggaccaaattttcgaacatttttaatcataacattttgaaatttaaataatttttttgaaatttggcaggataatagaaaaacattgaggatctatcgaatcatatcgtgaattaaaaatatgtttgctttttagcaaagttataagtaaaatttatttttattaaaatggtttttgaataacgcccatttttggtcagtttttagacaaagtctgtcttataaaaaatgtgaaaattggatgaatggacattgattggcatattcagtaagcaaataaaatcctaaggcccaagatacagcttaaaggaagaaaaattgaattggacactgaaaacggtacaaattccgttccaactaaaataaaacttcctcctatttatgtaagattataaattgattgtttaataattaaaaacttttcaaatgatgataataaatattctagtaaggaaagttataaagatggaaaaatatcaaaataattatattgaacttttgcaattgtgaatcatcaacgacgaagtaaaatagaagattaatgatgattagtacgtttggattaaccatttgctcaggcagtgaaaaggttgtgaaaacggtgaaaaatcattgctaagagtgctctaaaatgagtagatgtctacggatgcttgtaagtgttgtttatgaaatgatcaagtaagtgtatgagtgatcgtgtgactagggacgagtgagtgattaggaacgagtgtgtgatcaaagagagacacagagagatcggtgtgagtgagtgataacagagagtaagtgatcagaaaattaatcagtgtgtgtgtgttaacatgtgagagagagtgatcgggatgagtgtgatcataaagacaatgattagaaggtgatcagagtgagtcaatgtagattagagtatgattaggagtgagaatg

SEQ ID NO: 115043 - DNA, 164 bp, Heterodera glycines
  Promoter: Source sequence=SeqID_17067; Location=1705..1868; Strand=-; Gene=SeqID_47414
tttggataatgaaatgccaatcttttctagagactgccaatagaaagcataattttaatttgaaccataaatcaaaaaaaaaaaattttttggcgttgcccctgggtcatttcaattgttaattagcatcactaatgagagataattaagcaagagttcaaatg

SEQ ID NO: 115044 - DNA, 85 bp, Heterodera glycines
  Promoter: Source sequence=SeqID_30735; Location=203..287; Strand=+; Gene=SeqID_61138
cgtttgctcattatagttaattgaggaggataattattgtgggaattatcgatttgaatttttttgatggaaaaagaggggaatg

SEQ ID NO: 115045 - DNA, 1003 bp, Heterodera glycines
  Promoter: Source sequence=SeqID_10529; Location=2405..3407; Strand=-; Gene=SeqID_73757
ttcgtaaaataaatggaattacttaaattagacttcttttgcttaaattatgaataaagggcagtttcggcacaaaatcaacaccgaacaaattttaaatgacgacgaaacgacggcgttcactgatggtacaatgtttaatgaggctaagcgggcactttgcatgctaaggtagcaatggcactaattgcagcacgcagaatttgttggagcattctctaaaaaagtaatatctacgaattctcggagattttaaccaccgatttgtatattttcgcatgaaaaatgggggatgatcaatcaatgtgccaaaaaatgcacaaaaatggggaatgcgaagggatcccccatttaggggccattttcgggcgaagagggggcgggggatggttaaattagtccaatcaacaaataataaaattattacttattatctgaacactaaaaagaatgaaatatttttctggaattccaacaaaagagaacaaaaaaaatttagagaagggagtccgaagactttttttctctagcccataaaaatttttctcattgctatttttcaaaattaggagcaggaggagaaaaatgttatttgggcagaatttaaaaaagagtaggcctaaaaaggactgttattattagccgaattattataaatcattatcgtattacttttttgagtgtttggtcaagcaatttttggcctactgtgcatatagcccattgaaatttgttaaaatataattttgacatggtcctattttttatgtttgatgattaataatgatttttgtttgacctaccatatccctaaattaagcattgatcagaagaccaaaccctccccattctctcacattgtcgtattgcggctaagccaaaatttccatccattcgttcgtttccgtatattcggcgtcaaaatctttgcacggcgcgatgtcctaagcaatttagggatgaaatattaaaaaaattaaacatcgtacagtaaaccataatg

SEQ ID NO: 115046 - DNA, 345 bp, Heterodera glycines
  Promoter: Source sequence=SeqID_8547; Location=2122..2466; Strand=+; Gene=SeqID_68482
ttgctcaattgtcgtcgttttcgttgtacacagagaagggatgattgatgaagatgaattgccgataattaatgaatgatgaaaataatggcaaccaaatgaattttttgtgccttttatatatgaatttatccgaaaaatttgactcttccgactaaaaaatttgctatttaaggcccacactttttgcttatccacgttcattccgttcattcattccatccacttaattattcgtcctcctccaccgccacttaaatcgtcagtttatttaggtaattaattgttttgttatgtgcattttcattgtgctaattgccccccccccccatttttcagcgaatg

SEQ ID NO: 115047 - DNA, 167 bp, Heterodera glycines
  Promoter: Source sequence=SeqID_27944; Location=1600..1766; Strand=+; Gene=SeqID_58607
actgaaaaatttaaaaaaatttgtttaatgacaagcaaattatttaaattgaaaagtgtcgccaaaaaattttttttaaggcacggaattaaattaattttttaaaatgcaattaaaatctttaaaaagctcccccttatttaaaattttcaccatttttagcaatg

SEQ ID NO: 115048 - DNA, 53 bp, Heterodera glycines
  Promoter: Source sequence=SeqID_15050; Location=2200..2252; Strand=-; Gene=SeqID_79226
tttattttgcagttttccgtcacaacaaacaacgaccttcccttttcggcatg

SEQ ID NO: 115049 - DNA, 163 bp, Heterodera glycines
  Promoter: Source sequence=SeqID_19084; Location=1..163; Strand=+; Gene=SeqID_83827
caccaattgtgaatgaataccaatggtccgtagccaatgatgaatggaatttgtttaattatttcactgactatttaagcaagagaatatgtctaaatatgccaatttaaattagttaaaatattaaaaataacaatgtaataattaaattccagacaccatg

SEQ ID NO: 115050 - DNA, 87 bp, Heterodera glycines
  Promoter: Source sequence=SeqID_26063; Location=1..87; Strand=+; Gene= SeqID_56809
tccttgggcaatgacaaagagctgctcaatcgtttgattctcgctccgcacattgacacgtgtgatgaagtcaacgagatcatgatg

SEQ ID NO: 115051 - DNA, 250 bp, Heterodera glycines
  Promoter: Source sequence=SeqID_11765; Location=715..964; Strand=-; Gene=SeqID_75264
atacaaatgtttttttttaataattctttttttctgtccacaaaatcctcaaaagatttgcgccattctccatttttctttcatctcacaatgttacgcaattttctcggctcagtttttttgtccgtccgcctccaattggtccttaaaacttttgcctctttttccccattttattttttctttttctggcattccgtcgccccaacagatggacaaaatttttcaggaaaatttcttcgaaaaaatg

SEQ ID NO: 115052 - DNA, 177 bp, Heterodera glycines
  Promoter: Source sequence=SeqID_506; Location=3698..3874; Strand=-; Gene=SeqID_45835
ttttccctccttttatacatcccaaaaccaaaaagattcatccggcgacattttgggtgctgcagtgcccagcagaatttgcgtataaaaggctcacattttgatgactcctgccatttgttttcaatccctctacacacattcatattttcttcacttttgcgacgacgacacatg

SEQ ID NO: 115053 - DNA, 1003 bp, Heterodera glycines
  Promoter: Source sequence=SeqID_3868; Location=1728..2730; Strand=-; Gene=SeqID_52215
attgaaaaaaggaagccaaaaaacatttttttttaaaatagtgagaaaaagtgccaaaatagttaaaaaaagtccaaaatagtgacaaatagtgactaatacaaaacttttaatatcactatgatgaaattaccttacaaatagagatgattgaattttctattcataactctttcaatacctaatttaattctatgaacttttattaggtgccagttgaaaagttacccacagctgctgagggttagtcaaccgggttaagttacgttcaactcaggattgactcaaaataaaaaaaaaccaaaaacacaaaaaataaaaagtgtaaaaaaaaatatgaaaatgtcatctatttaaataagtaaaatgctctttaaacaataatcgtatctttgtacaaagaaaaaaatccgctttcaatagaaaaaatatataaagaaagaaaatagacaatattatcttttttgaaaattaataacctaatatgttataaaaatggatataaattatattcttttgcatattttttctgcgcatctgtaatgaagaaagaggttcaaatttttttttataattttaatgctattttttaactgattttgtctaaaaataacaaattttgagattttgggcttatttttttaagaaaagaaagtttttgggggggccgacgatgccgataggcgccgccgggggaaatttttaagaatttttaatgaattttgttaagaaaatggccaactgatttttgataaaagtcggtcggttttttcggtttgctcgtcccctttttctgctaagttgctgaatttatgcaccatttatgcatagactttcaaagcaaaataaatttacggcaaaatgattatccaaaaaaattacatcactttcacaaatgcccgtctcatattatcacaattgccattttatatcagtaaaaaatttatttttattaattaattgtatcacaaaaaagaggaggtgcaaaataacataaaaaatg

SEQ ID NO: 115054 - DNA, 153 bp, Heterodera glycines
  Promoter: Source sequence=SeqID_14440; Location=679..831; Strand=-; Gene=SeqID_78476
agcaaagggacggcggagacaaaagcgaaggcaccgacggaattggagggattggagcaattgggggagggggaggggagggagcagcgaatctcgggctgtttgaagacactgatcgatcagttgagcgacgattgcgaatggaaagcgatg

SEQ ID NO: 115055 - DNA, 241 bp, Heterodera glycines
  Promoter: Source sequence=SeqID_22968; Location=1831..2071; Strand=-; Gene=SeqID_53669
aaaaaaaaaatttggggttttgggggccgggggtgccgataggagccggcccaaaagttttttggatttttaattaattaatataaagaaaattgttaaaattttaaaaatttttcaacctttctcccctttgttgtgaaattaactttttaagtcgggggatcggggtcggggagctcgggggcggggagcaaacactagtatattagataatcaaattttcttgaattaattaaaaatg

SEQ ID NO: 115056 - DNA, 119 bp, Heterodera glycines
  Promoter: Source sequence=SeqID_14286; Location=1722..1840; Strand=-; Gene=SeqID_78309
tgttgttctgttccgataagaaaaaagaacaaattcaggaaaaattaagaggctattaaaagaataatattttacttttttggcttatttatattttttaggtgtttttctgtaaaatg

SEQ ID NO: 115057 - DNA, 859 bp, Heterodera glycines
  Promoter: Source sequence=SeqID_40544; Location=1..859; Strand=+; Gene=SeqID_68843
atccctcccttttgtgcactatttcgtttcaaattgaatcatttttttttgtcttttgaaataaattgtgaaaaatatacgaaaattattttcggttttaattatgctgtacaatgcttttaagccccgcctgcggcggctccccttttgtgcactattttagtttttaaaattggttccggactttttggctttttgaaataaattgtgaaaaatatacgaaaattattttagcttttaattacgctgtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcatttttttttgtcttttgaaataaattgtgaaaaatatacgaaaattattttcggttttaattatgctgtacaatgtttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccttcccttttgtgcactatttcgtttcaaaattgaatcattttttttggctttttgaaataattgtgaaaaatatacgaaaattattttagcttttaattatg

SEQ ID NO: 115058 - DNA, 560 bp, Heterodera glycines
  Promoter: Source sequence=SeqID_10889; Location=1..560; Strand=+; Gene=SeqID_74169
tcgggtggggaaaatgcaaatccttcccttttctcacatttaattaaaaacagcaaataatttaaattaatttttttacttcttaaaaatgtgacttttaaaggctttcggtcgacaaaatttcaattttcgcttctcaatgatcacaacacttttgcttctttgttaaaagcagtgaaaatttgggcgaaaagtcagtctaataaaacactgttttataattatattcaaaattaaaatttttttatttttcgatcgtctgatttatgccggaatatttggctatttcaatggcgccgcattggctttaatggcgacaaaaatttcgcttctttacccaaatgcaccattgatttatttattatatcaattcttccgaatttactcacaattgtatgccattgataaacaaaacttaaaaatttatttaacttcaatttctgcttattcatttcatcaaaaaatgataaataaataaatgcaattttcccgttttttggcattatttaattgtttaattcagtgattggcaccgttctcagctgatgattgacaaaatg

SEQ ID NO: 115059 - DNA, 864 bp, Heterodera glycines
  misc_feature (155)..(155): n is a, c, g, or t
  Promoter: Source sequence=SeqID_27043; Location=1068..1931; Strand=-; Gene=SeqID_57770
ccatgttaatattagttcaactgagtaaatttgcatcttattaaatcaataaagattttaaaacaataaataagtaaacagtgtaatacttaattaaaaaataatttctctcttaaaattcggcaaatgcagcgaataaattttcaacgcaagantttggattttgaactggtcctagaggcagtatagtttacatatccgagagtgtttattaaaaagaaaaagtcattaaattaacaattaaatattaatgaatacataaataattctatttaaaaacataattgttaaaaaacaaacgcttggttaaagtgcaaaaagcaaaaaaaaaaaaaaattagaaaaataatatggagattaaaatgataaaggaaatattaaagaataataaaaaaaattaatgaaaaagtaatacaacttactatatagaatcttatgtttttccttgtgtaaaattaaaaaaatgataaaaagggtccgaacgatgatcacatcattcatttaataaaacaataagaatcaagaggaaattcgtaaattaaactaaaaaatattaaaattttaaaaataatatatgaaatataaaaataatatattaatttaaatgcttttcaattaatttgagttttaatatcgctttttaaattgagaaaaatggctgatatatgataagatataaaccagaacaaatgtcttaactattataagaatttttaagaatttaagaataaaacacataagcgacaaatatatttggacaaaattcttaatacgagcataaattaaaacaaaaaatcaaaaactaccaacataattaatataacttacgttcataaaaatcaaacaactaataaatatactatg

SEQ ID NO: 115060 - DNA, 157 bp, Heterodera glycines
  Promoter: Source sequence=SeqID_31705; Location=1106..1262; Strand=-; Gene=SeqID_62009
tttcgtttctgatttatgaaagaaatgtgcgaatgtgttgttgtaatgttaaggacactatagggagttataatctatatcttaacggtgttgtatatattgacgacgtatcagttaccatttcttttttcgagaaggtgaacaccgttataatatg

SEQ ID NO: 115061 - DNA, 577 bp, Heterodera glycines
  Promoter: Source sequence=SeqID_10763; Location=3438..4014; Strand=-; Gene=SeqID_74014
ttaaatctttaaaaagaataataatttaacttttttatcttataactttttaaaacaacatttaagcgatgataataaacatagaaatcgatgcagatttttttctctatcgatatgcaaaatttggtgcagattgtatggttagaaaaaaagttatatggagagaaggaatgttgtttttcttaataataaaaatattagatagtatgccaaaaggagagaaaagttagagacaaaaagtttctctgcactctctctttattgacacatgtctcgttttttgactcggtgtgtatatgatcaaaaatcactattcctattaatgagaaaattctttatgaccaaaaaccactattcttaactaattagaattaaattttgccaatggatttgcccggatagcctgaaataagtgctataaaagccgaactaaatttacaaaattcattaaatataatggctacgtttttccttcacaaatgggcggctacgaactcgctttcgaaggccatatgtaccaaaaaaagaagcacgaagggaattaatttattggcgctgtgaccaaaacaaaacaatg

SEQ ID NO: 115062 - DNA, 946 bp, Heterodera glycines
  Promoter: Source sequence=SeqID_4378; Location=1..946; Strand=+; Gene= SeqID_54219
tttcgaaataaacttgttttatgggttttctgggtcatagaattcgattctgatatctatttcagcccgtttcgaacccctgaccctgactcgaacaaaaattcgaaaattcaattcgaaaaaattcaaaatatgtatgcagccaaatgcattaaataaaaaggagtctcgattcagaaggcaaaacatagtaattcgtgcatttgaaatggttttgttgcatattttgaattttttcgaaaattgaattttcgaatttttgttcgagtccgggtcaggggttcgaaacgggctgaaatagatatcagaatcgaattctatgacccagaaaacccataaaacaagtttatttcgaaaaaaaaattttgaaaattttctttttcaaaaaagaggggggggggtacaaagtacactatttattattaccgacccgggtcttaaattgttcaactcccttaaaagggagtcttataattggagaaatatgtaaataaattaaaaatgattcacgctcgtgtatcacggcgattttctgcgcgtccgcgtcgcttttaaaccgcgttgcgccacacttttttggtccgcatcacccgcaaaactttaaagttaaaaaagtgaaattgaaatatgccaacatggtcttagtaatacacagttttagcaacaaaaaaaagtgcataacaattatctttgtaaatgagctatcgaataataccaagaatgtttaatttggatgcttcaagaacacttctgggtgcattaatgttgccaaaattttttttggtcttgtaaactgcaatagagccaattttttgctgctttccagttatcggcgagataaacaaataccattccacaattattcaatttgttttcagcaaaaagggaaattgtttttttgctttgtttaccaattgttctgatgacaacgcttgatgcgaagatg

SEQ ID NO: 115063 - DNA, 121 bp, Heterodera glycines
  misc_feature (21)..(21): n is a, c, g, or t
  Promoter: Source sequence=SeqID_691; Location=1622..1742; Strand=-; Gene=SeqID_59125
tccttccagcagaatagatcngtataaaggggtcgtcttccctcgactttacattcttctcttcttcttcttcaccacactccaaccaacgaaccgcttcagtgcgcaacgcaacgcaatg

SEQ ID NO: 115064 - DNA, 384 bp, Heterodera glycines
  Promoter: Source sequence=SeqID_35885; Location=501..884; Strand=-; Gene=SeqID_65340
atcatcggctttgtcaatccaaagcgaaacaacaaagatgctgttttgaacgaataaagggcataggttattttgaagaagtgtcaaagaacatgcagcaataagcctgcaaaatctaataagtggaaaatacatgagtatagaatttattttcagaaagtgtcaacagacttttggaatatatatttgcaatttatcaacaattttgagaagtgagttagaaatgataatcttcacgattcaaaccaattttcgttgctctaattaaccgcgataaagacattcgaatcaattaaatagcttctgagataataaggtttatcataaaatttcatttaaaaataaaccctcaattattggtatgaacgatactttccaaacatg

SEQ ID NO: 115065 - DNA, 1003 bp, Heterodera glycines
  misc_feature (911)..(911): n is a, c, g, or t
  Promoter: Source sequence=SeqID_27215; Location=507..1509; Strand=-; Gene=SeqID_57902
caccgccagcaattaagcaaattagcaaaaactcattagcgattaaaattcgctaaaaaatttgattggaaattctctgatcaaccaacaaaaaatgtcctttttaaactgtttagttattatttttttattcttattattgggcataaatttgactctgctactaagtttggccaattcaatttgttgagcctaaaaatagaaactagaaaaatctatattaataaaaataaattaattagaaagcattgaattcaaaacggtcacatacatttttgagtaaaataaatgtttttaacagaaaaatgagttttaagcattgaccgatcacgtggttttggagatgagttcttttggcataattgttgagtattgccgaaccaacgaaaatagtaatgagcaagtaaatttcgaaattgatgctatgatgaattttaaccggctgaacagggtttgaagcatttacatcatctccacagaaaacccgaaaatattctgctaaatttcgacttaaaaattttaaggaaataataatttcaccagatccattttgagataaatttggtgagcttttgggttgtcccgcactcgaacccggagtcccgaaacccgaaccgtacgccgaatttctttgaacgtatcccccgacccgaatcgcgactcgacacttttcttgacccgcggttttagttgaaaggttttatcaatcttttaccataaattatttttaacattgcttttatttttctttaatcgaaaagcaattagtgagtaattactaattacgactgtaaaaggtgttgaagctaaaaaaatatttcaccatttgttctaattcttaattaaagcatttattagacaaatgaaattaattaaaatgccctttggggaattgcttataaatacatttntatttattggtttttctaatacaattaatgcatttattatttttaaaatcataataattttgaataaaattaaaattagttttagaattatg

SEQ ID NO: 115066 - DNA, 117 bp, Heterodera glycines
  Promoter: Source sequence=SeqID_21896; Location=963..1079; Strand=+; Gene=SeqID_52534
ccttaaatacagtaagaaatttatgaattaattattgcttcgattttcactttattataaatttacgtattttttaatattgttatttaagcaattttattaccctttatagatatg

SEQ ID NO: 115067 - DNA, 53 bp, Heterodera glycines
  Promoter: Source sequence=SeqID_6293; Location=1408..1460; Strand=-; Gene=SeqID_61049
ttccgaggccccaaaaattttaggaaaccggaattccgtgcccatccctgatg

SEQ ID NO: 115068 - DNA, 78 bp, Heterodera glycines
  Promoter: Source sequence=SeqID_9371; Location=951..1028; Strand=-; Gene=SeqID_71137
ttttgagcgatttttcgatttggcattttcagttttttcctcgaacgtcaaatgttttcgcactttttgcgcattatg

SEQ ID NO: 115069 - DNA, 137 bp, Heterodera glycines
  Promoter: Source sequence=SeqID_4351; Location=2821..2957; Strand=-; Gene=SeqID_45785
ttagtgtacaattagattgtgatgagtacatgaccaaactgggttttattaaataagtactaaaatacaatttcatttttattacatactgagaattcatttgaacacacacagtcatacgctagtaattacaaatg

SEQ ID NO: 115070 - DNA, 407 bp, Heterodera glycines
  Promoter: Source sequence=SeqID_6756; Location=4539..4945; Strand=-; Gene=SeqID_46306
aatttagattaggaaatcggaattgatcaaaataatttctggattcgtgatcggggaccccaaaaaccccagagaacaaatttttatgactatcacaaaaaaaattttgcaaaacaaaagggtcccccctttttaaaaaattttcaaaaaggcccactttccatatagcgcccaaaaatgtatgtccctcacaatttatgtttttggagatcagtttgagttcgattcctttccataacataatcttttcatttaatccatgtttagatttagatgccctatttatcccttgtaaaatttataggaaaataaaatcttagtgctttcagcactctcgcactttctccatttaatttacgactaatttaccttaactttaagtttcattgctttttctattgaaaatg

SEQ ID NO: 115071 - DNA, 772 bp, Heterodera glycines
  Promoter: Source sequence=SeqID_3225; Location=1702..2473; Strand=+; Gene=SeqID_83768
aaacgaaagattgagaaaagaatgaatgagtcatcgaaatggaaaaaaggagaagcgattgaaattccttatttaaaagtgaatcattcactgatcggtagtacattaattaaacaagaggaatgttttatttgctgctaaaaaggcgcgatgagaagagcgaagagagaaaggaacgggggaaggcatgacatttgtgtcaccgtaattttctctgctaaaattggggaattcttgggcgggggagtctgtaagtctgtaattacgggtttagtcttttttttttaaagtagcaatttggggcgctcacacaacaaagtcaaatccgattgcgcggcacgcgccgcaatgattcctttcctcaaagagtttttgcgcttttccactcatttgtcagcccactttttgttttgaaaatgtatcatttgtaaagcaaaattaaaacccttatcagaaatttcgaaaatattaaaataaacaataaaattcgcaattaccaaaatgcattttcaatatcagcagaatttactcctcaatgagctcccatttgccagttgttcttcgaaaatctttgccaatttccgtggagggcaaaagcctttctccgaccaacgaccatcggccaatggcaaaagagagacacctgacgaagggggggggcgaaagcgacggacggcggtgattcgataaaccgatcatcattcacaaacaaacaattaggaacaaatctttcaataacaaatcttttagcccgatcaaagaaagcgaaatg

SEQ ID NO: 115072 - DNA, 72 bp, Heterodera glycines
  Promoter: Source sequence=SeqID_6342; Location=1868..1939; Strand=-; Gene=SeqID_61193
agtttgtgttctataatacattcattagtccgaaactgggatttccaattaatcaggggggggataattatg

SEQ ID NO: 115073 - DNA, 359 bp, Heterodera glycines
  Promoter: Source sequence=SeqID_10210; Location=2158..2516; Strand=+; Gene=SeqID_46849
ggtttgtttttctgctgcctcactattttaatcaacttcttgcaaagaatttcatgttccatagtttgtaatagacagtgttttcgaattttcttcccctttcgtgaaaaagtggaacttggataattctgctttctctcctcaaaatttttatacaacaatatgaaatgcttctctgctcttaagccaaaggattaaatcaattccgctaaaattttttcgtttcctagtctttgaagcgttgcccggtgctcaactgtggtctcggctcaaatctgacccacgtcattgtgacctcaacgaggctccagcatgactggagcctccaggattggctccgccggaaaagggaagagatg

SEQ ID NO: 115074 - DNA, 79 bp, Heterodera glycines
  Promoter: Source sequence=SeqID_4547; Location=2231..2309; Strand=-; Gene=SeqID_54852
ataaacccataattgtgactactactgttcaccaaattctgttgatcattttttgcgcaatcaacaacataaaacaatg

SEQ ID NO: 115075 - DNA, 678 bp, Heterodera glycines
  Promoter: Source sequence=SeqID_928; Location=2197..2874; Strand=-; Gene=SeqID_64289
tgccatgtcatttggtcatacagttcgtccttcataacaatatcgagacatggcattgcaaatatcacatgtcatgccattccatggtaataaatattaaaaaaaaatatttgagcgtcctttcttttaaaaaaggtagtagttatataaactttcaccccccccccttcatcctaattgccttgatgacctttgaactcggatactcatatttctttcctcgataaacattaaacaacaacaaggcgaagtgaaaatcagttttttttgtagcattacacctttatttactgcagctttcaattgatatggaataaaaaattccgtatttaaaaacgttatgacacttgactaccacatttttttcaatatcaaaaacaaaattaaacttcagattttttttttgttcaccaactcgacaatgtccaattcgcgggcaagttgtcattaacttatcttcatattaaaaaatttagaacttcgctggtcttagggcaccgtctggtgttaataatggacaaacagattttgtactgttatggttttaaatatttatcaattcctaccctgattcagcctgctacttggtgtgatggattcacttttccactgacggctcatccccatccattaatgcctttaccaccagcaccaccgctgttgctttcgccgcatatg

SEQ ID NO: 115076 - DNA, 1003 bp, Heterodera glycines
  Promoter: Source sequence=SeqID_2537; Location=383..1385; Strand=+; Gene=SeqID_80256
cccctcccccctcgaggggaagtgagtgagtgtaagtgaactcgttttcggagaggggaccccgcactgcattatcagcaagtttggcgcgcgccatgttccgcagctgtttccggcgcccccttcgactgggcaattttgtccatttttgatttgggtgggcaaaaaaggaaaactgttgaaaatttaaaaaaagaagttcttggcataatgtttaagttttaagagcattttaaaatgccaaattaaatgaaaaacaaaatttaactcatttttaaatattatttaaaattaatttttgttttaccgtgttttttaaactgacactaccgtatccctcccccccccctccgccgcttgttgtccaatcattttttgccccgcgggcatttgggcggagtttctctttttttcgcccagcagcagcagcaacacaacgccaatgggccggggggagccaataattgccacagggctcttcttcgcttgagttgttgcgccctctcgcgttttacgattctcgggcatcaaaatggaacacacaaattacacgcgccccgaggggggggggcattttgccaaaaatgggaaatttaaaatttaaaaattaaaaaccaaaattttgttcaataattaggccacccttttggtaaaaatgccgtaaaacgcgggagagggtaattttgccaaatgtacacattaatttttaaaattcattaaaaacacccccctgagaaaacggcactgtcgattaaattgtgccaagaaatggcgattttaaaatttaattttaaaaattttgctctattttatggatatttttttatgtctaaatattacttatttcaaatgaatagctccggataaatgtgctagtaaaaccccaaaaagcttatgaccaattaatatgtcccatttgtggtcattaaaaaatgtaaaacaattgcaacaaaataatgcgctaattaaattaaacagattgtgagtcatacggtagataatg

SEQ ID NO: 115077 - DNA, 155 bp, Heterodera glycines
  Promoter: Source sequence=SeqID_16066; Location=364..518; Strand=+; Gene=SeqID_80423
attaattgattttgaaatcgaattttaagtaccgacgtgctccttattaccgggtcgcgcgcgccgcacaacgaagtccgtgccaaaatcatttaataaattgaacatttaatttaatttttaaataggatgttcgacatatgttcgaaaacatg

SEQ ID NO: 115078 - DNA, 253 bp, Heterodera glycines
  misc_feature (23)..(23): n is a, c, g, or t
  Promoter: Source sequence=SeqID_11368; Location=1..253; Strand=+; Gene=SeqID_74757
aaaatttctgccttttatacttntttgaaaaaaccactgagaaatgtatgataaatttctggatatttaagcggtgaattccccaccaaaaccatccattcattcaattgcactcacttccattgtttccctccatcgatcgaatcttcatcctgctgctgctgtacaataaagataattcccgtcagttttttttgttttgtttatttaggttttcaaaatgtattaaattttgtgcccttttttcaggatg

SEQ ID NO: 115079 - DNA, 1003 bp, Heterodera glycines
  Promoter: Source sequence=SeqID_2600; Location=919..1921; Strand=+; Gene=SeqID_80642
tttctttttctgcacataataccatgggtgaagcccaaaatattaaaaataaaaaccctgataaacctgtgtgaatttttggcatagcaaaatattagatggagttttaaaattcatgccctatttgacaaaataaaatgaagaaaaaaatatgaaaaatattaaaaaaggtatggaaaaatgtctagacagaaaagatttaactatgtgtcaagaattagcagaagaggccaaacaatcaatcgaaatagctaaaaattatcggcaagaaattgggcaaatttatcggaccgcttactcgcagccagatttaggtattggagatttggcaaataaactaaaagaaacaatgcgcgaaaaccaaatacggtttgaaaggcaaagacctcaggaagaatttagggatgaatttattgcttataaaatttaagaaaaaaataaaaattcgagaaaatgaaactgcatgagaatcaaaggttgtgggacataaaccaaaaacaggtgaaaagggaaacaggtgaaaataggtgaaaaggaaacaggtgaaaacaggtgaaaataggtgaaatttcacctaaaaatatataggggcgtgcatttaatggggcatattagagaatgtctcaactagtatcaataaaaagtgccaaaagaaaattttgtgatggttatcgctattacaaacataaaacgaccaagttcaaactttggtggaaatgtgaacttaattcacatgggtgccagggctggggttttgaaaaggaagggttttttacaatgacgcgccgacacaatcatcatcctgaccctatattaattgaaatcgaagaggacataaaatatcataatttttctgcgggggcaaaatgctttttgggtgacaacaagaaatagttgatgatgctaagaaaaatccgagactccaaactgaatttagagatgaatttattgtttgtaaactataaataggatcaagaaaaaaaataccaattaaataaaaatg

SEQ ID NO: 115080 - DNA, 361 bp, Heterodera glycines
  Promoter: Source sequence=SeqID_14069; Location=2027..2387; Strand=-; Gene=SeqID_78042
tttttgtcctataattgaactcattgaaaatttagactgctttgcctctaaaaaggctcttgagagatttattttagagctggctaggggattataatatagtaattttttatttttgatggagtggattttgattttaaagaaatttgaattaatttcacataagcataactttttccggcaaagattaggtgcaaaagggcctaagttttctgtttccaatagtagggcagggctggatactgagcaatattttgggaatttagctaaatatttatttctcaactcaaaataatgttttaaatgcttacagccaccaggggctctcggcaaatacaacgaaaaattgctttccgagatg

SEQ ID NO: 115081 - DNA, 799 bp, Heterodera glycines
  Promoter: Source sequence=SeqID_18130; Location=1292..2090; Strand=+; Gene=SeqID_82714
acagttgcgtcgcttccctttggaatttgctctcccactgcgtgtcactgccttggcatttgttggcatttactcccaaacatgccctggtccgagtttgcgcaaaaactgacattgggcaaaagttaagttgacaaaaaaaatgggacggactccccgcggagtgctcaaagcacagcgaccaatggttccaaggtgaccattccgcgttgagtggcacaaattggagaaagaccaggaagagggtgattattaagcagtggaacatttgcccaaagcatggcaaaacaattaaagtgattagcggcggaggaagaagcttccttcctccccggcggcaacggaacacaaacaatcggaagacccttccgtccctcactcactcacttcccccgtccttccaatccctttgccctctcatcttctcgacctaattatacgagcaaaaaaacagtaatttgtttgttttacactcaccaattttctaaaataagaaatgaacacacaacaacaaacttaagcagacaaattattgtttattcacttattaatttgttttgtctgctattttccacaattcccttgacaaatggccgaattgccgtcgctcgataccaaatttatgtggcagcacacgtggccaagtgcggatgtcctctgttcgtttcgtacaatctcatctttgggaatgtgatttttcaattgtattttcggtgaatttattgcgagcaattcggagctttggcgcggtgctttcattttggaactcggtgccggaatcgcggcacttccgtcaatg

SEQ ID NO: 115082 - DNA, 78 bp, Heterodera glycines
  Promoter: Source sequence=SeqID_45020; Location=1137..1214; Strand=-; Gene=SeqID_72411
tttgcctttttgctctacgagaggtttccgtcctctccgatctcgccttaggacacctgcgttacgctttgacagatg

SEQ ID NO: 115083 - DNA, 397 bp, Heterodera glycines
  Promoter: Source sequence=SeqID_19936; Location=1..397; Strand=+; Gene=SeqID_84697
aaaaaaaggggaaacagagataaaagtcaaattttagagggtctcaaagaaaagcgtgatttttcaggtacataacggaccgccgcatgacagcaattttggttattcgtacgccagacgaatgatcggtgggttggcaatgatcagctaaataaattcaaatttccaataaacaaacagatgtactcaaccgcggatatgctcaggagcacaatcgaaagtatcgagaaaaaataaatattttatttttgattaaatattttaaactttctctctccacctctctctctctctccacctctctctctctctccacctctctctctctccacctctctctctgtatttctttattttttttctctctctctccccgatctctctctaataattaatg

SEQ ID NO: 115084 - DNA, 494 bp, Heterodera glycines
  Promoter: Source sequence=SeqID_4321; Location=924..1417; Strand=+; Gene=SeqID_54054
agtccaaggaggctcggcgccgaactgtcacataaagacgacaaaaaagagtcagcaaaaggtgctcgccagcaacagcagcagtagcagtggctacgagttgaaagtggaatcgcccgacgcgttggacaaacggcaaattatcgccgaatcgggacagggatcgtgatcgcgatctgttgatcggtgtacacaaacacggtaaataatgccaaatcaataaattaattcaatccatttttagtcttagtatcaattttccgttaaaattatcggaaatcggaatcagacggcccaaaaaatttcggcaatcaaaaatcggatttttttttttttgtaaaaacaacaaaatggttaaatacttaattaattgcttcaaaatgatatttttcaaatgcgttttttgttctaaaggaatggaaaattgggagcaattgcgcgcggatgaaaagctttgttttacccaaaaaagcatccaatttccgaacacgatg

SEQ ID NO: 115085 - DNA, 140 bp, Heterodera glycines
  Promoter: Source sequence=SeqID_616; Location=1..140; Strand=+; Gene =SeqID_57569
tttggccagcttctgaacgacgtcaaaatcgaaatcagcagcatcgaccaactgacggaaaaattctggatggtgtgctacaaggcgaaggatgagcacgtggtggagcacgacaccagcaacgtcgccattgccctatg

SEQ ID NO: 115086 - DNA, 172 bp, Heterodera glycines
  misc_feature (37)..(37): n is a, c, g, or t
  Promoter: Source sequence=SeqID_5869; Location=1070..1241; Strand=-; Gene=SeqID_59492
caaaacatgcggttcgtcagaaaaccgctcgacgacntgctgaagaaggacgcggaatggaattgggcagaaaattgccgcaaagcatttgataaatgaaaggaaattttgacttcaaatttgctgctcactcattatgacccgaatttggagatcatcgtctcggccgatg

SEQ ID NO: 115087 - DNA, 70 bp, Heterodera glycines
  Promoter: Source sequence=SeqID_22244; Location=1005..1074; Strand=+; Gene=SeqID_52919
aattgacacctattggtgcaatacttcaacgtttattgatttcgggtcgaaacaataatcgtctacaatg

SEQ ID NO: 115088 - DNA, 876 bp, Heterodera glycines
  misc_feature (32)..(32): n is a, c, g, or t
  misc_feature (64)..(64): n is a, c, g, or t
  misc_feature (118)..(118): n is a, c, g, or t
  Promoter: Source sequence=SeqID_2979; Location=1..876; Strand=+; Gene= SeqID_82617
aaaattaaataaatattaaaatgtttttattntaaaggatatgaaataaaatttataaaaatcnaataaaatggtactagtattttaaaatgaaactcaatgaaaatatatccgaatntaaaaaatagaattacgaatcatttggattttgtttaaattattccttatttttattctaaaacagcagataaaaaataataatttaagagttattgaaaaaactaagtgaatcaaaatcaattatggtttcaataattataatttaaaaaatataaagtaaagtactaaatatgagtgctaatcattttaatcaattttttaattagaaacaacaggatgataataaataataaaggtaacatgtgatttcgtcagaagtgatttcgtcagtgagtgatttcgtcagaagtgatttcgtcagtgagtgatttcgtcagtgagtgattttgtcagcgaccataataattttttttttaaaaacaatttagtttaattaaggctaatagtttattatccgtattaactggttaattttaatttgataaaattgataaaatcagttcagatctcaataaatttaaaatactttatatataaatataacaagtgaactcaaaagttcggttgatattttcgccggccactcttatcagtaaaatattggtttttgtgactcgtctttgctagtttatctcttgtatgttaattaatttctcgagggtcgccattatcattctgcattaacatcgagactctcgtgtgttcgttcatttctcgagactcgccacccatttattcgttttggattaacctttgaattttcacatgaaattgcttaccacaattttgcttttctcttttttgagttattcaatg

SEQ ID NO: 115089 - DNA, 860 bp, Heterodera glycines
  misc_feature (103)..(103): n is a, c, g, or t
  Promoter: Source sequence=SeqID_44552; Location=230..1089; Strand=-; Gene=SeqID_72033
tttgatagtgaaggcatcagagagccttatttacttttaattaacattggtgcgtttcagagcacgttctaaaaaatatttatgaattatttttgcaaataantaaataattaatgaaaaagtcagaatttcgaaaaatttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcttatttaaaaagcaattaaaatttttaaaaattttattcatctccctttttgatagtgaaagcatcagagagccttatttaacttttaattaacatttggtgcgtttcagagcacgttctaaaaaatatttatgaattaattttgcaaaataataaataattaatgaaaaagtcagaatttcgaaatattttaaaaacaacaagcgttggcattttttcaggttaagttagtcctttacaatggagaaggcctgcaagatttggagagattatatcgattttagtgcgctaggttcgatgaaactttttaaaatataagcctaaactttttggcctgtttaaaaaggaattaaaaatttttaaaatttttattcatctcccttttgatagaaaaagcatcagagagccttatttaacttttaattaacatttggtgcgtttcagagcactttctaaaaaatacttatgaattaattttgcaaaataataaataagtaatgaaaaagtcagaatttcgaaaaattttaaaaacaacaagcgttggcattttttcaggttaagttagtcctttacaatg

SEQ ID NO: 115090 - DNA, 980 bp, Heterodera glycines
  misc_feature (44)..(44): n is a, c, g, or t
  misc_feature (89)..(89): n is a, c, g, or t
  misc_feature (177)..(177): n is a, c, g, or t
  misc_feature (213)..(213): n is a, c, g, or t
  misc_feature (223)..(223): n is a, c, g, or t
  Promoter: Source sequence=SeqID_25317; Location=1..980; Strand=+; Gene=SeqID_56069
gtttgaaaaattttcgatacgcagcacctgcggttttatgaaancgatattgtattttcaaagttttgtgcgtaatgtattcagctacnacagataaaatgatacgtcaatgaaatattgcgcaaagaatatgtgaatattatcggaaagtaagggcaataatatgtgaatcatttnaatcgaagtaaatatgtgaaaataatatgtgaatcnaattaatggngaagtaatatgtggaaattaatatgtgaaatcaaataaatgggaagtaatattgcgcaattatagcaatcactttcgtatttattcgcatataattaaatattgtgaatcataaaatgtacctatccagttatttatatggttttcttaattccatgaaccttcggtttcaaaattcttaaaagcgggccctggccggccggagaattcccggttttctttcgttcccgctcacctttagtattagcaaattgtcaaaaattttggatctggaatccacaaaattcttggttattaaatctatccatatccattttcaaatcaaaatccaggaataaactaggcaacttttatgaaatgaatagttttttcttaaatttctacaataaatttaaaaaagcgcttaaatactctcaccggaaaattttcttgcatctttcataaataaaatagctctagtgcagaaacttcattcgatattttcatgtctttgacttctgttttctttcagtttgggttatttgatttctggataattttatttaatatttattcgatttggatccaggttaaaagacctaaaagccagatccatatgatattgatcaggatttggagtttaaaattgcgctttgcgggaaaataatgattatttatacttatcatattttaccgtgttgatgaattttggttttcttcttgggtggccaatagccataatgccaaattttcagataaatttgaacatattccaaatg

SEQ ID NO: 115091 - DNA, 382 bp, Heterodera glycines
  Promoter: Source sequence=SeqID_4739; Location=187..568; Strand=+; Gene=SeqID_55578
tctaaaaaatttgttacattaaagattaaactatttatttgaaaaagctatttagggatacgatttttaggctctaaaaaaaaaccaaaaataggcactaaaatggaaaatagggactaaaaagtctcaaatttggaaaatgacaaaatctattcaaaaataataaaataagctaattaatattgagataaataatttaaaaccaaaattcttgtcaataaaaaaatataaattttgaagatgaatttttctgaaatttccatttcttaggggtgtatttttgaaaattttcggcttggttcttggggggtttatttttcttttttattactagggttgtaaattatatggattaacatattttttctgcgcatatgctatg

SEQ ID NO: 115092 - DNA, 107 bp, Heterodera glycines
  misc_feature (79)..(79): n is a, c, g, or t
  Promoter: Source sequence=SeqID_30365; Location=183..289; Strand=+; Gene=SeqID_60780
aatgccacagcaggacgaagcagggccgtcaacatctgctgcatcggccgaagaagcgatggagccaccaccaccaacntccagcaccagtgccaacgccggagatg

SEQ ID NO: 115093 - DNA, 331 bp, Heterodera glycines
  Promoter: Source sequence=SeqID_3143; Location=752..1082; Strand=-; Gene=SeqID_83394
gtccaattttttcgtgatttattttatcaataaatggtgattattcatacaaaaagtgtcgtagatatgaaaaacataaaaacaataagaaaactgagtaaagaactatcagcatcaccattccttgcaaatgttcaaatctcttttccgagtcatattcatagtcaagagtcaaatttccagcagtcatattggccgtctacaaatttgatgtggtcagtagaaatgataggggcccaatgtgtatttaaggagtcaatacttatgtttggtattcaaaaatttcgaaatgtcttcctccgtcccatccaaaaaatcaattagcgaaatg

SEQ ID NO: 115094 - DNA, 1003 bp, Heterodera glycines
  Promoter: Source sequence=SeqID_1173; Location=1320..2322; Strand=-; Gene=SeqID_69318
actgaaaggggtgtgtttttaaaatcaaaaaaccaaataccaaaaaattggtaccgctggttttcggtattttcagttcggttaaacgaccgtgactaaccctagtttaagttaattatctattcattactattattattattttattgcatttttatcattatttaaatgatttttttttgaaattatatacatatattaattagcgttattttttaaaaaatattaatttatgaataatcaaatggaattaaaaagaaacgaatttttaacacagtcaaagtgattttatcattaatattaatttgttaaccaattgtcaaaataataacattcattaatttctgtgtcaatcatcgctttgataaattaaaatgaattttcatgtggacaattgaatgtaaagtgattatgttgaaaattttattgtttaatcaacgattgctgaaacgaaatggcgctttaaaataaatatttaaataatggcaaaaacctgtatgcgagtgaatgggaggatttaaatgtccccatcgaaaattcaatgtttacaaatatattggtcattttgttgagttcaattttgatgatgtcatgcctttgttgtgccttgcgcaaggaatgtgcaactttggatttatttatggatttttctgtctggataaatgggaatggattttccggaacggcaaaaattgaaaacaaataatcaaaaagttatgtagtgtattatcaaaaattgactgatttggctcatttttactaaaagaaaaattattatgcacttttattgtggaaaaaagattttttatacgctgtttagttttgttataataattaaaaattgtattatttttttgtgttggttttaaaccaggacctcaaaaatacgaatgaaacattgagccattattttgaatagaaacattcgattaaaaattattttctacaagaaaattactaatttttttatttttttcaaatatatttcagtaaataataaatg

SEQ ID NO: 115095 - DNA, 302 bp, Heterodera glycines
  misc_feature (29)..(29): n is a, c, g, or t
  Promoter: Source sequence=SeqID_6431; Location=3679..3980; Strand=-; Gene=SeqID_61547
ccaaaactttgcaaaacttaaaatttttntggggattccctttagtaaaaatagaagagccgatctcgagttaaaaacataacttcgaaaaaataaacagggattcgatagagggggtcaaaatattggcctatgcaaaatttcaaaaaaagttaccaattgggaaaaattttttccaggcaaaaattcaactaaattcacaactttttttaggctttaaatgttattacacgtaaaaaaactgataaattaatgaaactaagcaattcggggaatgaagcaaagcgaaaacggaaggaatg

SEQ ID NO: 115096 - DNA, 325 bp, Heterodera glycines
  Promoter: Source sequence=SeqID_3591; Location=434..758; Strand=+; Gene=SeqID_50997
tctgtcaaaattgtaaaataaaaataaaataaaaatgaataaatatttttaatttattttaaaaatgtaaaaataaaatgaaaaaaatagatttaatttaagtgttgtaaaaacaaaaaactgaaacatttaaatttaatttaaaaaatgtaaaaatataatataataaatatttttaatttaaaatatttaaaaataaaaaaatttaggttttattttaaaagtgaataaaaacaaaaatgaaaagatttaaatttaatttaaaaagtgcaaaaatatgaaataaatattaatttaaattattatttacacagcgatctgcatg

SEQ ID NO: 115097 - DNA, 87 bp, Heterodera glycines
  Promoter: Source sequence=SeqID_42041; Location=161..247; Strand=+; Gene=SeqID_70043
ggttggtggtttggtgaaaaagcataataacagtttttgattaattatgaaacaaaattcccaaattagtcattgagcattaatatg

SEQ ID NO: 115098 - DNA, 1003 bp, Heterodera glycines
  Promoter: Source sequence=SeqID_11965; Location=663..1665; Strand=+; Gene=SeqID_75484
actggaaactttcattttttgttcattcaatcctacaattgttacatgttacatgtcacatgtaaattataatccatataatattttttcctttgttcattcaagtctaatttgtttacatattagatgtcaacagaaattccctatgaatagattttaatttcatttttgttcattaaagtcaaaattaattatttgttacatgttacatgtaaacataacttccttgggtccaccactataaatatactggaaactttcattttttgttcattcaatcctacaattgttacatgttacatgtcacatgtaaattaaaatccatataatattttttccaattttgttcattcaagtctaatttgctacataatacatgtcaacagaaattgcctatgaatagattttaatttcatttttgttcattaaagtcaaaattaattatttgttacatgttacatgtaaacataacttccttgggtccaccactataaatatactggaaactttcattttttgttcattcaattcttcaattgttacatgttacctaaatgtaacatataaacacaaattccctatgaatagactttaatttaattttcacgttttcaatttttaaagattgcttttattatatggaatccgtttcatcttctttaaagtcaaccgagggccagacccagcagtaagcacgccggcgtcttccatcggaagtaaaaaaagaggcaggccctcgaaagccggagcgaagccaatcttggctacgcaagaaagtgtgtctttcattgacacacctcgaattgccgtcactcaaagtgaccagggttcgccgtgcaagaaaaaagggaaggttgacgaccaccaacccatgtttgctaatgaagcaattgcttctacgcccattaccacacaaaaataccgtggagggcgacctgccaaaaaaattggaggcccaggccgaggcagactcagtgattccatgagcaaaagctcaaaaatg

SEQ ID NO: 115099 - DNA, 566 bp, Heterodera glycines
  Promoter: Source sequence=SeqID_4669; Location=1541..2106; Strand=-; Gene=SeqID_55304
ggtgagaggtaacgtaggattacccgctaaccaaaataaatgcggacctgccccttgaggattgtggttcgtgggcctgccccgttgggtgattgtggtccgaaaggtttacaatgaattccttatcgttaccggccaaaatccggtgcgaagctggtcccgcactttaccaagaccagtggactggtgagaggtaacgtaggatatcggagtcaaccaaaatgtggacctgccctttgaggattttggtccgattacctgccccttcgggattgtggttcgtaataagctgattgaattcgccaatcaatgcttaattttcatctgcattcttaacgggatgtgtgagccggtttctttcttcgcaacacactgtgcgaaaattggacatgcgagccctggcttatggattcgcagcggcatcatggtggcattcaaggaatatgcatcctttttcacattttcaatttttttgataaatatttgatttcatgtggtttaacggttgctttccctaaatactttgccgcatgtacacatcattgattcatttttgttttcagatg

SEQ ID NO: 115100 - DNA, 547 bp, Heterodera glycines
  Promoter: Source sequence=SeqID_21215; Location=896..1442; Strand=-; Gene=SeqID_51805
aacctgatacaaagcggcattttagggcagggatcccagccgagactcgggattttcccaaaaaatgaaaattcaagtattttttctaacaaaggctgaacattagagtaaccaaatttaatcattcaaatattagaaatgttgtaaatttcgcaatttttaatatatcttaagaaaatgatcatttttccgagaccaataccgggattcagggttgggaatcatatcgggatatggttgtcggggggtccgaatcccaggttttctttattgtttcccagaaattccattctgaaaccctgtcaaggtgaaattagcaaatcttctcaaaatttgcgggctccttatttattaccaaatataataaaaaggcttaggaatttagttatattggtttattaatttttagaatgtttattactttctctattattttgattgttttaattccgtccaacggtctctgggtgatatatattcatgcttaaacttacggttggattttgtaaagtgtgatcggaatgaaaggggtgaaagaaacgcaatg

SEQ ID NO: 115101 - DNA, 250 bp, Heterodera glycines
  Promoter: Source sequence=SeqID_9942; Location=1..250; Strand=+; Gene= SeqID_72980
acatacatatgatcatttttggacaaaatctgataagaaacgaccaaacattttcaaaaatttatcgaatagcaatttgaaaaaatgatgcgcattatgaaaaattgtccttttatattagagttgtgagcaatctcctaaaacaaaatttcatcaccatttcctggctataaaagagccaattttctgtttttttttattattctcacatatcttatcttggcgacactattgcctattctttactatg

SEQ ID NO: 115102 - DNA, 1003 bp, Heterodera glycines
  Promoter: Source sequence=SeqID_419; Location=814..1816; Strand=+; Gene=SeqID_52034
attaattaggagaagattatttttaatttctaaattcttttaacaaaattcgcgcactctgcgccttcccaaatcaattttatggtggtataataaaaaaaagggaaacataaaattgccattaaatttttgagttgacaagaataaatgaattgttttgctcattttcagtttattttatcggaaaagagacaattaccaaagcattatattttttaggcttttttacattattaaaaatttaattaaattttccaaaattcaataaaattcattaagccattcatactgatgtgagtgacttctgcggtgcgttcttatttttattttttaggcttttttacattattaaaaatataattaaatttaccaaaattcaataaaattcattaagccattcgtactgatgtgacttttgcggtccatttttcctctggccccccccaacctaagcgaccattaattacttaattgaccaccagctcttttctctcacgcaaatattaatgccatcaataattttgcactcctcctggcttcccccattttggcattgattgtttcgccatttttttcattttttcaaatccgttgccacggcaaatgcgcaaagaaatgccgcagcaggggaggagaaggtttaagaaatatgatgaatgccatttgtgatggctttaagtggcatcacaacgccaagcaaatgcagagaaaaaacaattggggcaaaatttgaaattggcacattcaaaaaattatggtggcattgatgccaccgttgaaaattgagtccatcacattcatttaattttcccatctgccagtggttttcagtgtctgtcttcataatataagtgtgaattctaactgtttaaattgaatgtcagttttaagtatgtaatgtaacaatgatttatatacatcatttattttttcatataatgaaaattgaggtaccactaatgggtgatatgtttagacaaaatatttgccaatatgcctaatg

SEQ ID NO: 115103 - DNA, 131 bp, Heterodera glycines
  Promoter: Source sequence=SeqID_15093; Location=1..131; Strand=+; Gene=SeqID_79270
ccgttcggcaccgctttaaaagccttcccattcaaaaccttcattgatacaccattaataatgaatgatcctacccttggtcgttctacaaatgacaacaaaattttttccagaatttacgcgttagcatg

SEQ ID NO: 115104 - DNA, 290 bp, Heterodera glycines
  Promoter: Source sequence=SeqID_1784; Location=1..290; Strand=+; Gene= SeqID_75953
atcgatgagcatagaattgggccgacaaacgccaaatgcgaggccaacggaggctgagcaaatccgttgcgacacgtcggactttgagctctgccgcttcgctctgatcagaccccactttggacttgcacttcgccaacacaacaaaagtcacacgagtggcaatgagtgccctttgcccgtcactctctgcggatgggtccgtcacaatttggcgttagttcatccagaaacattaaacatcgccgggttgagaccgaggagtgccgttttgctcctttcgccaaatg

SEQ ID NO: 115105 - DNA, 1003 bp, Heterodera glycines
  Promoter: Source sequence=SeqID_8746; Location=1261..2263; Strand=-; Gene=SeqID_69087
tgtccacagagagcgggcgccgtacacagcgaaaagaattagccattggggcccatcggaagtgaaatattggaaccacttaatcaaatttataaataaattcttatggaattccgattaccaagtctgctgatgcgttgtacgtcataagaaaattcacttgaaacagacagaaacttcaatattttaaaaaactctttaaatttcaatcatcgaattaagttctctatttttttaattgggaatttaccaatgagcaaaaaaataataataaaataaataaaagttcgtttcccattagacggattaaatgaacagactttacgcatcacaatattttttaaatcctttactcaaataattccattactcatttttcatcacttaattattttttatgttcactttaatttaattcggcttctttagctgtctccacttttttccaatgctttgtgctcattaatctttggggttttcatttttcttggtcaatcaaatccaacaaatttaaatggctctacaggtttagtagttatctatttagtttgctagcctaatggcctggcctcagtttttgattaactttgtcgaatgttcagaacagtgtaaaaaaagaagaataattaatagagaccgagccggaccggatccggtaccggatttttctggatccggcaatccggtccggcgattttgggaaaaatccggattgaccggattaccggattgaccggattatgagagaccggatccggaatccggtcatttttgaaaatgccaatccggtccggtccggcgaatttttgaccagatccggtccgactcggtctcaaccaaaaaccttcttttgttcatttttctttgaaaaatatctctggcataatgtctttaacatttaatcattttgacaaatttcaagtgggatttatgtgtaattttaataatctaaaattttttaattgataatttatgtcttctttgttttaggtttattaaaatg

SEQ ID NO: 115106 - DNA, 278 bp, Heterodera glycines
  Promoter: Source sequence=SeqID_41723; Location=103..380; Strand=-; Gene=SeqID_69792
gcttaaatttttgttaatgattttttattaattttttttccaaaatttcaccctcaaatttcattttgaggaacttcagcaggtacgagtggaacagcccattgctccaatcgcacgcgagccgccagatgtaggcacggtacacatgcgtcacctgtacccagagcggagggcggcctccagctcaatgtgcgtgacagttgtcgaaaatcctatcaagaaaaatatttgcttaattataagtttctaaacccacccctttcagagtcctcaaaatg

SEQ ID NO: 115107 - DNA, 56 bp, Heterodera glycines
  misc_feature (34)..(34): n is a, c, g, or t
  Promoter: Source sequence=SeqID_329; Location=1..56; Strand=+; Gene =SeqID_82634
aaaggttagaatttttctttgtcaaccaaatcanacatttgttggtagcaaaaatg

SEQ ID NO: 115108 - DNA, 173 bp, Heterodera glycines
  Promoter: Source sequence=SeqID_1480; Location=11242..11414; Strand= -; Gene=SeqID_73814
caaactgaacaggtagattaagctccaaaaaactacaaaaacaatagcaaaaaaacccaattaagctaccgaatggtggaagtagtgctcgaaagtgcgctgaatgtctgttcatcttcccaaatggtgggtgctacgactaccatctcagcaaccacgctccagctccgatg

SEQ ID NO: 115109 - DNA, 1001 bp, Heterodera glycines
  Promoter: Source sequence=SeqID_13703; Location=2028..3028; Strand=-; Gene=SeqID_77619
tttttttgacaaatgaatttgcccgaggggtgcattcttccctcgtgaccggaaaatcggtcagtggaaaatgcgtcagtggaaaatgcgtcagtagaaaatgcgtcagtgatgcaaatattttaaaataaaattctatggcattagtattgtaatatagaagtaaacttctataagaaaatcattctcaattttttaccccggacccaaactcgaacaaaaaatcgaaagtcaaaattttcgaaattagtgtttttcttcaaatcggtttaaatacacagaaacaaactgaaatacatcaatcctgcaataggagatcatgtatgccgtttttgaacaaaaaatgcttaattcgaaaatttagacttgcaactttttgttcgaattcgcgtccggggttcagaattggccgaaatggataccagattcgtggtaagtgcccccgaaaacgcaaagaacttgtttttatgacaataaaattttcactgacgcattttctactgacgcattttccactgacgcattttccactgacgcattttccgggcgccagccggagcagtgaccaaaggcgtcgccgggaagtttttcataaaaattgcaccgtaaagaaagttttatgaattttcaacacgccactggtagaagttggttttaacctcataagtgcttgttttagggcccatttttaattggtatttaaaaaatccgacctccaaatattcataaaaaattatatagttatttgatataattgcagaaatatatttttacattattaacgattcattgtcgacattataatgccacgctttcctttgttaatgcatccatctcccatttacgtatttccattcagtgatgggcgtgacattttatttggcatttcattaccattctttattatatgctattaatatatatttttaaatcacaattttataattattaaaaaattttttttattgaaataattcctgtttagaaatagtaagaaaatg

SEQ ID NO: 115110 - DNA, 216 bp, Heterodera glycines
  Promoter: Source sequence=SeqID_1576; Location=7792..8007; Strand=-; Gene=SeqID_74562
tttccaatggcaatttgcattataaattttattttacatttgcagaagttgatggcactgcatttattgacagtttggaaaccgatgtaaccagtgggggaaatgaggaattaccattaactggtcggcaacagctgaaggtcgttgaaaattcatttttcaatttaaatttttcaattttaatcataggaatttcgtgaaaaatttgtcaaaatg

SEQ ID NO: 115111 - DNA, 518 bp, Heterodera glycines
  Promoter: Source sequence=SeqID_14784; Location=1..518; Strand=+; Gene=SeqID_78925
ttaataaccaaaatcaaaatgccaacattaaatgatcacatgtcgtcctcccaaacttaggtacagtaagacttcaaaaacagaaaaaacgaaattacggttgccgaattttttttcaaaagaagtcgtctggaatttgcgttatctctggaaaatagcttaaaataggtcaaatttgccacaatatataaatatgagcggtattattcattcaaaaaccagataagcaccaattttcgctcaagtgatcaatagagctctgagtcttgaaaaaatatcgatcgcgattcgggattggaatcattccgggatagttttactgggattcaaatcccgattttatcggaatccgatcccggccctttttaagaaaaaagccgcgatcgggattgagaccccgggaaaatcccggcgggatttcgatcccgtccgggttctcgtgatcagaaatcagttattaccattatccaccgacttttgtatatttcaagaatatttagattgaacaaaaaagtatg

SEQ ID NO: 115112 - DNA, 142 bp, Heterodera glycines
  Promoter: Source sequence=SeqID_1779; Location=3013..3154; Strand=-; Gene=SeqID_75906
tccttgactttttgtcgggtagctccatttttcaatttcttcattatcttttctatcaattttctttatttttaggtttctctgttcgctcccttttcacaaattgtcaaatattttttcatttaaaaaaaaattcaaaatg

SEQ ID NO: 115113 - DNA, 696 bp, Heterodera glycines
  Promoter: Source sequence=SeqID_1338; Location=5338..6033; Strand=+; Gene=SeqID_72881
tttgaattatatttaaaaatggaataatgaatgcataatgaacgaaggagaaaaaaagggcacaagcaccgaaattgccgtcgcaggacataaaatgacgcaattaaatgcccaaatttcaagcacacattgatatgccttgatgctttggtctatcaaacacctgctaatttaaaataaagtcacatgcaaatgagtcgaataagcggatattccataggtcaaggtcataaattatgcttctaagtaaaaattgcgaacaccccaaaaatccgacatctgctaattctcactattcattttaaaatttggctaacattttgcattttttttaatcaataactatctcatttttgctgttaatcagggcggttgatcaaatcctggtctccgtttatcctgacagcatctcttttagctcttcatggtagatcaataaacttttctaatttcccgagccgtttaggtgccctgtcgtcttgtgcttcatatggcagtgcgcagctcatcaggccaagatttgtttgccattaaaaaatatgattttttaataaaataattaaaattatgttatttcatttcatttgtgctttttccatttccattatccgtcaattataaaatgccacaagtctagctattttactcatttaaccaaagttaatccctaattatttaaaatagattacaaaaatg

SEQ ID NO: 115114 - DNA, 559 bp, Heterodera glycines
  misc_feature (29)..(30): n is a, c, g, or t
  Promoter: Source sequence=SeqID_28325; Location=595..1153; Strand=-; Gene=SeqID_58955
ccatttctgctgaattcatatctatgtgnnttagtggtacgggatcggaaacagggttcttgtttgttttccacggactcaggttcggaaatcaacttttttaggtattcccggcctacaaaaaaagtctaccggcttattttcataaaacaaagtttatctaaaaagaaaagtaaatttccgagcaaatgttacaattgttggtgagaaaaaggcaaagattgctcaagttgcaatcagtcagtttgatctttctcgcactaattaatacacagtgaaaatagaattttcaaattccctcttttttcaaaatttctggcgattcgttttgagttttcttaaactttatatgctggcgttaaagttggaatcgatgtccctagagcccgcaaagttcgaatttgcggtcccgctgcgggaatggaactcataatttttgcgggacgaaatccagcgggataatctcgcaaaatccccgcgctggatccctcccgttccgggaaatctgttgttttaattttttttctgatattttccaattaaatattcaccggttatg

SEQ ID NO: 115115 - DNA, 309 bp, Heterodera glycines
  Promoter: Source sequence=SeqID_31366; Location=85..393; Strand=+; Gene=SeqID_61731
aaaatagaattaattttcatgtacgaaatcaagaaaaaaattttttcaattattttttaaattgtttcacttaattcaatcatttacaaaataaattcaatttagaaattgaagaaatgtaaattaaataaaatattaaatgcaaccaaacaaaactaatataataaataatataataatattattttttgtacaaaacacataataagttcgagcgataataactttttaaattctttcaatgtgaattaaaaataaattgataaaaaatataaacaaaaatatttgtcaaaatttaagacaaaaatg

SEQ ID NO: 115116 - DNA, 373 bp, Heterodera glycines
  Promoter: Source sequence=SeqID_14003; Location=662..1034; Strand=-; Gene=SeqID_77972
gtatatacattatacatgaagtaagcgttggtgtgggtggtgtcatggcataagccagcagcagcactccgtttatttattcgtcgtaatgcttgttaacggggggggggggggggatgaggtgaaaacattgtagggttgatggttatacacactttataaaatccattcaattggattttacaaattctctgaatagagagagaaagggaatgagaaagagagatgctgcacgcattaaatgccacgtttgatttgtgccaaaaaatggcaatttaagcgcggcgaaaaggaaaaaaatcagaatttaaaaatcataaaaattcaaactcatcaaattcactcaacatcatcaccaaccgtgaacattatg

SEQ ID NO: 115117 - DNA, 700 bp, Heterodera glycines
  Promoter: Source sequence=SeqID_2913; Location=1771..2470; Strand=+; Gene=SeqID_82308
ggtgggcaacgaactgataaatggacaaatgggcacagcgcgtccgtcctctcacttttcacttttataattgagttatttactcctggatcaaaactcggaaaatcgagagagatattgtacagacttttgcagttgggaagcaacgatttaaatctcgccaactaagccaaattcagacatttcgccaactaatataaaatcattttttaatttatataatgtttaatgttattagtcattgctctgaattgttaagagagcaaccgacacattgctgaatcgctgatgagagcctggtttctcatagataaacaaatttgcatgaaattttattattgtttcataattaaaatcagttttaatctacatagttggcaaaattagttggcgaaacgtccgaatttgggtgagttggcagggaccagagcgtttgggcccccgtttttgggcccccgcgtttggacccccgtttttgggccccggggtcgtttgggccccaacccaaaaatagaaaaatgtgcttttttaaaaattaagattctaaaaactaagcctgagggatccctcgccacttggcataagttaggtttaattaacattcgctcattttttacaattttacttattccaaatcctattattttttaatagttaaccaatttgatgtacattctgatttgtaaatttttcagaaatg

SEQ ID NO: 115118 - DNA, 427 bp, Heterodera glycines
  Promoter: Source sequence=SeqID_43728; Location=424..850; Strand=-; Gene=SeqID_71334
ttcccttcaattaaaaattcatttgttttaagtgcttttcgcattttaccgaaataaccgcaaaaatatgtatttcagtctaattgtaaggcacaaataaaataggttttagcaattttcgcatcgaatccattttgtgcgtccaatcaaaactttacgcgtcaaatcacagattaagtgtcccagcaatgactatataggccacattcttggtatcaattgaaagcttaaagtatacagaagtttttgtataactaatttgtgctcgaaacagtaaacaaaaaattatttacaaatatagtcgaagaaaagtagagttataaaatacatcataagtcataaccagacaacactaaattatgttcacaaaaaacaaataaattgttacaatttaaggtaagctaaatatttccctaaattgcaaatg

SEQ ID NO: 115119 - DNA, 1003 bp, Heterodera glycines
  Promoter: Source sequence=SeqID_9835; Location=985..1987; Strand=+; Gene=SeqID_72854
tcaaatttaattttggagattaacagcctttttctttcttaatgatttacaagtcatcctaatattcaatttgctcagactaacagcaattgaacacgatataaattataccagctgggaagctcctgtcaatctttgatcattttggatcgcatttaacacaaaaagtttgtaaattaaaatgtatttaaagatatatgaacttttttgcctttcccacaaaaaaatgccattcattagtgatgtgaaaatctttcactccaaaagggtgaaagcgaaatcaaaccctgctggaaactggaagtctttataaattgaaaatttttgaaaaaataaaaatgtaataaaattttaataattcattgattttcatgaaattattctaatgcgatttgttaacagattttgagaaaattttttcaagaaaatatatatttttagggtcgggcggtttttatttttttataagtagccctaaataaaaatgttctgagaaaatattttgggcttctctcgccataataacgcatagaaaaatatgatttaaaattccgggctctgttctaaaaacaaatctccctgagttggttcaactcattcaatccgctctcctttcttcagaacaatcattaatgactctgatattaaaaagtattataaattcattcttgctttgacttgtggtcctaacaatgattccacatgttaatagaaaaaaggggatcttcatgaattaccaaaacacaagtactatttaatgaagtagttaatcttaaattgtttttgaatatgaaactttccaaaataatcaaagattgataagggcttaccagcatttggtacaatttattttttgcttccccggccctcgggaatagctttttctctttttttataatgatataaataaaattttcattcatttttttttgaaattgtgtatatcctcaaatgtcgggtcctcaaaagtcgggtcctcaaatgtcgggaatatccgcaaatg

SEQ ID NO: 115120 - DNA, 91 bp, Heterodera glycines
  Promoter: Source sequence=SeqID_519; Location=4094..4184; Strand=-; Gene=SeqID_55099
ttttgttgcagcaaattattaagacagttttcggcactttttcagtttcgtaaatgggctttattttcttagaaattcatatgaaaaaatg

SEQ ID NO: 115121 - DNA, 651 bp, Heterodera glycines
  Promoter: Source sequence=SeqID_18950; Location=700..1350; Strand=-; Gene=SeqID_83682
tttttggcctttcatcactgttcaaacaaacaaacaaaaaaacatcaaaaaagtttcgttctcagtttctccttttaacccgaaaaattattttaattcaatcaaatcgctggaaagtttttcaataaattgtttttttaattttcttattaagaaatttcttaagaatttttttggaaaatttcggtttgaaatttttaaaaaaaatttttcgggggcgaaacgacgcggggggaggagaaacgacgactcgctcccctgaatttgtgcgtttcgcctcacaaaaattttttgcgtctgaatggttccagctattgggggaagagggggctcacggctgcatgcgtaggccttgaaatcggggtttcattgagaattcttgaacgcgtgcgtcattttttgaatctttgtgattcctgggtggacccttgggccccgttgtttctgcactctctcacttttcacaagtgccgtcgccgctggggaacagtcccggctcacagccctggcacgtgttcagtccgctgtggatgtgaaaggacagccaaatttgctcggcggtgccaatgctgaccacgtcctcgtgccgcacggtgtggctgacgccgggctgaacattgcgaaattgggtttgaaaacccaaaaataatg

SEQ ID NO: 115122 - DNA, 283 bp, Heterodera glycines
  Promoter: Source sequence=SeqID_44147; Location=557..839; Strand=-; Gene=SeqID_71675
ctcatctccttctacttttccctgcttaatttgttttgttatgcctttggcattgccaatttttctcactttttgtgttcaacaactgttcaatttactcatgtcaatctcttcttttcgatctgttcttttggctatgtctcaatgctctccatttttttcctcttctttcgacggacggacaaattaataaattgttttattttgggataacatttaattattcatttggatattaatgttttgtagattttgtataatttcatcaaatctttgagaaatg

SEQ ID NO: 115123 - DNA, 896 bp, Heterodera glycines
  Promoter: Source sequence=SeqID_22; Location=733..1628; Strand=-; Gene=SeqID_78599
cggttgcacaattgtaaatcaaatacatttgaagattttcaagcgtaaaaagttttcgatcgtccgccaaatcatggccaggatttttgctttttgaaaaatcaattcttaggggtgcattttttgaaaaaatttatgtggattcttaggggtatatattttttaaattttttttattattgcattttcataataatttgaaaaaatagttttttttttaaattcacaagtcaaaagagttattaaaaagtttcataagcgaaaattctgtagttgaaaatagttgctaaaaaggcgctatatatcgaaaagtgttcgaagaaaatttgttttttgcgcttatcagttgggactggatttgtatggatttccattttttttttgcctacaaaccacgtaaatagtgtttttagctttgtttgatgcttctaggatccttttttacttcatatttttccatatttcagatttttgtccatatttccatatttgacaatgtgttggactcataaagtttaatagagttaaaacatttgttttaattaacccttattttcctaaataccaatattttaagtgaagaaatattgtaaattttcaactttcaacttcaaacgtcaaaaaccattgccagaaaatgaggaaggagaacaacaaaagcagtgccgcctcagcagattctgatgccaatgccaaaagtggtggcgatgcttctctcaccgcccccactgaagaggaggcggaagaaatcagtttaattattataatacgtttggtttcactaaaaattctttctttaaattaaattgtcaaaaatatttggaaaaataaatgtaacgctaatccctttcttcgagcaaatttgcacctaattaatttatttacatatagatatg

SEQ ID NO: 115124 - DNA, 419 bp, Heterodera glycines
  Promoter: Source sequence=SeqID_23584; Location=1..419; Strand=+; Gene=SeqID_54275
atcagggcttctttttttatgtacctgttttgttcctgcattctccatagcctaattagtaggaccccactttctttttcgtgtttgcgaacaaaaatcgggacttttatttacatattccgagctttttatacatatttacacatatttcgggtttttgtacatatttggtacatattttggactttttagcattttttactaatgaaaaattaaaaattttttttgaaaatgtacccctaaaaaatcgttttttttaaagatattaaaaatcaatttttaaaatactaaaaatgtgaacgaattgttgcattaaaatgagaatttcccgactaaaaatgtgttttttgtgcacttctcagtgaaacgaagcaacagaaaaaaaaaatgaaaaactaaaaatcccatccctgcagatg

SEQ ID NO: 115125 - DNA, 107 bp, Heterodera glycines
  Promoter: Source sequence=SeqID_10696; Location=1237..1343; Strand=-; Gene=SeqID_73946
ttttaaactgacatttaaaaataaatactatttaaatttgtatttaaatatttaactttgcaaaaatgcgcgccaatttgtcttttctcctttttgtcttcgttatg

SEQ ID NO: 115126 - DNA, 78 bp, Heterodera glycines
  Promoter: Source sequence=SeqID_24906; Location=355..432; Strand=+; Gene=SeqID_55654
atatttatccatcaacatcttaaaagaaaagtcaaaataaaaagtaaagggaattaattcacttctcttgggaaaatg

SEQ ID NO: 115127 - DNA, 556 bp, Heterodera glycines
  Promoter: Source sequence=SeqID_33371; Location=239..794; Strand=-; Gene=SeqID_63450
agtcagtcatttaaatatttttatccaaaaaaatttttttgggtttcggggcagtccccctgaaccgatgcgcccagatttatggggagaccgaatccttccggaatagcttcactatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttcgggaatagcttccctatagcctgtactttaattctgcgttggatttttgctccccataattgtttgagtaccctaaacggacacttgaaaaaatcgatttttttgtttcataaatatttttttcagaaagagctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatg

SEQ ID NO: 115128 - DNA, 178 bp, Heterodera glycines
  Promoter: Source sequence=SeqID_10264; Location=847..1024; Strand=-; Gene=SeqID_73422
tttcgctgcccacttagagatggcattaattcttcataaataaatactaattaatgtacaatgcaattttgattaaaaaaacccttaataatttcacccaaatttcatactcttagaaatattcgcgtttaaattaatttttttatttatcgtgttgtctattcaaatttagaaaatg

SEQ ID NO: 115129 - DNA, 1003 bp, Heterodera glycines
  Promoter: Source sequence=SeqID_21445; Location=622..1624; Strand=+; Gene=SeqID_52053
aaaatttttctgcaacttcgtacatatgcttaataaatatttcagctcgattgaccaacagaaacttagtatttgccatttttcacttttttcccatttttggcattattttttaaagtaagcatattgcattgacaatttaccacagcagcagataatttaaaaatttgattgaccatttcgcaatggcaaaagaatatttgagcaaatggttgctatacatttatttgtttttaataatttttcattaggtccatttttatgaatttccatattttttcctcaaatattttggattaaatataaattaaaaatagttaattatagcttggttttaagtttttaagtcaggactcccatcggatgagttctagtcaaacaattttgactaaagactttttgaaattttatgactataactttttttttataattttgtaaaaaaaaaattaaattaatattctgataggagaacatttagagctttagaatgacaccatgaaatatgattttttttttgaaattgagccaagatacgaatttatatgttttacattttttatgttcctacaacttggcagttttaagaaacgcccatggtggcgctttttaagaaacgaccttcggaagggttggtcctcaaattccccaatgtttttggaagttcttaaagcctaatttcataaatttttttatatcccaccccccccccccccacaattatataataataattataataaaaaagaaaaataaaatattgtacaaattatatcgtcacatttacgtaaatgcgccggaaatccaaaaaatggcaataacaactatttttttcatttacgtaatttatattaattacaataatataaattacatttgcaatattgttggctttgtaaggctcgacaaatgtttgaataaagcaatgaaaaatggatagacgattttaataatatgttttatttaattccaaactccgattgaacaactaatttttcagatg

SEQ ID NO: 115130 - DNA, 443 bp, Heterodera glycines
  Promoter: Source sequence=SeqID_23375; Location=952..1394; Strand=+; Gene=SeqID_54082
attaatttattaattaaaaattggaataaaactattcccagagtatcgtcgtcgtcaaccgtgccccttccgttctgtatatcacttgtgaccctaagcatcacacagaatttctgcggaataatggccaattgctaaaggagataaaagaggaccatggacggtgcctcatcaacctgaacaaaaaaatggaacgctttgagatcagttgcgatttaaaacatagcggcaaccgatcggcggcaattgagtcgtccaaggcgcacattgagaagatcatcaatatgttggtgggttgtagaagattatgagtcaacaaatgcccattctctgtcaaggagtccaaggtggttcaccacgtgctcattccaattcgccaccatcgcaaattgggcccacacctcagctcccttcgggagcagttcaacgtccgtattcaaatg

SEQ ID NO: 115131 - DNA, 1003 bp, Heterodera glycines
  Promoter: Source sequence=SeqID_8413; Location=768..1770; Strand=+; Gene=SeqID_67979
tttgcttatctgataatgtaaaggaactttcgaatgataccatgtttgtttgatttgtccaacaaagaaaaacagttatgtaaagttgtctctcagacgcagttggcccgttccgtcccgttcataatttaaatcgacctgaaatacattaattaaatgaaatttaattggtttttttaatccgggccaaagccattcgggactcaaccgtcggggcgcaaaaatttggtccgtcccttccgcattgtgtgaaatggttgctgttcggtgggacacatcttttttttcgtcacaggcggaagcgccaatttgaaagaaagggaacaccgaccgaacggcggagggacgaaagggcaaaatcgaaaaccaaaaattggtctcccgtccccaaaaaatttattattttttttcaaccactcgtaagtttctgcgttccattccattgctcatccgtacgtttttgtcccccgaaatatttgccgataagctaaaatatttttaaaatttagaaaatttatttttgctttagatttgcttattttaaagatatatttttgcttgcacataaaagggtgatttcagccttacaaatcacaattttttaacaaatccaagcatcctttagctataatagcttcttttctttaatttctttttttaaataatattctttatataatggaaaatgcggataggcgccgccggaaaattttgaaaatttgattgtgaagtgttaacagattttcaccaaaaaaagacaaaatttttgcgattttggtcaatttgttaagaaaaattgtgcgttattttttggggttgggcggtgccattggcgctgccgggagaaaaattataacttttgacccttttaaacagattttcattgaaaattgtctatttctaggttaaatttagtaaaaattaataattgttttgacaaaaggccaaaaaatttaattttttttttcataaaatctacatttttacttcatacgcaaaaatg

SEQ ID NO: 115132 - DNA, 1003 bp, Heterodera glycines
  Promoter: Source sequence=SeqID_4608; Location=4735..5737; Strand=+; Gene=SeqID_55071
aatgatagcaaggtttaaaaatttggttgttttagagcaaagttataagaaatttttttttttttttgatggttttagaaataacgcgcataatgatggtttttaaataatgacaaagcacccaaaataccatcaaatgggaaatttttgacagaaataattcataaccttgctcgaggaacaaaattttgaatttttatattatttctaagaaaattttttgaactttggcatgaaatagagaacatttagggctatagaatgatattaagaaataaaaatatggttgctttttagaaaattataagcaaaaaaaattttaaaaaatttttgtacggtaattcaaaatttcaaaatttgtcgactgactgttaggccttatacaaatgtattttttctgaaaaattttacattattctgacaacagcattttaaaacttcgtgaattttaacctaaattcccagccctactaataatgtgataactgaaaaattaatatttgtacaagtaattcgaaccggtaaaagcttacaaaaattttggaaacaaatattttaatttttaaaaaaccgagcttatagcatattaaaaacccatttattcaataatcgtaataatataaaacattaaaaaaaaattattctgaatttgcactttatcatatggatatattatagtcaatgaaaataattcatacaaaaaattcatcatatgattcgggcatttctcagcaaatgtgtttctcttcaatcagaaaaaatccattcgaaatattttacaaaaagaaatgctttattttatttaaaaaattattattattattatatatctggcccaaattatatagaaaaatgaaaaaaaaaattaatatagaaaattttttggaaacctttaaacgctttttatctttttttaagttcttaatcattctaaacaattcacccattttttaaataatataacgattaaaccgttaaaggttaaaagcttttctttagaatg

SEQ ID NO: 115133 - DNA, 85 bp, Heterodera glycines
  Promoter: Source sequence=SeqID_5939; Location=2148..2232; Strand=-; Gene=SeqID_59740
ccctaagggcattgatccgccgtcgttggatttgttggcacagcacggcattttggccctgcgacgtgccaagcgccggaacatg

SEQ ID NO: 115134 - DNA, 488 bp, Heterodera glycines
  misc_feature (59)..(59): n is a, c, g, or t
  Promoter: Source sequence=SeqID_824; Location=1..488; Strand=+; Gene =SeqID_62122
ctaataataatgggttcaactttttggcaatttccggaatcatttgcacgaactttgancactgggaataaccaaaacaacgcatacaacaatgctaatgaaagtgggcaaatggtaaataacaatgtcggatggatggattgatcacaaactttaatcaattttgcaaaatagttcatgtatttgaatcatcatttcataataaatttaaatattaatcattataaatttctttaatcccctttggtgtttgaatacacccgtaaatgtgacaagcgcatcgccggttagcggcatgatgcattagtttctcttttgtgccggttcagaaatgccgcacatccctttgttatttgaatttgaccccgttcgcatcggtcaccgaagcgtcggaccttggctacacagatggccacgatcccgcctcatataaaagggcacatgggaaagtcgccctcttttttttcctccattcaccaccaaaaatg

SEQ ID NO: 115135 - DNA, 155 bp, Heterodera glycines
  Promoter: Source sequence=SeqID_10547; Location=1..155; Strand=+; Gene=SeqID_73781
ctttaaatctttaaaaatggttaatcttttttaattacatacacttatcgaccgtagttattagtcgtatctttttgccttttgtaaaattagtgaccaaattgctaaatgtttttactttaaaaatataattaaataatttctttcataaaatg

SEQ ID NO: 115136 - DNA, 1003 bp, Heterodera glycines
  Promoter: Source sequence=SeqID_16787; Location=36..1038; Strand=+; Gene=SeqID_81203
ccaccaaaattcaaattgctttgttggttcctttttgttttgtgcgaaacattgagccatttaaatgagtcagcgaacttccacttaaaaaattttgttattctaatttcaaaagttttacttaaattaaatcaattatatgtctatctggaaaggtttttgattcactgtattataattagacagcatgttcaattttgtccattcactgcacatctttaattcatatcataattatgattattcctcaaatgaatccgtctgtggctatttcaatctataatcgtcgtccagcataacgcaatctcgttcaaggataattctctcacctcccccccccccctccccccactttcttccactcatttttcctctttatctcttccgcctcccctccctctttccttcctcttcttgatggtcaataaaacatgcaaatatatggatttctttggttttaaatagggttcctccccgacatgtttcggggaattagtaaattgcacttgaaataagatggaagaatctttaaatgagtttttaagacttttttgttctggactttttctttttgtgtttttttagactttttatgaaaatttcctccccgacgaaggtgttgctccccgacattttttaaatttctccagccatccccgacaaattcattcgggggatttcctccccgtttcccgacattttgctccccgaggctcggggaggaaccctagttttaaatctcaaattgagtaggattcaatttttttttttatccatttttggctcagatttttagcatttttcaaatttttgcctcattttagttttttacaaacgcacttaaaagaaatgtgtttcaacccacatacaatccaaatttttatgaaatctacactaattttgcaaatctttcaagtttcagccaaaatattcattccatttttgtgccaacaatttcccagccgatggcacttttttgtctgtaaaaattgcgccaaaaatg

SEQ ID NO: 115137 - DNA, 1003 bp, Heterodera glycines
  Promoter: Source sequence=SeqID_1734; Location=4315..5317; Strand=-; Gene=SeqID_47009
tacaaaaatgatttagaacaatattatagtacttccaacatgaaaattatatacaaaattcggttaaaaaatatgtttattatataattagcattaatagattattttttagcatgtgttgacttttaattttaaaaattaatttgcacaataattaataaagaaaaaagaaaattatatagaaaatcggttaaaaaatatgtttattattaattagcataaatagattattttttagcatgtgttgacttttaatttttaaaaattaatttgcacaataattaataaagaaaaaagaaaattatatacaaaatcggttaaaaaatatgtttattattaattagcataaatagattattttttagcatgtgttgacttttaatttttaaaaattaatttgcacaataattaataaagaaaaaagaaaattatatacaaaatcggttaaaaaatatgtttattattaattagcattaatagattattttttagctgtgttgacttttaatttttaaaaattaattagcacaataattaataaagaaaaaagaaaattatatacaaaattggttaaaaaatatgtttattattaattagcataaatagattattttttagcatgtgttgacttttaattttaaaaattaatttgcacaataattaataaagaaaaaagaaaattatatacaaaatcggttaaaaaatatgtttattattaattagcataaatagattattttttagcatatgttgacttttaatttttaaaaattaatttgcacaataattaataaagaaaaaagaaaattatatacaaaatcggttaaaaaatatgtttattattaattagcataaatagattattttttagcatgtgttgacttttaatttttaaaaattaatttgcacaataattaataaagaaaaaagaaaattatatacaaaatccggttaaaaaatatgtttattattaattagcataaatagattattttttagcatg

SEQ ID NO: 115138 - DNA, 1003 bp, Heterodera glycines
  Promoter: Source sequence=SeqID_17321; Location=449..1451; Strand=-; Gene=SeqID_81792
agatgtgtaccaataaatagagaatgccagagaaaaacattatctttttttctctaattttttgtctccttttggcgtactatctaatatttttattattaggaaaaacaacatttatttcgtgacgtttaacttttttcctgcacgttaaatccacaccaaattttgtatatcgatagagaaaaaaattctgcatctaatgataggtcaggttaatttgaaaataggtcgattcgagaatttattcaaaaaacaaaatttcaaagcatcatatcttttttctaactcatctaattgcttagcatttgcttacaaaaagcttctcctcataaagagctttcgaatgatatcaagtttttccaatttggttgggaaaaaccttcaaaaataattcccaaaattcggcattttttaatattttggacaaaaataaataaaaatattcatgttgcacaacggactcgaaccaccaccctttgtccctttactatcttacaaaaaccactgagccacacatgcaaatcttttctggtacaggagctcatttctgggatggtgtgccctaaaagtgattttgggcaataaacgtgaattttggtgaaaagatgaccgtaaaaaaaccttttttcctattgatcaattgcttagcttttgcttagaaaaagcttcttctcatcaagagctttcgaatgatatcaaaattgtccaattttattcactcgtgtaaacacagcggcccaattttgggctcccagtgcaaataagattattatttatttagtaatcagaacgccaaaactttgcaaaacttaaaattttttggggattttcccttgtaaaaatagaagagccgatctcgagttaaaaacttaactttcacaaaataaacttagaatcgatagaggaggtcaaaatatgggcatatgcaaaatttcaagaaaatcgcaactttggaaaaatttttacgactgcgcgaattttcaatattttagagctaaaaatg

SEQ ID NO: 115139 - DNA, 747 bp, Heterodera glycines
  Promoter: Source sequence=SeqID_26074; Location=1..747; Strand=+; Gene=SeqID_56820
aaaccgccacattgggcgtttcttaaaaccgccagggcgtttcttaaaaccgccagggcgtttcttaaaaccgccaggtgggcgtttcttaaaaccgccactttgggcgtttcttaaaaccgccagggcgtttcttaaaaccgccaggtgggcgtttcttaaaaccgccactttgggcgtttcttaaaaccgccaactcatatgattatgtatgtatatccgttaaattaaatattcaataatatctattaatttttatttgttgtgcaagtaagtgtcagccggaaatattattagtctagcagtgacagactaaaaatctttattaaattaatttacaattatttacttaatttttatttggttgtaccaataggtgtcagcaggaaatatgaggctggcagttttattacaatttaaatggtataagtagctaaatttctttaacatacatttattataaaaaatattattgccttaattcctttaataaattaatccaatgttattagcatttatattcttttcattcataaatattattaattgtattagctttgatgaatttgtttcaaacaatggcgcaaaaggcttggttgaccaataccttaaaaaagaaataaaatccaaaggagaattgttggaaaaactagccgaaattaagttgacctaagcttcaggacgctggaaagatatatttcaaaaataaaaaatcgaaaatcaacagaaggaaacaaagacaacatg

SEQ ID NO: 115140 - DNA, 1003 bp, Heterodera glycines
  Promoter: Source sequence=SeqID_10931; Location=1524..2526; Strand=+; Gene=SeqID_74236
tttgaataataccatacaaataaatacgatattgagttgataaataatgaaaaaaaaagttttttaaaaaaggaattgaatacttaaaagataatttaataattacataaaataaatgtttaaggacagaattacaaattaataattaaccaaataatatttatcttgtttcaaaattatcctaatacaataaaaacaagaaataaacattaatataaaaaacttaatttaaaacaatttgaataaaattattcaaaaaccaaagtttttctgcttaaaatgtaacaaactcctatataagacgagatttttttttgtaagaatatgaacgcgaaaagtatttggtattatattaaactaatatataaaaataaatataactccaacatccttgagaaaggatcagctctatagttttataactaaaatactgaacaaaatattaaagattaataaatttataataattattaagtacttttaaaacaataatattttcttttctaaaataatcattaaataaaaattatttatttcgaaagagataaaagcagaaaaataaattactttcacagatactacaactaatagaaaaaaaattaaaaaattaaaataaaaggtgaaaaaatcagtttaatactctgcaacaacgaacaatgactcaacaacaagatagaaatgctggttcggatgaagttaaataatataaatatataaagtcaaattacatagctaaaaatgggaaactactaaagattgtttggacattttcaaacatgttttaacttaaataaattttaaattattttacttataatagggtatttacacacttttgggtattaaaataaataaataattaatcaaccaatcacatacctctaaatataagtaaattttctataaattattaaataaaggtattaaaaataggaacacttataatttttttggtttttcttaattttcatcaaattgattgaattagatttgatagtaaatg

SEQ ID NO: 115141 - DNA, 453 bp, Heterodera glycines
  Promoter: Source sequence=SeqID_11789; Location=1446..1898; Strand=-; Gene=SeqID_75288
tgttttaatcaatttaggaactaaagtgagaatttttaaaattttgagttttagactttttgttcgaattcgggtccgggattcgaaattggtccaatgaaggtcatattcgtgatcagcgaccctgaaaacccccataaacatgtttccaatactttccagaataaaaaaatttttcgtcaaaaaggggggggggtaccatctatagtattgccgtcatcggcacttatcttggttgtagagatggccacctgctgtagctttggggtatttcttttggtgtcatttgatgttgcataacggtacagaataataaaggcttaaaatgtttaaaatttatggtcgaatttaaattaattaataaatataagaataacacaattaatttgacaattaattgtccaaataagatcgcaaaaaacaacaaattttctttcctaattaatcgacatg

SEQ ID NO: 115142 - DNA, 789 bp, Heterodera glycines
  Promoter: Source sequence=SeqID_15637; Location=368..1156; Strand=+; Gene=SeqID_79936
ataaatattaaaataaatcggtgttaaaatgtaaaaaccatttttttatttaattgtggacgcgtgtacaaaatatgattccagggtatattaattattaattttaaatgtttaattactattttttcaccagactaaaatttaacaattattttatctttttataaaagtttccttgcataacattaaaatatttctgcaactaaatttaaaaaaaaacctctgccatgcaaaaaattagtaataaatattttcaaatgatttaaaactttttaattaaattttttttagtaatgacgcatcacaaatttgtaaattttttgtttttttttctaagcaagtcatggtttttacggcattttaaaaacgcatggtgaagtttggctgtacctgagaaggtatgcgctctctacattgcgaaacttgggcatgggccgaagccgactgagtgacgaagtgaatttattaattttttagctttatccacgaccggaggccccgggttttttttgccatttttttaagctcaaaaccgactgtctatttccgtcgataatacccataacaaatgaacggtataaactattcaagccgacctcattaaccctattttccgactttggaatttggcatatactatcgacctgatattctttttttggcattatgcagaccgattgcaaatgatttcaaataccattagccaaaattcggaaccccaaaaaatgcttcctacaaaggggcggaatgcaattaatttaaaattaaattttaatgcttttttagatg

SEQ ID NO: 115143 - DNA, 62 bp, Heterodera glycines
  Promoter: Source sequence=SeqID_39273; Location=561..622; Strand=-; Gene=SeqID_67881
aagcgatttgtgtgcaaacgggacagcagcagcaacctcacaacacgatcaacatacaaatg

SEQ ID NO: 115144 - DNA, 151 bp, Heterodera glycines
  Promoter: Source sequence=SeqID_21097; Location=1894..2044; Strand=-; Gene=SeqID_45621
gcacgcggtcagtccgctctttgtgctgcaccggcacgcgctgcgacgcgtcaaccaccggctgatcagtcagcacagagagaccaatgggacggcacagcggcgcaaaatgatcaaagcgacgcccaaatgggtgccccggtgagaaatg

SEQ ID NO: 115145 - DNA, 392 bp, Heterodera glycines
  Promoter: Source sequence=SeqID_9905; Location=1..392; Strand=+; Gene= SeqID_72933
agaagtgggaactaacccagctcaatttaaaatgatgatttaattttaaattaatataagtttcatcttgccatgaattatttaaatataatatttctattccatttccaatgatcttatgtcgctttgggccttgaaaaagctctcccttttgtctgcattttatattttggtttcttatatttagcaaatgtccattaaaaattatgaattgcgattaagcaaaaatgcagatgagcagtcggaagcattttattgttatttgaagtcagtgattgaagaacggagcaaatgtaggcaaactgtcattatcggattttcaggtgtttgaattcattaccatttgagtgtcttttcgaatttgtcctcatttttccaaaggtggttcgatg

SEQ ID NO: 115146 - DNA, 114 bp, Heterodera glycines
  Promoter: Source sequence=SeqID_37901; Location=1..114; Strand=+; Gene=SeqID_66873
cctgggcttttatactccccggaaaattaggccacgcccactttttaaagctatttaagccaagattttctcgcaaaatcaaatcagtcttgcaaaatttcatcaacaacaatg

SEQ ID NO: 115147 - DNA, 543 bp, Heterodera glycines
  Promoter: Source sequence=SeqID_6699; Location=1..543; Strand=+; Gene= SeqID_62533
cctgcaggtcccccccctcatttatccatctactttcattttaatccgctcaaatcccaccacattccttccctttacaacatcatcccattttcccactatcccattcccatcgcggattggcttagattggattacatactttggaacaaaatgattgagctttcagattgcatttgttttttcccatagaaatatgtaagtggaattaatgaaattcaaagtaaaatttaaaataaatggcctatcagcactaatcatcttttacagatccctatttacttaattagttcaaacaaattgctacttgttaaggatcttctctatataaattttaattttataattttgataattttcatttttttttaaattttattttaattctatttataattttataaaaatagtaaaactttaacatcaatatttttgtgtcaatttaagccttattttcctaaatagcaacttttaagtaaataaaaaaacattgtaaattttcaactttcaacttcaaacgtcaaaaaccattgccagaaaatg

SEQ ID NO: 115148 - DNA, 1003 bp, Heterodera glycines
  Promoter: Source sequence=SeqID_18370; Location=1352..2354; Strand=+; Gene=SeqID_82972
ttttgcaggccaatagagaactgatagggctatcgaatgatgttaagattaaatttttaattaggcttgagcaaagttatggttagttttttgttgaaaatttccatttgatggtttcttttttataacgccctttttggatgacttttttataacgatatattagagtgccacgggaccgggaattttgggcaaaaccgggaccgggactttccgggacctgagaagccggtcccggtcccgtggcactctacgatatttcgccactaggatctcctggtacttatatggttcgtacgtaaagtcgaaatccctaaaaagtcgagaattcaaacgtgcggcagtgaaattattcaatttgtccatgatttaagtaagaataagtgcttaggaaaattatatatgtcagttgcggtattatatgaattcgaaaattgattccccattattgttgtttctttgcatttggttatattgttgaaaaattttgaattttcgacttattggggatttcaattttaggtcgaatcctttccggggttcgaaattggtctaaatagatgtcataatcgtgttcagcacccctgaaaaccatataagtgactttctaagtaaaaaaaataataatttgtggcgtacgaaccatataagtaccgatctccttccctcagcagtttgggggtataattacaatttactatgacaatttggaaagttacatttttttttttgcaatttacgcaaaattaataatttttataaaataattctcaaattgttaacaaaaaattattatttttggttaatttttcatgacttttctgcactttttcgttactttttgagctttttatgactttttcgtccaaaatttaaaaaaattagtagattcaatttgaatgggtagcgggagagatatgagcgctgagattaaaaatcaaataatttttgaagttttaactaaatgccaaaattttgccgattctttagttataaataaatg

SEQ ID NO: 115149 - DNA, 86 bp, Heterodera glycines
  Promoter: Source sequence=SeqID_3302; Location=457..542; Strand=+; Gene=SeqID_47585
ggtgttttaattgaaacatcatattaaccaaaagtttatttcgttgttagatcgacgaaggctttgaaattttcgatgacatcatg

SEQ ID NO: 115150 - DNA, 61 bp, Heterodera glycines
  Promoter: Source sequence=SeqID_1133; Location=4089..4149; Strand=+; Gene=SeqID_68377
tgttttatgactcttaataagctttattaaatacattttttcatgcagttgtgctcaaatg

SEQ ID NO: 115151 - DNA, 724 bp, Heterodera glycines
  Promoter: Source sequence=SeqID_9473; Location=1..724; Strand=+; Gene= SeqID_71549
tttgtcaaagtttcacatattcttacattagagacgcctccttgtatttctgtatgttttgttggagattcatgtgtctttagacattggacggtttcagtcccgggtctgtaactcttcagggagtggttgccgccaaaattttttttcatattctttcatagagaccgagaggagtcgattgatattatatttacattttcaatcccgtcagtatcttcacttttaccaaaaatatataaattcgcaccctactcatttccaatgtttttgagtaatttttattttgaaagctttgatcaaaaataggtacatatgtacctatgtgtcccggaaaacatttttttgtcccgttaacctcgtttaattacctgttttagacaaatttgtttgttttgttgaatttccaaatgctgcttattttaaagaattgttttggtcggcttcatgttatttgtcatcaacttacgcgcagaaattttcgtcttcttttgcatcgacgaaaggaattttccgtattccattaaacttcctgtccacaaaacgaatgaataaatgttttagaaaccgattttcttcagcgtcggtcagccaaagtcttctttcactggtggaaatgcatcgggcggtagcggcggaatgcctcctaaccctttgtcggttcgtctcggcaccttttctaatactttcttttagtcagggcatgtcaaactggcagaaaatg

SEQ ID NO: 115152 - DNA, 92 bp, Heterodera glycines
  Promoter: Source sequence=SeqID_1250; Location=5030..5121; Strand=-; Gene=SeqID_70795
ggtttgacaactgcgacccgcaatggctgatcagatgcccgggccgagtgaatctgatcggcgagcacatcgactactccgtgctgctgatg

SEQ ID NO: 115153 - DNA, 80 bp, Heterodera glycines
  Promoter: Source sequence=SeqID_22761; Location=208..287; Strand=+; Gene=SeqID_53451
ggtattgaatgggcgtagttaattgatcattaaaatactttaatttcaaaaaggtaaacgaagcgggcgagacgctaatg

SEQ ID NO: 115154 - DNA, 455 bp, Heterodera glycines
  misc_feature (83)..(83): n is a, c, g, or t
  Promoter: Source sequence=SeqID_8986; Location=738..1192; Strand=-; Gene=SeqID_69918
atttgtgccaatggcacatccggcaaagttgcattgccaatgtctttaactatcaagcgacaagggttgtatgcaaatgaaanatccctaaataaaaaaaattatttttttgaggaaatgaggcagattaagctacttcggaaaaatttgcaataaaaaatttactgtaaatttcgttccttttccacaaagaaaattttataatttaatcattgatttattaattattattatgaaagttcaatttaaaaatttgtttttccaaaggttttggaacacaattgaatcaaactccaactgcctatttaatttagcgtttaaaattccccagtcagctagataatggcacctcgttttggtcgtgtcagagttactttggtgcgcggcattttttgccgctaattcaaagtgtcccacattatttaattattttagtggttaattagaaagttatg

SEQ ID NO: 115155 - DNA, 263 bp, Heterodera glycines
  Promoter: Source sequence=SeqID_735; Location=287..549; Strand=+; Gene=SeqID_60095
ttctctttttggcggccggaggatccttcggatgggaacctcgaaaaggggattctttccccgtttcatgcggggaattaagaatccccgaccccgaattttcattcagggaagcagaggggaatacagtacccctccatcaaaaaatcgattaccgtaatcgatcgccaaaaactgatataaaagaaggaaatttgatgacaatttcattccttcgccatcatcaagctccaaacaacacccagcgcctcagcaaaaccatg

SEQ ID NO: 115156 - DNA, 83 bp, Heterodera glycines
  Promoter: Source sequence=SeqID_25087; Location=489..571; Strand=+; Gene=SeqID_55823
ggcaaaaaaataatgattttaaataaatatttattttgaaaatttaaaagatcattttcaaggaaattccgcgcaccaaaatg

SEQ ID NO: 115157 - DNA, 478 bp, Heterodera glycines
  Promoter: Source sequence=SeqID_10628; Location=1499..1976; Strand=+; Gene=SeqID_73863
tgcctgcaattagcgctacctagaagatgtatattaatgtctaattgaaaaaaataactgataaagtgcgggagaggaatgtaaaacgttatgaatttatacgaagtcaagttgtccatccagttgtaagtgtattaggctacgagatcgctaaaatgttaatgagcaacaaataaatgagcggatttgaagacggaatgaaaaaatttctatgtgacttcatttctctctacccctttgttaattttactacacactactcgattggtaaaccaatgtacataagtcgagttaaatacccggaagataaacactaccccttgacaatactcaaagttttggatgatttctttagaaaattcgatattctgttttgcccgtcaaagtggacgacaggctctgattctctttatgtatgaagtgcaccaaaaaccatccaaaaggcaggatagacgtaaatacatatgcaaacataatg

SEQ ID NO: 115158 - DNA, 257 bp, Heterodera glycines
  misc_feature (22)..(22): n is a, c, g, or t
  Promoter: Source sequence=SeqID_13055; Location=4301..4557; Strand=-; Gene=SeqID_76836
aatgacgactgcttcgcctatncatctgagcaatccttaccagggcaagcatctataatcagggaggacgcacttttcttccaatatgtgaatggagaagagcatgccgacaatgtggagccataacctatgcgaattatccacataaatgtccagcccaaattggccaaacggaatgggtgcgctgtgcacgatgctctggaccccatcaaagtggagacccttgttttattcagcctctcaaagatgaacctatg

SEQ ID NO: 115159 - DNA, 281 bp, Heterodera glycines
  Promoter: Source sequence=SeqID_12627; Location=2672..2952; Strand=+; Gene=SeqID_76296
attctgattgtgttttatttagagaacccttttccgccaatggatgacttagaaaaattgcgcaagaaaaatctggtcgattatgtggagaaggaattgctgaggactgaagaataataatagacgtcaatcggaatattttattgtttcctttccatcgattattatgcttgtttccttttttggatatacatatatccgaccggaaaaaataaaacaaggattcccgaagtaaattcagttttttattaacagagataaagaaatagtacaccaaaatg

SEQ ID NO: 115160 - DNA, 226 bp, Heterodera glycines
  Promoter: Source sequence=SeqID_7301; Location=2810..3035; Strand=-; Gene=SeqID_64403
ttttgaacgatcccattgatttccctggtcttattctttccacattcattcaaataaaaatattcatataaattattttcgtattcttttgcctttcttttttaaaaaaattcaataaaaatattataaaatttagttctaatatgttagaatgtttcactcttctctaaattaatattcggtatttggaattggttaaattaaaattgttttgtgcttgcagatg

SEQ ID NO: 115161 - DNA, 224 bp, Heterodera glycines
  Promoter: Source sequence=SeqID_9393; Location=3720..3943; Strand=-; Gene=SeqID_71229
aacaaaattttggaaaagattcgttagaggatcaacaaaattttcaaaaaaatacgttagaggaaaaaaccaaaaaattccaaattcctgaggatctgttggtggattctaaaaaacaaaaagcttggaattatgtgtcagaaaacattccaaaagtggtggcacggtcaattttggtgtttattgtggataatcaagtggaaatcgaactgaggcaaatcatg

SEQ ID NO: 115162 - DNA, 203 bp, Heterodera glycines
  Promoter: Source sequence=SeqID_39835; Location=1..203; Strand=+; Gene=SeqID_68318
aaagcatgttttttgcccaattccgcacctcaggcgtatttttctgggcattacatggcattagagaatgaatggcatcaattttatccattttttgcttgtgctagactaaagtaacttctttttttgccggaatcccggatttttttgataaaaatttattaatccaaaattagtaaaatttaaaaaattggccaaaaatg

SEQ ID NO: 115163 - DNA, 198 bp, Heterodera glycines
  Promoter: Source sequence=SeqID_3181; Location=2155..2352; Strand=-; Gene=SeqID_47546
atgaacatttgaggggcgaagggacatttttgtttttgtttggactattattttctatatttgttcttttagtcgtcattttttggttacactttttccttaggattattcaaatcctcaatatttctctcattttcctctttttgacatttttatttgaattgtccgtcgtttatgttgctcaactgaataataatg

SEQ ID NO: 115164 - DNA, 549 bp, Heterodera glycines
  misc_feature (79)..(79): n is a, c, g, or t
  Promoter: Source sequence=SeqID_18862; Location=1502..2050; Strand=-; Gene=SeqID_83562
gtagagaatcaaagaataaaagatagaccgggaggggtcgtttagtctggccggtttagtcagaggggacgtttaagtnccccgctagtaaatagagaattcttagggctatcgaaatataaattaattttggttaaatttcattttaaagactttaaaattttaaatgtttattattatatatgcattaccattgcaaaaaacatagcctgttcaatgctttataacttcttttatacttaagttaaaaatataagaaaattatattctgaaagagaacaattaaagctattgaatgataccccgaaatattaatttggttgaatttgagccaagctattaatttaattattttacccattttttgttttcaaacccattggcagttttaacaaacgcgcatgggtggcagtttttaacaaacgcgccagcacgactaaaaatcattggaattgaatcattttcactatttttaaatgttatttagagttttccatcaaagatggcacggctaatcctcgttcatgccgagcaggaccaattaaaatg

SEQ ID NO: 115165 - DNA, 686 bp, Heterodera glycines
  Promoter: Source sequence=SeqID_9183; Location=2056..2741; Strand=+; Gene=SeqID_70518
ataataagaaaaaaataaaattaaattaaaatgattttttattattttaggggaataaactcacaaattatttaagagaatgggggaaaggattagaaagatttaacaaaacatacctgaagatttgtttatccctttttttaatttattttttagtatttggggatacggtcatgcacagtatgccatccgccttttccatttcattttacaaaaataaaatactcactcatcactcccttttttgttttgtgtaattttggttgttttaattgttgttcattttttttgatcatttggccatttgattgttttggccattttggtcaactttcgttcttcgataaatgcgacaagaaatgcaaaaacaaaaatattttttagttattaggtaattaattaattctgactcgggagttattgttttggttaattttctgttgatcaaaattagtgttccaaaccacgagtgcttcccatttcattaaattttgttgatattttcgtccgatcactctccgccgtcgttcgtttgatttttgatccgccgatcgtgcctttattttcgtgctaaacgctcttcataaaaagagtcgcaatttgcactaaatctcacaatgaatcccttatttttttgtaaaattattattttattaattttaatattttatgttaatagatcaatg

SEQ ID NO: 115166 - DNA, 100 bp, Heterodera glycines
  misc_feature (10)..(10): n is a, c, g, or t
  Promoter: Source sequence=SeqID_36863; Location=1376..1475; Strand=-; Gene=SeqID_66077
cggcaaattnaaataaataattaaattatgacagcattttttaattttcgaaccctgtacggtaccacagctgcttgaactgtgcgcaataagttcaatg

SEQ ID NO: 115167 - DNA, 656 bp, Heterodera glycines
  misc_feature (22)..(22): n is a, c, g, or t
  Promoter: Source sequence=SeqID_9259; Location=2076..2731; Strand=-; Gene=SeqID_70782
aaatggtttgaaagtaatattntcgtcaaatcaaattacagctcgcgctttctctcagtaaactccgtttttattgtgggttttatatcccaccgttgacagcgatatccatgcgtcgaagacttcatttatttgtaaaaaaaagattaaacaatttttttaacaaaaaaaacaaagagaaaaacattttttaggaatgcccataaaaatgatttttttttaatttacagaaaattttttcgatttataaatgtataattttttaagaaaaagtctcagtttcgagtcttttgggtctcggggtcaagactccgagcatcactattacataataattttcaggtgccgaattaaaaaattcaataaatctcgaatttttttatgtcctgatgaaaactcaggcccaggtttcttatcccggcaagtccatggtcccggtattttccaaaatatccggtctctaccaattttaatttaattgaaacgcaaacaaataaaaatacgttctcattttacattgcacacatttatcacaaaataaaagaacaatttaaatgaaaggatgtggattttattaagaatgagaggtttcaaaagtgaaattttatttacaaaagtgttattgagttcagctcataaaaaacaaataattaatg

SEQ ID NO: 115168 - DNA, 108 bp, Heterodera glycines
  Promoter: Source sequence=SeqID_14426; Location=1..108; Strand=+; Gene=SeqID_78471
tgatgaatcccctaatgattttggtaaaatcattaagttaaggtggatacacatcttgtcatatgatcaaatggtttcgcgaaaaatcaataatcagacaacaagatg

SEQ ID NO: 115169 - DNA, 1003 bp, Heterodera glycines
  Promoter: Source sequence=SeqID_43424; Location=455..1457; Strand=-; Gene=SeqID_71097
gctcattggcaagtgcacaagtgaaaaatttttttttgttgaatttgcacccctaattttcaattttttaatgcatatttcgtgcatatttgacgatttttgtgcatatttgatgcatatttggcaattttatttgcatatttatgtgcatattttggtcatttttcgtgcattttttggcagccctgttaatgattcgttcttttttcgatttttaactatttatgtttcttttttgtatttgtcttttgggctaatttttgagtaagtaaaattttcagtactagcaaaagtagtgcagaacatctttgccctgttgttggagattttaatttaattaagatatttgttttaatttaaaattattatggcattttatctctatttattttatgtttgttgacctctttaatttatgtttggtacattttttttcacttctcattattctcattaatttgttttccaaaatttcctctctaaatttcgttctcaatttgcttcacattggtgatctcctcggacttcaaaaataaatattgtgtgtggctttgtcttcgtgtgtttggtctccaccccccaattcaattgaaggaaaacggttttcttcctatttggcgctcctgaggaacagcaggtaaacggggaaaggtgagatcggaattaggtagttttgtttgaagtccgaaccggacaacaaaatcaacggaattgaattgaccctgagccagggcaaatttcaaaatttgaagaaaagaagttggagtgaagttgaagaaaagagttggagttgaagttgaaaagaagtggagttaaaaatcctgagacaggataaagggcaacaaaacgattcgagtcgaacgttttcaaattgcaacaaattcgagccgaactatcgcattcgccgtcctaatcgccacgccatcaaacgaaaaagtggaaaagtgtcgacagcggaaacttttgttttgtttttgctatacctgagccagatgcaaaaatg

SEQ ID NO: 115170 - DNA, 178 bp, Heterodera glycines
  misc_feature (29)..(29): n is a, c, g, or t
  Promoter: Source sequence=SeqID_16454; Location=686..863; Strand=-; Gene=SeqID_80855
aaaaaaaaatgtttgggaccagtaaaacncattattgccgtttaattttagctcaaatacaaaaaaattcaaataaataatttaagctggccgtaacgtccacaagatgggccgagattgaaggggaggaggagaagagggcgttcgtccggcgggaggtccggcggttagagcgatg

SEQ ID NO: 115171 - DNA, 103 bp, Heterodera glycines
  Promoter: Source sequence=SeqID_5836; Location=1..103; Strand=+; Gene= SeqID_59387
gagcagacggtcaactggcgacatccatatgacaacacgtacaagggaccttttaaaagttttacttttacccccaaacaggaatatcaatgtaaccgtaatg

SEQ ID NO: 115172 - DNA, 627 bp, Heterodera glycines
  Promoter: Source sequence=SeqID_30341; Location=1..627; Strand=+; Gene=SeqID_60759
gatgcaaatacatatttttcctggattctctatgctctgaaatagtaggaaaatcctttcttttttgtgtttacgaacaaaagtttggacttttatttacatatgtcgtgattgttatacatatttcatacatgttttcattttttttacatattttgagaatttatagaagaaataataaaaatttatttttgaaaatgtacatcaatgaaaatggtgttttttcaaggcggaaggaatgaatggaaattttttgtgaatgaatgaataaatatattcaatcaatttcatttcccctctctgtgctttggcaatctttggcctccaaaattgaccaaagttttccattttatattatttaatttgcaataagcatatttaattcccgattttttttattttaaacaatttctcttaaatattttgaaattatcgactaatgaaaattccctttatattgtttaataagaacttaaggattttttttctattttatgcatttttaaataaataattttaaaaattttctcatgaaaatctcttcacatttttttttcttttacctttttaaatttagaagaattttttctgtaaattttatcaaattttctacaaaaaaaggcaatg

SEQ ID NO: 115173 - DNA, 453 bp, Heterodera glycines; identical to SEQ ID NO: 115141
  Promoter: Source sequence=SeqID_11789; Location=1446..1898; Strand=-; Gene=SeqID_75289

SEQ ID NO: 115174 - DNA, 354 bp, Heterodera glycines
  Promoter: Source sequence=SeqID_10077; Location=1291..1644; Strand=-; Gene=SeqID_73146
aaaaccggaaaaaaaccgtgactagtcccggtctcggaacttcggtactcagttgtccgtgtttaggtcccggtcccgctcaactctacttttgagcatagaaacaaattatttttcatttttggtggtttttgagtaatgccttaacatcattgagttgaattttaaaggaaaacatttcttgctttcgtctaattacgtaaaagattatgaaatttgtcttatgtataaaaattttactgcaaattttattcattctaaattttgactgagttagaaaaaacaatttctcaaaatcagtgtgataaattcctaaatatctcagtcctcgtcataaaatattgtttaagaatg

SEQ ID NO: 115175 - DNA, 1003 bp, Heterodera glycines
  Promoter: Source sequence=SeqID_4358; Location=102..1104; Strand=+; Gene=SeqID_54168
actctaattatttttgatgtaaagttgtgtaggtctttatttgaacacttcgtccttaaaatttcttcagtccatttgcagaatttaagccggacagcgcaggaaaggtcctatgatttggctttagtcgagctagtcccagtcaaagtgaacgggatcggaactaaaagtcgtatttgccgggactctcgtcccggtgtttccagttcaggcttatggtgaaaatcttccatttatcattaagtcccaatttttccttaaatttcctcaactttttaaagttttgtatcaaaaaattcacaaatttttaaaacaacaaaaaattctcattttcaaaaaaccctttttaacccctccaaaagggtggggggaagtttgggcaccaaaagtttgggcaccgggaagcaatgcaatttttaaaaaattaaaaaatatttttgttaattaaattttatgcatttgttgattatatgttaaatatataaaagaaaaaaataattaaaaagcaaatggaaaaataaattaattaaaaagtaaatgactaaattattagtatgtatttacttttcactgatttattatataaataatttgagataaatgttaattaaaataatttgaattagccaacatttatcagctttttgaaatcgttatctttagtctgcacatctgctgtttacataaacattaatatataggatgaaagtgaataaaaatattttcatgaataacttaagatgggaattgtccattataaattttttctgttttctgtgtttaatttacccaaagattttcggttttttacaatttaaattttttacatcgtcgagcggaagcagctttacgtgccttatacaatggcacttcccgaggatcagaatttgtgtcaagcgattcatctgaggggcagcagaaggagcccctcagcacataaattttttgtaaattgtttcaaaacgccatggctaggaaagtaaatcgcttttaacgcacaatg

SEQ ID NO: 115176 - DNA, 683 bp, Heterodera glycines
  Promoter: Source sequence=SeqID_13165; Location=213..895; Strand=-; Gene=SeqID_76984
atggcaaatataaaaataattaattaattcaagtttaattaatatttttatttttttcatgcaaatgaaaaacctttttaatatttactttattaatgctcctctttttatgttgtgtcataaatattgtcctacttcgattacagttgaataactttagatttctcacacttttcttgacataattaagttattaaactattttaaaatattatcgctatttttgacataaatctgttcctaacaaatcgggtcacaatgatttttgataatgttcgaattaaccaacagtatttaagcaaattgaaaattacaacctcattaaaagaccattcatccattcgatcattgaaattattcataaataactgatcaaaaattaatccaaaattgaccagtgccaaaaagttatttctcatttccccgccgatcagtgagttgcgtctgttttcattggtacgtgaaaaaatccgtgacaaaggtcaccgtgtcctcctccgcgttgtaccacccgttggccgggtccatcagtttctaaagcaattttccaatattttaacccttcagttaaatgccccggtggtacgccgtttaaaataataatattaaattaattaggaaagatatttatagaaaatagataaaaccaattattattattattattttatcagaaccatatg

SEQ ID NO: 115177 - DNA, 497 bp, Heterodera glycines
  Promoter: Source sequence=SeqID_28336; Location=1..497; Strand=+; Gene=SeqID_58969
aattaaataataataatttaatttttttctcaaaaatttctccttctcaaccgatttccttatctacctcatttttcacccagacccctttcttaccagtgcttattttgactcgaaacctgaccaaaatcatcgggtcgggtttcgtgtcgagaaaaatgtcgggtttcgggtaacccgcggcaactctgatatggtcaatacagaaataatacataaaattaaaaaaaagggatgaactaccactcaggacttattttctgaataaaactctttcacgagttttttaaatttagctaacaaataaacttccgatttctatagctgttttgggtaagcaattccattattactgcatcttttgttttgaagcctaatttttttttcgttgctatcttgataaaaattcggaaaattagaaatattttgatggcaaaaataaaatataaaacaaaaaattttgttcacttaatccaaagatcaacattgacaaaatg

SEQ ID NO: 115178 - DNA, 302 bp, Heterodera glycines
  Promoter: Source sequence=SeqID_3789; Location=1..302; Strand=+; Gene= SeqID_51885
tatggtcataaaatttcaataagacttgagtcaaattgtttgacaaggactttcttaattgatatatttgatattctatatttatttttaaaatttcaaaaaatttattgtttcaaaaaattcttgaaaaaatctaactcattacttattgaaattttattactgaaattttatgaccaaacctttttataattttgtataatttataaaaaaaaatattttttaaatattctgataaagaacacctagagctttggaatgaaaatgaaatattaatttggtagaaattgagctaagttatg

SEQ ID NO: 115179 - DNA, 1003 bp, Heterodera glycines
  Promoter: Source sequence=SeqID_15661; Location=317..1319; Strand=-; Gene=SeqID_79962
atgtcgtttacagcccataaaaaaataataatttttaaatcaatttataaacatttctaggggttttcggggtcgctgatcacgaatctgacatccatttcgaccaattttgaatcccggacccgaattcgaacaaaaagtcgaaaattcaaatttttcaaaaaatcattttacggtgcgaaaattacaaaagttcaacaaaatgccatgaccaaccacagacaaaatcaacgctcgcatcgatacaattcatgggtctgtatcgttttggcgccgccgttttggcgccagcccaagttttcggactataacttttttaattgttaaccaaatccaataatcttggtatcattcgaaagcttaacatgtttagaagatatttctaagctattgcttcgcgattagacaattaccaaaaaagttataacatgaaaattgtgaaaagtcgaaatttttgaagtttttttttcataacttttttccaagcttgaaaatcttttcgctttttgtaaagctaatagagcatgttaagagctttcgaatggataccaagattgttgggtttggatgacaaagaaaaaagttataatggaaaagcatgctggcgcccaactgaggtaaaccacaaaatcccactcttttttttgcgaggatgtctaaccgggcccgatttttgcccaaatacccggacccggccagccctaatttaaacgtgcagaaaaaaaagaaacatttttttctagacattcaaaaattgtaattctttaatttttcatgagaacattttgccaaaataaatatttttgatttttccactgaaatcgtccggtctttcactaaaaaatcaccccctggcataaattgtgccaaaatacaaaataaatatgcaaataaaaaatctaagtaatttgttattaattttcaaagatccattattttttagcgacaataaaaaaaacccgctgtgctcccttttcccaatttttccatttcaaataaaatg

SEQ ID NO: 115180 - DNA, 1003 bp, Heterodera glycines
  Promoter: Source sequence=SeqID_42457; Location=163..1165; Strand=-; Gene=SeqID_70344
tcgcggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccgcataattgtttgagtaccccaaacggacacttgaaaaaatcgatttttttgttttctgggcagtccccccgaaccgatgcgcccagatttatggggagactgaatccttcgggaatagcttccctatagcctgtactttaattctgcgttggatttttgctccccataaatgtttgagtaccccaaacggacactagaaaaaatcgatttttttgtttcataaatatttttttcagaaagtgctctaaagcgcaccaaattttatttgcaacttaattttagcactctgatgctttagtatcaaaaaggaagatggagaaaaaattttttaaaaaatttttccttatattttggttatatcgtttcgcttttggtggggtgcttggaacagtggaatcatg

SEQ ID NO: 115181 - DNA, 229 bp, Heterodera glycines
  Promoter: Source sequence=SeqID_44563; Location=723..951; Strand=-; Gene=SeqID_72042
tcagacttgtgcgtctcgggcaatatctctgtctcaaaatgcactcgaattgacggacttagactgcccaccgctgtaccccctcgtcctttactttttgccatgccgtcgtggacgacgaccgctgctgctgttgttgtggctcaatttgttgtcgatgatgctgttgtagcagtgcccgtgaggggtatttgagtgccgaacggagttggtccgatgggtggccatg

SEQ ID NO: 115182 - DNA, 444 bp, Heterodera glycines
  Promoter: Source sequence=SeqID_6938; Location=336..779; Strand=-; Gene=SeqID_63355
tcttttaaataagatttaaacttggccttttatttacaaataaaaattctatatttttaaatttaaaatttacacaaatcttttatcctttccaaggcatcgtaaaaaagttgacagccaaacatttttgagttctaactttattttatcgcatgtttgaaacgcattttacactaatctcgcataatctgcttacttaaattacgtgtattacatacatatacggtatttgcttgtataatttagttgtgatctctgaccagtaaacattttatttctttattgtgatacattaaacaagcgtttgtgaaaaagaattgatgtctgttttaattattcggttcgttttttcaacctaattgtcttgtaaagtctgaatcacttagaaatgatgataattgtgacctctacaaccgaacggttgtcgtctgttacacacgaatg

SEQ ID NO: 115183 - DNA, 168 bp, Heterodera glycines
  Promoter: Source sequence=SeqID_16507; Location=2404..2571; Strand=+; Gene=SeqID_47374
agtgagcaaagccttctttttatgtgtaaacaaatgcccgctcgttgcaggaaggaggacagcggcgtgtacacgtgcagagcgagcaacgaagacggcgaagcgacttggaccgcttctttggttgcggaagggcacaccaaccaagacactgtttttcaccggatg

SEQ ID NO: 115184 - DNA, 469 bp, Heterodera glycines
  Promoter: Source sequence=SeqID_1410; Location=2589..3057; Strand=-; Gene=SeqID_73352
tttgtgttatttttccttgttatttaaatattcctccccatttattttgtgtctttttcccctctgctccaaataaatattgattatttgtttgccatcggccggcataacaattagcgacgcccgtacgtattgcactgtgggcttatttatttgaaatgtggaagcagttttggatttattggtttgcttgaagcaaccaacaaactttttccaaactttggactcttaattggagggagaggtcaacagcaatcgaaagtcatcgctgctggactgcatttgtttattatctaggcgataataaacaacatttttgttggacctgctaacagttaggtactgttagtagttgaaaatttgcgctgctgattttgtgtcttggcgacacttttcagttcatccacgcgcacccactctgttaacaagctaggcgctgttagcaatagagtggtgaacggcaagaatg

SEQ ID NO: 115185 - DNA, 905 bp, Heterodera glycines
  Promoter: Source sequence=SeqID_12828; Location=1..905; Strand=+; Gene=SeqID_76550
tttttttgaactattttatatctcaaaattattttaaaaatttcaatgaaaaattgacatttttcctagcaattttttagtacaaaaaggagctttacaaattaggtaccatcaggccaacttttcacaaaatcttttcaaaaatttattttaaacaatcataaattcagcgaaacttagaaattttcctcggcggaacgcccgcctctttcggcatcgccgctctccaccccaaccatcgctaaataattaattaatttgaaaaagactcatccaacaaaagcaagaaaatgttagtaaattttcattctgcggatgaaagaggataaattgtttttactttattccattaatatgcctatttttgaaggttttaataaatatatttcttatttgtagaatttatttcttgacaaattttaggcaaaaaataaaataaaaatttatttaaaaaaataaaattactaataaatttaaaaaaaaacaaatgaaggcacacaaagctgacaattttatgaaatttaagcacactaattaggtttttcccccagcaagcttcgctttttaacactgacttttctaaggggcgctccgtgccgtgtcaaataacttttgttagatggcaatttatttttgatgccggaaattcaaaaattttcttcttctttctctttatctttcctattcctattttttcatttaaaatgtattttaaaaaattttaagatttcgatggcattgaagaaataatataaatatattttttgttgtttggtaaatggcattacttttttttattgttataatttcctattaaagcgaaacattttaagtacaagccagtttaaatacaatttattatttaaaaattctttttcaaataaaagctttttcaacaaaaaatg

SEQ ID NO: 115186 - DNA, 491 bp, Heterodera glycines
  Promoter: Source sequence=SeqID_4775; Location=1..491; Strand=+; Gene= SeqID_55676
tccattttggactcttccgactttctcacctctcttttatcaccaaacacgcttaaagagaacatgaacagcaccaagatggacgaagccggcaaattggagactatcggtgaaagcattgaacggactgcgagttcgaccctcagctgtagcagcagaaccgagaagagagggaaatgatggaaggacaaaagaatgacggcgaaatacaatactattgattttatgtttttctgtataacagtgattagcgtaaattggcgcaataaattctctctctctctctctctcgctgcattttttctagactttgcgtttttatttaaccaattattaagaaaatgcaatcgaaattcaatttcaaatttaagttccaaaattagctcaaattgccaaattgaaagaccattactgatttttttttctaaaaccgtctattgtgttgttaagtaacatacctaataatttttacaacttttagcaattcaatg

SEQ ID NO: 115187 - DNA, 1003 bp, Heterodera glycines
  Promoter: Source sequence=SeqID_13467; Location=189..1191; Strand=+; Gene=SeqID_77358
aaatacaaatgtatttggggctttcgctatttcgtcactatttctgtacatatttggccaatgtttccattataaattcatttattagtgactatgtttttttggcgtttcgtcactttgtccttgccctcgtcatttctccaccactgttttgccctttcggccagaaatattaaaaatcaatcaataattggccctgttcattctcgaataaacaacaattccactctctctctctttttctccccattctctctctctctctcccctctctctctctctctctttctctctctctctctctctagcattctcttttcttctctctctttctccctcctctctctcttctctctctcatcattatgtattcccgtctctctgcctcatttctcgagaattcgcttttcttcaactcatatttttgtgttgctatgggcggtttgttggcatagcgaaggacaatttgtgaacttatttttttatgtttaaaattgaatcttttgcctaacggctgaattattctaaaaagaattatcattggcagttagcacaataaaataaaaaggggcaatttatattttgtttatcaccaggtattttatatttcaatttcatttatatttttaataaaatttggaaacaaatttaaatcaaattaatcattgcctttttttgaccatgatcattactcaaattgggaaattttctaaatattattttaaattacaaaatttatttcgtcttaaaattccccctccataatataatacgcatgaatcgattccttaattggtttcgtaaacacaaagcatttccagtcccttctatcagtgatgatggccacaaaacatttgataacaaaattttcttcaccacttttagtcatacaaaataaaatgcagtgattattttcttgaaaatgccaaaaaaaataatttttcaaaataattttccatttaaaaaattatttccttacaggaaataattttttcaaaaaatg

SEQ ID NO: 115188 - DNA, 172 bp, Heterodera glycines
  Promoter: Source sequence=SeqID_15940; Location=1..172; Strand=+; Gene=SeqID_80291
atcctcaaaataacaacaaaaatataaattcaaaataaaattcatattttccccggcggcgccttagagagttcacagtaaaataatatttcttaattaattaataaagttgctttttacgaatgccaatgccgaagaagagaatcataaagtgaaaaatgataaagaaatg

SEQ ID NO: 115189 - DNA, 94 bp, Heterodera glycines
  Promoter: Source sequence=SeqID_12250; Location=1..94; Strand=+; Gene= SeqID_75837
ttccccctttaattcgagcaggaattttatgtataatttattaatgtttgctttaaattttaataattacaaaaataaaactttcgataaaatg

SEQ ID NO: 115190 - DNA, 365 bp, Heterodera glycines
  Promoter: Source sequence=SeqID_1823; Location=1063..1427; Strand=-; Gene=SeqID_76191
cttccgatccgtcgtcattttatgtcaaaatgtttccgcgccttccgtttttggcaatgatttttcgcctcctattggcacttgtccaacccctcgagcccattggcaacagttgaagctgaactggttcaaaattgttttaataaaatgcgattctcgtgtttttctcatcaagtattatccgtaaaaaataggaaaaccctaaaaatccaggctttatccaacgcaattatttttctgctatttgtgtgacatcattcgaaattcaacagcaaattttgctaattgccaaaaaatgaaccgacggtaagcacaaattcgtcatttatttacctaacaaaacttttttcagttcttaagatatg

SEQ ID NO: 115191 - DNA, 294 bp, Heterodera glycines
  Promoter: Source sequence=SeqID_43596; Location=1..294; Strand=+; Gene=SeqID_71227
ttctgcagttcgcactaattatcgcagttggctgcgttcttcatcgatccacgagccgagtgatccaccgataagactagaattcattcttcaacagaagtgtaaaaaaataatgaaaaaaagaaaaagctggcggtgcccgagctgacactcattgagtcttaagccacgtgctaggccaagcacgggccctaccgcgtcgtctcatcacggccacggacgtagcagcaagcacaaacacaccgctagttacggcacgtaagaccgggaacgaaaccaccatccccagtcatg

SEQ ID NO: 115192 - DNA, 719 bp, Heterodera glycines
  Promoter: Source sequence=SeqID_8771; Location=138..856; Strand=+; Gene=SeqID_69175
tttttaaaattcttcagccatccacgacaaattttgtcggggaattgaattttctccctgatccccaaattttatttccccaagggtcagagaggaaccattgttttaagtgccattcttacaaataaaaattgaaaatgggtatcaaatgtttttgatttctttagtgctctgctcccttctcttccattctccgatgccattaacaactcttttttcaatttggcaatatcaattaattaatcgtccggccattttgctgtgctttgtgtccctttttgctggcttattacttttgctcgccttggccactgacaaacacttcctaatcattccattccttttcagctgtgtgagtaaaaatttttggttttaaaaatcaacagagaaatttttttgggtttttacgaaaaaataattgcaaaaatagaatgaaatgatcttgctaactttataatgagaaaattgttgattttcggcagttaagttgtcactgtgaaaatttaattaaaaaggaaataaatttccctgcctatcactgtgcactatgataattagagatagctagctcgacctggacctagacccaggcctgtgtttttcctaggtataggtttaggccatttttcggcaacctggtttttttggcaaggattttgtacggaaaaaataggtccagggtccaacatggaatccaggcccagacttttgtcaaaatg

SEQ ID NO: 115193 - DNA, 75 bp, Heterodera glycines
  Promoter: Source sequence=SeqID_41734; Location=1..75; Strand=+; Gene= SeqID_69800
tttcaatcactgggtactcaacccaacagcatttcaatcactgcgtactcaacccaccaacatttcaatcacatg

SEQ ID NO: 115194 - DNA, 134 bp, Heterodera glycines
  Promoter: Source sequence=SeqID_358; Location=274..407; Strand=+; Gene=SeqID_84288
ggtatttttccatattttacttatttatgtatttatctttaaaagattggtgttccgtctttgctaaatatccgattttgctgaataataattggtccgacactttttactacgaaatttcagtcaaaaatatg

SEQ ID NO: 115195 - DNA, 101 bp, Heterodera glycines
  Promoter: Source sequence=SeqID_22330; Location=1007..1107; Strand=-; Gene=SeqID_53010
agtcggcgagaggggcgggggagggggttgatttgaaatttaaaaaaattgaaatttcagcgggggaagaacagcagcagggcacgggtatagcgacgatg

SEQ ID NO: 115196 - DNA, 1003 bp, Heterodera glycines
  Promoter: Source sequence=SeqID_19688; Location=1767..2769; Strand=-; Gene=SeqID_84427
tttgggatttgggaggattaaattaaaaaaacgtatagccgattcttctggaacgttttaaagaccatcgaatttcaaaattcgaaattaaaataattcttttttaatttacaattgataagagagaaaagggaggacagagaaaaagtgaaaggccaattcatattatcatatcagcagaattcctttgcttaactttttttttgcacattaaatttagcattttaattgtttaattttacgtttttttttgtctataaaaatgcttttttcacatttgaaaatggtttttgcatgggatttacgccagcttacaattagtcctttttttctgttccttcttagcctttcccctccattcccccgttgtctccccttttttcccaattctctcattcgcttaaatgcactcccccccgatctgtgcagcaaaaaatatcggtaaagttcatgaatgaatcacatcaaaagaattaaaacaacacgcacaaaaaaattaactggtcaaatcaaatgattagctacctctaatagaataagtcaataatctcctatataataaaaaaaaattcgtcagataataaaaaaagagtaaaaaaacagccgatattatcaccaatttcatacgatcaatcaatatcaatatcactgatgaccaacaaccttaatagttaaatcagaactagtattagaaaaattttaaaaaaatagatggaataagttgagaaataaaaaaaaattaggacaaaacatatccaaaattctaataacccaacttaaattaagattaaaaaaaagtaaaaaaaaaaaaaaaattaaaaaaaaacaatgataaatgatcattagggaatggaccacattacgagaagggtcggagctaaagttgatcagagtgctcagagagcactaacataaacagacagtcagaaaattagaaataatatatacaattaatttctagacacttcaccatatatattttgtagaaaaaatagttcaaatg

SEQ ID NO: 115197 - DNA, 245 bp, Heterodera glycines
  Promoter: Source sequence=SeqID_14802; Location=988..1232; Strand=-; Gene=SeqID_78950
cctaaaaattttaaaaaaatctatacaaaaatggcataaactgagaccatgtggccagcccaaggcccgcaatgctggccatggtgacggtgaacacgccggccaacgccaaaccaacagccgactcgacgcccagcgagcagcagccatcgaagcggcactgggagtacagcgcgtacagcaacatcagcaagtagccggccaaaatgatggcgtaattgaagtcgcagaactcggccaacatg

SEQ ID NO: 115198 - DNA, 147 bp, Heterodera glycines
  Promoter: Source sequence=SeqID_4876; Location=949..1095; Strand=+; Gene=SeqID_56045
ggtgagtcagcgttttggtgccggacgacaaatgcaactttttttgcttaagacgacttgatctacacggcccccctctcctccaattgttactccgtcgtggccaaagactgcggctcagaccaaccccaatttgtggtgctgatg

SEQ ID NO: 115199 - DNA, 247 bp, Heterodera glycines
  misc_feature (20)..(20): n is a, c, g, or t
  Promoter: Source sequence=SeqID_30442; Location=1..247; Strand=+; Gene=SeqID_60848
gggagagagagctcatttcnagcacaggattcatatacacacgcggataaaggggtttggttgggtgatcgagggggaaaaaaggcacaaattgagggaagtgcctataactgaaaagacatacgaagaaaattctcaaaaaaattccataaaatttagcttattaattgtttaacaattgaaaaagtataaaaaaataaaaagaacaaagttttaagcaatttcagcaaaattcctttcccacatg

SEQ ID NO: 115200 - DNA, 185 bp, Heterodera glycines
  Promoter: Source sequence=SeqID_43191; Location=209..393; Strand=+; Gene=SeqID_70916
tatcaaagggggcgcccgacgtcgtttggccaaagtccaccaccaagttaatggcaaatgtctgatcaaggtcgtgcttccgtgacttttttggcaaattaccactttttaagttatagattcgaaacgaggacgaccaaaacagtaacaactattgcctgttctatgctctccaggcaacgatg

SEQ ID NO: 115201 - DNA, 146 bp, Heterodera glycines
  Promoter: Source sequence=SeqID_22521; Location=139..284; Strand=+; Gene=SeqID_53187
ggtaccaaactcaaaaaaaaaaattttaaaaccataaacactttaagggacacgtgtgcggagaaaaattctgtcagctctgcaacaacttccacagcaccgagcgtggctgtttcattgcaccacttgagcctaaggaagagatg

SEQ ID NO: 115202 - DNA, 686 bp, Heterodera glycines
  Promoter: Source sequence=SeqID_14022; Location=2379..3064; Strand=-; Gene=SeqID_47179
tttgctaaaaaggaattaaaaaaattatcatttataaaaagtgaaaatttacgattttcgactttttgttcgaatccgggtccggggttcgaaattggtcgaaatgaatgtcatattcttaatcaacggccccgaaaacccccggaaatgtattttcatgacttttaaaaaaaattttcaaaaagggtaactttcaatatagcgacggaaaatgaatgacaaagagaaaaaaaagttgcgaccttttttgaaaagtaggtaatccgctgcaaaaatttgtttataaattcgcgaccaaactccattttttgtcattatttactttttttaaactgcacaaatgtcgtttccgtttattttatttaatgtcttctctaatcatacaatttccttgtaaagttccaaattttccctgtgtttatttttgaattccaaaaacattcattcccggaattaaaactttggaatatgctattgctaattgctctagaatagactgtccttttttcagcttacctaaattggacgcctaaagtgcaattgaacccaaatttagcaatttttgttttccaaaacttgaaccataaaagaaataacaaaacgcttttctaattgcttttttcagcgatacttaagcacacatatttgtctactaatttgctgttgtccgctgccaatcaaggatg

SEQ ID NO: 115203 - DNA, 240 bp, Heterodera glycines
  Promoter: Source sequence=SeqID_134; Location=4293..4532; Strand=-; Gene=SeqID_74202
ttacaaaggcggaaatttggcggacagacaagcgaaagaaaggcaaaagcgacgtcagcttaaaaacaatacagacgcagattagactctgttaacagatttgtcatcaattttcactgatttaaataaatacacagattttttggactggtgtgaatttttgtcgagactaattcaatttatttccttaatttattgacaatccgttttgtttttattaatggctaattgtaagtgatg

SEQ ID NO: 115204 - DNA, 275 bp, Heterodera glycines
  Promoter: Source sequence=SeqID_2332; Location=1074..1348; Strand=-; Gene=SeqID_79173
attaattgatgctaatattgtgtgtcctttggtccgctgatggctttgtgcttttcaggcgtttctctcttcaacaaaagccgacacgacgctgtccaactcgtctcccattccgccagggaagtgcgtcttcaacttttgcgcttcccttccgtctctgaggtgctcgctcgggcctccccttctcctccgagtacgtccaattcttcagttttgattatcatcggtgatttatatgaaattttttgtccgattttgcagccattgccaaaatg

SEQ ID NO: 115205 - DNA, 150 bp, Heterodera glycines
  Promoter: Source sequence=SeqID_18134; Location=417..566; Strand=-; Gene=SeqID_82718
tttcagatggattacataaatttgcaaactggaaactcattttatactctaaatcttggccactcccatccaaattcaaatttgactccaccatttttcaaagcaaatttaaattaccatcccgaatcccaattcatttttgccaaaatg

SEQ ID NO: 115206 - DNA, 85 bp, Heterodera glycines
  Promoter: Source sequence=SeqID_7554; Location=1530..1614; Strand=-; Gene=SeqID_65196
aagtgtaagagggggggggggggggggagggcattgactgatcggaccgaccgatcgcaggaagggctctcttgtggaccaaatg

SEQ ID NO: 115207 - DNA, 347 bp, Heterodera glycines
  Promoter: Source sequence=SeqID_1410; Location=1838..2184; Strand=-; Gene=SeqID_73353
aaagacgacgacgaggattttggcaccttcatcaaccggcaaaagaagcttctgcgggatttcaacttcacgaaattgaatgaggggcaattcaactgtatggttttgctcatttctttgaaatcgccgaaggatgctactttacggtcgcgaattttggccaagttggcagcggatggtgacaatgtcaagtatgacggtgtggtagacgacctgaagatctacatgtcgaccatcgccgaagccaagcattggagcagccacatgtttcgaagcatttgttggcagcaaaattgaagggccaaaagagaaagaactcggaccattcgtcgaatgcgagcagcatg

SEQ ID NO: 115208 - DNA, 523 bp, Heterodera glycines
  Promoter: Source sequence=SeqID_16313; Location=1227..1749; Strand=-; Gene=SeqID_80705
aaaaatgatttgtttaaaatggatgatccacatattaatattcgtaaatgttatgttaaaccagacgcggacaatttatatgtaatgaaaaaatatttgtttttttttcttatgatgtcatttttggtgatatttcctgtttatttagttgcaaaaatatttttattaggtgaatataaggttgaagaaaaccaccatttaaattgattttcaatcgcaaatttttttagcttattccattacttacaaattattgttttaatgaatgctcaatgcaattgtaaataataaattctttgaaatttaatcaaataaattaaatatccaattaataatttcgctacccttttattatgttattttattcttttctttttttaatatttaaaaaaataaaaattaaaaatatttaaaaaatatagctggcgaaaccgttattctcgttttaccagtttttagcaggtcgcaccctaattaataattatcatatatttttagccactttttacgcattagccaaatg

SEQ ID NO: 115209 - DNA, 71 bp, Heterodera glycines
  Promoter: Source sequence=SeqID_9927; Location=1043..1113; Strand=-; Gene=SeqID_72960
gggagtattcgttggccgttttttattttttggaacttccaaaaacaattgccacacattcacagccaatg

SEQ ID NO: 115210 - DNA, 226 bp, Heterodera glycines
  Promoter: Source sequence=SeqID_16882; Location=793..1018; Strand=-; Gene=SeqID_81316
tgtttggacagaatgaataaacggttgaaaaacatgaaaaaacacaaataattaatggaacatttggcccaattaggaacaaattaaattttgcgggaggcacgcaaaaaaaaaatgccgacgcaagcgactgtaacggcggggcaaatttgttagaaaatggaggggcacgagcggggtgcggacaatccatcagtggacaatcaaggacaatccgtcagtaatg

SEQ ID NO: 115211 - DNA, 539 bp, Heterodera glycines
  Promoter: Source sequence=SeqID_591; Location=352..890; Strand=+; Gene=SeqID_57059
aatttttaaaaaaagtatattttaaaattttattttcacctattttggcgttttgcacaaatttccttaacaaaaaagcaattcacccataataatggttcgaattttgaaaaatttattttttgtaaaattccttataattttgattcctttttctaacagcaaaaaaataagttaggttaaaatttaaattgaaattatttattttttccatgaaattggtgaatggactaaaaatgataataaaaaaaaacttcgaaaaaatcaaccattttgcagacataaatttgtgactttttagagcatagtttcccgcttttggtcataatttgctttttttagattatactttttactagaaatagaggccctagcaataaacaaaacaacgagaattgaaaaaaacgcattttaaaaaacttttagttttaaaaattaattaaaaaattttagacttaagggcactaaattaaattcaatttttcttaaattttttgcccatgtaatattctgaattgtagaagaacgaatggcggatg

SEQ ID NO: 115212 - DNA, 986 bp, Heterodera glycines
  Promoter: Source sequence=SeqID_30614; Location=1..986; Strand=+; Gene=SeqID_61012
cgcgaagcgcccgttcgaggccgcgaagcgtccgaaaagcacaacaaaaattagaaacgggcgcaaagcgccgttcgaggacgcgaagggcgcgaagagcccatcttgagcctcgatgtggactaaaaacccataataattttttaaaaattcaaaaaaaaatctccaacgaattcgatcaatttgaatcgcttcacagtctaggtagcgaagctcccatagcgcgaagcgctttttcccagtctaatcacttttgtacctcttttaatcactgttgcacctcttctaacatttgttgtacctcttctaatcacttttgtacctcttttaatcaccgttgtacctcttttaatcacttttgtacttcttctaatcacatttgtacctttttaatcaccgttgtacctcttctaatgacttttgtacctcttctaatcagatttgtacctcttctaatcactgtcgtacctcttctaatcactgttgcacctcttcaaatcactgtcgtacctcttctaatcactgttgcacctcttctaatcactgttgcacctcttctaatcacttcacagcctaggtagcgaagctcaagaagcgcgaagcgctttatcccagctaaatagccgacggttcacgcacccgctagttatatatatgttatataggttttgagtttcgtttcaaaaactaattccggccggccgaaggccggccggaattagttttttatatatacgttatattgacaaggcaactcatctcaaaaactaatttgagaagaacggctaagcgcgcggggctgaaattttgcaccaaggggtaactcgagacggcgcatctgggaaaactataggttttttggtccgaggcccaactgagtaccagcggcttaaaaaccgactttgccgacagtctcactgttacgaaattttttgcttttgccttcagcgcttattggaccccaaaagcgaaatgccccaactatg

SEQ ID NO: 115213 - DNA, 313 bp, Heterodera glycines
  Promoter: Source sequence=SeqID_27931; Location=1..313; Strand=+; Gene=SeqID_58596
tttaattaatttttatatatgattttaattcttttttttttgttggccatccgtcggcggatcgcattttgaatttatggtggaatccaataaatgtacatagtttaaaaaacataccctttaaaaagcaattttaaatataaaagaaacattgaagtattgcatttaatgataaaaggtaacgacttacttaatctgatcaccttgcaaagtataggaaatattctggaaaaatcccggctaaactaactatcatatttcctatatttaaattgatttttggtcgattaaatatttccgttataaacatatg

SEQ ID NO: 115214 - DNA, 366 bp, Heterodera glycines
  Promoter: Source sequence=SeqID_36312; Location=836..1201; Strand=-; Gene=SeqID_65658
cagtttgatgcgtgccaagagagcaacaatattattataaacatatgcagtcttaagaataaaaaaatcaattgaagaataggtaattaattattaatacgacgaagtcctgtgaaaaacttatttaggcattaattattttcttcgtttcaaaaataccctaaactttttaaatttttatctgagtttgctggaatctctgctaagtttttggattaaagtctaagaggtaccaataaccttgaataagtaattatttaaaggagaaacccagaaaatagttaacaataagtgtttattttgaaatttgtacccacctgtctcaattttttaaagcaccaccaggcacacttcacacatgtaatg

SEQ ID NO: 115215 - DNA, 103 bp, Heterodera glycines
  Promoter: Source sequence=SeqID_23595; Location=1..103; Strand=+; Gene=SeqID_54286
ttaaggatttggggagcaccgttttttctgctttttaccacagggaaaattcttttcgggccacattaaaacccttcatttttagatgaagcggcagaaaatg

SEQ ID NO: 115216 - DNA, 482 bp, Heterodera glycines
  Promoter: Source sequence=SeqID_4697; Location=61..542; Strand=-; Gene=SeqID_55435
ggtgcgagatgtttaagaatattatatatctcatatgatgtttgttcaattaccattcaactgaagttctaccttaatcattcattttctatccacatacgtatttcattccatgagttgtaagaaaaattcatatgtgtataatgtgccaacatctcagtatgtattgtaggctatgatttatgtatataaaatagaccggcttaattctatagaatccatttttaatgaactgttgttgaatacttaaacagaaaaaaacgtttgagtgaaaatccaagatctcagtgccgttagttaaaaacttaaattttggcattgttgttatggcgaaactattattttttataaaaacgaaattaggtaattactaattaggattaggcatttgtttgctacttatactgacatattttctctttttccttgtaaatcgcatttttttgatttttgcatactttttacaacttcgattcaacatg

SEQ ID NO: 115217 - DNA, 503 bp, Heterodera glycines
  Promoter: Source sequence=SeqID_29790; Location=625..1127; Strand=-; Gene=SeqID_60248
tctgaacatttaaatttagttaaattatttgtaagcgcaaggaaattcaaaatttagagtcagaagagtgttaggggtcatgagatattaaattcaattaatataatgggaatttcaactttttataatttaaaattcaaaaaaattaatagttttaaaaagctataacaaaaaaaagattcaaaatattttttatttgtgttttttttgtaaacaaaacgattttttagaattttgaatgctcagaacatttgagctcttcgaatatacaaataaattgtactatttatttgttttgagcaaaataacaatgaatttttggaataaaaatgggtacaatgtccataatattgcgactaaacgaaaacgaccaataaaaaaaaaattgggaagagaaaagcggagttattgattcagagagagttggaatatgtacatggataaacaaagataaaaatgaaggaatgacgaataggtaggtcactgaaagatgctattaaatg

SEQ ID NO: 115218 - DNA, 707 bp, Heterodera glycines
  Promoter: Source sequence=SeqID_9497; Location=534..1240; Strand=-; Gene=SeqID_71639
aaattgatattttataggcaattagcgaatttgtgaaagcgaaagactcaaatgggtcgatggaccgcttgttgggctttttggacgagttcaacagaacgaatcgttttgacatggtcagaaaggtatgtatggatcataattaatttatgttgatttctcaatgatcagtttatatgaaacaaaaatttacgaagattttgaatctgtcctgtttttttagtcttttaaaataattattattttattaaataaataaattataaaaattgaaaaaaacagtaaattaccgtattttctctaattatatgccccgtctccatttatctacccgtgtctcaaattatctccccctttctgaggaggttaaaaaataatataccgtggcatataattagagaaaatacagtagtcaatttttataagaattggtttcaaatccgcaaaatatgttatttgaaatgttgtcctaataatttaaaaatgtatgctaaatgtccgtccattcccatttgatcagttcgccggtcatgtggacacctaaaaaatttatttgttttaattgaaattattaaataaataattataaaactgaattttatgaaatgaaaagcattaaattagtcaactctatgaatagggtttgaattacaaaaaatcctgttttacccaaattttaattgttggtcctaataatctttaaaatg

SEQ ID NO: 115219 - DNA, 440 bp, Heterodera glycines
  Promoter: Source sequence=SeqID_16576; Location=1437..1876; Strand=-; Gene=SeqID_80983
ttacacacaaaaaagacataacaaacgttaatcaagtcttaaaaaaagtcattttgaaaaagcgcccttttttatgcaacgacctagtattatttagagggccaattagtttcaaggggtttaatgggtcttcaaaagtatgaaattttccagtttttggcttgaacttttgaaaaatttaataaaagttggtcggtcgcccaaattagcacttttcgtcgtttgacatagcatcccaaaaagcgggcaactagcttcgttgacaatgatggaaaatttcgatactctataattggctctaaaccagtttgctggggaagggtgctgatcatgaatctgacttggatttcagctcattggccgcgaggtttaacatcattaattggggagtcattccgacattggttgtgcttaaggaggacggcactttgataaccatg

SEQ ID NO: 115220 - DNA, 121 bp, Heterodera glycines
  Promoter: Source sequence=SeqID_5251; Location=2707..2827; Strand=-; Gene=SeqID_57464
aaaatcaaatatttaataattttgaaattacaagttctgctgttaaattattattagtcttttatttacccattttataattaatttttgtttaaaatttttttgtgtaaaggtgattatg

SEQ ID NO: 115221 - DNA, 459 bp, Heterodera glycines
  Promoter: Source sequence=SeqID_10296; Location=353..811; Strand=-; Gene=SeqID_73460
ggtggcacgctgcgcctcctgcacttgttgaattttttttttaaagaaaatttggtttttatttattttctttataaaatcatccgaaagttttccattaaattttttgaaatttattgaagaaaaattcatttaaaaaaggttatttgaaatttcgctgttcgtttatcagtcatttatttggccaatttgtccaatgaatgtttcggttatttttttaatttataaaaaaatttattttgttgctttcttcagttttcatctgatagctgataaacacaaaaatttgaaattatctcacagatgcatttaaaaatattcaatgtgaagcaaatgataattcattcattccttgtgaacttttcgcttgttttaaaattattaacttaaattaatttaatttaaattaaattgaaagtaacaaattataatataatttaagcatttttatccacgatg

SEQ ID NO: 115222 - DNA, 158 bp, Heterodera glycines
  Promoter: Source sequence=SeqID_7986; Location=687..844; Strand=+; Gene=SeqID_66597
tcagttggaagtcggccacgaccacaacgggcagctcgccaagccaaatggtgtaaatggggccgaacttacgtgcccattgttggtagatggcataaggacattttgaactgtttgatgtaaacggggggaggacattagaatggaagaaaataatg

SEQ ID NO: 115223 - DNA, 128 bp, Heterodera glycines
  Promoter: Source sequence=SeqID_12328; Location=1190..1317; Strand=+; Gene=SeqID_75923
ttttttcttctattcaatcacttctttttaatctggtcagaaaaaaagtaatagaaacgtaatatagaattaataattcaaataatattggtatctacatatatggagatggtggattttgcaaaatg

SEQ ID NO: 115224 - DNA, 480 bp, Heterodera glycines
  Promoter: Source sequence=SeqID_384; Location=2737..3216; Strand=+; Gene=SeqID_50941
ataactttatttaaaggattggatacaaatataattttttaaatattaatgttaaaatgagacttttagagattttcaaattttttcaacgagagctttttgaattagagaaaaatgccctgtttttcaatccctcggtaccagtgagctcttccgggcattatttaaatttggcctccctgttcgttagtagaatctgccaaaagttaaaaaaatgattaaattagtaattgtaataaaaaaaaattagtttcgcgctagctttgcttacgtcagtcattggtattcaatatgatgccacatttttctttgttaatgtcttcatcccctatttgcgcgtatttcatttatgggcatggcattttttataaaaatatttttttatttatgccattatatatctatttttacatcagatcattattaacacataaaaatttttaaattttccatagtaagaaactgctttcagcaccaatg

SEQ ID NO: 115225 - DNA, 190 bp, Heterodera glycines
  Promoter: Source sequence=SeqID_232; Location=8716..8905; Strand=+; Gene=SeqID_78832
agtgttccgcgtgctggagtacgagcagagtgacgaccagctgttcagaccatacattgctgagttcatggcgcagaagatccaagcatcaggatttgactccaaaatcaaaggcaacgccgaccaagaagcgcagttcgtccaggaatgctatgagcagtttggaataagcattgacccattgaaaatg

SEQ ID NO: 115226 - DNA, 224 bp, Heterodera glycines
  misc_feature (13)..(13): n is a, c, g, or t
  misc_feature (30)..(30): n is a, c, g, or t
  Promoter: Source sequence=SeqID_20370; Location=1547..1770; Strand=-; Gene=SeqID_50893
gaggaaggcggcncaatacagcagacgacnatcgaagaaatcgaccaccgaaaaagcgccattgaaacaaagcaaaaaggacgaaaaaacattgttcgatggatttaatggcataaggtaagtgaagcagcggaggaggaggaattaatgccgaatcagactaattgattcaattaattaaatatagcaaatctttaaatacctaattaagacaacttcgaatg

SEQ ID NO: 115227 - DNA, 157 bp, Heterodera glycines
  Promoter: Source sequence=SeqID_26999; Location=1362..1518; Strand=+; Gene=SeqID_57730
cctgaatttatattttaatataatttttgaattattatggttaattttttaaacatatattaccgagtccaatcgtggaaatgaaaagaatttttgctgccagacgattctcaatgaaattctgtccagaaaatgcggtgtacacaaacagaaaatg

SEQ ID NO: 115228 - DNA, 242 bp, Heterodera glycines
  Promoter: Source sequence=SeqID_36455; Location=1..242; Strand=+; Gene=SeqID_65761
tttctcttgccggcagcgacgacgaaagtcaacaaccacgcccaaagaaaaagttcaaaattccgaaacgacgctcagcactgttacgacccatcggtcagcagcaaagtccattgcaaggacaacacaaacgccgcaagcaactacaagactcaggcttacgcaagttatttcaagccatctcggaccaacaaggaagcagcaaggccaccacaaaggtcatcgaggaaagccgagaaatg

SEQ ID NO: 115229 - DNA, 686 bp, Heterodera glycines
  Promoter: Source sequence=SeqID_29894; Location=1..686; Strand=+; Gene=SeqID_60354
gtgtgcgctttgcgagccgaaattggccaactgaagcagcggaatgccaagcagtgcccgcagttggagaggcaaattgacgacttgaaaaaggtggggcaaaaaacaaataatcgttctcatgcattcttgttcaattaaagggcctcaacttttttatggttttttatgctttactcttggcgataaactaatatttgacaatattaatgttttcaaaaaggtattttgaatttgaccgctgtttactgaataaatttttttattcaccccacccctaaaattaagcaaaaagttttttctcgaaataatcgccctccggcgtcattactttatgatgctattgtatgtgtattcccatctaataaggaaaaattgtttgttctcggggcactgccctttcattctcccctccctctgcttggtggtgacgactctgctttttccagtcgcccattagcgtttttcggtccgtttgttcgctcccccccccccccccctttgctcctcatttacacataaacgcaaaaggaaaaaagcatggaatgaaacgacaaatgtttgtgggaatgcaaaaacacctcttttttttctcccatttattatcaataatttctttggtatattaatttttttgtttcaagaacgatcaaaataaagaaattttgcttggttcttaaaaaatg

SEQ ID NO: 115230 - DNA, 331 bp, Heterodera glycines
  Promoter: Source sequence=SeqID_17999; Location=819..1149; Strand=-; Gene=SeqID_82569
gaaaaatagctacaaaaattgggtaaacaaaataaatttttgtttggttttaaaaaagttatcgacatttttctttgaaaaatattttactgcataaacatatgaccatgactgtatattcaaaaacaattcttctcatggacattaaatttgtaatttttttttgattttgttaaaaatgtatttattattttatcattaaattctcatttaatttttgcattaatttgttttttcaataaatgttatattaattttcaaatgaattcttttaattgtaaattcttttcaaataatttctttctttttttagcctttttggaaaattatg

SEQ ID NO: 115231 - DNA, 675 bp, Heterodera glycines
  Promoter: Source sequence=SeqID_12171; Location=3461..4135; Strand=-; Gene=SeqID_75746
ttgttggccaccaccatcaaaacaccaccgcccgccgttagaggaaaaagagccgatgatgcaaaaagcaattaattaattaattactataattaaaatcttcatcctctctcttttttctgtccatccatccatttgttgttttgtttgtttattgttgatttgttttttaaatttattttatttttttttgaatttttcttgaccagggcttcttctatcgaagaaaatttttcaaaatcaaaacattggggcttaaaaaaataaataaaaaattttgggaatcagaacattttgccaaattgtttcagatcgattattattttgttacaatttaatcgttcaaaaatgtatcaaatattattattagggatgtaaataaaattttttttaatgcttatttttttggaaaaaattcctagtaaagggtgaaacaggcacaaaatgcacataaaaattacctaaattggcttagaatcactttttagtattttaaaaattattaaattgaaacaataattagtgaaacataatgttttttttctctaatcccttttcaatttattattattcatcatattttaattcacatttcaaatgcaatttcatcagtgagttaattaataatggtaattaatttgtctaatcatttttaattaggtcgatgacaaaatg

SEQ ID NO: 115232 - DNA, 841 bp, Heterodera glycines
  misc_feature (27)..(27): n is a, c, g, or t
  Promoter: Source sequence=SeqID_15836; Location=1042..1882; Strand=-; Gene=SeqID_80161
ggcaaaaacatgaaaatttataataanaatttttatactatgaattagggtttttatgatctctttgaaatgaaataaaaaatattattttatttctcaaaaatgcgaaataaataaataaatacatctgtttaattttacatttaaaaggtgggatttgtacaataaattgtaaattttgagggggagatcagcagcaaaaggggggggggggaattaatggtcacaaagggacggttgagcaacaaatgagcgaaaagtgcgaattgtgtcgatagttttacatttttgaacataaaaaacacttaattggcaaccgatcggcacaaaataataataacagcaccaaatattggcaaaaatctgatcaaacaatggcaccgtttggctctgttttgcttcgaattgtgtccgtccaaatggccattccgccggttgtcctttcgccgtgcttttccatttgcctcccaatgttttggctattttccatcccctggggtgccattgtggctgacgttcccccaattatggatgactccgtcgtcaatgtcgactgtggcgaattgcactgtttcggcttggcgttccgtcgttgttcctcgtcctccgcctcctccgatttgccggcctcgcgccccttccgtttctgcttcttcgtccgctttttcacttccaatcctttagccgatttcctcccaaattcaattccccccggcaatttctgtcgaatggcttttcttcgagtgttttgtcgtgagaatgtgcagatcagtgtcaccatggcggccaccgggacgaaaatgacgacggagagaagggccaacacggagccatccaaatg

SEQ ID NO: 115233 - DNA, 613 bp, Heterodera glycines
  Promoter: Source sequence=SeqID_22797; Location=792..1404; Strand=-; Gene=SeqID_53498
gatatgtatgatgattaacctgctgctggattagtctagtagaaccaaagtaagaaattaattcatttaattagtcgccattaaattttaattgtttttcggcactcggttgggccgattcgaagtgccgtgaaaatggcattgaatgcacggcagagaattgtcgttctatgcttggtccggcacttttcaacatacgttttccgcttttgtcaaacgtggaatttgcgaaggatattgataaaaaaagagattaaaaccaagtttaaactcattcaacaacgagtgtcaactttttaaaataattaatttaaataaataaaataaaaatttaatatgctttttcttataaaatataatttttttaaaattttattccattttttatccatggagaatattggcacaaattaaaaggaaatggggaagcactgatcagaattgtttgggctttaacctttttcgatgctccaaaagaaggtgcgaattaactgttaattaatgctaattacaacgatgattaatttccatttagacgaaaattggagttgcaaatgtcctgcaacttttcgaattgtctctcaaaagaacgatgggtcgcgtttgaagaatg

SEQ ID NO: 115234 - DNA, 301 bp, Heterodera glycines
  Promoter: Source sequence=SeqID_743; Location=2982..3282; Strand=-; Gene=SeqID_60286
ttttgttcgtgggacaaaaattcctttgattggccacgaaatccgtgaaaatccattattttcatttcatgctacacattattttcctctttacctattctttaaggtgaaattaaaatttttaaatgtaatgtgaaatactctgaaatgtataatatatatatatatatatatattcaatcgatttatcaataattaaaaattaatacgtgggcaaaatcttgtggcattttaatgtagattagcattgccaaatatttattcatttattttattttttttgcaattattattaaatatg

SEQ ID NO: 115235 - DNA, 1003 bp, Heterodera glycines
  Promoter: Source sequence=SeqID_12063; Location=2510..3512; Strand=-; Gene=SeqID_75609
gacgaccatgaaaaagaaaatatgatcatatggcctttagctaaaaaaactcaaaaacagatttatagatttgttaggtgttgaaaactaaagtcgcataggtccgggtaggcgcaaaattttcgagttttttttccggcccaaaactcggtttaaatgctaagacacaatttttgatcttatattttcggcgcatagaaaaacataaaactgtttttgagtctttttactgtgggagattaagcgatttcgttggttgctgcccacctttctactctttcaaatgctgtacattggttggtatttatataatattaaacataattagagttggggtttttgtgtgctaaaaattctttaaatatgtaataaaaatatatgctaaaaaggggtaaaatatttgctaaaaaacataaaaaatgtataaaatatttgctataaaaggaaaatcaggtccatttttgcataaaacacatcctcacaaaatctcattcattatgttggatatgtcccagggttaccgcgggtcacacgaaacccgatacccgaaacccgacatttttctcaacccgaaacccgacccgataattttctcccgacccgatccaaaacctgacccgatatttttctcgacccgcggcaacactgatatgaattaggaaccctaatcaagctagctctagttgtatcagcagaaatggataaatagaaaaattactaaaaaaaattttatattaagatgaagaagcagaaggtcgtttttgagcatacatcgatgtatgcaatttcgtatttctgagttttttttcaatttttataagattgggttttaatgcacaaaaaattaatttttgccaaaaaataaataaaaaaaaactttcaacaaataataaaaattaataataaaaaaaaaattactgctgctgtcgttgaatggtaaatataaaagccttatttttaatgttaaaacaaatattttttcagtgatcataaaaagaaaatg

SEQ ID NO: 115236 - DNA, 107 bp, Heterodera glycines
  Promoter: Source sequence=SeqID_25834; Location=338..444; Strand=+; Gene=SeqID_56599
ttacggggaaatttatttttattatttttttgaaacaattaaagaattgattggaattgaaattgataaaataattaatttaagtattttaaataattttgaaaatg

SEQ ID NO: 115237 - DNA, 495 bp, Heterodera glycines
  Promoter: Source sequence=SeqID_16807; Location=976..1470; Strand=+; Gene=SeqID_81220
attggttttttggaaaatcattagacagaagaattccgctgaatgaaagcttttttgaaagtatagatagaagatgaaaaattcagcaaaatactgatccaaaattcacattaatagaaaaaatttctttcattttttcctgtttaaaatgttcctcaacgcgctttttgagttcctcgactgttatggcttccatttcgttttacatgggacaatatttcatgttaatataaaacaattggacttttttgttagcgctgaaaaattatttccacccaaaccaaaaagcccgctggcggtggataaaagagtattgagaaacgaattaatatatcatattttggcgcgattcagttatttccaccaaaattaaatatgaccgccagggatggcattccgaggcccaaaaatttttcgggaatctgaattctgaccacaaaatgttaaaaatcgtaaatttttttattatatttcattttaaatgttcttcagatg

SEQ ID NO: 115238 - DNA, 385 bp, Heterodera glycines
  Promoter: Source sequence=SeqID_134; Location=410..794; Strand=-; Gene=SeqID_74203
aaccaaattttaaagagacatcgcgacggttctgattttttggccaccaacaaaaagctcgttgttttttatttatgacttattatttatgctcaaattatccaggaaaatcggttgttggtctttggttgaccattaatcgaaatacctaataatggttattagcctactaaagatttaaataatctctcgctattaaaaattctaatgaccggtttttcagagaaaaatattgagaccaagcacatttcactaaattatattttataataggtattcgcaccgcacaagtttacattgcttcgaaatatcatattcattgtttactcataaatatgggttgagaaacccccttaagaataattggcgtaaaacaacaataatg

SEQ ID NO: 115239 - DNA, 63 bp, Heterodera glycines
  Promoter: Source sequence=SeqID_10573; Location=1498..1560; Strand=-; Gene=SeqID_73812
taagtgaaaatttgcacacaaattgtgccaaaaatggtcatcatctcgaaatgatcaacgatg

SEQ ID NO: 115240 - DNA, 1003 bp, Heterodera glycines
  Promoter: Source sequence=SeqID_18470; Location=318..1320; Strand=+; Gene=SeqID_83081
tacaaaacctttagttttttccaagtatgaatttggtttatttagtatttatttttcatattaacaaaattttagtttgtctgataaaaaccgcattttccgtatttataagttttgccattttcaccataataatgtccataaactattctcatttcttcgcttttgttataaataccaaaaaatatatttaatttataatttttgatgttgacatgctccaaatctgttatcgaaaaatgatgaaatacataaaaaaaagtcttctgctggaaactctagtcgtgctggcgcgtttcttaaatccgccaataggttcgaaaacaaaaaatgggtaacaaataaaaacttcacccaaattaatttttcttggtatcattcaatagctttatttgttctctatcagaattttattttcccaaattttttacttaagtataaaaaaagttattgtcataatttcaaaaagtctcatgtcagaattttttgtccagaacttttttgaaactcaatgaaattttctaaaattttaaagctaattagagaatttttagggctagcgaataaattaattaattttggctcatttaaagactttaaaattttaaatgcttataatggatatatgcatgaccattgcaaaaaacatagtatgttcaatgctttataactttttttattcataagctaaaaatttggaaaaaatatattctgaaaaagaacaattaaagctaattgaatgataccaaaaaatattaatttggttgaatttgagccaatatatgaatttatatattttactaattttttgttttcaaacccactggcggatttaagaaacgcactagcaccactctagttaataaccgatttgccccttaaattcttcgaattcatgaaccaattctcaccatctaaataatttattttagttgttttttggcacttgaaaaataagataagaaaataaatagttttttcggtatttataaattaaccaatg

SEQ ID NO: 115241 - DNA, 89 bp, Heterodera glycines
  Promoter: Source sequence=SeqID_8125; Location=2339..2427; Strand=-; Gene=SeqID_67054
tctaaaataaaaaaaaattaagtaattataaaatgatggggaggaaattattcctttttgagccttgccaaaatgacctcgtcaaaatg

SEQ ID NO: 115242 - DNA, 155 bp, Heterodera glycines
  Promoter: Source sequence=SeqID_21880; Location=2726..2880; Strand=-; Gene=SeqID_52520
aaaaaagagaaaagattcaaaaatttgaagcaacttttgaaaagttgaagcaaaaaggaaaataccaatggaaaactggcaccaaaattgagaggaaaattggaaaattattaggcacatatcgcgaaaaaatatataaatggaaaaaaaaaatg

SEQ ID NO: 115243 - DNA, 56 bp, Heterodera glycines
  Promoter: Source sequence=SeqID_11809; Location=1731..1786; Strand=-; Gene=SeqID_75310
ctttttcagagtcggtaaaatcatttaaattctccctttaattcgccttaagcatg

SEQ ID NO: 115244 - DNA, 664 bp, Heterodera glycines
  misc_feature (71)..(71): n is a, c, g, or t
  misc_feature (144)..(144): n is a, c, g, or t
  Promoter: Source sequence=SeqID_19318; Location=1..664; Strand=+; Gene=SeqID_84056
gatagttttgaaattttgcaatataatagaggacacttagggctatcgaatgatactaagattgttggatntggtttgcagaaaaaaaattagggccaaaaactcgtcctggtcagatataatttgtgttagacactaatcttntcatattcaaagaaattggtgacaaagacaaaatatgagcgccgctctctgctgctgctgctgtctttaaaagccgtgttattgcttatttgttagcttggatgagatcatttttattttgtttcatccttttgttttgtcatccccaaagttatttctttctttgaataaatcaattacactttaattttaattgatacctttttaatgtttgtttaacgggccacatgcccggaggggatgatttacttgaaatatggagactttttgggtttgacacaaaaaaaactatgcctatatgtaaagttaaaacattttgctttttcttgatacaaaaatgttgtgggtttggccaaaacgaaaagttatggccaaacaaaccgagggtattggacgcataaaatgaaggagggcctaattttttaattctttgaacagcaagaaagcacttttaatacctttttttgtttaggttatattttccaattttgttcaaatttcaattttaagcccgaaaatg

SEQ ID NO: 115245 - DNA, 181 bp, Heterodera glycines
  Promoter: Source sequence=SeqID_307; Location=1180..1360; Strand=+; Gene=SeqID_81801
ggtcagtgcgagtgttttaaggctaaaaaagcaatttgtttcatccatcccaaagtctttatcattcctccgtccttcactttatttccgtctttagctggagagagcgtgcaaaagaattgagcgtgactatgaccaagtgacggcacagcacgaacggcgcgaagaactgcagaaaatg

SEQ ID NO: 115246 - DNA, 218 bp, Heterodera glycines
  Promoter: Source sequence=SeqID_9573; Location=228..445; Strand=+; Gene=SeqID_71937
tttaggagaggagaggttagctagaattatttttacgggattacaaattgaccctaaaaattgtggccgagaaaacacaaaaaatccgggattaaaaaattcgacaaatttaaatgagaaaaactctcaaacaaatttccaactgaaaaaattaataaaattaatttaaaacttataattggtttctataagaattttcaaaccaaccccgaaaaatg

SEQ ID NO: 115247 - DNA, 648 bp, Heterodera glycines
  Promoter: Source sequence=SeqID_4311; Location=1554..2201; Strand=+; Gene=SeqID_53996
ttttgctctttcaggactccctactactcctcctactattacccctactacagttggcgcagttattggccctaccgttacagagactactcttacgtacgttttctgttgggttttcctttcctaccgtactggtaccgtttagtctgacctctattcatacgatcgctacagttacttctccccgacgtactaccgttcgctgttcccttaccgtcgatactattacaggtgaggggaaggggggggggcaaaagcaatcggacggcttcatcaaacactgcctttcagcgactacatcagcaacccgtactattggtcgtcttcgtactcctattggggccgctacagaagctatttgtacaattggcggggatatcgtaataaattgcacataccgtacacttaaggtccgactacgattggccctcctattacaatcgctggtcagttccatttgaatttctgttgcttaaaagtgtgttgttctctttcaaaaggtactattattggtaaaggtacgacccctactacgattcgtattcgcgcacctaccgttaccgctcttggcttctagacagtatccaaatttagcggggggggggggcactcgagtgaacgggtgaatttgtcctttcccaaggtatg

SEQ ID NO: 115248 - DNA, 54 bp, Heterodera glycines
  Promoter: Source sequence=SeqID_3684; Location=6360..6413; Strand=-; Gene=SeqID_51443
cgtcattttgtcccttttctgatcacccattcctttttcttctattttcagatg

SEQ ID NO: 115249 - DNA, 706 bp, Heterodera glycines
  Promoter: Source sequence=SeqID_2898; Location=4886..5591; Strand=-; Gene=SeqID_82252
aaatttagcatttatcaaaaatatttatttatttttggtaattcttagagctcgacattttgaaaaaagcctagacctagactccatgttggacctggatttcctggacgaaaacccaggaaaacccaagtccaggaaaaatccaggctcctcgagacctggatccaggtctggacctgtattttttgaaactcattttaaaaatcaaaaaatatttcaaaaaaatcaataattgcttgggaacaaataaatatattatttacaataataatttgtttttaatatatttaatcattttttgaaaacttgaaaaaaagatcggtcatttgaaataataaattctaaaattttacccaggaaatccatgtatttttgtgttttgcctggacctggattttttttcacatttgacctggacctggatttcatgacaaaaacccaggaaatccaggtttcgaaaaatggcctggacctggatacaaaaaaatccaggcctggacccaggtccaggtcgagctctagctaattcttatttaaatttgccctttagctgcaaaatgtgaatgtgagcacaattcggagcatcgaagatgctttggtgccgttgatcaagttcactttccaatttgatcaaaacactccgatcgatttcgacattggtctcgtcacttttgatccgaatgagcaaatattcaaatcaaaaatg

SEQ ID NO: 115250 - DNA, 343 bp, Heterodera glycines
  Promoter: Source sequence=SeqID_32344; Location=1353..1695; Strand=-; Gene=SeqID_62661
agaacctacatacagccctaccaaaccaacatactcgcctacggtaccaacatacacgccttcgataccaacagacccgcctacggtaccaacatacacgccttcgataccaacagacccgcctacggtaccaacatacacgccttcgataccaacagacccgcctacggtaccaacatattcgccaactgtaccaaccttgactgtcccaaccttaactgtgcctactgtaactgttccgaccttcactaagcctaccgtaaccattccgaccttaactgtgcctaccgtaactgttccggtcttcactgtgcataccgtgacatctccaacaataactatg

SEQ ID NO: 115251 - DNA, 119 bp, Heterodera glycines
  Promoter: Source sequence=SeqID_11210; Location=1508..1626; Strand=-; Gene=SeqID_74568
agtataccttttaaatataattatttaattagttaattaattgcctcaatttggcttattagtgtcaggattttaacaatttcttctgtaaaaaatgggccattgtgcgagaaaaaatg

SEQ ID NO: 115252 - DNA, 113 bp, Heterodera glycines; identical to SEQ ID NO: 109579
  Promoter: Source sequence=SeqID_1504; Location=615..727; Strand=-; Gene=SeqID_74023

SEQ ID NO: 115253 - DNA, 265 bp, Heterodera glycines
  Promoter: Source sequence=SeqID_10813; Location=5085..5349; Strand=+; Gene=SeqID_74079
tcccacccctccactcgccgacctcttgacggtgcgcaatcgacttgtcacaaatgcgatgcaaatgcaatgtaatgagagggggaggggggagaggagggcacatttcaccaggggccgaccgccggaagagtttatttgtacaacgaatccatccatcggcacgtcgtcggataaaacggcgacggacggtgctgctttttgagccttttcgggaagtgagattcaatgactctgtcgatcattctgtttgttattaattatg

SEQ ID NO: 115254 - DNA, 237 bp, Heterodera glycines
  Promoter: Source sequence=SeqID_45440; Location=370..606; Strand=+; Gene=SeqID_72736
gagaattttgtgctgatcatttataaaaaaaattgtgcctccagcacctttttaaaattttttatgaatttttgaaaaattaaccacttttatcgatttttcgaaactttgatcacttttttctgatcagttttggggtcagggccaaaaaagccgaaaattggcaatagcaaatcgactatgctctacacgatagaagtggttttaaagtgatttgaacacttacagttcgaaatg

SEQ ID NO: 115255 - DNA, 1003 bp, Heterodera glycines
  Promoter: Source sequence=SeqID_9017; Location=268..1270; Strand=+; Gene=SeqID_70008
taaaaatgaaagaataacatagataaatgtttgacataaaatatatgaggtcatcagctcatgaaaataataaacgaacacggaaataaagtttttaatattattaaataaagagaatcaaaacttaacattgcgcatacttaataaacaacataagcaataaaaaaatttctaaggaataaaacacagacagaaaatcacatatcgccataaatttgaaagattggtagtttttggtagcagttttacataaaaatggccgatttttgaggattttttccaaaaatcagagtaaatcagtaaactttctcaactcgtaaattttcggtctcaagctacactactaattagggggtccaattttaccaaatcccccccccctccctttaccacccatcaattaaaaaatgccgcaaatattttgacacaacattctgttataccaccaccatctccgttctcttctcccgcatcgacagcaaaacaacaaaattgtcacccctacgtcatgactcccccggcgttgtcattgaagcggacgcaattttcggtgttggcgaagtgatttgattttgtgatcgatggggttggcgaaatgcgcaacccccgccggggcgaagcgaccaaaaatataaaaataatcacatttttcgcgtcgttatcgacgtacgagcagctttgactgcttctatttattcccgaaattagcatagctccctgttagtcgttcattggatcaattataattagagcttggcacggtaaaataatcgcgataaatgtcgactttaggaaaaccctctaaaagatagataataataattgcggcatttattaccgcttactaatttatggaaaatcgcgcttaccaaaggaaattatatagtgttggaatttggcaatttgatactattttcaccgaaatttttagcattgttttggcattttgaattaattttacatttactatacatttactgttgttacagtaaaaattgaaatg

SEQ ID NO: 115256 - DNA, 1003 bp, Heterodera glycines
  Promoter: Source sequence=SeqID_2670; Location=846..1848; Strand=-; Gene=SeqID_80990
ttcccaattaaaaaattgggcatttccctgagcatatgactttttaaatgggacgaaattgtgccattttaaatttaaagattaaaattacccaataatctgagttaatgccgtctaatgtgacggttttgaacataaatttgacaagcattgcctcctctgctgtttcatttggcattatgccacagtttctgaggctccttaatttgttggttttaatttggcaccaccgtaacagattgggacaacaattggaatgccgaacctccggtggcagtggccgaccaaattgcccaataccgaagacatcggcaggaagaagcagcggcagcggcaaacaaagcgaaaacaaaaggcaaagcgcagcagtgccaacagcaattggccggggcagtgccgcaagaagtaattagcagactaattagcgaaaaagcagggaagcacagagacaaatgtgccatttaatgataaaaaccatcaagaatgggggaaaacaatttataccaaagacaaataaataagaatttattgcctccacttttagtaaattcgaagtggcaaccgattaaattgtgccgaaatgtcccatttgttaaagatagaagtgatcattcaattttcttattatttttgggaccttgaatttaggccaaatcgaaaacaaattaaattttaaattcgattaattttctgttgtgagttcagcaatgcgtcgatttgttcagcgaacttcagcccaatgtgaaggcgccaaaaaaggcaaatttaaaattggaaattattgtaaaatcatgaatgtttcatttagcttttgctgaagcaaaagcaacagatcggcatcaaacagcgcaatttgttcgctgtacaaccggccgaaagcggcttctccattgaggttggcaccacaaaaaaaatgccgaattgaatttgtcaagtttaatttacgatttaatttctaataaaataaaaggttttttttaattttgccatttttgtcagaatg

SEQ ID NO: 115257 - DNA, 1003 bp, Heterodera glycines
  Promoter: Source sequence=SeqID_17542; Location=887..1889; Strand=-; Gene=SeqID_82042
tttgttttcaaaactcatggaaaaatgtttctcccaatgtattttcggtttcgcgctgatcacgaatagggcacatccatttcgactaaactcgaacccccgggcgtgaattcgaacaaaaagtttgaaaacttcaaatttttcgagtttcgcatttttgttttcaaaacaacggcttaaaaacaaagaaacaaacaaaagtcatcaatgaaaaaaaaattgttagaccatttttgagaccaaaaacacgcgattctaaatatttgagttttcgactgtttgttcgagttcgggcccggggttcgagattggcctaaatggaatgccagttttgtgaaaaactttctaatgacattttttgggttttcccgaacttacttttttcaccccatgtaaaaaaacgaaaattttttgtataacttcccgactttttcacaattaatgtctttgcatttaccatatatcaattctccattacattttagctccgtatccctgcttctgtcttctgtataccaatccgtctacaatttggccgaaatgactgtggacatcgtcacgccgggcaccacccaaacagcgactaggacaaggacgaggaggactgcttcacgccgtcgcgcgtcaacagcagcgcgttcggtgagccgtccctggcgctagtggtcggtcaactgcgtctaatgagacaactttaagaagccatcacatttttcggcacttttgctgtttggtgaatcccgaaaagacagaaaaagtcttacacgcgctattttcgtgtttctctttctctgcttccactgccccttgttatgagcggtagagacgcatacttttataagtaaagcaaaagcaacattttttttaaaactgcgtctctcctctcataacaaggggacagtggaaacagagaaagagaattgtgcaaatagtgtgtgaaaatgaaattctctgtcgttctttttcgggacccccttaaacagcaaaagtgccgaaaaagatg

SEQ ID NO: 115258 - DNA, 797 bp, Heterodera glycines
  Promoter: Source sequence=SeqID_8383; Location=4602..5398; Strand=-; Gene=SeqID_67879
agccgacaactgcggccgcctggcaccaaatgcgttcgctgacaacgttacagtgcaataattaaaaaagaaaaaatgtatctgaaacggacattttaatgtggaaaattcaattgaaaatgatggaacggactggatttaaaccgtcgtcccaaaaaaaggtggaaccgaacgcggacttcgacttgttgagtcccacaaaattggacactaacaattttcgtaaaattttccattgaaaaatttggcaaaaaatgagcttttaataggccaatttagtggagaacattttagttacaatcaaatgaaagttttcaaggccctcagaaactgttttggccacttcagtcccgtgtcaataactctttaaagagtggtcgctgcaaaatttcggattattttattacagaccgagaggagccgaatggtataaaatttctatacaataagatgcatattcttcactttaccaaatccgtaattacttcgtccaaaacgccgtaatttccgtaatccgtaattgcgtgcagccttagtattttattccccttttcaaggacagataaagctaaaacatatttccgtttcaaaattccacaaaatgacgcatttgtcaaactgaacaaattgagggattaacgaaaaaaatgaaatttaatttgcttagctgtgattctgtgatttgaatgggaaatgaaagcacataaaaggagcgaatgaatcagtgaaattattcaactttaatttgactgtgcttccgaattgtcaaaatcattaattaattaatcgcaaaaatg

SEQ ID NO: 115259 - DNA, 1003 bp, Heterodera glycines
  Promoter: Source sequence=SeqID_3475; Location=1787..2789; Strand=+; Gene=SeqID_84823
atggaaatcctttcacaatttttgatgacacaaaaggacaaagtcaaaatttggcatttatttgacttgactttggcaaaaaaaaggggggaagcaattaaatttaaaaaatgaattttaaaatagaaaaagtaaaatgtaaaacagtgaatccataggatttgtgttactctggccttttgccacataatctttggttgttttgccccgattttctctcccatccatttttctttgtctgtccaaaattggcacaatttccgcaaaatttgcaaaagtgggctccggcttttgatgcattgaaatggatttttgttcgcctcgggggatgaaaacaatgcgggaaaaaaatgagtgccctcggggggcaattggggaggggagggaaagggcacttggccatcggaaaagcggaaatgaaacggaatgagacgggggggggggaatgtacgaacggcacaaacagcagaagatgaacgagggatgagagacgatggggaaaaaagagtcgagacaaattgggcaaaatcatttccggcatttaattgccacacaattgcccaatttatacttattcaaaaaaaaattgtgaaagaatgcgatagaatttcattaaaattatttcaaagaaaatattggaacaaaataagtggtaaaattaatttgcagaagccccgcataaaaataaataatgttggaaaaccatattcacaacgaaggcgtaaaacagcaaatctcccgcggagtgttggcattttaatttggccaatttcgccaacacttttcatttggcctttgtcgcttttcctctttccgcaaaggacaaatgagccttggacaattgagtccccggtactcagtccaaaattcggtaaaaaccggcaaataatttttcattcattcgacacagcaaaaattgtgccaatttttgacagcagcggcggcacacatagaagcagtgtttgaatgacaaagtaaataatatttattggcttggcaaatg

SEQ ID NO: 115260 - DNA, 129 bp, Heterodera glycines
  Promoter: Source sequence=SeqID_30209; Location=947..1075; Strand=-; Gene=SeqID_60642
aaatggtgattctaagcctattttggtcatttttatggcattttgtgcctattcaagtaattgtccaattaagatttgacacaatttgcatttcatttcttcctaatttttgttctacatcgaatcatg

SEQ ID NO: 115261 - DNA, 783 bp, Heterodera glycines
  Promoter: Source sequence=SeqID_7492; Location=1021..1803; Strand=-; Gene=SeqID_64988
ataagcaaaatgtgatagggaaaaagtgatctgaatatgtacaaaattagtaccacaaattaatcgataaatgactgaaaatacgtaatattgctgattaatttcaatctaattcgatgctaattactttgtctagctataagagtcgatttgtaagaaaatttacgatttcttaatccatcttccggtttttttagcaaaattatttaatatgctaaacggatgggaacgacgcgcaatttacaagcgcgaattacgcataacgatgataatgtccaaccagtgtcgagtccgtgttgcaggccatgaaattgggcatgttggcgtgaattggtgggacgaggacagcgtggaccacatgcaatgggtatttttttgacaacgaaattgaattttggatagaggagaatatttaccaccctcagattttaagtgacgttttatggcaaattttatataacaacaaaaaaaaattgacatagtcaaaaagcgactagtgaagcgaagaaacgggattttttagctgatgcttattttaaatttcggcgctgtttttttgtctcggcgagatttcgggttgagagattttggcggctatatttctatttgtggccaaaaaatatatatatgatcggaaaaaagagggtttaaaggagctgaaatgctttttttttgaaaataggtcagtatccagcctgactaagtagatggatctgatggacacacaatgttcttcacacaaagaacatacacactggcacaactcaaatcaaaattggcatg

SEQ ID NO: 115262 - DNA, 372 bp, Heterodera glycines
  Promoter: Source sequence=SeqID_25099; Location=705..1076; Strand=+; Gene=SeqID_55834
ttttgtaatttagaagttttttttaatgaaaattaaataaatttactaaaaaaagaacagattggagcaattttttaataataaagattattatcgcaaactaattaatttgaattgaccaaaaaatggttcgcatataataaaagagaaacattgatttgggaaaggaaaatgaagaaattcatttcatttgggtgttgtcataattaaatgacgaggattatgtgcctgtgtcattcaccgatggcaaattatcattcaaatttttcaaaaaaatgatttcttgctcaaatatgcaattattgctttaaataatttttaatttcattatattatttgaactttgtatcttttcattgtcagatgaaaatg

SEQ ID NO: 115263 - DNA, 1003 bp, Heterodera glycines
  Promoter: Source sequence=SeqID_5400; Location=1153..2155; Strand=-; Gene=SeqID_57890
tatgccgattatgcgatgactaaatacgcaatttcgcgtttgcaagagggaattcttttcttggcatttgccaatccatttatgggccatgaatttatgccgagtggagagtgagctagtaaatcaatcaaatggttcaaggaatatcgtggaaatttttcttactttggaaaatttgtttgaaaattgttaatgaactgcaggaatttaaaaatgcccaattttcttcactttttgtgttttgaatcggttcaaaaaccggtttatacttgtcggatcaacttcccccacccctagatcgatctgtctcatcgagagctatcgattggtaccatattcgtcgagattggtccacgagaaaaaaacatcgtataagtcaagaaaacccactgaccttttaacggtgtcatgacaacttgtacaattgcttaggtcaggcctaggtttttgtaaaatatgagttgggtttgtacgaattagttttatttggtgtaaaaattgacctttttgagtttgtgccaaattgcgcacccattaaaacatgccaaaaaagtggccacacaaattatcgtgaaaatggtgccgagtcgctgaaatgcaaaaccaattttgtttttggtccgacccgatacattcggccttcatttgttatcggaaatttttacatgcccttgaaaaataaacgggatttcagcttcgagtacccgaggaaaatattaaaaaatttccattataacgggtgccattctgcaaatcagtaactaactttttaaacggcaccttaagatggtttcgttttggtaaacatttgaccccctccaccctcctctcagcggtggttttagtctctgctcggagggcaaagtgcgcaaaagtgggcgtcataatcattcactcattcatttgccctttcatttcgccctccacccaaaacagcgacaaattcttcgccaaattcctcccaaaattacaaaatttatgccaaaaattcaattcaaaaatg

SEQ ID NO: 115264 - DNA, 614 bp, Heterodera glycines
  misc_feature (605)..(605): n is a, c, g, or t
  Promoter: Source sequence=SeqID_20287; Location=970..1583; Strand=+; Gene=SeqID_85086
tttggcaattcagcaattaaaagaattaagcaattggaaataaatgttcgctttgaaaggaaaattggcaataaaattaatttatgcttttaaacgcgtttaattatttaattattaatttttattgcttccgtttgtctattaaattttgttaatattttcttaaggcaactaataccatattagggaagcaaacggaaatatggctttatatttattggcaatttatgcttacacatagtgacacgttaataaatgttggctggtagtgcgtggattttcaatgtaaaaataaaaaaaaatcgtcagtgccatttgggggatggtggggcctcggcagtgccattttcgtcggtcctttcgctttgtccaaaaagaaaagtaaaaatttcataagaaaacttctaaaattcaaattcgaacaatttatttgaatttttatatatttttgcattattttattatatgagaggaacaaaaaacacttctctgaacatttatttataaatgactttagcactaaaaaacacttaattttccgctgcgctttttcacaaatattattttgaaatattcaaaaaattaaataatttattttattattntagatcatg

SEQ ID NO: 115265 - DNA, 711 bp, Heterodera glycines
  Promoter: Source sequence=SeqID_7004; Location=1361..2071; Strand=+; Gene=SeqID_63547
attgaataccggtgattggactggcggagaattgagtcccagattaaataaagagaagagtcccagttagaatgccggagaattgagtccctgtgattttctgccgtaaaattgccgaaattgagtcccaagattaagtgcaaagatttttttagaatcagtcccagtgatcggaagggataattgagtcccaataattgggatgccgaagaagtgaggagaatgacttccagttattagaatgccggataaaattactgagattgagtcccaagattaagtgccaaagatttttttacaatgagtcccagtgattggaatgccagataattgagtccttttgttttttgccgtaaaatcgttgaaattgagtcccaagattaagtgctgaataatttctagaatgagtcccagtgattggaagggataattgagtcccaataattgggatgccgaagcatttttgagattaagaggcgcatgcttgcaatttttaataagcaagtccttttataatttcaacagggactgaatagtgcgataaaaatttaaaaatgcgtttttttaggtcaatttctttcaattcggaatgtctaaaacgattttgagttttggaccaaattatttatgtttcattaggtttttctttgttacctattgtgccacaaataggctgctttatctattttctttttaaatttagacaatatg

SEQ ID NO: 115266 - DNA, 123 bp, Heterodera glycines
  Promoter: Source sequence=SeqID_33483; Location=770..892; Strand=-; Gene=SeqID_63537
actttttctattttctttttaaaattttttttaggtatcaatttaataaaaattcattttcaatcagcgacgaataaatgtccgacaacgtctcgaattcgatccaggagttaagggcggatg

SEQ ID NO: 115267 - DNA, 1003 bp, Heterodera glycines
  Promoter: Source sequence=SeqID_10251; Location=3432..4434; Strand=+; Gene=SeqID_73407
aatatgtacaaaaaaccccacatatgtaaataaaattttttttaatggtattttttgggaaagaaattccctgtaaagtatgaaatagccacaaaatgacataaaaattactttttttggtattttttggcaacattttcaaacttattttttctttataaatcttcaaaatatgtacaaaaatatttgccgaaattttggattttttttgaggatttccaaaaatttccgtaaaaaatactcaaaatatgtaaaaaaaatgaaaatatatatatgaaaaaaatccaaaatatgtacaaatatgtaagaaaatcccgaaatatgtaaatatgtagaaaaatcccgaaatatgtaaaaatatgtaaataaaagtcccggtttttgttcgcaaacacaaaaaagaaagtgtttttcctgctatttagagcaaggagaagccaggaaaaaaatatgtatttacataaaattggcagccctagtgattaaaaaccaatatttttttgaatagtttggtgtttttcgaaattgtttggcatttttcataaacaaaaattatcccagtaattagtctttgacacccacgaaattgttgtgcaaaacattcattttcattcattcattcgtccacctcacatttcttttattgatttctttttctcacaaatggagaaataataacggataaccactttgttactccaaattgcataaaaaaggattttataaaattattttatttaataggagtaaaaaacccataattagcgcgcgtaaataaatcgaaaattacacatttctgaccataatttatttattggtcgctaaaataccataaattttgattattaattttgttgttttgactttacacttatgccaataagataggcattattgataaagattggcaaaccatacatttggtctttcgttaacagtcaattggactcataaaattaatggactcatttaattaatccaggaaaacaaataaaaaagaatg

SEQ ID NO: 115268 - DNA, 105 bp, Heterodera glycines
  Promoter: Source sequence=SeqID_3884; Location=1..105; Strand=+; Gene= SeqID_52279
tccgaactgaccattttccgccctgtggacgatagcgttggatcactgcaacacttcctcgagactttggagcgtgtgtgccgccaacttttgagcctcaacatg

SEQ ID NO: 115269 - DNA, 965 bp, Heterodera glycines
  misc_feature (503)..(504): n is a, c, g, or t
  misc_feature (551)..(551): n is a, c, g, or t
  Promoter: Source sequence=SeqID_14448; Location=1..965; Strand=+; Gene=SeqID_78491
ggtcgaaactttacaattgggcggaacggagctcaccttcgaacgccggggcaaacttaacgccatcacacagtcagaagttgtgcacattggcgaacaacagcaacaaacggtgccaaaagaacagcaaaagtcgggagaggaagggtaagttggccaaagggaattggacaccaatgaacacaaattaattgaaaggggcgcaaataagcaacaaaatggaggccatttgcaagcggaagaaaatgcaatgggccacaaaacggaggtaaggacagacagttttaagaggcatttcctttttagttcttggcaattctcatcagcccctaaaagatttttggaaaaattgaagaataaatttaaaaattcgttcacttttcatgcgccggggactgactgtccggtagtgccggcaatttattatgaagattttggtaataatctcttcattaagaaaatgatatttaaagtttgtcttattgttgacttttttcctcgannaatttgaatctctttcggtgagattcttcaaatatcaaaaacgaaanatatggaacctataattaattactcatctttttaaaatttctttttgcatatgtcagaaattacggcgttctgtcaaaggcaactccatcgcgtcttcaacggatggacatttaaggcatcgtactaatgagaacaaaaaagcagcaaacgcattattggaggggatggcacagcgatttccaacggtggcggaggttctgtaaaactaaaaaatcaagttgaagctgcagaacatttcacacactccggcttactatgattttctctcttttatttaaggtcgaaatgccgtcgcaaaatgatgacgaacaaaggtaaaatggacgaaattgccttcaaaaaatgtttataagctaaggcccgtggctgcttcgaaagtttcattaaaaaagggacgaaaagcggccaaaatg

SEQ ID NO: 115270 - DNA, 1003 bp, Heterodera glycines
  Promoter: Source sequence=SeqID_7827; Location=1046..2048; Strand=-; Gene=SeqID_66087
caatttaataaagaatgtcatttaattatttttttaaatattcaagaacaataatccatttaccagtcaaaaaaaaacattttaatacccaaaataatccatttaccagtcataaaaaaacatttcgagccataaaaatggcatttttttagttccaaaaaatggacaaaagtgttcaataaataatcatttaattatttttgaaaaatcttttcaaaaaattaccaaaagtggtcatgggaattggcaaatccactcccgcctcctcctccacctcctcggtgatgaatgggggcaggcaaagggcgaacagcaaaaagcgtatagaaacgccaggacgaaaacgaacaataccacaaaaatgctaaatgctaatggcaccaatcattttttttataaataattaacattaaattttaaaaaaaagagattgcatttttttgcttacaataaaatgaactgaagaaatcggccgaagacgccttgcgtttccatccacaatttgctgttcagccctttgcctgccatcgagagattgtcccgataaggacagggaataacggagggggggggatcagctattagctgagctaaaggggtgaaacgagggatggggaggggggtggataacggcaaacgttccactaaacataccggaaggaagagggaggggattaacaacgcaaggaagggggttaaaggccgctaatagcgggcgtaagcatttggggggggggggaaagcgattaaggtactggggagagtactgtatccattgatcagcccgtccgctctctctctcgcgcattctctctctctcattctttgcaataagtttgggatttatggatcgggagagggaggggaagggatccccaaacaggtcaataggtttgggctcatgattggatgaccaatcaaattatcgaaatcaatcgataatttgattgggaatattatctactttaatatttttttttgctcttttaaaatttcagtcatg

SEQ ID NO: 115271 - DNA, 87 bp, Heterodera glycines
  Promoter: Source sequence=SeqID_28204; Location=2123..2209; Strand=-; Gene=SeqID_46091
gaagagcaagaaacgactcgcgtattttcgaaaatttacaacaaaaaaaagtattaaatattttacagaaaattagtgccaaaaatg

SEQ ID NO: 115272 - DNA, 677 bp, Heterodera glycines
  Promoter: Source sequence=SeqID_1008; Location=984..1660; Strand=+; Gene=SeqID_65975
attatgacccctcgaaaatggtagaactttgggcgccatggtgccgataggcgatgccagaaaattttgattttcattgaatttagttaagaaaatgttgcacgcactttgaagtcataaaacgaaattttttgcgatttttcaagaaaaaatttgtttgttttttgaaatttttaaagtttttggtagcagttttgcataaaaatggccagattagatcattttaacaatcattctcatacatatgttttccttttttcacatagaattctcttcttatttcggttttgattttagcttacaaattttctacaaaaaattttcatggatttggacgcattttttcgtttcttcgctggggtttgcaatttattttaatgtttgtcttaaactttttttttgtccagccgcgcagcagccagcaccaatgagtatttacgaacgctttaacaaggaagtttgcgaaaaaaacccttgagcgtaaatctaaaaatgtacatttagttcttaaaaaattggttgcgatcaaatactgtggagtcaattaacgcaagaagcgttgaccacggaggaaagacgcctttgatttgcgccatacagcgtgaatgtttgttgttttttctatttaaaaataatttttatttgcacttttaatagcacctcttgcgtgcacgatg

SEQ ID NO: 115273 - DNA, 115 bp, Heterodera glycines
  Promoter: Source sequence=SeqID_37422; Location=46..160; Strand=+; Gene=SeqID_66502
ggtgcgcgcatttttgaatttgctttactgacattgtgtttattccttctgcaacgcaggcacgaaacgattcgacgcctctgacacgggggaccgagacattcagcggacgatg

SEQ ID NO: 115274 - DNA, 304 bp, Heterodera glycines
  Promoter: Source sequence=SeqID_2271; Location=1272..1575; Strand=+; Gene=SeqID_78836
ttgcccccgtctccgctcacttcgatgctttggtggacggttgtttcaaggttctcgtaattaatgccattccatatttttaataaaaaatggtgtaaggctggagaatctgggctccaaaaaaacattttctatagtaaaaggccagctcgccggaggtttccggggctttgatcacgaattgatttcagaatttcgacatttttaattttagaacatagatttcctgaatttccgcccgtgtttttagaccaaaaagcgcaaattgcgacgcctttggatccgtcaggccattctcaccatg

SEQ ID NO: 115275 - DNA, 477 bp, Heterodera glycines
  Promoter: Source sequence=SeqID_15453; Location=1327..1803; Strand=+; Gene=SeqID_79716
tctaaaaatcctcatttttcattctcctcctttgaccaacttctttatatatgctctcaaatttaatatcacattttttgacaatttttgagccacacatatttaatataaataagtttttatgttgaaactatttattgtttattctctaattattttatcaatggacacgccgtcacatgtatctgatcgcaaggccggcgatggtgttggtaatgctgatgcaccggcagcatgccaacagcagcagccgagtttggccgatgacgaaccgctgttggtccgacagccaaaggaaacacctgcgcaacacccgatggagaatgaggaggaaccgcgacaggaaagcgcactgcttcctcagcccacacatggggatgacatcagccaaacggtcagccagttgccacccaccacagtgcacaaaacgcgaaattgtcaaaacaaaaaagtcagttgctctcgtttgttaagatg

SEQ ID NO: 115276 - DNA, 211 bp, Heterodera glycines
  Promoter: Source sequence=SeqID_11412; Location=1..211; Strand=+; Gene=SeqID_74805
tatccgtttgtgaattatggtaaaaaatctgcttgcatttttgaaattttccttcgcttaagacaccctttatccggtgggggtccctaaaattgtggtgagcagggaattcgatgtgaattggacggtgcccgacgatgtgccctatgatggtctgctaaaggtgaaggtcatccccccaaaggaactgctttatcctctcctccctatg

SEQ ID NO: 115277 - DNA, 196 bp, Heterodera glycines
  Promoter: Source sequence=SeqID_22581; Location=143..338; Strand=+; Gene=SeqID_53245
ttagaggcacttttccttcgcgcgagtcgaagccaattgtttattggacgaacattttaaatgcactgacattccttcgaaatgcaatcgttctgaacgaacaggcgagggtaggacagaaaacaattgcttttaattaaccaattaagtgcaatttgtcattaaaaaattttaaaaggattatttggcatcgatg

SEQ ID NO: 115278 - DNA, 449 bp, Heterodera glycines
  Promoter: Source sequence=SeqID_713; Location=3999..4447; Strand=-; Gene=SeqID_59587
aaccgacttggcacaccccatataaggacttttttttgaaaaattatatttgttggtcaaatgacaaactttttctttgtaattctgccgagcaatacgccaggctttgttggaaataaaacaaacaaattcaaagtacacttgacaaagaagttggtgttcgatggggccgggtggatggttggaccgtcaggcataatttgcccaaacaggctggggaaaaacatggctttggggtcctttttgtgttaagttgggtacatggaacccacaatatgtaatagttcacctatacagcagcaggaaataccgtttccgtgtaccaaaaggtaagctttctgtcgccacaattgcatgagaggggcaaacagacacaagaagagtgaaggcaaaatgaagagcagcagagaaaactaagagaaaatgaacgtaaacgctcgaggaatatg

SEQ ID NO: 115279 - DNA, 408 bp, Heterodera glycines
  misc_feature (52)..(52): n is a, c, g, or t
  misc_feature (54)..(54): n is a, c, g, or t
  Promoter: Source sequence=SeqID_24356; Location=1..408; Strand=+; Gene=SeqID_55076
tcctctctctgagtgccaatgtcccctccgcccctctccttaccaagacctncnccgtgccgaagtcgcgtggcagcacatacccctaaggaattagcctaaaatggaagaatttatgtgattttagaaatgttttttctacttttgagtggatggatcgcggcaaactcgcggaggaatagggctgacgcaataaaacgcccatttccgccgattgacgcaattcgtccaattcggccgccaactgacgagccaatggagaagtggcggcacggccgctgaatcaacaaacaaacgatcattcaatttggcaaaggagtggttgacctgcttgaagttgagggttgttctgcctgtggggggtgctcctgggggagtttttctgtggacaattgatggggcggaatg

SEQ ID NO: 115280 - DNA, 1003 bp, Heterodera glycines
  Promoter: Source sequence=SeqID_7071; Location=4278..5280; Strand=+; Gene=SeqID_63741
atccaatggtaaattaaatttcttaaattattctatttcatttatctaacgcgaaaatatgaaaatttacaaattctgactaaaatttaaaataatataaaaattaaattatcagtgaattttaattttcaatcgttgaaaaaaattgatgaattatttttatttttatttaaaataaaaactgaccaaattaattaaaattaaaattgaaaatttttacattaaacctaactaatagagggaaaacgcaaaatgattaaattttacattatctttatgaaaaataaattacttttttaaaaatatttggaatgttttatgtttttaataatttggctgacttttagtggtaagaaaaatttaaaatttatatgacaaaatagctgagactttaatctataagaaatatataaatattatttattctggtgtctcccgaattttttacgaatttttttcctacatacgatgtaggaaaatcgctggttccttccatgtatgtctacatacgattttcatagagggaggctcatcgtatgatgggctcgtcgtatgtagaaatgttttaatttgaacgcacatacgacatatcgtacaaataatcgtctgccgcagacgattttacgtgcgatgtgacgatcgcatcgtagatgcgatgatacgatgaatttgaacgtacatgcgatgacttggtgtgataaatcgtatgcgggagacgattttaatttaaacgggcatcggggctatgataagccatcacatcgtatcatcgcatcgttgatacgatgctaatttgaataggcccctggattttggtctcgaaaatccagacccagccagatccaggttagacacgaaaaaaattccctaggtccaagtctcaggctttccaaaagttgaactcaaatgttcaaaaaatatttttttaaatattaaaaataaataacaaatataaacttattcataatttaattaattttagttaatataaatgacaaacatg

SEQ ID NO: 115281 - DNA, 1003 bp, Heterodera glycines
  Promoter: Source sequence=SeqID_4369; Location=2954..3956; Strand=+; Gene=SeqID_54197
gattttctcaaaaattaatggcgacaaaaaaatcttatttacgttaaaagatacgtcaacaaatgcactaataaaatacccaaattagtgataaaaaaaaaacctctaaataatttcaatttttcttcctttttagcctttcttttttactttccactgactgtgccttttgtccagctttcgtcttcaattttcttcatccaaaatagcggtggaaccaccaaaaccagtgacaacatcttcgaggacaacggcatcaaagtcctcgactcgttgtgggccgccgtcgcgcacgctccaaaatgtgtggcgttcgctgccggctttggattggcaaaaaatgccgttatttcgctatggatttaggcgcttgaatttccattatgtgtagctttttgacatgcatttttgcacaattttgggcataatttccaattttcttggtataccattgacggattcaccacgaaatccatcacatgccatatttttttgaaaaaacaaagttttttctgaacagcttgccatgggcaacatcgaaggccttgttgaaaaggtcacggaaatggggctggaggataccattaagtcaaaagaaggtcaaattcgtgctcagcgcatcaaataacccctaaaaagtgttttttgaatttttattcctttttttgtgggaccaataatcttcatgattgccaatattttattttttcataaaaaattgacacaaaatcgcaaaaacttttcatttttaaagtctgttaatgctaattttttgtcggcaaaatgctgattttgaaaattttaggttgggagccctggtttaaaagaattttttggtggccccaagcgtaaaagtgccgaatttaccaacatttaaaattaattacctgtgcaaaaaactgaacatttggtactcattttctttttagaagcaattcaattttctttttttaaatacctcaaaatttcgtctgcaataatccgaaggcttttttcgtcgatg

SEQ ID NO: 115282 - DNA, 428 bp, Heterodera glycines
  misc_feature (8)..(8): n is a, c, g, or t
  misc_feature (65)..(65): n is a, c, g, or t
  misc_feature (70)..(70): n is a, c, g, or t
  misc_feature (75)..(75): n is a, c, g, or t
  Promoter: Source sequence=SeqID_35732; Location=487..914; Strand=-; Gene=SeqID_65217
ttttttancaatgcagcaaattaaaatatgatacaaatgtgcaaaatatcacataattgtcaatntcatntaatntagtccgacatcctgggtccgaattcgaacaaaaagtcgaaaactcaaatttttgaatttcgtttttttgtattgaagtactgctgactatttgtttttaaacagggtttgaacccaaaaatgcgaaactcgaaaaatttagaattccttttcactcttttataaagttttgtcactttttcttgaaaaaaggaatacggtatcattaacaaatttcacccaaaatgtctgttgtcttgctaggcaaaaaatggttcaacaagatgtaattaaattgttatcaacataaaaattttcggttgcctgaagtcaaaatttagtttatttattttccagaattggatttcaaaatg

SEQ ID NO: 115283 - DNA, 71 bp, Heterodera glycines
  Promoter: Source sequence=SeqID_13557; Location=1..71; Strand=+; Gene= SeqID_77461
atagtcaatacaatccgttttttcctttttatgcttggtatcattgcttttccctttagctattgcccatg

SEQ ID NO: 115284 - DNA, 184 bp, Heterodera glycines
  Promoter: Source sequence=SeqID_5920; Location=1..184; Strand=+; Gene= SeqID_59689
ttttctctatcaaatatgcaaaatttggtgtggatttaaccagtaaaaaaagttaaacaggatgaagtaaattcggtttttctctaataacagagacaaagaaatagcacgtaaaagactttcacgttctgttttaagtcagatacggacacattgaaatttgaaatttatcattgaaaaaatg

SEQ ID NO: 115285 - DNA, 278 bp, Heterodera glycines; identical to SEQ ID NO: 109672
  Promoter: Source sequence=SeqID_4213; Location=2670..2947; Strand=-; Gene=SeqID_53619

SEQ ID NO: 115286 - DNA, 343 bp, Heterodera glycines
  Promoter: Source sequence=SeqID_11305; Location=1601..1943; Strand=-; Gene=SeqID_74683
ttcccttttcagctacatcgaccattccgtcattgaatttctccgtgccaatcaacaaatttggaacaaaggcaccaatttgagcttgtgtgttccttttgcaaaagatgaccagcagccaatttggcgtgtttttgtccgtgaaatttggccaatttttgcacaaagcattcgccacttgagcattttcggcaatggcctccttttggacaatttgcgtcgtttcatttcgcccacaattctcactgatctcaacattaattcaatcagttccggctatttgttgcccgatgcgactgatgatgttgacgagccaaatgcaattccaactgctggccaaatg

SEQ ID NO: 115287 - DNA, 64 bp, Heterodera glycines
  Promoter: Source sequence=SeqID_6964; Location=4273..4336; Strand=-; Gene=SeqID_63425
ggtatcgtccattttttaatctgcaatttcattattaaccagtaacttttaggtgccaaccatg

SEQ ID NO: 115288 - DNA, 390 bp, Heterodera glycines
  Promoter: Source sequence=SeqID_18150; Location=2149..2538; Strand=-; Gene=SeqID_82736
ttgacgaggggaatggccacggtcatttggaatagtcatgggcgcagcattcagtttcaacctccggcattttcttcagattcactcgtcacttcgaccagtacttgggatacttggccaacattgtgctacgactccaaaaccgcataatcatttactgtgattcattggtcacttcctatcttcagtccttgggaaagcgcatcaattgggagcggattcaagtcagtcgatttcagtctttttggagtttttattattatacaatattcttttttaggttgtggagctgtctttgcaggaattgccttattacaaattccgaaatgaggtgtttactctccctccaaatgccaaacaattgtggccccacagattgaagagattatg

SEQ ID NO: 115289 - DNA, 102 bp, Heterodera glycines
  Promoter: Source sequence=SeqID_10399; Location=1..102; Strand=+; Gene=SeqID_73594
tttctctataaaaataaagtttccaacgcaattaattcttcttccctttgtgacgacatcattcggaactcggccaaattgtgctaattgctgccaaaaatg

SEQ ID NO: 115290 - DNA, 470 bp, Heterodera glycines
  Promoter: Source sequence=SeqID_7909; Location=5179..5648; Strand=-; Gene=SeqID_46501
tatattttataacttttcttaaaacaaaaaatgaatgtttaactcaaacaaaagtaacgccacagattcaacaatttaaaatttttaactagcactattttaaattttgaaaaatccatccggctttaattcaatgcagattctgatgttcgaccacattttgctctcattcattttttattattttgtaattaattctaatttaagcattgtcaaaatattaaataaatccatctcatatgtcacctacaaaaaacaaaagtattaattcgcagtcaacgatatttcttagtccaagcgaatcaaattcttccaacacgcaaaaaaagtttgctattctaaaaattacatctttataatagcttttcccacatttcaaaagcagtcttgacaaatccattgagaatgtaatcatcagtgttagggatgagtttgggtatctgaaccaactctgggacactgttcacatg

SEQ ID NO: 115291 - DNA, 61 bp, Heterodera glycines
  Promoter: Source sequence=SeqID_30387; Location=119..179; Strand=+; Gene=SeqID_60801
ttttgtgcttttgtaccgatgcaaatcgttgctacgaagcccagcagtgtttacgaatatg

SEQ ID NO: 115292 - DNA, 1003 bp, Heterodera glycines
  Promoter: Source sequence=SeqID_13489; Location=343..1345; Strand=+; Gene=SeqID_77377
ttctttacgtaataaaattttttttattttataaatgaaattaccgtatttgctctttttatatgccatggtatattatttttcaacctcctcagaagggggtagataattggagattggtagactaatggagactgggagattatttttcgatgatttatttagtggaaaatttttgaaatttattttaaacatgtcgccaaaaaatgtcatcgcgtcaaaaaaaaacatttttattgcatttatgttaaagaacttctgaaaatgactccaaaatgacaaaaatctatcattttcttgcttccggtatgcataaaaattggaatttttaatttgaagaaaggagctcaaaaaacgtattttttcgttgaaatttttcgattctgatgtcactatcgggcactagaaatcactacctattttggcgcttcgtactaaaatagtgaaaatttactatttcgacatttttaggaaaattccttaacaaaaatgcaataaaaccaaaaaaatacacccctaagaaacgacctaaacattttttcaaaaaatgcacccctgagaatcggtctaaaaaatttttcaaaaataccactaagaattggaaaattttcttaaaaattcttcccacaatttttttttcttgacaaattttgattaaaaatgttcagtattttgataagggaatagttcaaaggaaaagtacctcatttgcaactccaattagtgaataaaattattttggcttaatttttgactgaaaattaggtcactattcgtcactatttcggactttttgccactattttggaatttttactcactattttagttaactatttcgagattttccgtcactaaaagtagcgacccaccctactctaatgatgatgcagggctggatttgttcatttattagccccttttactgttgaattgatttttttggaaaatgtgccaaataaattattaaaaaattctatttatcccccctggcacataaatg

SEQ ID NO: 115293 - DNA, 552 bp, Heterodera glycines
  Promoter: Source sequence=SeqID_3654; Location=1..552; Strand=+; Gene= SeqID_51299
tgctaaaatgagaaatgtttgaactgaaacaaagcattgaaaacaatttcaaacttgaaacaatgaagccaaaacgacgagaaattgggccaaaccgaacaaaaagcaaagggttcgattggacacgcgaaaacagctgaggaattgcgtgtggtgatcagaaatgttaagcaaataccaaaagcgcatttctaagaaaacgaaatgaccaaaaatattttttattttttcactaaaaatttgcgataattttaaaatgttaaaccaattgaaaagtttggaataggatgcgtttttctgtcacttttagcccagcaatttcttaatggcaagggaacactttgtcatgcttcacactttgttcagttggcactttttggtgctaaattgactttaatttgttgtggcatttgtcaatttaatttttcttcaccaaatctccgaaaataaaactcgaaatctccccggattcttcctttactaatttcagcatattacaatcacaaattgatcacccaaatttagggcagcaaagtctaatttgctgctatg

SEQ ID NO: 115294 - DNA, 758 bp, Heterodera glycines
  Promoter: Source sequence=SeqID_19464; Location=984..1741; Strand=-; Gene=SeqID_84183
cctgaaaacaaaatttgatgccttttctcacccaaagatgtagagcaggtcctttgctgactgcgccaaattattgtgtatttactacaacaataaaaatgtttggtttttaaccaaagcaaatgttgtccaataaataaataaattatttattaaacaaataaatatggaggacagcagggaataaataaataaaataatgaaatggtggaatgaatgggagaatgcccggagtgagggaaagggagacatatttatggggctggtcaaggggcgggacgagagacaataagagagggagtgaaagggaaaatataatcaataatcggtgtggtcccttatccaacaaatataaacttcaaaattttaactattttccccatatagttcgtcgtgtatccttttttcctcaccattccgattttctaatttaactatttaattcttgaaattaagatatccctaaattaaaattaatatagtatagtaaaataaaatttttttcattagaatgcactatttaattatttgttatattaattgtttattcaaaaatttaactgatatagaaaaattaaaactattttcgtactacagtaaaacatttttcttttgagcgtttttgatttttttctattctaacgaataaatatttgtggctcctctgtatttatttattaagaattttttaataaaatttatttattcatgcaagattcagtctgattgatttattatcattttataattttagcatg

SEQ ID NO: 115295 - DNA, 344 bp, Heterodera glycines
  Promoter: Source sequence=SeqID_9810; Location=1205..1548; Strand=-; Gene=SeqID_72781
agtgtttttaataaaataaaattaaaatagaaaaaaattaaaataaaaaaatcaataaataaatacattaaatttatttaatgaagcaaaaaaaaaatttttaaagaaaaaattgaaaaaataataatttaatgaaacaaaaaaaacagaataaaattaaaaataaagaaagtaaaaaataattaattaaaaaatattaaataaataaaaaataaaatttaatgatacaaaaaaaacagaaaaaataaaaaataaagaaagtaaaataaaatgagtttaaaatatttatttttaaataatttaattaggcaaaaaataaaaattaagtaaattttaggattatg

SEQ ID NO: 115296 - DNA, 357 bp, Heterodera glycines
  Promoter: Source sequence=SeqID_5013; Location=3655..4011; Strand=-; Gene=SeqID_56570
ttgtctgaaaaatggctggttgtctctcagaggtaacatttccgaccttaaaagtttttggttttcaaattccaatatcaatcaattcaccaacctttttgtctcttaattttttctccccttaaggactcattgcgaaatttgccaattcaaattccaattaaaacggtgcgttcgtccgtttgccccggcataaatgcattccccccccccctccccctcagcactgcgccctctttctttgcctatgtccgttccggccatcctcgtcctgtgttcggtcttccgttgacaattcgcggcactcttctcaccgatttattgtgcttcctcctgctaacgccgctcgtccttatg

SEQ ID NO: 115297 - DNA, 267 bp, Heterodera glycines
  Promoter: Source sequence=SeqID_33078; Location=1..267; Strand=+; Gene=SeqID_63251
tttctcaaccaaattaaacattcttggtattatttgaaagcattcgaaaaatgctattagcctgcaaattttcaaatatttttatttatgcacaaaaaaatcagagcaaaaaaaagttcgaattactgggtttttgagttccttctggccataacttttttgaaacttaaccaaaatttttgagattttgcaaattaataataaacacatagagctatcgaacaacaccaacaattcttaatttgattgacagtgaacaaagttatg

SEQ ID NO: 115298 - DNA, 423 bp, Heterodera glycines
  misc_feature (318)..(318): n is a, c, g, or t
  Promoter: Source sequence=SeqID_41745; Location=1..423; Strand=+; Gene=SeqID_69810
tttattaatctcgtgaatgacccaaaaagcccaaaagtgaaaaacggcacatttaattcacttaattattgcatttgtcctcaggctatatgtagtaatagtttagcttttcaattttgctttttgaattgttcagtaaagaaaacccactcaaaataaacaaaagttgtttgaaaagctttgtttcttttctcaattacatattgcataaaatgaaatggaaagagcattacataataatttaattttccaaaaataaaattggtcaattgagggaaacaaaaagaaaaaagtgaatggagaagagggggggggggngggggggaaatagctgaagctgatgaactttgtgccggtgctgttatggtgcgttaacaaccacaggacccttttaaccggcaccattaatgagaggagccaatg

SEQ ID NO: 115299 - DNA, 308 bp, Heterodera glycines
  Promoter: Source sequence=SeqID_40882; Location=389..696; Strand=+; Gene=SeqID_69113
cgtgagtgcgtcctgcctacatgatgggagctagcagtttgtccctcccttccgccgaattttatatttttcaagcagaattttttttattaaataaaaaatcctagaaaagttttctgtgatttttcttaaaattgttggaaaaccctattaatttaccataaaatttttgaaaagattactgagatattataagaaatttgaacaatacggagggggggggaggaggaacgtaggctcgtcctgataagaatagggattgtatttgatatgctttttaatcaagttttgaatttcaggtcaaaatg

SEQ ID NO: 115300 - DNA, 271 bp, Heterodera glycines
  Promoter: Source sequence=SeqID_15991; Location=1..271; Strand=+; Gene=SeqID_80352
attgaataaaaaataaaagaaaaaagaaaaattcattcaaattttttgtaaaatttttgttcattatttgtaagaaatttgccggcatcggaggacagtggcaacccgctcaaatcttctgaggataaccaaaaacagcagcagatggatgaaggagaagagaaggaagcggaggagagcaaagagtaaaaataaaataaaattaatatttagttaataaataacattcaaattttttgtcaaatcttttttaattatttgtagcaaaatg

SEQ ID NO: 115301 - DNA, 544 bp, Heterodera glycines
  Promoter: Source sequence=SeqID_15032; Location=1001..1544; Strand=+; Gene=SeqID_79208
tctaaaaaattaatttaaaaaatgggattaaattcttttttgtttaagccgccagtgaaattttaatttaatttcgaaatgccaaatttaatttacgaataatttattctcttataaatagggatgatatttataggcactaaaaaccgccaaaataggtaggctctaggctctaaaaaacccccaaaataggcactaaaaaatggaaaataggcactaaaaaaactcatttttaggggtgtaaaatgacaaaaaattattcaaaaaagtaaaaaaattaggccaagtcagtattgagataaataattttttaaagcataaattcttgtcaagaaaataaataaatacattttggagatgaatttttggaaaatttttcatttctgagggggtttatttttagaaatttttgggtcgattcttaggggtgtatttttaaaattcccaaaaaatcgattcttaggggtgtatttttcgtttttattgcatttttgttaacaaattttggacaaaacgccaaaaatccattttttgaaaagaaatg

SEQ ID NO: 115302 - DNA, 1003 bp, Heterodera glycines
  Promoter: Source sequence=SeqID_9640; Location=813..1815; Strand=-; Gene=SeqID_72164
ccccgcccgggtccattttccaagtcccggtcccggccatttgggtcggaaaaacgggactaaatttcaccagtgaaactgccccaaatgtgaaaaatttaataattatttttggcgaaaggtcttttatttaaaattttgaagatggaatttgggttttctacatacgatttaaactgttaaaaagatcataaaatccacctaaaatattcaaaattagatctaacatagcatttttggggaaaattacttaatatgaatgtaaaaatttatacaaattcttacgccgggcccataaaaatccttattttcttaaaaattgagttgaaatcgcaaaactttgtcatttttttggtgtaaatctgtttttttcatgttaaaaatcttaaattatttcttaataaacagccaaaaatagggtaggaaaattaaatttaatttagaaaaacctgtttatttaaaacaaggctaaatctctaaattttgtaaaacgcatccgagcattaaaaaattcataatgaaatggtttttcggtattttactcattttttatgaaaattaaggagttggaaaaaattggaatttttccttatctttaacagattttcacaaaaatggccaatttttggatagaattttgactataggaattttgaaattgaattatctataactaaagttacaaagaaaattgaaatcgagatatgccgaagcattaaaatcattcaaaaaataattaaattttgtaattttttttgaaaaacccacaaaaactcaacaactcatttctcttcgaccaattaaaaaagatcacagaatgagtttaaaaactcaaattggcagactgatttaaaattaaaacagcataacataatttcagaaaaaatgcgaacaaaagatttatttcttttaattatttttaatttttgtcggattttcaatttctatgcaaccactactgcctgaaaattgttctacgacattatatgaaagcttaaaaatg

SEQ ID NO: 115303 - DNA, 1003 bp, Heterodera glycines
  Promoter: Source sequence=SeqID_8226; Location=1251..2253; Strand=-; Gene=SeqID_67361
tgggagagaaacaatgctgaatttgggcacataaaaccgcccccgcccgcgcactgtccgccgaccgtcgcggttcgcctggggagcaaccacctgctgatgctgttgctgctgagacggaagaacggacagaacagcgaaagcagagagaatcaagcttttcataccaccacatcataccatcaccagcaccaccacaatcatcattattctaattaattagtgaaagtaattagctaattaattaatcaccccccgcccattccctcctcttcctcccaattcccatcttcgtccttctttactttcttccactactgctgcacaacaccaccacacacaaatgtatgtatgcgttgtgaaaatcatccatttggaatattttccgaagcacaatattattggtggtcaccatttattggtgcataatattttgaacacttttattacatagatttcccttaattagttaactaattaattttcatttggtgaacatcattaacatgaagaagagttactaattatctttaattgaaagttcgcgaattgctagagagaaacttttttttttgttaagtcaaaacaaactgaaattttttatcatttaattattaacttgattaaatagtgaattttttattagtaacatgatggtggttttgtttttggtacgattacaccagcaaaattattattttttcggtaagttggcgatgctactgataaaataaaaactgattaattacccttgaacggttcgaaaaaatctcattgcaatttacattattttaatattaaactgtagtaaattaattcccaagtatttaagtaaaatagtagtcaatgtaaaatagttgataacctaattcaatttttttattattatgaaatttaatttattctaaattcccaggtgattagaaaaacagcaataattttaatagaatttttgatcattaaaataaagaatcaaattgtgtgatgagtagtgcccgtgatg

SEQ ID NO: 115304 - DNA, 205 bp, Heterodera glycines
  Promoter: Source sequence=SeqID_12583; Location=1276..1480; Strand=+; Gene=SeqID_76246
agtaaaagacggcacagagtgtatctgaatacgtaaagtatttcaaacggaaaaagaaagtcagactcagtggaagggagcaaatctcccgcagagtctgtatgtcgaaatttgtagcaaaggtcgaccaaatcggccaagtgatcggagccaacggggacggagcaggccaagtccaagtcgatcgcactcaaatggcacaatg

SEQ ID NO: 115305 - DNA, 74 bp, Heterodera glycines
  misc_feature (71)..(71): n is a, c, g, or t
  Promoter: Source sequence=SeqID_14818; Location=1..74; Strand=+; Gene= SeqID_78970
gtgatgaaattgaaaaatgtcggaattgcgcgagagattttgagagtgaacggctcagcgaaggcgcacanatg

SEQ ID NO: 115306 - DNA, 88 bp, Heterodera glycines
  Promoter: Source sequence=SeqID_13133; Location=3429..3516; Strand=-; Gene=SeqID_76937
ggtttgttttgccatttgttggcttagcaattgaggagggccataaaattcggtctgactcccttgaaagaagttggacgtgcacatg

SEQ ID NO: 115307 - DNA, 112 bp, Heterodera glycines
  Promoter: Source sequence=SeqID_25663; Location=1570..1681; Strand=-; Gene=SeqID_56415
cagaaaaacggcacgcaagtcacgctcaagcaaattgaagaggaattaaggaccattcagctggtgaaggacagcgcactcactttggcaaatcctcctgttgcaacccatg

SEQ ID NO: 115308 - DNA, 1003 bp, Heterodera glycines
  Promoter: Source sequence=SeqID_8632; Location=1373..2375; Strand=+; Gene=SeqID_68730
tgacccaaatgttgggcaaagatatttaaatattgttgtatttgattgttgctcataaattcataaaaaaacgagttaggcttaaccaatattttgtaacgtaaaaacgcaaaggaaatgactgtgctaacttataacactgggatggatggattaattggtccaaagctgaagaaatagcatcagatttgttgacaccccaaaaatagcaaaaattattaattttcgcatggaaaccccagggcctcgcattttgaggagacttagattttgttgtgattacctatgtgatcgaaatgttggttctcagccatttaattgttgttgtatttgatttttgcttacaaatccataaaacgaattaagcttaaaattaagttttttaccacaaaattaaaaattgctgttttctgcttactcaatccaatttttgtcattccacaaattaaatcaaatataaattgttcaaattggcacacgaattttcgcggtctttccacttaagtgccgccgtttcgccaataagcaattccatcggggaaaagctcagcggaatcgctgaattcagcccagtgagaccggtgagaagtgtcagcgatgtgagacgaagcaaattgtccaactgatcgcaatagtcaaatcgcaaacggtgaatgttttttgtaaaatgggccaaatttgacgggcaaaaacatcccaaaggggctggacatccttcgttttgaatgccacacattcaaatgcaaaagggtttttccggatttagtaatactcaccgggtcataccatcggaaatgttatccaatatgaaaagcaaaacttatttgctcggatgttcataaagcacatccttcgttcttttcgtgtaccagagtatataaagctgacaaaatccccttccagtcatattcttcattcagcccattaattccatccccatttatttgatccttttttcagttcagttctttgggaatattgtctaattaccagcaaaaaaatg

SEQ ID NO: 115309 - DNA, 813 bp, Heterodera glycines
  Promoter: Source sequence=SeqID_15349; Location=1..813; Strand=+; Gene=SeqID_79603
tgatttcaatatatcgagcttcgaaatttcgggtttcgatacttgcgtatcagtttcgagtgctaagccgagcttcgcccgtccctgtctcagaccagcaggaggccccatttcttatgctggactagaactgattttttgaaaaactcccaggaaccagaccgctaacattcgatagcccaaagtgttttctattagcctgcaaaatttaaaatttttgatgaaagttgtgacggaaaatgttaagaaaacatttgagtacctcaggtcacaaatagatttttcaacagaatgaaaattgtttttcggcgcaatcgtttcggcccaacaagtttttggctataactttttctttgtcaactaaattcaacattgttggtatcattctaaagcttaacatgtttataatgtattttaagttattgcttcgcgattagacaattgctaaaaaagttatacatgaaaatttcgaatttttaaagttttatcttaataagttttttacaggcttgcaaatcttttcgcctttcgcagggctaatagagcatttgaagggcttaagaatgataccaagattattagaattggttaacaaagaaaaaagttgtaatcaaaaatttgggctggcaccgaaacgccaaaacggccaatccctttttttagatttaaatgtttggccttctatttcctaataataatttcttattttttacttttattgtaatcgttttcaagaaattgcttgaatttagataatttgattcacatgaaaaatttagattattcttttatttatttaagttgaaaaaaatg

SEQ ID NO: 115310 - DNA, 333 bp, Heterodera glycines
  Promoter: Source sequence=SeqID_22534; Location=591..923; Strand=-; Gene=SeqID_53199
aattatttttaaatttaaattattaaataattttttgattataaaaatttacagcggagcgaatttaattaataattattttggcgaaaatttggtgcaatacgccaaagctgtcaaaattgagtttgatccgtacaaaggttaatatgtaaatgtgttatatcattaaaagggcggcaccccaaaattaaaactgttgaaatgagaaagcgaaataatggctggaaaaattttacggattaattataagaaaagcgcattttcagtaaaagccttttttcgagttaaaattcctttaaaatgaatttcgaatttttcacttcgcttaaaatg

SEQ ID NO: 115311 - DNA, 155 bp, Heterodera glycines
  Promoter: Source sequence=SeqID_186; Location=1..155; Strand=+; Gene =SeqID_76730
tacaaatctcgtaatgacagggacagtaatgacaacacttaattttatgtgggcagttcatttttcaatttaattttattttgggttgctatttatagaaggggtatataaagggagtgaaaggaccatttgattgataccttgtatcaaaaatg

SEQ ID NO: 115312 - DNA, 261 bp, Heterodera glycines
  Promoter: Source sequence=SeqID_14280; Location=968..1228; Strand=-; Gene=SeqID_78299
ggtgggccgcgtctgccgtcatgtgcacttatcagtcgtattaccacgattcttatctcgcggcggagttcgagaaacggagagccatagcatatttatggaccatggggacgaacgccgggaccaattgggcaaaatgggcgggggaggagcagcgaaattgggagagacgggggaaggaaaagcggaaaaaggaagggaggggagcataatttgaatgggaaatcacaaattttgaaattaaaatgaaaattagcaatg

SEQ ID NO: 115313 - DNA, 1003 bp, Heterodera glycines
  Promoter: Source sequence=SeqID_7536; Location=4141..5143; Strand=-; Gene=SeqID_65152
aaattgaaacatttaatttgcacctcttcggttggtgcacaaaagataaagcctgtactttactgatgagtgttttatttttcgagtttattttaccaataatttaaatgtatctcctccatttatgctcttctttcactatttcaatgtcaatgtcatcactttgtcttcatttttaacgttaaagtttttctcctggtcctttaattgcttaattaagccaatgattggtcaatcaatgaaaaacaaattgataaaagtgtctatttttggcgcaaactttttatagtttcacattacccaatggtatttgaatatattcaattttcggctctgttccagtttacgcgtccaatcaatatttacgcgtccaatgagtgaccatcctcacttttttaaatcataacttttttattacttggtaatccaaaattcttggtattaatcgaaagcttaaagtttagcgtatttattaatacaagaaaaaaacaaatacttacatatattaagaaaaaatttacaatgagaaacccgaaattcataacttttcgcatatattcaagcatagttttttgtcggttgcttttattccagaattttgctatacaaaaacttccccaaattttaagctttcgattagagcacaattttctcccactttttttctatccaaaaatacaaaaatatctttgtttatattaatacgtttaggtaatttctcgtacattgcatctatttttcaaaatatatttgtttacgtttgcattttagtcggatcaatttttttttaccgatggcaaagcgatgaaaaaatgcataaaaacagggggggaggagcacaacgaaacatttgcatgttttttttgctacaaatttcctcaaaataatcacaaagcccaactgaacataaagttttgctgattttgtgccgtggtttttatttcttgccaattttgaaattgccaataattttaccgcatttaaatagataattaaacgaatg

SEQ ID NO: 115314 - DNA, 63 bp, Heterodera glycines
  misc_feature (30)..(31): n is a, c, g, or t
  misc_feature (57)..(57): n is a, c, g, or t
  Promoter: Source sequence=SeqID_4804; Location=1262..1324; Strand=-; Gene=SeqID_55784
tgctctgttaacaaaaacaaaaaaagagcnncatacattccattccaattccatccncaaatg

SEQ ID NO: 115315 - DNA, 380 bp, Heterodera glycines
  Promoter: Source sequence=SeqID_1260; Location=1..380; Strand=+; Gene= SeqID_71016
ctgaaacctgccgctgaaacctacgcctttgagggccttcctggcaagtttccgaaaattctgtttcggtccaacaccctgcgttcagatgtcaaagtccaacagtatttctacataaaacaccggattcgcctactgtaccctcagctcaagtgcattgttgagtaccacaacaagggccattgcaaatactacccattgggtacaaatttttgtccgaaaaaaataaaataaaataaataaataaacccccttaagagttgttggccattgaggagggctgtgagagtgcacccatcgaaaaacctgccgctgaaacggactatctggactacttgaactttcgcagtgggtggcaatcagcactctactgatcaatg

SEQ ID NO: 115316 - DNA, 367 bp, Heterodera glycines
  Promoter: Source sequence=SeqID_19884; Location=1301..1667; Strand=-; Gene=SeqID_84639
aaacgagcaaaatgaaaacacatcaggagttgatcacctgggtgaagaaatgggaaatggtccaattaatcaacaaaaaagagaaacaattaaaaaatttgatgcaattaaagaaaaattgagagaaaaaggaaaattccgaagcaaagatcaaagcaaaattgagagaaaaattgcaaaattattaggaacaaatcggcaattaatacaaaaatggaaaaatgaattaaatttaaataaaaacaaaataaaaaagaatttttatgatgagaaaaagcgcaaattcattgaacgatttgaagatttaaaagtttatatgcccatggcaaacagatagaatttgcgaaggaattgggcatttccaatg

SEQ ID NO: 115317 - DNA, 229 bp, Heterodera glycines
  Promoter: Source sequence=SeqID_21543; Location=1..229; Strand=+; Gene=SeqID_52158
tcaacgcattcctggatccggagcttcacatcctcacagcgtcatcaccattcgcagattgtggaaatttccgttaccattatctgcaactgagccagagcaattggatcaaaatcgacacacgcaccgctacgatccagaaaatcgactccagcagcatctctgagatccacgaagcctctggagacaaatcgttgttggaaatcacgccgctagtttttcatcgatg

SEQ ID NO: 115318 - DNA, 110 bp, Heterodera glycines; identical to SEQ ID NO: 98226
  Promoter: Source sequence=SeqID_25524; Location=416..525; Strand=-; Gene=SeqID_56265

SEQ ID NO: 115319 - DNA, 817 bp, Heterodera glycines
  Promoter: Source sequence=SeqID_23607; Location=293..1109; Strand=-; Gene=SeqID_54306
tggggggcaattgcctcgtgaaatgaaaaattattattattttttttttgcagaaaaaagggtattttttttaatttatacttaacgactttcccgttttcccacgacgccaaaaatttagaaaaatatcactgaacaaaaaattattgggcccgaaacgcaaaaaaaaaagaaacttaaaaacaaatttaaaactgaatttaaaatcaaataaaataggtaaataataataaaaaaataatataataaataaatctaaataatatttaagataaataagtatttacaagtacaagacaagcaatccggtgaacaagtggttagtatgcctttctttgttggtgtagtgtatagggttcgattcccattaattctgattatcaaactttttaattattttttttttgataattacgtttaggaaataaaaataaaaaatttacataaagagtgaaatactatgttttttatgcataccgaatgaactcaaaagtaaaaatttgatccttttttggacaaaacttgtaacaaattgaaaattaatttaaaattcgcaattttcatgtataacttctttagcaattgtctaatcataaagctatagcttagacaaagcttttaaacatgttaagatttcaactaataccaacaatgtaacattgttggatttggatgaccaagaattaacagtataaaaattgacaaaaaaaatgtttctgatccaatttaacagaataaattttgattcatggcttacggaaaattaaaaatcgataaaaattaaataaaacaaaaaaatttaaaactaaaaaatatg

SEQ ID NO: 115320 - DNA, 231 bp, Heterodera glycines
  Promoter: Source sequence=SeqID_37367; Location=438..668; Strand=+; Gene=SeqID_66456
attctccaatgtggcccaaattttaggcccccagccacagccctttgcttctcccagttttaagtcttggatttgtcaaataaattcaagacttcaaattaataatcaaaaattctcttaaaatttttttgaacccaattcaaaaaaggaaaaaaaattgcagtcaaaaaattattcgaatttctccaattttgtttccataatttccgaaagttattcggtatcataatg

SEQ ID NO: 115321 - DNA, 333 bp, Heterodera glycines
  Promoter: Source sequence=SeqID_29801; Location=1..333; Strand=+; Gene=SeqID_60261
gttgaattaattaattacgaattgcccattaaatagttggcattttccattaaatacataaatttcatttaaaattttttcattaaagtgtttgttatatgataataggggctaaaataaaaaaaaataataaataaaaataccaaatagttttttcatttctcggaaaaaaattatttagtgttttttttatttttaaatatttatttctatattaattttttgttcgtgtcaaattgttattaaaaaattcaaataccatcttattgaattagaaccctcggggctctattttcaaccactcctattttcgaatttttagccaatggaatg

SEQ ID NO: 115322 - DNA, 445 bp, Heterodera glycines
  Promoter: Source sequence=SeqID_4109; Location=1..445; Strand=+; Gene= SeqID_53219
ccctttcgatactattgatcaaattcattagcagccagcgccgctgattgacccgaaatgataatggcacaaatcaagagtcctgatgatttttaatgttcttatgacacttcatcaagtgccagatttgaatggaaatgcaggagcgtactaagtcaatgcgttcttccatcaattagactcaatcagtgaggattgacctaacaaaaagcgtttaagcgcatttaaatcaaaatgctcgggtagagcagagcacgcatacatttctgcagttgtcatcaacccatttcggtatgaaaatatcagaaaggccattaagcagatactcgattctatagatgcgaagtcgtctgatgactgggtttgcagaaggaacggccataccattgatgacatgccggaccgagtttcataggtgtgaagactttacacgggctcagatatg

SEQ ID NO: 115323 - DNA, 119 bp, Heterodera glycines
  Promoter: Source sequence=SeqID_35499; Location=1..119; Strand=+; Gene=SeqID_65039
tcatttcgacgcgcaaaactatgacaagaaaatatttaaaaaatacaattgatttattcttaaaaagaatttttgaataatttattaaaagcaaattaattttttatagcacacgaatg

SEQ ID NO: 115324 - DNA, 278 bp, Heterodera glycines
  Promoter: Source sequence=SeqID_11872; Location=1..278; Strand=+; Gene=SeqID_75380
tggatgttgcacaagggacggacgtcacaacattatcagtctgttttcgctcacatcctgctctcgtccgctgtacggaggccggcttttacaaaccgcacgccgagcagttgacaccaggacgcgacgactccgagcgggcgctcatgaccgaccaaacggcattcaaattgccgaaaaagggagtccccctcattttagtccatcagaacacgcccgcgcaacgcgacgaagtctccacttcttcggccaatcctggccagaccgacacggcgatg

SEQ ID NO: 115325 - DNA, 275 bp, Heterodera glycines
  misc_feature (62)..(62): n is a, c, g, or t
  Promoter: Source sequence=SeqID_4186; Location=1124..1398; Strand=-; Gene=SeqID_53512
atgatacttgtgcagttttaattaatttttttttatctttatctatttagtacaaaaaatancgctggtctcattttcattcctttccacctgctaaattaaaatcttcgtttcgggataatgttattcaaaaatatctacttgtaacaatgtagtttttaatatcaaagattgtatatatccttccttttatttttgaaccgtaaacacacacattaatagctttatttttgaaaaataggaattcaaccgagaaactgaaaacgtcttccatg

SEQ ID NO: 115326 - DNA, 75 bp, Heterodera glycines
  misc_feature (24)..(24): n is a, c, g, or t
  Promoter: Source sequence=SeqID_21738; Location=2131..2205; Strand=-; Gene=SeqID_52338
aaaaatattggatttccatataanttggaagccctactaacctttaattgcatataaattgaggcggcggagatg

SEQ ID NO: 115327 - DNA, 59 bp, Heterodera glycines
  Promoter: Source sequence=SeqID_29486; Location=863..921; Strand=-; Gene=SeqID_46166
tttttaattgccaaattaattccgaaatttcagcttccgattccgtccacgagaaaatg

SEQ ID NO: 115328 - DNA, 69 bp, Heterodera glycines
  Promoter: Source sequence=SeqID_19708; Location=876..944; Strand=+; Gene=SeqID_84455
aatgccctcttaattaaacaatttatatttgaaaactgtcttacgcctcaccccttaagttcgcctatg

SEQ ID NO: 115329 - DNA, 1003 bp, Heterodera glycines
  Promoter: Source sequence=SeqID_1200; Location=3561..4563; Strand=+; Gene=SeqID_69789
tttgttttttcgttcgtttattcgtttcccatcctaattacctaattatttttcatatcatttgataatttctgttttcctcctcttttcccaaaagctatgcttgccacgcgtcccttccgtttcgatcggcccgcgcctcagccgcagcgagtccatccgttgtcactgattcaaatggtcactgctgcgaaaatcgttgacgaacagcagcgggccaaagaacgaacgcagacgccactgtgagttgagagtgacgcgaactgttcaattttggttggaaatgaccaattgctttgttacgatgtccaaattggatagttgggtaaattcagttgaaattccatttggttacgctttgccattggtcggtacttgtacaatttacaccccatagaaagaatttttaatttttcaaaagccatgaaaatatgtttccagtggtatttggggtcgctaatcatgaatccggcatccaatcatttaaattatttttagaacaaaaatatgaatttgaaaaatttaaattttctactttttgttcgatttgggttcggatttggtcgaaatggatatcatattcgtgatcagtagcgaccgaacacccctggaaacacgtttttatcattaaaaatataaaaaacttctatgggtgtaaactgtagaagtacccattggttcccaaatgatttgtcctggtgcttaattaagacagaataacttctacgaagtgtcaaggaagcgagtgagattatcagaaagttttaattgtgaatgaattgaaaagtccaaatttatgaattttgaattgaattaatttaataacaaacccaattttagttaaccaaagggagcaattgaagcgcaaaatcattttggcgaagatcgtcaaccaaagtttcagtttttagtgctttttactattacgttttcgtttagagttcactaaaatttggggtcgactcgcattgaacgtgggagagagttggcgaacacggaaatg

SEQ ID NO: 115330 - DNA, 250 bp, Heterodera glycines
  Promoter: Source sequence=SeqID_2759; Location=1..250; Strand=+; Gene= SeqID_81449
tttttgactattttgtcaaattaattaaacattgacaataagggcgaaaaataatttatttgtttatttaagcagcatcaaacccggcaaatggtttccatatgctgaagaatccattagtaataacatagcaatttttttgcaaatttaatgtttatttttattatttattaaatcaaaagtatttttattaaattttttgttgaaattttgtctatcgacttgtttgaacaccgcacatttcgcaatg

SEQ ID NO: 115331 - DNA, 51 bp, Heterodera glycines
  Promoter: Source sequence=SeqID_12583; Location=1006..1056; Strand=-; Gene=SeqID_47052
tttgccacagatgcggccaaaattgccatttatgtgatgctgcaggaaatg

SEQ ID NO: 115332 - DNA, 540 bp, Heterodera glycines
  Promoter: Source sequence=SeqID_25915; Location=960..1499; Strand=-; Gene=SeqID_56684
cggagaaagcaaaaaaggggatagaaagagaaagaaagaatgggatgtaaaaagggtcaaaaaccaaaaagaaaatgccaacaaaaaaaaaattattttattccccgatttttttttgcttttagaatggcagctcggctcctggggttgcaaattgtctgtttgggtcaattcgaccacatcatgtgcctccattttcacgcttgtcggggtaaagcattttcaaaaaacaaaagctgtttgatgattgatcactgatcaaaaaagttcataaactgaattatatgtataaggaaaaaccaagaaaaatggggaagtttgttgttttcctgtgagataagactactgactcgatccagggtctgatcagtcagactttattgatcagtgttcaaattcgatgactctatccgtttcacaatttcaaagacgtttcgccaatttacgccaaaatgcccattttcaaattgtttcttcgtggcacaggtgaccggcgaccgctatttggccatctgtcatccgttgaggcagctgaaaatg

SEQ ID NO: 115333 - DNA, 729 bp, Heterodera glycines
  Promoter: Source sequence=SeqID_6766; Location=2055..2783; Strand=+; Gene=SeqID_62816
aaaaggccattatttattttagaattttccaaattaatttttctttttgctttactttctcacataatatttatgtgtttgaattaatattttaaattaacattttttcattggatgttaatgttttgcttgtattagtctcggttataaatgtttattttgatgaattttgatggcaaatttatgccattgccaaccaaagccaaagccaatcaatttgttgtcgttttattccattttcatggaaaattctccaattatcgatgtctattattaaaagcaaaatattttttgtcgaaactttaaaaaattttaaaattatttaaaaactttactttcattttttggactgtgaatttttacggttcttaataaaaaaaagcatgtcatttttggcatttgccttttcatttgttgaaaattatgaaattttgcagaatcaataaaatcaaaaaaattaataaaatatagaatttttgttaaaaataaaacatttacttatgttattatatattttttttgttaatttcctttttccatttaatttaatttttaaataattttattattacaattttaattcatcatttatattcaaattttatgttaaattcaatttccattttctgttttttctaaaattgtaattcgaaattaaatttccccgttttttcataattagtttgataattaatttaaatcatcggcactttttgttcccccaaaatg

SEQ ID NO: 115334 - DNA, 556 bp, Heterodera glycines
  Promoter: Source sequence=SeqID_29905; Location=1..556; Strand=+; Gene=SeqID_60364
ttgatactgaatcataaaaataaaatatcattagcagaggtataatggctttcattacaaatgggcatacaattaatatctatggaaaagaatttctgaaaattcgagtttaatatattcgattcatccattaatttagcagttattttaaaagtcgaccaataaaaaaaacgtacgtttgttgttgtacatacttaaagaaaagggataagttcataaaaaaaaattagatgtgtcataattaaagtcaaaaaactcagaggagctgatagattgatgatagtaaattagggaaggatggggacaaattggacaatcaccattatcattagcaattagcattcgttgtgctttctctctctctctcccttgctccctccctcgctctatactcttctagtagtgtgtctctatctctgatgtgtatatcgatctgagtcgctgaatctttgacatttggggtgggttgatcgaatcgtcgagttgacgaatcgaggggaggcggttgaagctttcttatttgtaaatttccgaattatgatcgcttggcgaaatg

SEQ ID NO: 115335 - DNA, 776 bp, Heterodera glycines
  Promoter: Source sequence=SeqID_11510; Location=535..1310; Strand=+; Gene=SeqID_74936
tttgtcctcagcagaaaagcagttcattagtgagtgttcgtaaagcgatgaaaaagcgggcggagaacggacgaaaatgaattaaaaaatgaatggaaaaagcggggaaaattaggtaggggaggggaggcgagatgggataaaatcttaaagggattacgatgaaaaaaggaaaagcggatgaacaaataatagagaggggggggggagggaggcgtaatggggtttttttggggtaaaaaaaaatttaaattaatgaaaagagagaaagggcggcacacttttttgatgaaaaaacacaaagcagctgccaattattattgtttattttattatgagttgtttgtgatgcctaccaaaatatgatcaaaagtcatttttaaggaaaaaaaaaattaaaaaactttcaattttgttaaaaatataataaataattgagtaaaacagacttgctaacattattttgtaatggaccattttattaaatagcacaattaatcgttcgtaagaatataaaattcacgaaaatcagacttttttcccgagtttctgaattcagattatcagattacaattctcggaaacaaggccgaaacctgatagccatgaccatgaaagaacacgagaaattgtgggattggcaaaaacctttttttgtcgagagtcgggattaacaacaattatgtttggtttatgaggcaccgggcaataatgtcaagaggagagagagagagagaagtagagaagcaaaggcaacggtcggaaatgagagaatg

SEQ ID NO: 115336 - DNA, 997 bp, Heterodera glycines
  Promoter: Source sequence=SeqID_18016; Location=1..997; Strand=+; Gene=SeqID_82592
ttttgctgacatttagggctatcctctgctgaaaaaatcgcgaaataggcactaaaataagcaaataaaatgttttattaacgcttttttggtaacaaaacaacgtaaaaacttaactaaaacacttaatttggattatatcttaattgtaaataaaattaaataatattttaaaaaatttttcgaatacgtacaaatttttataccaaaaatttttaccaagaaaaaaaatattttcgggaatcaatttttgaaaaatttttttcaattcataggagtgtaattttctaaaattttttcaggtcgattcttatgggtgtacaattttctatacgatcgaaaaactattaaacatgctaaaacataaaatatttttttaatttatattttattaattaatcataaatcatcggatgatgccaccggaagtgataaattgcgcgaaaatatatttattgattatgtcgactgccaacactaattagatattgtatttccttttaatttgtttttgttaccctcagcaatcatagagaagtaaaaatttatttatttctttaatcaaataaacactacacacaatatgaatagggaacaaaataatacttttcaaacaaaaatatgtaatcgcatttattaggcaatttgtgagcaaaaattttctaggaaataaatgtacaaagtttgtatagaaaattttggcaattttaaatttacccagaaatttttgggattttttcatgacacaaaaaatcaagggaaattgttctcttggaaaaaatccaggttttacgtgagccccggtcccggtggatgaaatcccagcccgtcttttttggtcctggtaagtccgtcccgcttttcccaaaagtcctggccccaatattttttatgaatttgcctcctttttttgttagcatttttttttgttaccatttattttaaataattaaaatacattatgtttagatattaacattcagagagtaaaaaaatg

SEQ ID NO: 115337 - DNA, 96 bp, Heterodera glycines
  Promoter: Source sequence=SeqID_17020; Location=3028..3123; Strand=-; Gene=SeqID_81440
ttttttgtccccaaaaatcaatttaagaatttgtgaaatattaaaaaggatgagttttcagttttatttttattttagcttttattctttggcatg

SEQ ID NO: 115338 - DNA, 457 bp, Heterodera glycines
  Promoter: Source sequence=SeqID_4533; Location=1..457; Strand=+; Gene= SeqID_54801
aactcagccaaaaacattcatttcgccaactgacattctcttaactgatcaaaaaagaatgattaaggaatagtaaataagaggaaaacgaatctgttctgatatcaaatacattattctttctattttttatgctaaatttttagaatttgtttttttttctattcagattatattaagaaatgccaactgttcgcgaaattcttgagtgtttgcaaaagccaattaaacggcccacggcccagaaatccaacaaatgaagacagcgtactgaatgctgagataaagcgttaaagtattacgcggaagtccttcaacaactgaagcgtgccattaatcccatccggccaattaaaggcaagaaaaactacataatgactttaataattattagttaagggatgtgcgacttcgagacaggaatgctgaaggcaatgcggcatgtcttcccatcatg

SEQ ID NO: 115339 - DNA, 167 bp, Heterodera glycines
  Promoter: Source sequence=SeqID_33494; Location=1..167; Strand=+; Gene=SeqID_63543
acacaacataaggaggacttgaacctgagacccctttttgttgactaactcacagaccactaagacgaaaaaaccaacttaattgtacttggagcagggttcgaatctgttcttatttataagaaatgttctgatttggagggttcaaatcttacaaaataaaaatg

SEQ ID NO: 115340 - DNA, 118 bp, Heterodera glycines
  Promoter: Source sequence=SeqID_40339; Location=281..398; Strand=+; Gene=SeqID_68705
tgtacgagacccatcaatattattgctatattaatcacacaatttaattatgacaaaaaaatacgatttgttttcccataggttcactgaattacgacaccgtattgaggcaaacatg

SEQ ID NO: 115341 - DNA, 316 bp, Heterodera glycines
  Promoter: Source sequence=SeqID_28763; Location=1..316; Strand=+; Gene=SeqID_59337
catcaattagtaacaaatttaacccaaaaatgcgttaaaagggctctaattggttcaaaaattgcctttccattttcaattttcctcctacaccaaaaaaaagaaatgtttccatttgtccatttttgtgacactttgtcttctcattagctgcttaatccccttctcgtttgactatgatgacgacctgttcgaaattggcactgctcagtccgtagcagtcaccggaattttgacgtgcaatggacgaccaagtggcggcacaaaagtgaaactgtacgacgtggacagtaagccaaactcacagtttaatatg

SEQ ID NO: 115342 - DNA, 364 bp, Heterodera glycines
  Promoter: Source sequence=SeqID_23866; Location=1..364; Strand=+; Gene=SeqID_54556
gggctttataaaaaaaagcaacaacaatgaatttgagttaaatgtgctgaatgcagtaagaatattaagtgcaagcaaggcaacacctccaatgcgataaaccaccttaaatcaaaacacaaaacagcgaatatgaggcgaaatatgaagatttgttgaagcataagcgaggttagaaagggacaatcgaaacacccttggtcttaggaagtggcacgttatattaaatgtgcatatgcattggtttttttaaaatttttaagagggtctttcatcattcgacaaaaaagtaattcattggatcgcatgcacccaatcatctttctccgatatcaacaacccgacaacaatcgcactatttatg

SEQ ID NO: 115343 - DNA, 1003 bp, Heterodera glycines
  Promoter: Source sequence=SeqID_2660; Location=9350..10352; Strand=+; Gene=SeqID_80941
aaacagaatgccaaggattgaatatttattaaaatttaaaaaagagaatgccaaaaactggcaagaaataattgaggagttttggcacgaaaaggtgcgacaattggcaaatgaaaatgtgaaaaaagggggcaaaacaatgccaaaaatggaaggaaataattgaagaattttggcacaaaaaggtgcaataattggcaaataaaaatgtgaaaaaaagggggcaaaacaatgccaaaaatggaaggaaataattgaagaattttggcacaaaaaggtgcaataattggcaaataaaaatgtgaaaaaaagggggcaaataatgcaaaaaattgaggcaaaataaatgataagggattattgattggcttttccatccgtaaagtgaattaaattaaatgaaaatgaccaaatggacaaaaaatcaattagtaaattgtttattgtctgaaggtgtcagattacataataagcgtgcgggagtgtgggcggcactacaaagtacgcgacctattaaaaaatttgatttgtttatttggcaccttttcaacacccccgcccctccttaattgatttgtttatttgaccccctccccccttctcgccgcctgctctcgcccccctctcgccgctggtgacgtcaatttttccctttatgagagcaaattaatgtttatcatcaattgccaatgtggccgagtggttagtgcgtcagtctggccgcccccctggggttcggatccgcttggtgcgtggaatttttggagaattttaaatgaatttaaattcaacgtctttgaccttttaagacgtttaaaataatttagaattaaataaatttaattaaaataatttgcataaagtcgcgcagtcaaaaaagtcgcgcacccccctgcaataggtttgggtttgcaagaaaaactcgcgcaataggtttgggtttgcaaaaaaaagtcgcgcaataggttttggcttcagtactgaaaagtctggcgctcagatg

SEQ ID NO: 115344 - DNA, 463 bp, Heterodera glycines
  Promoter: Source sequence=SeqID_18701; Location=443..905; Strand=-; Gene=SeqID_83374
acaaatgtctatttttgcggggacgtcaaatgcttttggccaactccgtctcagccaaatttaagattctcagtccaatagtttcaagctttttttggcattatcgatcccttttcttttgtaatttttgaatactaagcattttggtgcttatttgttagcaaaaaatggaaaatatgcccaaaattggaggcagttttttgttgaaaatttgtatttgatggcttttttataacgcctcagcaccctcacagggagttagcccgcttcaccattttgtatattttataacagagatgatttccccttctccactcaaaagtgtacaaatttcttaaaaaagcttcaaggttgcacataaaaatataaaaaataaaataaaaatttaaaaaaaaattataaatccttaaattaaaattaaaatcaaaaagaaatctcacgcactattttttaggtacggatg

SEQ ID NO: 115345 - DNA, 92 bp, Heterodera glycines
  Promoter: Source sequence=SeqID_31531; Location=358..449; Strand=-; Gene=SeqID_61865
tttctttcatccccccccccccctctattgcattttcctttcttttatttatatgacaaacatataattttttaaatcattcctctaagatg

SEQ ID NO: 115346 - DNA, 705 bp, Heterodera glycines
  misc_feature (18)..(18): n is a, c, g, or t
  Promoter: Source sequence=SeqID_1615; Location=1104..1808; Strand=+; Gene=SeqID_74839
tttttaaatatttttccnaattctaactgaaagcgatcaattattgttaattctgggcattgatgcataaaaaacaatttcattttatgagattaagatgaataaaatgaaattcaaaggggctaaatccacttttatattttccgaattgccgtttttatttttaatttttaaatattaatttttgctttaattattcctgtccatccctttccctcataatatttgtttattgcatcattttttttaatagtttttacacatattaatcccttagtatttatttgtttttattaatttaaaccattatttcttctatttatttctttccatttttttgcaaatttgaaattctatacaaaacccatttaaatataaaatctttcattattaatttacaatttttttttctaaattttatataaagttgagaattataaaatatatgggccggttattaatgtaaatttgtttttaaaaaatatatacattagcagtgtattcatcgccagagctgtataaaaattttctgtggttatggatttattgattcagaaataggcgtatttcaatttgccaacaaataacggatgatttgctttattaattggttttattttttcattaatatcattattatgagcatgaataatattataaaaatatattaaaaaaattcaaaactaatttttataatttaagatg

SEQ ID NO: 115347 - DNA, 103 bp, Heterodera glycines
  Promoter: Source sequence=SeqID_5950; Location=1..103; Strand=+; Gene= SeqID_59777
gaaatttttttaaaaaatggaaaattttttattaagggattaacagtttgggggcaattttcgatgggaaatacctttcaaatacgaaattgggggcagcatg

SEQ ID NO: 115348 - DNA, 687 bp, Heterodera glycines
  misc_feature (23)..(23): n is a, c, g, or t
  misc_feature (46)..(46): n is a, c, g, or t
  misc_feature (65)..(65): n is a, c, g, or t
  Promoter: Source sequence=SeqID_17558; Location=1..687; Strand=+; Gene=SeqID_82062
atttgaagaaatggacggggcancggtggaatgggggactcgatcnaactcggggagcaatcgcncaaatcggactcaacggacacaaaagccgggactcgcccgaacggacccgacccggggggcctagggggaacggtgactcgaattggggccccctctcgtccctctccctcaaatcgtcgaggtcaaatgggagcgttcgccgaagggagtgcctcctccctacaagaacagtgggcaatggctgataacggatgggaaagcaattcaaattttggcgaaatccgatgggaaccgaaaaaggaggaagaaaacaatttgcagaacgataacgccgacgaggggatagagggagaggggggaaagacgaaaaaaggagacaaaacaaacaaagatgggtccaaaagtgcaaaaagacagatgtctccctcctcgtttgcaaacgggggattcgatcaaagggagggggaaaacgacgataaacagcataattttgggcgtcattttcaattgacccgcccctccccccaaggaaagggggcattcccccttcattcatctccgcacagcattccgtggccgcacaattcgccaccttcaattgggagattctcccatcttttctcatccactttttcttctagcacatccccaactgatttgtcttcccaatcttcaggaatg

SEQ ID NO: 115349 - DNA, 51 bp, Heterodera glycines
  Promoter: Source sequence=SeqID_122; Location=5015..5065; Strand=+; Gene=SeqID_72910
tgccgatgcgacacatacctccaattatttcgtgaaaatgtgttgaatatg

SEQ ID NO: 115350 - DNA, 109 bp, Heterodera glycines
  Promoter: Source sequence=SeqID_6612; Location=1..109; Strand=+; Gene= SeqID_62200
cataacttttcaaaaagcatcaaaattagacattcttagtatcatttgatagccctaagaatgctctattagccttcaaaaaatttcgttgagtttcaaaaaagttatg

SEQ ID NO: 115351 - DNA, 308 bp, Heterodera glycines
  Promoter: Source sequence=SeqID_24041; Location=719..1026; Strand=-; Gene=SeqID_54739
tgtcgccccaccactgggccaaaatggtcgaaacaaacaaaacggaaatgaaaccaaagacaaaagggaggcgacaaagcattgcaattctcaacaaaaaaaataaggaactttttttaattggaattaaattcttaaaaataatttttgaaattggcaaattttaatgaatttactaaataaataattctgtcaaagagaaatatttcgagtgaatattgtggtgcaaaaggaacttgcttttatatgggctgattttgcaaaaaaaaaatgaaattattttcgcccaaagccccgcggcggtcatg

SEQ ID NO: 115352 - DNA, 543 bp, Heterodera glycines
  Promoter: Source sequence=SeqID_30220; Location=1..543; Strand=+; Gene=SeqID_60647
acatcatatttcattagttataactgaagaaaatacaattggatttatccacaggataaattttctttttttgataggatttaaaaatttatattttccattaaaattataaattcattttttcaatctatacatcataatttttattagttataacagaaagatatgtaaaattttctttttttgataggatttaattaaaaatttatattttctaaaaatgcaattatattttccatttatacaaattatatttcgattaattatataattaaaatatacaattttgtttttccacaggaattaattaaaatttaaataaaattatctttttccacagggaattaattaaatttaaattaaattttatttttgattggatttaattaaaattttacatttcccataggatatccttgtcgtcatggagcacaacaattgagccaacttttgtcaagttatgttcccacattcgttgaatcggtcaaccacactgaaaaaatcgtggtgtgcaacaatgtcattgaggacgtaaaaagtatg

SEQ ID NO: 115353 - DNA, 611 bp, Heterodera glycines
  Promoter: Source sequence=SeqID_6403; Location=1118..1728; Strand=-; Gene=SeqID_61435
ctgcggatcacgcgcggacttcttccggagcccgtagtctcgccccacctactggccgccgtagtcgagtatgcggcggtggttttttagcgcaataagctaaattcaatcttttatatttgattttttccttttttctgactgaatcggtttataacagttttaacgattttgaggagccataacttttgtaaatttcttttttatccaaaaattccttcgaattcatgattagcagaccgtaagggatcgattggtatctatttggtcgcaattccatgcgtttttggctttggacggttcagtcccaaagccatttggccatttcagtcccgggtctgtaacgacaaagggtaaccttggattatgtgcattaaatagaattgttttgaattttatattaatacatgtaggtatacaaataatgttttttggaaaatatcggtcatatggcccggagcccaaatggccgaaaaaatgagcaagggctcatataatgcggttctaattaaactcaacatgaatattttggctgtttctttttaccgttttcatcggctacttttttttaattgcagtgaatttcttttttaagttttaatttagcaatg

SEQ ID NO: 115354 - DNA, 527 bp, Heterodera glycines
  Promoter: Source sequence=SeqID_7517; Location=1341..1867; Strand=-; Gene=SeqID_65090
ttttctgaaggaacaaaaagcaaaattataatttcaaagcgggatttagaaattgaaaatgcttaatcagaaaatcctttccctctctaattaaattttgctaattggtcctaatgagagagagagcgtttttgttttcgctttcattgggtttcctctgctgctgttgaaccacccacggttgttgttttggctgttttggtggtgtgcactgtgtgtggcttcgcttaatgaatgccccgcttttatagcaaggcaacgcgccgaaaggcgtgcccaccgggcggcgacgggtcgccccaccctttcgatttgccttttgctgccgccggtcgcccacgccgcgggggacgacgaccaacgcccggcgcatcgtttggtggtctgctgctggtcgcgccacacgtgcgccgccggtgactgtccgtgccactcccaaatcattcattgcctcccccgcccgacggtgtggcatcgccgaaggcgaaacgaagagtgaccatgaaaagagagtcaattaattaatg

SEQ ID NO: 115355 - DNA, 311 bp, Heterodera glycines
  Promoter: Source sequence=SeqID_69; Location=14607..14917; Strand=+; Gene=SeqID_46233
ggtaagtgaggacatagaaagagccactgatgaacaaatattatgccttgttgaaatctgtctcaatattttaaaaggaagagttcctttaaaatacaaacatttgaagaaattaaaatcaaatgcacaattaatacgttgcctttcacgcactcgttcttcacaatcagcgaaaaaaatattattacaaaaaggggatgggcttccggctatagcaggactaattgcaaacattgctttaccatttatttcaaattttattgaaaaattataaatataagataggatttaaattgtaacaaaagaaaatg

SEQ ID NO: 115356 - DNA, 779 bp, Heterodera glycines
  misc_feature (67)..(67): n is a, c, g, or t
  misc_feature (74)..(74): n is a, c, g, or t
  Promoter: Source sequence=SeqID_19999; Location=1..779; Strand=+; Gene=SeqID_84774
tttgttaagaaaaaataggtttttttgagtccggcggtgctccaaggtttcacaaaaaaaaaacagnaaaatanccgcgccagggatggatgagtgaatggacaagttgagagtggaggcccaaagtgacggaggaggacagattagcacagaaaacggggcaaaagcgtggcggtggtgctgctctctctgttggcccaacatcagcgccaacagtcgttggaagagcggcgcgtcggcacgctcccaacaccttttggggaagaaaatggtcaaaatcaattttaaatgagcagaaatggaaaagtggtgatccaaaaaagaaaaatagatcaagaatgcacccgaaaaattagaccgaattccgaatttaaaacttactgacgaaatttgtcggttttttaatccccagaaatcttatgaaaggtttggtttgaaagtgttgctataatgcaacaatctaaccaaatgtccaaatgtttaaaacccaaaaaataacaatttaaaatggccaaacaataaaaccgcgtaccaacagtgcgagcgcgttcagacacaggacgagagaatgggtgtcaatttgaaattggcgctgttcaagcagttgcagcagaatctgttgaattaaacggttataaaatgcttggtttcgctctgtctgcaccttttccgcgtccggatggttcaacgacagcagcgaggcgacacgaattgcacgggaggagaactcgtggttgcgcaccaacttttgcagggtcgcaattgtgtccgtggaaatg

SEQ ID NO: 115357 - DNA, 261 bp, Heterodera glycines
  Promoter: Source sequence=SeqID_5429; Location=1941..2201; Strand=-; Gene=SeqID_57989
ttttcactattattcccattgcatattcgccgtcgctgttcaactgcgttaattcgcatggtaaaaaatcagctttaacttcaattttgcttgtgattccaacatcgtacaaaaagttcaatcccccctcccattttcgaatttttggtttttaaattctttccactggattttcaaggtccactgatcacgaatcccctccccctgaaaaaatgttttccgcaaattctgcctcagatttttcatattttttcaaaaatg

SEQ ID NO: 115358 - DNA, 749 bp, Heterodera glycines
  Promoter: Source sequence=SeqID_11039; Location=3457..4205; Strand=+; Gene=SeqID_74373
tgacactgaaaaagtcggtccctaatttttacattctattattattttaataaataaatttttcataaatttaatcgtaataaccgggacaattttttttcatttttcataattatatttgcattcaataaagtaattggagtttctttctttctcagccttgctatttcttttgaaaaatttcattaacatatgccaaaatacgtggaaagaaattggcattttctttctttctcagcctctctatttctccaggtctcagtccaacatatgccaaaatacgtggaaagaaaattggccaatttttctctttttctctgtctcactatttcttcattaattctcattgaataatgccacaattacatggaaagaattttattcattgggtagtccatcataaaacagaatgactagctaaatgcagataattattcattttcatttcttgaaattccattctctttcaaaattattgtttttgccttctttctatacaacagggatattccatgtcaagaaatttttttgaattttatcaaatttttaaccatttttcgaaagttttattttggggcgtttggttttttgctttttaaattatttttccaaaaaaatatatttcattgctaaatctcactttaattcctcactactttttcatacagaaaatggaacatttttctttctgcgcattaattattgctatttttgttggcgctacttttcgtcacttttgtgttgcaatg

SEQ ID NO: 115359 - DNA, 971 bp, Heterodera glycines
  Promoter: Source sequence=SeqID_3326; Location=1428..2398; Strand=+; Gene=SeqID_84224
ttttggggtcaaattaaaaaaaatggttcaatggggtccggcggtgtcgataggcgacggaacagctgtggcttcctccataaattgctttacaaacgcagcaaaaagattccattgctaaatatatggaatttttcatgtaaaattaagaaattctgtaacaaaaaatgcaataaaaaattattttttgacgagatgacatttttggcgacatgttcaaaaaaattcaaaaaattttcactaaataaatcagtcgaaaaacgaatttttttttatgtaatttgctttatctaataatttttcaataattgattttggctaattttttgggcttatttcaaaaaattcaatatattaacagagcgcacattttttcatgccaaaaagtccgcgcgcttttattacataaaaaggcaattcaaaatttaatttacaaattaattttaaaagcgtttgtgtccccaaaaaaggaaagtgccgctaattgctctccctaattggctccatttaaattaattaaatttctccttttcctctttttcacagatgttcgccgatagaatgtgttgaacatccccaaacacatatttagcattttccattttcttaatttcttttctcagtggcttctttctcaactgctcaattcttgaggtaaaagcattgatttttttaaaaacggtaaattttaattaaatttaagttttcgtttaggaatttttgcattttctaaccctttaatttttatttttagacatttttcgttgaatttctcagtatactcttattttcggactgtttcccctaattttcaattgccaaaacccaaaaaagggtcataaaccgaaaatttaggccccaaaacggaaaagtgccaaaaaaatttggcaaattttgccgcaaaatataaaatttcattgctttttagggccattattaatttcgctatttttttgcagcattttattatg

SEQ ID NO: 115360 - DNA, 859 bp, Heterodera glycines
  Promoter: Source sequence=SeqID_19143; Location=2096..2954; Strand=-; Gene=SeqID_83896
ctttcattaatttagtatttttctctattttttattttgtgtgttactggttctctccctctttctttctctctctctctatgcgcgtacgcatgcgcacacgtctctagggctataaaagccgcactattcgcccatttggggcttcttctcacttctatttaatatttatatttaatcgtcccttttccatttattcacacatttatttgtgactaataaagtttaccccacgaatatgccatacttaggggtgcgtttttacccccgcgcctccccggaggcggggattgcggggggtctgagtcacgggggcgagtgtgaggctaaacaagcagtcccgtccccggggaccggggcgggggtggggctcgaatcctactagaaacacctggagctatcgaatggtaaagaattcaaattttagttgggattgagtaaagctatggtagttttttgatgagaatcttcatttgttcatgacggatgagatcgagacggaaatgaagaataaataattttctgggttttaatacgatttttatggggttgaaaaatgtagtaaccctatgaaaatttaattgtaaataatattttaattccgatcagttcgaggatttatctttgataagtgcatgaactttaccgacaaagtgccgaagcaccagcggcacaatgtgttgtacgtgccgcccaccttcattcaaacatatttttgtaaatttttttgcgttttctgtatttagtattagcccaccaatcgttagctcaattttaaaggaaaaaacattttttttaaatctctgctgctgtcgatggggaggaaagagtgctgctgtgcaaatattgggcctaaatg

SEQ ID NO: 115361 - DNA, 319 bp, Heterodera glycines
  Promoter: Source sequence=SeqID_14468; Location=3349..3667; Strand=-; Gene=SeqID_78513
aattgtttcctatttttcgaaaagtgccagttttttcctcccatttttattttgtttttttctgggaggaatacagccttattttcctaaattttcttggaaattaattcacctatgttaatataaatagtgtattttttcatgattatgattagatcccagcttgatacctcattcattaaccaaaacattctatacatttttcgcaagtaataaaaaatttaaaaaaaaaattacaaaaacttttatatatttaaataataaaaataaattaaaattaagacaaagtcgtgatgaatgggaacgtgatcagcgcatg

SEQ ID NO: 115362 - DNA, 529 bp, Heterodera glycines
  Promoter: Source sequence=SeqID_238; Location=11790..12318; Strand=+; Gene=SeqID_79394
tcttaaaatttacacgaaaatgtgcctaataaaaaatgcccaccgttcgagggggtagaaaaataaagccctcggggggtgtgggggagagtttctattttaggagtacggtaacgtaattgactaccaaattttgaaaatttttctgcttattcctcccactaccgtatgtccccgctttttcttccactaccatatgttcccgcttctcctaataccgtatgtccccgctttttctcccattaccgtatgccccgctttttctcccactaccgtatgccccgctttttctcccactaccgtatgtccccgcttcacccgctaccgtatctcccagctttttctaccactaccgtatgcccacgctttttctcccactaccgtatgttcccgctttttctcccactaccgtatgtccacgctttttctcccactaccgtatgtccccgctttttctcccataccgtatgtccccgctttttctcacattaccgtatgccccactttttctcccattaccgtacgcatg

SEQ ID NO: 115363 - DNA, 840 bp, Heterodera glycines
  Promoter: Source sequence=SeqID_5041; Location=3209..4048; Strand=-; Gene=SeqID_56688
tttattttatgctccaaaaaaagaggggggaaagagtgactgaagatgaaaaggaaagaccttctggggttttgcttgtgtttcaatgtggtgaccaaatgaatgggcggtcatttggagtggacgagagagtgcataagcacacgacgagacggcagagaaaaaaagggcaaagcgacgccacgctcgccgtagggggcaaaataaaaacgaagaaaaacgacaacgttgggcaggtgatgggacggacgaaaaccaactcgtagaaattgggctgctgggggccacagtccaaaatagagacgggaatttcaaatttgcaggtgctgcgggatttgaactcaaattttttttactggatgggattaatcccgcgcgggatcccatcccgtcccgtgcagtctctagtccaaaacacggatactggccacttcaccagggccacctcgatacaagttttacttaaattttaattggccaaaattcatttttaagttgagaaaacagaaatttcctttaactctttatgctgttcaaacaagcttttttaaccaccaaccagatcactcattcagtggcaattcggtagcgaattttatgctctttctgtaggcttactaattattgtacaaattttcgtaatccactagggttattattttcatagatttaaacccgcatgttcctgtcaccatgaataagtttgtgtaaaagttactcgattttccctttgatcacttgtgctcatttagttaactttttaaaccgtaaggcatttgcttttttttgtatttacaaaatttttcgactttaaatctttgattgttgttattagggatg

SEQ ID NO: 115364 - DNA, 320 bp, Heterodera glycines
  Promoter: Source sequence=SeqID_8705; Location=1..320; Strand=+; Gene= SeqID_68908
tgaggtttaaaataaggcggagtataatttaaatgctctactgagaagagtccaggtgtatataagccggccaaatctttgtttcttgtaaattttaccaaatcattctcctcactttctcaccacctcttgccatggctattaatatgagtgacaaaaaatcgttaatcaaccaaattctgggtgaggctgatttgaccattagcacgagcggcataacagtgagcggaccccgtctgtcaaccccccgctttattccttttgatgagagtggccgatgccgctcatgtaaagctacagaggttgaggtagacacaatg

SEQ ID NO: 115365 - DNA, 479 bp, Heterodera glycines
  Promoter: Source sequence=SeqID_33089; Location=1..479; Strand=+; Gene=SeqID_63256
ccattaatctaaaaagcaattagcgacaataaaaaagaaaaaaaaatttttttaaaatttgaccaaaatataggacccaaacttaactagtaccgccacggtagaccaaaatataggacccaaacttaactagtaccgccacgaaatgtccaaaagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttttcgtgggctggacattttgtgggtaagcgaaaaatttaagagcaggcagatctttgaatccgtgggtcccactaactttgttcgaattcgtttcttaatttgttttttaaagcaaaccaaatttctgcaatttctttttctggtttacaatg

SEQ ID NO: 115366 - DNA, 281 bp, Heterodera glycines
  Promoter: Source sequence=SeqID_4421; Location=1..281; Strand=+; Gene= SeqID_54390
ttgagcgggagttgcaggaacatgccaacccgcgcacttttcttccactccccggcactttcgacggaacaacggatttttacaattatttgaaatccttcaatcttgtggcaactgcacatggctggaacaccgtccgctgcgttcaaattttgcccttgtatttgcgcggttcggccaaggccatttatgatggcttagaccaaaatgtcaagacaaactggaaggatttagtcgacggtctcgcggacaaattgaagaaagtctcttccgggctgatg

SEQ ID NO: 115367 - DNA, 83 bp, Heterodera glycines
  Promoter: Source sequence=SeqID_12464; Location=1452..1534; Strand=-; Gene=SeqID_76095
agtaaaacaatggcactttggcctggagcgactgactcattcattaattgttccgttaaaaggtgcgcgcctcgggtaaaatg

SEQ ID NO: 115368 - DNA, 271 bp, Heterodera glycines
  misc_feature (13)..(13): n is a, c, g, or t
  misc_feature (18)..(18): n is a, c, g, or t
  Promoter: Source sequence=SeqID_24367; Location=1752..2022; Strand=-; Gene=SeqID_55091
gataaaaaccganaattntaatgaataggcgtgtcataaatgaccttattcttaattaaatttaaattaaattaaattttttgaacgcttgaaatagtgttgtagtttgatttttaagaagaaaaacaattcaatccctattaattcatggccaaaaaaatagaaaatttagtccacacaactcatgctcatcgaaggactgcgtaaatcgggcaccaaacggttttcgtaaaaaaaattctgtgtattgttttgtacttaattaagaatg

SEQ ID NO: 115369 - DNA, 127 bp, Heterodera glycines
  Promoter: Source sequence=SeqID_29182; Location=605..731; Strand=-; Gene=SeqID_59721
gcacaatgaatgagtggatattctgccgagcgattgacggatgtacaatagcctgactttcagtttgccgtccacatggaatgaaattgccgattaaagcgaagggccgaatggaagcgccggaatg

SEQ ID NO: 115370 - DNA, 1003 bp, Heterodera glycines
  misc_feature (582)..(582): n is a, c, g, or t
  misc_feature (589)..(589): n is a, c, g, or t
  Promoter: Source sequence=SeqID_8250; Location=602..1604; Strand=+; Gene=SeqID_67434
aaaacggaactaaaagcgtaaggcacatggactaaagcgggcgcggaaaatcaaagtcaggacatagcatccgcgtcaaaaattgggcaattgaaactttaattgtcaacatttagtaaagtttcggattttaattcaaatatggccactaccccaaaatcagaaaatttagaaataagaaccaaacaaacccctgatgtatagaggccaatatttggcaaggtttttaattttctccatcaacaattgcttttttgacccgacttcaaaactgaattccgatgctcgacatttgtcttgtccacggaaaccctgagatattatactctttttgggatattttttcaaaacttttttttgaaccttctaaaaatttgattcaaaaattcagaataagaatcgtatagaagttttgaatttttattaacttaccaaaagccataaattatgaatacactgaagtctacctcagggttgacgcggctcgtgaaagtcgagtttcggtcttgaggtcgggtcagaaaaaatcaattttttgatggggaaaattgaaaattttgccaaaaaattgggggatgtctntaatttnttatataacaaatccactaaaaattgctcgaaaaattctcattgctctgtcactgctcctccctttggcattgtatgccagtttcagtggtggaaaagatattctacgaaaattttatttccctattattgaatttatcgaattttctttgtcacgacgtgaatttttttggagtggagagaggagcttaatgttggatgaatgtaaaaaagacaattttacattttataatattataaaaaaaattattttatctaaaaaaatttataagcaaaaaaagacatttagaaattattatttaactgcgctttcacaaataaaaattatactttaaatagaaaaacaatttttcaactcaatcaaatttagttaggtaaattattttcccgttttatttcttttcttcgagaaatg

SEQ ID NO: 115371 - DNA, 353 bp, Heterodera glycines
  misc_feature (77)..(77): n is a, c, g, or t
  misc_feature (240)..(240): n is a, c, g, or t
  Promoter: Source sequence=SeqID_20610; Location=1..353; Strand=+; Gene=SeqID_51160
tgtgtacgaaaggattcgcgaaatggtcgggctgagtcgaaaggcgaaggcggcagagacggaaacgaaaagtgagngggaaaataagaaaaagagggacaaatgaacacgagaaaagggggaaggggacaaatggacatgtaaaaaggggggagggcgacaaatgggaccgaccgattgattgaccgttcgattctttttaaacttttagcggaacctttcaaaaaacgccggcgattncaggaagtcgaaacagcagcaacgaaaagtgatcagatattcaatgaactttttcattaaaagtgaatcttttgcttaaaagggaaagattttctgcaccgattggaagaatg

SEQ ID NO: 115372 - DNA, 892 bp, Heterodera glycines
  Promoter: Source sequence=SeqID_28358; Location=1..892; Strand=+; Gene=SeqID_58988
aaaaatgaattgtttataaaaataaaatggagattgttggttaattgaaaattgaagaaaattgggaaggaaaaggaaaatgagcgaaggaaagaacgaatgccaaagcgaagccaaacggaacggaccaaaggcactcaatcattcccggggatggggaggagggcattctcaagagagggagaaaagcgatgccatcgcaaatgacccgagggatggcggagggaccgatttattatttatttctcccccgccctttggcccttttttttgtttattttcttttgcccgtcacaattaattaaattatcagtcgcgtccatcttgttaaagaacgtccgtcggtcagaagcagattctctgcacctcaaatgtgttgttttccatgcattccttctcttagaaaggtgaaaaattaaatattcttgttgaataaatggcaaatgcaacgaaaggaatttttaggacatttggacggaatggtaattgtaaaaattgtttaattaaaataaaaatatctatcaaaatcaaaactaatataaacaaatctgactgatcagcgcaccagcaaataaatatttaaaaagaattattaataaattaaacaagtcaaaaggaacaaatttattgaaattaaatatttcattacatataaaataaaaaggatgtttgtcaattactttaatatttatgtcatattattgataaaatattagtgtgtaattattattgttatttttgctataaaatttgtttttttttcactgatgcattaaataaatgtccaataattttaaattcttatttaatatttttcaatataaaaatccattttcattcgattaacccattaaattttttctttcattcattttattttttttgagaaatg

SEQ ID NO: 115373 - DNA, 302 bp, Heterodera glycines
  Promoter: Source sequence=SeqID_3555; Location=1525..1826; Strand=-; Gene=SeqID_45574
ttcgttctctttccgttcaaattaattcgtttgatctgccgacaattaaatccaattaccattcattctttttaatccgttcattttactaatgatttgacggggccaacaattcgattgttcatttcgttctgaatcggtcggcctttttatttcttctcttccatttgtttgttctattactttttttgtacattctccgatcatcaaacaaaaactcaatttgacacaaaaattggatatttcccaaaattttaagccaattaattcatccgtaaattattcaaatcattccgccgatg

SEQ ID NO: 115374 - DNA, 1003 bp, Heterodera glycines
  Promoter: Source sequence=SeqID_4265; Location=960..1962; Strand=-; Gene=SeqID_53816
ttggggaattttggcggacaaaacgccgattgagcgccaaacattgagcaccagaacatagctcatccaaatttacaatttttatctcaaaaacggtcgatccaaagggtgctaggtcgtttcttaaaaactgccaagatagctttaaatgttgtctataagaatattaatttagaaaatttttataatgaaattataaaaaagttatggtgccaaaatttcaaaaaattgcaaaaagcataggctgttcaatgctttataatttttaaaaagcaattagattaaattttttagaatttcaagtaatctatttagtctattattctttaaaatttcaaaaatttcattcagtttcaaaaaaggtctggacaaaaaattctaaaattttctagtcataaaatgcaattgagccaaacttaattaatatcattccatagccctaagatttctcaatttaaaaattttggaaaaatttcattgacttttaaaaaagttatagccaaaaaattctcgagtttgtgattatacggtatttactagtgaaaaaaaattaaaaattcaatactaaaatcaagctctattcagctaaccaaaattcgtaatgattcatttaaggattaaaaagttaaaaataaaaaatacaaaaaacttggatttttaagattttgaaatttaacttttttatgtgtagtttggttttcgcttagaaaatgcttataaatatatctaaaaacatagagagctttcgaaacatataaaggttatttgatttggcgaacaaagaaaaaaattatggcgttgtctcagacgcagttgagccctaccgggcggaagtggtcttagctcacggaaaagatagggattaattaaaaaaaaaatttagttaatttcgcattacaaattaatgaaaaattccaaaaaaaaaaaaatttttttctcagcgatgcctaacggcaccgcccgacccagaatttcctaaggcggatcaaacaatcaaatgatg

SEQ ID NO: 115375 - DNA, 752 bp, Heterodera glycines
  Promoter: Source sequence=SeqID_18168; Location=1..752; Strand=+; Gene=SeqID_82748
cgtatttattttagtttcgtatttttcgtattatgcattttttttcaattcgcaacaactttgatatgtatgtacatcaatcgtaataatacgaatctttaaaaaatcgcaattttttagatttatttcacatgaaaaatatcataggaataacgcaacaattgatgagcaagtcaattgaaaatgaaattatttcttttttttattcatttatgtaataatttgtaaaattagaagcaaaaaaataataaaatatacaaattaattgactacaaaaattaaaaaatatccattttttgtaaatttttatttattttttaattggaaaaatcaaaaatttcacggaaaaacctttaaaccgcgggaccctagcaattaaaaaaaaaaaattaaacttgtatttcggcatgcctatcataaatgttgaatttaattttacaactttcactattttacttttttggcactttaaggtttcgctttttgtggtttttcactaaaatttgtatttgacacaacttaaaaatgtgtgtctctaaaaattaaaagtcgattctttttttcccttaattatttcacgtgaaaagtgtaatgcgcatgagataaagcatcagtggatgaggaagtcatttttattggaaaaagaatgtcttttattttatatttgtcatttattaatttattgccaaataataataaaaaaacgtaaaattattttgaaaaaaattttttaggaattaaaattaaaaatg

SEQ ID NO: 115376 - DNA, 429 bp, Heterodera glycines
  Promoter: Source sequence=SeqID_10421; Location=319..747; Strand=+; Gene=SeqID_73616
tttactttttgttccaatttgtgccatgacttaaattttcgctttcagttgaccatggtgctgatttgccttatcaccaatttctcatcgatctcattaatgcctacaaggtgattgtttggttgagactgggaatttggtttttgcatttccattgtttagcaaacgcaattccatcgctttcgttccggtgtttttgtgctgcgcggtgacagcagcgaagaggagcagcagacgcaggatttgagctcgctgatcgaaatcctttgtctcttccactcgaaaacctatgtgccgcctctttctgttacggagtccgaatgtttggcggggagggagaaaatttcgatgcatggtaaacggagaagcatttgagattggtagatgaaaatgcattcgacagggttggagctgttgttgccgttgatg

SEQ ID NO: 115377 - DNA, 193 bp, Heterodera glycines
  Promoter: Source sequence=SeqID_4835; Location=122..314; Strand=-; Gene=SeqID_55892
ttgtagcattttttgtgggctttataatgataccattcactatcccctgtcaaaatgttattattagttacaaaccattttaccaactgcactccctttttggggtggtcatatgtttaagaacactacccatattttttttcatcaacattaaaaaaatctaaaaaaattcaggtaagcataactttggatg

SEQ ID NO: 115378 - DNA, 1003 bp, Heterodera glycines
  misc_feature (507)..(507): n is a, c, g, or t
  Promoter: Source sequence=SeqID_315; Location=3137..4139; Strand=-; Gene=SeqID_47448
gggctaagaccattaattctaattattcttaattttgtctgtttagatatctcattatatcgtaaacacttgagcaaagaccaacaaaatgagcacattttccccgcttttccttacatttcccagcagacatttttaggcgatcataaaatgaaagaaaatgtaaaaagactttctgactgttttttcttaccattacaaataaattaagttgcaaaaatatctgtttgaaaacattggcaaaaattcatccgccgacggcacagaaattaatgggccgatatgggacggattgagccaaattcatcggatcgttgaggaatgggtgaattcgaatattctcaattaaattcacaatgtgaaaaagaggatgagtaatgagtagggttagaaattgtatttctgcgcatatgctatgaagaaaggggctcaaaaatagcatttctacgttaaatttttctttgatttggtggagaggtttttagtgcatataaaagcatattttgnggattttcgagaataatatttgccatttttgcatttttagagcatattcaccattttttggaaattttcacaagaaaaatgtaatttatattaaaaatgtaatttatattaaaaatgtaatttatattaaaaatgtaatttatattaaaaatgtaatttatattaaaaatgtaatttatattaaaaatgtaattttgttttagcatataataaaaaaatttaaaatataccaaaatttttgtaattgtctaaaaaaagcgttccatagccatttttgatgttttaaagtcaattctgaattttacacaattttagtcattttttgagggttcaaataaaatgttggcagtttttaatgcagattttagtgcatacctagacatttttcggctttttagggcatattagtgattttagtgcatattttatgcgtatactatgacattttttagtgcatacaacttaaagccaaaataatgagtataattaattgatg

SEQ ID NO: 115379 - DNA, 1003 bp, Heterodera glycines
  Promoter: Source sequence=SeqID_1296; Location=1724..2726; Strand=-; Gene=SeqID_71903
ctgcgcactagtttcggtatattaagcataaaaaacgttgtttccacttcgtttgaggcttcttcgttgacttttattatgcctttttttgcctatttcggaattttcgtgccttaaatgcctttttggcattttgcccttttggtgccttttttctgaaaaattccattaaaaatgcaataacatcgggaaaatacacccctaaaaaattagttgaaaaattttcaaaaaatacacccctaagaattaaaaaattttctcaaaaattgatcgctaaaatttcattttttttattgataaaaagtttaggtttaaaaattttccttattcgaaaaacattataaaatatttaataatcatttaaatggccaaaattaagttttttgattaagttttacgtgttttgctccctaaaaagccttcataaaaaattttaaatgccttttttcatgcctttttcgggattttccagccttttcatgccttttttttctattttttgttgactattatttgcctttttcgcgatttttggtgacttttttttgcggtctttgctatgtataatattatgtgtcccataatcattttgtgcgccattatttttaataaaaaagtttattgaaagggttgatttaacgaaattgtttttgtaataaatttcttgtgtttgacccataaaacctttatttgtttttgcctggatctttttttatttaccattatgggacgcatttaaagcgcctataattttgtgcatttacatgtattgaagggattgtgcggaattccgactttaccgaactccgagttccccttatttttgggttccgaattcagacttccgaaattttttgtgacttcggaaattaaaaaaaaaattattattaacccaattaaaacaacaatttaaatgttttgctttttttttgtaaatataacaaaaaagctcctattttattttttttaatattaacgcatcgaaatttgtccctttggaatg

SEQ ID NO: 115380 - DNA, 163 bp, Heterodera glycines
  Promoter: Source sequence=SeqID_14880; Location=928..1090; Strand=-; Gene=SeqID_79038
aaggagtccatcagacattgttggcgatgacggcattcgcttggagggcatcatcaagtgctacgccgtgccgccccgccactgtcactacgacatcccggtccttccgtaccggctcaacaaccgcacgctgttccccctgtgccggacgtgttcggaaatg

SEQ ID NO: 115381 - DNA, 457 bp, Heterodera glycines
  Promoter: Source sequence=SeqID_20440; Location=1178..1634; Strand=-; Gene=SeqID_50979
aaatttaaaattaaatgtttaaaaaaatataaatttattttttttattaaactttatttaattaattttttttcatgtaaagaattaaaatataatcattaatctgtttaattgaaataaaaaataatgatgattaatgcaatttgaaaatttatagataatatagaaataaaatattggacttttttcaacgaataaaaattgaaaataaattaaatctctcataatttaattttgattaatgctatactttttgcatgttaagaattaaaaaaaaatttacttttttctcgtaataaaggcataacacaattaaaaagaatttttaattttcagtggttggggcgattcccgcgcgagcaattcattaagccaagcatttacattattatacattttaattggtaatttttttcttatttttttaaaaagttttccttttttaggcattccaatg

SEQ ID NO: 115382 - DNA, 239 bp, Heterodera glycines
  Promoter: Source sequence=SeqID_6508; Location=333..571; Strand=+; Gene=SeqID_61833
agggactcccaaagaggaaacaattcaggcaaaaactggcaattaaatacaaatcggcaattaggggcaattagcggcatctatttgcctaattgggtttgcgagaatcgcccagcaatttttttgtgcgtgctcactttctgaaaccgttcaaggtcaccgccccgctgttctcctcgcgtctctttgaattcggtccaaaattgggcgacaaagaattgagcggaggcattgacatg

SEQ ID NO: 115383 - DNA, 480 bp, Heterodera glycines
  Promoter: Source sequence=SeqID_35023; Location=1..480; Strand=+; Gene=SeqID_64684
tcacaccgggacgagaaatgccacaaattctttattttggggtcaattttttaacataattttttttttttcaaaataccttctggtcatttcttaaatgctgccagaatgagcattttttggcaaaaatatgacatagattttctaattgtaatgggaaagaaattaaagaaaaatgaaatttacgtgattaggcttcataataattgaaaacccgttcttgatgcttattaggccattgaaagttagcagaaaaaatatgtaatgcatcaaaattcgctctctaatcatttgataggtcgatgttatctcaattagcatgcaaaattttaaaaattacacagtttaattgatgttgtttttaatttattttttgaaatttgtttctgagaaaagttaggtacaattttaaaaatatattagtggcgcagaactcaagcaatattttaacatttttagagctataccaactaccaaatg

SEQ ID NO: 115384 - DNA, 89 bp, Heterodera glycines
  Promoter: Source sequence=SeqID_16488; Location=1..89; Strand=+; Gene= SeqID_80890
tcctggtgtgcctaattaatatttaattaatggaccctcccacctgattgctcctatttatagataatataaaacaaatactcaatatg

SEQ ID NO: 115385 - DNA, 386 bp, Heterodera glycines
  Promoter: Source sequence=SeqID_17968; Location=3064..3449; Strand=+; Gene=SeqID_82535
gacttgaaaaagatatttgcaaatccatttcccctaataaattcaaattaaaaataatttacaattaaatatatttgttgtgcccttttcttcaagatattgtttttaaaaattaagagaatgctcgaatctttctgtgacatctacggaacaaatccgaacaattttccaaaccatgcgaaagttgcaggacttcgagggaaatgaaactcgaatacatgaattgaagaatgatctctttggttactaaatttattgaaattttctttgactattaatttactgattaaccattctcaacgtgtttcaaaatgttttaattcgcttaattttctttacttttatgtgaaattaaattactgattatgtttaagaaacaaacaatg

SEQ ID NO: 115386 - DNA, 53 bp, Heterodera glycines
  Promoter: Source sequence=SeqID_7353; Location=1736..1788; Strand=-; Gene=SeqID_64571
gctacagttatagttctgtactagtaaattcctcaaacgagctcgaaaacatg

SEQ ID NO: 115387 - DNA, 410 bp, Heterodera glycines
  Promoter: Source sequence=SeqID_25499; Location=635..1044; Strand=-; Gene=SeqID_56244
aaaaatggtcttagtaaaaatcgtaattacgctcaaaaaagcttctcaaacaaattttagcgcttccaattccttctacaatcgcctttaatacatcccattatgagcgctaaaattatcagagtgccgaaaatcgcatgtgatctaagcctagcaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagccttaaaaaaatgatctaagtaaaaatcgtaattacgctcaaaaagctcctcaaacaattttagcgcttccaattccttctacaatcgcctttatacatcccattatg

SEQ ID NO: 115388 - DNA, 69 bp, Heterodera glycines
  Promoter: Source sequence=SeqID_41756; Location=1090..1158; Strand=-; Gene=SeqID_69817
ttgggaaggtggtctacgacctatacccacagagcaacagttcgtgaaaaattggacaattcaaaaatg

SEQ ID NO: 115389 - DNA, 101 bp, Heterodera glycines
  Promoter: Source sequence=SeqID_8834; Location=1..101; Strand=+; Gene= SeqID_69359
aaaaaattccgcttaaagattttgtgcaatttaataaccataacttttctacaattttgtaaaaaaatttctaaattaatattcttgtagagaacaccatg

SEQ ID NO: 115390 - DNA, 632 bp, Heterodera glycines
  Promoter: Source sequence=SeqID_35195; Location=387..1018; Strand=+; Gene=SeqID_64805
taccatgccgtcgcccagtgggagccgaacccttgggcgcaaaaggcgctgcaaaactttatttattttgctgcgatttagactgttttctaaattatttttaatttaaaaatttaatgcttggcaccggatactatcttaaaaatttgagtttagtttggaaattttgtaggatgaaaactcaaaaaattgaaaatattaatttatcattttaaaatactctttttttggataattctttattctggaaagtctcaaatttttaaataaaaaataaaattaaaaattgttccaactgattatgattatgaggattaattgacttttaatagaaagtaattataatttatgatttttttttggattaaccaacatttaattgtttgcttgtaccgtattttgctctaattatcccccagtctctattaatcccgcagtctccaattatcccccagtatacgaggtgttttgaaaaataatccctctatcataatcccccagtctctaattatccccccttttctgaggagattgaaaaataatcacccatgggctataattagagcatatacggtaattgttatacaaaatgattacagcgcccaatcagacggtgctgcagtgcacgcatg

SEQ ID NO: 115391 - DNA, 169 bp, Heterodera glycines
  Promoter: Source sequence=SeqID_13766; Location=1..169; Strand=+; Gene=SeqID_77684
gcgaggccaccaagccaattttggaaagaatctcgctgaaggaatcaattttgagtccgggaggaatgataaaattgaggcaaatcacaaattatttgtttttttattattttatttttctatttcttttgttcgccaatttgtcctttttttctcgctctgccttatg

SEQ ID NO: 115392 - DNA, 100 bp, Heterodera glycines
  Promoter: Source sequence=SeqID_14374; Location=1..100; Strand=+; Gene=SeqID_78410
tttgcaaaaaataaataagtaatgaaaaagtcagaatttcgaaaaattgtagacgagcaagcgttggcattttttcaggttaagttagtcctttacaatg

SEQ ID NO: 115393 - DNA, 360 bp, Heterodera glycines
  Promoter: Source sequence=SeqID_20353; Location=1..360; Strand=+; Gene=SeqID_50872
aggtccatgcagagtgcctaaactaacatgtaaataaaatttggtgcgtttcagaaccctttctgaaaaaatatttaagaattaattttgcaaaaaataaataaaaacgaaagactcagattttcgaaaatttttttgagccagctagctcggcgctcatttcagtgtaagttagtcctttaccggggagtatccctgcaaagtttggtacgcttctgctcaattagcaaaaaatatgagtgatcgaattttcactaaaaaagttaagcctacattttttggcatatttaaaaagcaactttaaaatttttaaaatgaaataattttcctgcaccgattgtgtgttttggcgtagtgatg

SEQ ID NO: 115394 - DNA, 57 bp, Heterodera glycines
  Promoter: Source sequence=SeqID_30464; Location=580..636; Strand=-; Gene=SeqID_60870
cctgtaaatttacacacttaaaacttttttttttagagaaaatacagttcaaagatg

SEQ ID NO: 115395 - DNA, 912 bp, Heterodera glycines
  Promoter: Source sequence=SeqID_17036; Location=2116..3027; Strand=-; Gene=SeqID_81459
gtcccctcaatccatagtcttttaggcgggaggggcgattcgatcccggttttgggagagtaggaagtttggtactccatctcgcctctggcgggaatataatctttaggagagatttcatcacctggtaacgcatttattttaattgtttctaagtcagccaaatgtgaattcccataaattttaactggtgctttccccgcattcattagctgtaaaattacgtttttgctttctcccggagcaaccaaagttcgacccactataattccagggtattggtgttgcactccttttaccaagaaattttgttcactcgggaaaacttcgtttccccgagccaggacaatatattcagtccagggttcaaaaatttcggtcttttccattgttattcgtatcggtttggagatttagacaaacacaaaagatattatgttggtccaagcttctcctatccgacccaacaaaaaggaacttcaagttcgactcctcctggcggtggaataattattccaaatcacggccgccacggcatatcccatcattcaaggggccaaaataaaaaggaggaagtaggtgcgtaagtcgtaggcactgaaaagtcgagccgacgaaggtaaccaaaccagaaggcgcaaaaattattattccttgtgactgggcgctcaagttcagagctaaaaacttgaagttcctttttgttgtgactggggggcagagacagacgcagagagaggaattaaaccggaaatcacaaaaaatcagaggaactggacagccgagaggcagagcacaggaaggactgatgcttccgtttccaacgagaggagtcaagcggaaaacaacggccccaccagaatcaacaatacaaatacctccgaaaactcaacgcctgagaccacagaaatg

SEQ ID NO: 115396 - DNA, 299 bp, Heterodera glycines
  Promoter: Source sequence=SeqID_23438; Location=1..299; Strand=+; Gene=SeqID_54150
taattcaaatatttgcttcaataaaaacgataagtcaaaacagtcatttaaattttgcattttatttcaaatccaaaaataagcatatataatgctgaaataagcacaaacttagaaataagcacacttgggagccctgattatttctagtttatttgcataaattctctgtccgcttttttagcaaaagaacttttggcaatcccatggtgtttttgttttattttgaatttttaccaatttaacctttttttatttctaaggagacatcgccaatcgttgtttgcccaaagaaaatg

SEQ ID NO: 115397 - DNA, 293 bp, Heterodera glycines
  Promoter: Source sequence=SeqID_3637; Location=915..1207; Strand=-; Gene=SeqID_45598
tgatgaagtgatgagttgtcgcgacgaaatgtgtagacgagcttggcgcgcactggtgttgatgttgcgttgagttgaaggctggctggcactggtgaaaagtgaagaaaaccgtcgccttttatacacttttttttgctgcatgaatttttgcacccgaattttgtatataaggaggtggattttgcacattctcctcactcagcagcagcaacacttcaagcaacgctctcaacgatcacacatcaagcacccacaaagccagcccgacaacagcgacaacaacagcaatg

SEQ ID NO: 115398 - DNA, 217 bp, Heterodera glycines
  Promoter: Source sequence=SeqID_41036; Location=539..755; Strand=-; Gene=SeqID_69257
tattaatttcgatcattcagtagagagaaaaaattcactttacaatttaatggatatagtgatcctgtcaatattttaccattaatgtaaatttataaggaagagaaaaattcatttttgagaaatatttttattattatttatttctttttttcatatcgaataaattataaattttaatttttaagaaaaagaaaaagaaaaattgtcaacaatg

SEQ ID NO: 115399 - DNA, 188 bp, Heterodera glycines
  Promoter: Source sequence=SeqID_26666; Location=884..1071; Strand=-; Gene=SeqID_57419
accttaaaaaattcctttaaagggaaataaataaaccgcgacagcttttctaaataattaaatattttaatacaataaaattttgaggcaaaaattagaagtgataaatttttgtattaatttaaacataaaaaatcaaggttggacaacatcgagcagtggatccggataaggtacctgaagaaatg

SEQ ID NO: 115400 - DNA, 275 bp, Heterodera glycines
  Promoter: Source sequence=SeqID_7440; Location=4573..4847; Strand=-; Gene=SeqID_64827
aatggcaggagtcatcaaaatgtgagccttttatatcaaattctgctgggcactgcagcacccaaaatgtcgccggatgaatctttttggttttgggatgtataaaaggagggaaaatgtcggttggtctctcattcccttcacagcgacaacaacaacaaacaatcagcaacgacgacaattgcgcaacgcttcaacacagcacatccatcgcccgtgcacacgttgactccgatcacttctgctgctgctgctgctctccaatcaacacaatg

SEQ ID NO: 115401 - DNA, 93 bp, Heterodera glycines
  Promoter: Source sequence=SeqID_45552; Location=686..778; Strand=-; Gene=SeqID_46823
ggtgaaaattggaataattaatttaattgcgaattgaatggttccgattttcaggtgctcgttgagtacatcgactgcgaaagcggcgacatg

SEQ ID NO: 115402 - DNA, 159 bp, Heterodera glycines
  Promoter: Source sequence=SeqID_26345; Location=312..470; Strand=-; Gene=SeqID_57088
ttgcattttcgtgtcacttcgtcccccacccctccgtcagattgcgtttggttcccaagacggcgtcatgtcctttgttgacattcgtcaggtcaatcggcagttacccgtcgccttcaaagtctctcaacatccgatcagtcgggtaaaatcagaatg

SEQ ID NO: 115403 - DNA, 324 bp, Heterodera glycines
  Promoter: Source sequence=SeqID_12296; Location=769..1092; Strand=-; Gene=SeqID_47028
ggtactgaaaagagggacgggacaaaatctcgctcacaagaataaaattttagaaattttttataagaaaatcaaaaaaaatttcagcgatttattcttgaaattttataataaattactgtttttcgtaaaattttcaaaaaaaaagttgtaaaaaatttttttttttaattttcttataaaaaaattttctgttttttccttgaaaaattttatttttaatttctgcggcgagattttggggtgtactcactgaaaaggcattcagcgcaaaactcaattttcaattcttttgcagccaattactacagtgcacggaacatg

SEQ ID NO: 115404 - DNA, 243 bp, Heterodera glycines
  Promoter: Source sequence=SeqID_41208; Location=613..855; Strand=-; Gene=SeqID_69385
gaataaatttaaaaagatttgatatcggttcaaccgagcaaattacgacagtttgcaaccggggtatctattgtgtgttgtttatgtttattttgaattcataaaaatttaatttggcgtaatgtttgtctgccagtgaatgacccaaaatgctaaaacgatccatcatcattttcattccattttttatgttagctgcgtgttcatcaaattttagcaaaaacattttctttctgtgctatg

SEQ ID NO: 115405 - DNA, 412 bp, Heterodera glycines
  Promoter: Source sequence=SeqID_8034; Location=1..412; Strand=+; Gene= SeqID_66766
tagctgtttttatatttatatttcatgaaaattttatcgaaaaaatattgtatttttcatatttaatttaacagggatctattaaattaattttatttatttaaatatcttaatttagtattttttgcaggacatattccatattattatgataaatatttattattaaaattttattgtctttttctgagtctaagctattcgcaaaaactcagaatccttaaattaaatatgtaaaaattaaagtgttttttatttgtaattttttttcacatacatttgccggttctgagtcactttgatttaaaacaataatctaaattattttgtaaaatttttggaaataatgttataaattcaaatcatatcaatgatgtgttgccatttttcaggtaaaagatcaatcccaatg

SEQ ID NO: 115406 - DNA, 1003 bp, Heterodera glycines
  Promoter: Source sequence=SeqID_13048; Location=288..1290; Strand=+; Gene=SeqID_76832
ttagtgattgattgaccgattgctttccattgttctcctcataccatctttctcttctccccccccccccaaaggttgtcgaactgtggcaaaccccgcgcggcacagaacatcaccgttttcgtaagggaatgatgaaaagtatggtgggcagtggtgccggcggaagtggcagaacggccacctctggcggtggcacatttcggcacgcgcaattgccaatcggcgacgatgccaaacattcgacaagtacggcaccggccgggatgagtgccggtgaggggagggcacagatgatagagtgtcctttatttgattgaggtgtctatacggcgtcgaaagaagcgctgtgccgtcaattgtccctttcgtcggccgaagaattgggccgacgaagtgccgcgttggaagcggacaatttgcgacttcaccaaacgctcgtgtcggtgagttgacacatttgaacaaacagtgatcagttttgatcggaagtgatcactcgcgtttctgatggcattgaataccgagtctcaaaagtgacttaaccaccaaatcaattaaataaaatgccctcgggggctttcccctctccgtcaaaatccgtccccaattttggcctcaatggcaccaaataagctcggctcaccaaattattattcgaattccttgccaatcaaattcagaagtccaccgaactttgggatttgttggagcgcgtccgtcttttgacagtgaaactcagaggcaagtgaagcaaaaaataaataaaaaggcaattgaatcgctaatggacttggccttagccatcattctcattaacaaattgcaaagattttaatgcctaatttagcaaattggcacggctaagggaatcaccgccggtgtttaattggtccaattcggcgttttattttggaattatctccgccgattccttcgcttttcctttaattttaattgcccccccccccgcatttcgatttgatttcattttacagaaatg

SEQ ID NO: 115407 - DNA, 485 bp, Heterodera glycines
  Promoter: Source sequence=SeqID_2793; Location=705..1189; Strand=-; Gene=SeqID_81623
agatacaataacatactagatagacactgtattttataaatttaataatacctcctaattagcctaattagtttcctccttttaagcactttaaatagtaatcccgggagagaatgcgtgaatctttctaatcacgacgccaaaacactcgagcttatccggttcgagaactgcgttggtttgaaggtcttacaatgtcaaaacggaatatctttcaaattaagccaagaaaaaaattttttcaaaaattttttttactttttttgccaaagtgtgacaggcaatagtcagcatcagcagattgggcaaaacagttgttgatcagtccaaaacagcagcagatgctgatttgattactatttttgaaactttgacaaattgttaattgttatgttaatgggacgatttaaattgcaataataattaggaaaataattaaataaaaaataatcatttattttgaagacgaaaaggctgagccaatg

SEQ ID NO: 115408 - DNA, 125 bp, Heterodera glycines
  misc_feature (71)..(71): n is a, c, g, or t
  Promoter: Source sequence=SeqID_29916; Location=863..987; Strand=-; Gene=SeqID_60379
tcgacggaccaccgaattgcattcagcgacttttaaaacgcattggcagggacccgacaaacgcaccacanaaatgagggcgatacgaatctgatcaactcactgttcatggcatggtaaaaatg

SEQ ID NO: 115409 - DNA, 374 bp, Heterodera glycines
  Promoter: Source sequence=SeqID_20916; Location=773..1146; Strand=-; Gene=SeqID_51500
tatttgggtcagcattttgcctagataaaaattatatttgaaaatagggggaaaatccaatcaaatcaaatttgtttcatttttgagtcatcgttttgccgtaatttctttttttaatgccctcgccatccaaaacagaaagttaattgatttactcttttctaattactattcctcttcccctattaattttctggcatttttatgaagaatttggtttttattaatgtatttttgaaaacttttttattttttgcagctttaaattttttttacaaaatttgcaagtatatttaaaaaatctaataagattatttaaatttatttatttttcttatttttacatttatttagcattaaataaacaattaatg

SEQ ID NO: 115410 - DNA, 545 bp, Heterodera glycines
  Promoter: Source sequence=SeqID_7762; Location=1..545; Strand=+; Gene= SeqID_65865
tccttcccgcattttccttcactttcccatctctttatctccgttcaatcagtcattttcttatccatttcatttccatccttcgccatccgcgttatatccatcattcacttcattttcacatttcgttttattcaccaatacgtgtggtttaattacccaagtttgagatgggagaataaagtaattctggataatatttggtcgccaatgatcctgggagggcccgcccgtttcactatgccttcttcgccacacaattttaaagttgcaattgtcggcgctgggcccagcggtctcacagccgcaaggtcagcagaagagatttgcaaagattgggtcaatttcagacaagctctgctctacggctacaaagtgcgcatttttgaaaaggaacaaaatttcggcggcgtttggcgcctcgccatctcagaaaatgcgcaaagtgaattaattaattagataattaacaatcaatcaattaaattaataatagccaattaattaatgaattgattagctaactaatataataattccaaatg

SEQ ID NO: 115411 - DNA, 818 bp, Heterodera glycines
  Promoter: Source sequence=SeqID_12217; Location=1..818; Strand=+; Gene=SeqID_75793
atttttttttgcggtgtacccccccaaaaaagttggtgaatgggagttgggtccgacggccccgataggcgtcgccgggaaaatttttgaaaatttgagtgcaatttcattatagatttaataattaaaatcggtgaaaatgataaaaaaaaatcggtaaaataaagtgcgggcatgcgggatcgaacattaatccacagaacaacataacctgctgtcttcaccactaaactacaatatttcaataataaggcttattatttcttataaaaaaagtcattcttaagggtgtacatattttcgtctttttcgtaaaattttgctctgacgaaaacgaaacacgaaacgaaaaacaaaattttgaaaaccaaaaacgaaacgaaaaaactttggcggacgaaaagaaacacgaaaacgaaactcaaaaagtgcagaaaatgtaggacgaaacgaaaacgaaacgaaatttcgtccagcctgatggggtgcatcccaaaacgtcgccggccgaaacgtcgccgacgactttttgaaccatagctttgtgcattgtcaattaaattaattattcttggtgttgttcgatagctttatgtgtttaatattaataggcaaaatttcaaacattttcgttaggtttcaaaaaagttacctcactaccctatccatgccgatccatccccgcgaaatccatgggaccatcctgctctatccatgccgatccatcctgaaatccaggacaccctccctgccccattgttgtttaattgtccgttttattttgttgtagcaaagatgccaaaagccaccaggcaatg

SEQ ID NO: 115412 - DNA, 213 bp, Heterodera glycines
  misc_feature (53)..(53): n is a, c, g, or t
  Promoter: Source sequence=SeqID_44832; Location=769..981; Strand=-; Gene=SeqID_72253
ccaatcgatgatcttctccattcacttgtttgccttatctcttgacttcttcnccttcaaatacaacaaactgttgctgattattgttgctgctgttgttcgttgtcactcgtttccctccattaatttcatttttcaatttaatgactcaccttaattaattcttttttcagtgaatccaattactttctttttctttcttctgttggaatg

SEQ ID NO: 115413 - DNA, 139 bp, Heterodera glycines
  Promoter: Source sequence=SeqID_39621; Location=1354..1492; Strand=-; Gene=SeqID_68141
aaatataggtctcaatagggtgcattcccatcattttcctcgttctctttttgttgtgtcttgctatctctcgtattgataagtggcatttttttcaataagtgactgttaataaatacataggtaaatctcatgaatg

SEQ ID NO: 115414 - DNA, 217 bp, Heterodera glycines
  Promoter: Source sequence=SeqID_41351; Location=784..1000; Strand=-; Gene=SeqID_69499
tacttaattttaaattcattaatatcattttaaattcaccaaaataattgattaaattttaaataattatttttttctgatcaaagtaatttcgcaaaatatatttgaatatttcttttttaaaacatcatttttttaattatcaattttttataattaatattttataaatttaaaatttaattttaaattgtttcacccttccaatgttcagatg

SEQ ID NO: 115415 - DNA, 1003 bp, Heterodera glycines
  Promoter: Source sequence=SeqID_948; Location=959..1961; Strand=+; Gene=SeqID_64754
gagtgggtgactctgatttatcttcctaaaaacgattaaattaaaacgcttcactttgaagtaaatttgtttgctgtataattattctatatttataataaacattttcttttgtctttcttttattggttcatttccacatatctttgaaagacgaaattacttttctatttaatcgtgtttagcgattaaaatgccttcaaaagaacagaaagcgagacaacgccggaggtcgcgaactgcggaggatgatgatccctcattggggttaccattacttcaaagtgaagcgttgaccggttcaaattcaaaaaaacagggtcgccctattaaaagacaaagtgatattttggaaagttcggtatcgtgtgaaactccaaaaagttctcgcacaaagggcaagtcacaaggaaatatttcgcccgttcaaaaacgagcaaagacttatgatttatcgatagtttataatgcaattatgtcacctggtcatgattttaaaaatatcgtttttgcgaccgagaaaaatcatagttgccagatctggcgtaaagctagccttaatctttaccaaaatgactctgacaactctggctttaggcaaattgaaaaaaattggaataatttatcagaatggctcaatgattcgtttatttattcatttctctgctatattagcacgctatcgacgaaaaatgttgttgttgttgaccccttgtatactgatacccagcaaatgccaaaaattcttttatctaatatgaaaaatatagtctttattattgaccagcagtctcctccagagatattacttatgccactcaatttcccagggcattggactttacttattcatgacataaattacggcacttttttaatggattcattgcaaataagcgagttaaattttgatcgggtattgcgtgtcaaagatataatttgtaaattgtgtcaaatcaattctgatgatatattaatacaaaattttcctgcttcaaaaatg

SEQ ID NO: 115416 - DNA, 160 bp, Heterodera glycines
  Promoter: Source sequence=SeqID_10623; Location=1..160; Strand=+; Gene=SeqID_73853
agccattacaacaagtggtccgagaattgaacaagaccaattacaaagcgtatgaattcaatcaccaaattactcaattcacagcaattaccatttcagtgttgtaaagttggcaactttggccggtcgggaacagctttgcatcaacgaaaaggtcatg

SEQ ID NO: 115417 - DNA, 571 bp, Heterodera glycines
  Promoter: Source sequence=SeqID_26108; Location=1..571; Strand=+; Gene=SeqID_56855
ctgcatttctccgatttgcctatcgacacatcgccttcttaattctcatctgaaaggagcatgccgctacctttaccctcaattatttcaaattcaataataatggtcaaacctaaaaaccgacttcccggaccttacgccacctgctctgaatatgatactggatgtctttagggatacaatcgatgggcaagagattgacagagactagtcaaacttcatacatctaactatacagccttgtgaacaagatacagatcgacttgctataacagtgccttgtgaattttagtaaaaaccataagaaagggaggaccctttggttataagacttataatcgaattttattttttctcttgaagtcaaaaattttaattttttattttacacaaattcttaataaaacaaaatacgataagataaaaaacagatccataataaataccttaagaagggatcagccgaattttaaataattaaatcctcctaattttaaatgggttttctctattttctaattaattttctactcataaactttttaatttttaggcaccgatgaataaaatg

SEQ ID NO: 115418 - DNA, 553 bp, Heterodera glycines
  Promoter: Source sequence=SeqID_11853; Location=1..553; Strand=+; Gene=SeqID_75352
aatatttatacaataaaacatggtataatatgggaagtgatgcgagagaaattcgcatatctctccgtttctttctgctactctcttttcttttacattgctatttactctcattttttcgcactccctcattctcccacacacacgcacgcgtccaacagactactgctgcacagcaacacgcgtctgttcactgtctgcccctcccatctgccgctgcccgcatagacagacagtcatacagtgcactttttcccaccatccctccctctaacctctacatcctaggaggagaaatcttttaccttctttttctgtgctatttcttttgccttcttcttcttcttaactatttattttcgtctcttttctttatattctcttctttttcaaaacaatttcttttcatctcttttcaaattcatttttaacgcaaaactcaaacaaaacgccacaccaattcaaacagtgacacatacagagaatcaactttattatataagattgtaaaaatttgaatgttttttgttaatcattctgatttttagatatg

SEQ ID NO: 115419 - DNA, 1003 bp, Heterodera glycines
  Promoter: Source sequence=SeqID_9978; Location=2789..3791; Strand=-; Gene=SeqID_46832
ctttcccgcgcaaaatttacaacgaggcgctagaaattcaaaaagttaatttaattttaacaatttattcattaaagtagaaatattttcaaattttaattgatatacaaaattttgcgctatttaaaaataggtatatttggaattttattaaaatccggcacccttttggaatgataaaaattttttttttataaaataattgtctagtaattaaaatttgttcctgagctttttggctatgttgcacctattttgactaattctggctttctaatcaagacttcaaaaaataaataaaaatagaaaatttgaattttcgatttttgttcgagttagttttcgggttatggattagaaattggtacaagcaaaagccacacattcgtgatcaaggaccctaaaaaccctctgaaaacaagttttcacgagtttttatcacatttgcaaaccacaagaatcccttcccatttatttttaataaaattcgtggaccatttttcaaaaagcgcccaattttttcgaaattaattaattttttttactttttttttgaattaaggcaatgcaattactctactttcgggtttcaaatgatttcgattttttaaccaaaacattggagccggttgccgccacagatgttacgatccaaagctggttgaaactgtttcgtgaggttcacaatctgccaatcatcagtcagccgctcactttggttttgactcgatcagtttgtttaaaaatttaaataaataattttttattttttaacatttccctaatttttatttccttgggtaattaaaatttaaatatttttcatttaattgttcacaggattatatgtgccatttgcgcaaaagcaatggaacagatgaagaagaataccaattgaaacaggcatttaaaaattaaaaaattttatttatttattttaatttaaatttaattaaataaataaaatatttcaaaaaaggtggaattgaacattggtcaaatg

SEQ ID NO: 115420 - DNA, 54 bp, Heterodera glycines
  Promoter: Source sequence=SeqID_30059; Location=1743..1796; Strand=-; Gene=SeqID_60509
gtcaaaactgatcaaaaccaaaagtgtgaattgaaatatcatagaataaaaatg

SEQ ID NO: 115421 - DNA, 192 bp, Heterodera glycines
  Promoter: Source sequence=SeqID_31262; Location=1699..1890; Strand=-; Gene=SeqID_61636
tttttgtttctaaatatttttttcagaaagtgctctacttacgcaccaaattttatttacaacttaattttagcactctgatgctttagtatcaaaaaggaagatggagaaaaaatgttttaaaaaatttttccttatattttggttatatcgttttgcttttggtggggtgcttggaacagtggaatcatg

SEQ ID NO: 115422 - DNA, 91 bp, Heterodera glycines
  Promoter: Source sequence=SeqID_5336; Location=3226..3316; Strand=-; Gene=SeqID_57716
aggacatttcgaattccaaggcgtaaaagttaaagaaaatttttatgttgccgaaaaaggctcgatgaatctgttgagcatccaaacaatg

SEQ ID NO: 115423 - DNA, 490 bp, Heterodera glycines
  misc_feature (5)..(5): n is a, c, g, or t
  misc_feature (16)..(16): n is a, c, g, or t
  misc_feature (35)..(35): n is a, c, g, or t
  misc_feature (53)..(53): n is a, c, g, or t
  misc_feature (57)..(57): n is a, c, g, or t
  misc_feature (88)..(88): n is a, c, g, or t
  misc_feature (95)..(95): n is a, c, g, or t
  Promoter: Source sequence=SeqID_3170; Location=1..490; Strand=+; Gene= SeqID_83505
ccaantcaatttcttnccgaccatttttactatcnaaattatcctcttttttnttcnccacttaacaattaccaaataaaaaccattnaccaatnttaaaaatgaaaaatatttttttaaatcacaataatttgaaaaaataaattctccgtttcgctgcacaaattgagctaatctttttaaattataaaattaattcatccctttcttttctttctttctttttttgttcatcagcactttcaatttctttttcatttgatttatttgcactttctttctttggcgtcattttctcgtgccgacaataccctctgattaagcatatgattaagcatatggcatggattttctcaatgcgttgcgccaatttaaatgatcttatgccactaatccacaaatcttttatcataatttaattttaccatttaataaattttagaaatatttcacaatttaatattctaaaaatttattcagaagaaaaatg

SEQ ID NO: 115424 - DNA, 812 bp, Heterodera glycines
  Promoter: Source sequence=SeqID_3419; Location=2244..3055; Strand=-; Gene=SeqID_84614
tcctcactaatagttaatttggacccacatcaatttcccggatcacattggattgcattatttgtttatggattagagaaaaaagcaatttattttgatagcttaacctttccaatcaatgaaattgttttaaactcttttcttcatgattttccaggaataatttataataaacaaacatttcagtcccctatgtctaaatcatgtgcccatttttgtatttgttttgtgtattttttatcatttggattaagttttaatgaattccttcataaacttattatatcaaacaatccagaattatttgtccgtaattttattaataattttccaataaaataatttatttgcatttttattcagtaaattttggggggatggaaagggattggctagggggaaggtaaacatattgactgccactcggtaccccggcaccgattgtttaccgagagaaaccttccgcgtctgcataaaatggtgaactgtgattggctgaaaaggttaatccgtccctctcatactggcgaaaatgactcttttcctttccgttggatgattggctgaaagaccttttcctttttttcaaatatgacttctttatttgctatgtgagtgggaaggcgatgattggcgcaatgaactgtcatttccctctccaataattgttcaataataatgatgagtaaatataaaattttatctataagagaactatcatatccatcatattctggtttaaaaataagaaaaaatatgcattttattcataataaagaattttttaaataaaatttatttttaagaaaatg

SEQ ID NO: 115425 - DNA, 191 bp, Heterodera glycines
  Promoter: Source sequence=SeqID_13597; Location=930..1120; Strand=+; Gene=SeqID_77498
cctaagggtggaagggtactgtagaaggagtcgaccgattcggcaaacaaatacggtaggacaagccacggtagaatgtgtgaaaaacttacataagtgccgaccattccttaagagcaaaaatatatttaattactcatcacccgatgttgaatggtcaccctccccccccccccctcaattaattaatg

SEQ ID NO: 115426 - DNA, 690 bp, Heterodera glycines
  Promoter: Source sequence=SeqID_11891; Location=1535..2224; Strand=-; Gene=SeqID_46997
ttaaattaaaccagggatgcgatctgttctgatttatcagaaatgttctgatttgaagggtccaaatctgataaaataaaaaagttctgatttgtcagaaatgttctgattttggggtagcgaccaaaatttgttctgatttcttaaacaaactcataattttaaaattttatggcctaatgtcactattttacaaaaaaatataaaatttatggcaaaatttggtcattttttggacaaaaatctgttaacaaatcgtactaaaatcacaaatttttcccggcgaaaaaaagcgtttttaaaagcgaaaaaagcgggaccgggaattttaggcttaaccgggaccgggaccttttctggttgaaaaaccgggactttttggctgggaaaaccgggaaaaaaccgggaccttggtactcagttgtccgtgtccaggtcccggtcccgctgcactctagtttttagacgaaaaaaagcgaaatttgaagtttcgactttttgttcgaattcgggttcgaggttcgaaattgagcgaaatggatgccagaatcgtgatcagcgactcggaaacccctagaaacttgttttgaatgactttttaaagggcaaccatcttaactattaccgcagtgaacctatcaaattatttacataaattttaattattttctaacagaatatacaaaaatg

SEQ ID NO: 115427 - DNA, 403 bp, Heterodera glycines
  Promoter: Source sequence=SeqID_43314; Location=1..403; Strand=+; Gene=SeqID_71012
ttttcatttaaaattgctttattttcattggtatttaggtcccacggcatggatggctcgaaaacgcactttacgtgtgcctttattttgaaccgggccatgatacgctgaacaaccaattcacgacgatgcgtcaaataatcgatcatttttttgccaatcgatgggttctctgagggggcgcaatttattcggacaaaataaaatcgcacatttacagatccttcatttgcatgtcgattttcaaggtttccaacaaagaaaaagaccatttcctatttgtttgtttaatttattttaattttcagtcaatttgttccaaaaatgggggcgctttaaggctgccaatgcggcgatcgccagcacttgggacgcttctcgtgcgaatgccttcgccgaaatg

SEQ ID NO: 115428 - DNA, 185 bp, Heterodera glycines
  misc_feature (94)..(94): n is a, c, g, or t
  misc_feature (111)..(111): n is a, c, g, or t
  Promoter: Source sequence=SeqID_38901; Location=1..185; Strand=+; Gene=SeqID_67594
ataagttcaatttgtaattatatttctttttcatttctgacttttgtgccgcgctcgctaactgaaaatttgtttaaatgaaattaaatatatntagaaacaaaccccatntaaaaggggtaaaaagaagtaaatgcatcattttagaagagattttttatattattaaattcttattaactatg

SEQ ID NO: 115429 - DNA, 284 bp, Heterodera glycines
  Promoter: Source sequence=SeqID_2716; Location=4402..4685; Strand=-; Gene=SeqID_81227
aattatttcttaagactttgggctgctgggtgaaattcttaaaattaattttaaaactaaaagttcaccattccgcaatttaagcgggaattttattgtgctatttcttgaagtttaaatgattttttgcttatatagacaaaaaaaagcgcaaattccaagggatttttgaggccggaattcatgattataaaaatgttttagtctcttgttcattaaacaataaaattcattttaaatttttcccctccccctcttcttaggtcagcatgttgccggaaatg

SEQ ID NO: 115430 - DNA, 117 bp, Heterodera glycines
  Promoter: Source sequence=SeqID_15922; Location=738..854; Strand=+; Gene=SeqID_80268
aattattattagtagggattctttttttatgtaagaaaaatcgcgaaatatgtaaataaaataagtataaaaaatgctaaaatatgtatgaaatatgtacaaaaactcccaaatatg

SEQ ID NO: 115431 - DNA, 161 bp, Heterodera glycines
  Promoter: Source sequence=SeqID_21328; Location=418..578; Strand=-; Gene=SeqID_51922
attttttctatttgaataaatcaacgatccatacagtttgtctgtgtgttttaaacatttttataataatttaaatggttttataaaaaccaatttttatctatttttttaatcggtgttgaaattccacaattttgagaaaaatttaaaagttaattatg

SEQ ID NO: 115432 - DNA, 182 bp, Heterodera glycines
  Promoter: Source sequence=SeqID_14127; Location=2963..3144; Strand=-; Gene=SeqID_78123
ttggaaaccctctttacacaatcgatgaagagacatatttgcaattcttcaaagaaaatttgttattaattcttgactcagcccgtaaaaatgccgaaatttcacgggcggaaaccaaaaacagatatgatttacgtccaaatgtgtccatgaacaaatttgcagtcggggatcgctgcatg

SEQ ID NO: 115433 - DNA, 147 bp, Heterodera glycines
  Promoter: Source sequence=SeqID_1808; Location=5020..5166; Strand=+; Gene=SeqID_76089
atcagaaacagtgggggatacggtagcaaattacatgaggaaactgtagggaaaagcatttggggagtggggatacggtagcaaattacaagaggaaactgtagggaaaagcattttaatttttcggaagaaatttatgacacaatg

SEQ ID NO: 115434 - DNA, 1003 bp, Heterodera glycines
  Promoter: Source sequence=SeqID_10863; Location=461..1463; Strand=-; Gene=SeqID_74142
tcattaattactcaaaaatcatcaaatttaaaaattttgaagcaaaaaattatgtatggtgtaaaaaaattctaattcttcagatcattcgatagccctaagtgttctctattagcttgtaaaatttcaaaaaaacttttgttgactttcaaaaaagtcatggccagaagaattcatataaacaagattttgtccagcattattgtcataactttttggaaacttaatcatgatatcattcgattacctttatgttttctattagcctaattagcctacaaaatttcaaaaaaatttcatactaacttttggttgctttttcagcaaatttatatgctattgttgtttattttgatggtttttttaagtaacgactaaccccacctaaattatatgaaaatgtttttttcttcaatttttaccgtaattaaccattcgtaaaattcttcctccaactcatatgatggtgaataaataattctggatgcaaattcacgtccattccgtatcatattttgtaggtctttgagatgccgtttttcaatttgcaatattatgacaacatccgtgcttaatgcaattaaaaattaaagtaaattatttttaatatatttaatttttcttttacaaattgtttgcaatgaaaatttgagttttaaccggaaattcccgggaaatgagcatcactttgggggtggactaatttgtaagctgatatgatattgagaattcatagcttatttttgtaggcaggcaattcgcctaggttcaataataataaataataattaagaaagaaaaaagtaaatctatgttgaaaattacattgtatataatattttgtactaccaatgaatatcaattttgtataaaaattattagccaaattcttatggcgccgaaaagaaagataaattttttttatatatttcggagcgccttagcgttgcggcattataataacggcacatcaaatgaataatttcagaggatcaaaaaaatg

SEQ ID NO: 115435 - DNA, 823 bp, Heterodera glycines
  Promoter: Source sequence=SeqID_20011; Location=857..1679; Strand=+; Gene=SeqID_84786
atgattttttaatttgaaaacccagtcctttttattgccacgagtcggcagacaattaagtaattaatgcaaaaattaaattatggcaaatgtttaaaaaatttcgaacgaaattttttaaaattttgcagaataaatagaaaaaatttaatgctttcaaattatatcaagaattaaaatttgattacttttgagcaaaattatgaatagcttcttggccaaaaatttcccatttgatgcttttttgagttaaagaccaaacccctagcgaaagactaaaggtaaagaaatgagagtaaatgaaaatagcacaggcaaatgctctgtttctcttccctttatataaactcatataaaaatgtaaaacgaaaaaatgaaaaaggtgaaagtaaagtaactgcttcacttgacttgcacactacgtgaaggaatttttggaccggggccatcaggggatggccctaaaaatttgtgtttcgtcgttaaacacaatttttccataccgaaaaatggtgcaaaaaatctatcgattttttttacagaaatttcgattttttaaaaaggttttgcacatccaattccaaaaacaagagaggaaccaataaatagagagtgtgcagagaaaaaaatgtcccccttttttttgtggagaatacatgatacttaaattataataaagcaggtgataacttcagagaaacaaatattttttgttcaatttatgaaaagaattaatttattgaaacaaatatttggcgtatttgaaacaatgaataaaaagtttggcttatttgttttttttatttttaaggctattcaaatg

SEQ ID NO: 115436 - DNA, 153 bp, Heterodera glycines
  Promoter: Source sequence=SeqID_23176; Location=1169..1321; Strand=-; Gene=SeqID_53879
tcatccgtcttcgaccacctgagcagaacaacgctgcgacactggcggcagcgattgagcgactagtcgctgatccgtgtcatcaaccctgacgacaggctttgcctggcgcgtgccgtgcttctgggtctgagagaccgagagatgagaatg

SEQ ID NO: 115437 - DNA, 67 bp, Heterodera glycines
  Promoter: Source sequence=SeqID_28054; Location=1589..1655; Strand=-; Gene=SeqID_58714
aaaaatagaaattcaaaaatcatttaagtatttaaaaaaattcttatatgttttcgttttacatatg

SEQ ID NO: 115438 - DNA, 89 bp, Heterodera glycines
  Promoter: Source sequence=SeqID_40731; Location=1..89; Strand=+; Gene= SeqID_68991
caacggtgatcagaagaggtacaccagtgatcagaacaggtacatcagattagaagaggtaaactttgattagaagaggtggaacaatg

SEQ ID NO: 115439 - DNA, 130 bp, Heterodera glycines
  misc_feature (10)..(10): n is a, c, g, or t
  misc_feature (34)..(35): n is a, c, g, or t
  Promoter: Source sequence=SeqID_38583; Location=1338..1467; Strand=-; Gene=SeqID_67356
taataatttntaatgtaaaattatttctctaatnntagataaaattaattccaacaaaatatgatgctcaaatgaaaatcgccttaattgcattgttgaaagctttttctcccgcttaattaaaacaatg

SEQ ID NO: 115440 - DNA, 746 bp, Heterodera glycines
  Promoter: Source sequence=SeqID_18904; Location=2793..3538; Strand=-; Gene=SeqID_83612
caggattggtggctttaatttgtttccatgtgtttaagcgttttttgagcaaaatgattaaattgaattttggactttttgttcgaatttgggtccaggttgagggactggtcgaaatgaacgcaagattcgtgatcatctgccccgaaaacccctaaaaacatgttttcagtaattttcaaatcacaaaatatttttttcaaaaaagatgtgataccagcggcagtattaccccaaatccaacattgttgttttcattagagagcccttcacttgctctgttcactgcaaaatttcaagttcaaaagagccaaaaaggttggaaaatctgtctggttttttactggccatatcttttttaaaccttaacgaaatttttcaaaattttgcatgcaggttaatagattacaattagggctttcgagggagggggggggggggggggtgcgccggccgatgacgcatcccttgtatgtatgttatcacatttgccaattattttcaaatatttaattagtttttttaatgctacagagatttaaatggtttagaaaaaaccaatgaatgggagtgaggcgacgctgtcgacagacgccgctggggaaattttaaaaaactgggctcaattttcgaacagattttctccattaattgatcaaatcaccaacaagtgtaagccgttttagaaaagtgctgtgcggaaccaacggcagatttgttattaacataagttttttcaaaagatg

SEQ ID NO: 115441 - DNA, 79 bp, Heterodera glycines
  Promoter: Source sequence=SeqID_22821; Location=1250..1328; Strand=-; Gene=SeqID_53530
tagcaccttatcccttctgctactgtatttgactttttgcttttctatgctctcttttagatagttccaaggaagaatg

SEQ ID NO: 115442 - DNA, 742 bp, Heterodera glycines
  misc_feature (42)..(42): n is a, c, g, or t
  misc_feature (48)..(48): n is a, c, g, or t
  Promoter: Source sequence=SeqID_27230; Location=1..742; Strand=+; Gene=SeqID_57920
aaataatttttaaaaaaaaatttatgtttaactataaaattntcattngatcaattaaaaataactacgtgccatttccggcgcctgacaccaatgctctaatgacaggccaaatttgccaaaattttattattaatattaatttatttttattagaaaataaaaaacctaattaaaaagatttataagaaagacatttaaaaaaatgtttcctcaattttctatacccttatcactgtgagcattgattgataaatgtttaaagtttgtacgacacatttgcgcctcggacatttgcgcccaaggcggaaatatacggaaattgaacatttttgttgcccgacttttgcgccaaactgtcccaaaaaagaattcaaaagtttttcgctataaatctctcaagaactttttcttgcgcttatgggtccgaatttcacttagggcttaacatattcctgatattcttatgacaaggaggaaatgtatcaaacaaaaatccaatttttgggcgttctgtcgcgatttgcgaaataatttgtatttcctccctccgcctagagaatggcaaatcaacctttttattagtttttgcggggtatcaatttaaatgttgatatttaattaaatcaactaacattatgccatcaacgcaaatatcaacgtaatttttaaaatttgcgaaaattttttaaaatttatatgagcggtttataattttagtgcgagagataacgcaaaaatg

SEQ ID NO: 115443 - DNA, 55 bp, Heterodera glycines
  Promoter: Source sequence=SeqID_17373; Location=2705..2759; Strand=+; Gene=SeqID_81859
atattgcattttgtttagaacccacaaatttcttcatctcggcgccgaaacaatg

SEQ ID NO: 115444 - DNA, 1003 bp, Heterodera glycines
  Promoter: Source sequence=SeqID_9774; Location=230..1232; Strand=+; Gene=SeqID_72649
ataacttttttctttgttgaccaaacttaataataaacatggtgttattcgaacatgcctttaaatgtttagaaaatattcttagctaatttgtaagtgattaaatagcttacaaaaaagttgtggtttgaaaaccgcaaaaaaagacagaattttcgaagtttttaatctctatcttttttacattcgacattctcaacagataccttgattattggattcgggcaacaatttagaagatatattgactcaaagttggctcagagggagttggcccgttccgtttggccagctggctttttgggcaaatttttttattgactttttttttggaccatgaatttgtaagactttgatcgtttgaaaaactgaataccgtatatgctctaattatagcccagtctctattaatcccgtagtctccaattatcccccagtctacgaggtgttttgaaaaataatccctctatcataatccccccagtctctaattatccccccttttctgaggaggttgaaaaataatcccccatgggctataattagagcatatacggtaaaaccaaaaaaaaagtagcagttatataattcttttattactagacatgcattaattataatttttttttaaaaatttattcattaaataaaacaaattatttatttttttaggtttaaattttattggttcttttcgttcttttctaaaaaaataattttttgttatattgtattacgtttacagaggggtttttgattagtttttggttatttttatggttttgaaaaccattttttatcccttccaggattttccaattttaactatgggtcattatgaatttttttaaaattattatttattagccttggctctcccaccgatccgcaagaactgtcgcccgtccctcgcactcagtgcgccaactgcatgcgaatgttgtggcgcaacccgtcgaccgctgtcgcggaatggcgcgggcgtcgacggccgcccgtcatg

SEQ ID NO: 115445 - DNA, 325 bp, Heterodera glycines
  Promoter: Source sequence=SeqID_19786; Location=1..325; Strand=+; Gene=SeqID_84523
cagattcgtgatcagcaatagaaaagcccagaatgcatgtttttattagatgtaaatttatttaaaaaatcaaatatgtgatgaaaaatcatagacaaaatcaatgatttttcgaattctgagcacagatccgtaatcagcgtattttttcacactagaaaagtcgaaaagaaaatttttaaatttatttttcgccgggacaccgatttttccagtattaccctaaattaaattgcttattgctttttcatgatgcatttggccattgcacgagagcgccaggatcgcgtgatgtgcgggttgggtcttgggaatattggaaatg

SEQ ID NO: 115446 - DNA, 80 bp, Heterodera glycines
  Promoter: Source sequence=SeqID_36896; Location=1457..1536; Strand=-; Gene=SeqID_66100
ttaagattgaagtgaacattggccaatctggtggcttcgtgaattcagcaaatatcacaaaattgcacagacgaacgatg

SEQ ID NO: 115447 - DNA, 748 bp, Heterodera glycines
  Promoter: Source sequence=SeqID_43457; Location=485..1232; Strand=-; Gene=SeqID_71114
aggggtatatttttttaattttttttttattcctttttcataatatttgaaaaaatagtttttttttaaaattcccaagtcaaaagagttattaaaaagtttcataagcgaaaatactgtagttgaaaatagtgctaaaaaagtcgctatatatcgaaaagtgttcgaagaaaatttgttttttgcgcttatcagttgggactggatttgtatggatttccatttttttttttgcctacaaaccacgtaaatagtgtttttagctttgtttgatgcttctaggatccttttttacttccatatttttccatatttcagatttttgtccatatttccatatttgacaatgtgttggactcataaagtttaatagagttaaaatatttgttttaattaacccttattttcctaaataccaatattttaagtgaagaaatattgtaaattttcaactttcaacttcaaacgtcaaaaaccattgccagaaaatgaggaaggagaacaacaaaagcagtgccgcctcagcagattctgatgccaatgccaaaagtggtggcgatgcttctctcaccgcccccactgaagaggagggcgaagaaatcagtttaattacttataatacgtttggtttcactaaaaattctttctttaaattaaattgtcaaaaatatttggaaaaataaatgtaacgctaatccctttcttcgagcaaatttgcacctaattaatttatttacatatagatatg

SEQ ID NO: 115448 - DNA, 63 bp, Heterodera glycines
  Promoter: Source sequence=SeqID_3946; Location=1622..1684; Strand=-; Gene=SeqID_52552
ggtcaatttaaaaattccattttaattgcattttttaaatttcaaaatttgtcagttcccatg

SEQ ID NO: 115449 - DNA, 211 bp, Heterodera glycines
  Promoter: Source sequence=SeqID_18499; Location=381..591; Strand=-; Gene=SeqID_83121
tctttcactctctctctcgctctctctctctctctacactcctcccattcaaaacaaaatgccaaaaacaaaaatgttggcgccaattgtttttttcaattaactgttaacttcactatattcgtttgtccccctcctcagtgatcgtcacgatcacccgttctccccgaccaatcagcagttgaccaagggcaaaagtgccatcggaatg

SEQ ID NO: 115450 - DNA, 619 bp, Heterodera glycines
  Promoter: Source sequence=SeqID_8171; Location=3147..3765; Strand=-; Gene=SeqID_67202
atgaagcattatcgaagcttttacccagaaaaatgtacctttggaaaaaaattccaactttttgttcgaattcgggtccggggttcgcaactgggcaaatccgagttcaatctcatgatcagcgccctcgaaaacccccaattacttattttgagatcaaatttaaaataataattttatatttgggacccccattctttacgattgccgtttttgagatataactcctccgtaaatatttgtctgaattggatggatttgatggcatcattcggggaacgactccaaaaactttaattttctaaaagtgcaatccaaattggtcccccatgaaaagtacttttgctccctcggctataggctttgcctgaaatcacttgcccttttcagatcactttggcccaacctcacattgttcaaaggttgtccgcctttttcggcaccaactctttcatggtccgagtgcagaattgcgagcggaccaatgccgattttgcgatgcccgtttttgccgtgggttttgaaaacccatacaaaaaataagcattgtaaatgtttccatttttgtcagtttattatcaccaaattcaaaacggcgctcaccgaacggcggccaatg

SEQ ID NO: 115451 - DNA, 99 bp, Heterodera glycines
  Promoter: Source sequence=SeqID_11072; Location=532..630; Strand=-; Gene=SeqID_74408
tttctctaaaattaataatttattattaaataatttaaaaaaagaaaaaaaccgccctctttttttaaagaatgaatttaactatattcaggaaagatg

SEQ ID NO: 115452 - DNA, 110 bp, Heterodera glycines; identical to SEQ ID NO: 99093
  Promoter: Source sequence=SeqID_37940; Location=511..620; Strand=-; Gene=SeqID_66909

SEQ ID NO: 115453 - DNA, 400 bp, Heterodera glycines
  Promoter: Source sequence=SeqID_24200; Location=444..843; Strand=-; Gene=SeqID_54913
atttaaatgctgttgaaatggatttataaaaaaggcgtttattgcggtcgttgatggtcgtggccacttactccccccccggctctattgcagttcacatgaccataaaattgacaactttgatacataataaatttttctatagaatcatgcatattaatattggccatttcgaatccctgaccccccgaattcgaacaaaaattgaaaactcaaaattctcacttgtcactcgaaaagcccattttttcgtgtcacatttcgaatcatgtttagggccggggaatgggcgggtgggtggggggggggggcggggctatcatcaaaatttaaattcgtccacttcttctgcccaaccgagagccgcatcaatttttgttgttaatcggggtcaaaaatg

SEQ ID NO: 115454 - DNA, 763 bp, Heterodera glycines
  Promoter: Source sequence=SeqID_34787; Location=1..763; Strand=+; Gene=SeqID_64492
ataaaattgctgcttcattttattttgtttcttttaggtataaaaaaaggtattaattaaaaataggaaattttttggaaaatggagcctatgagactgaaaggagttaaagcctctgtttttggtctgtgaaatttctggcattcatttgaggtcttggccttgaatttcgtacaaattatgaaattaagtaaaattgcattcaaaacaaaaatccttttcaaggtggtaattcgaaaattatttggacaatataaagcaaaaaatttaaaaaaacatcgaaaattcttttttctttaatttttttttacttaataagaaaaaggtatgacacaataaattcgtttagagagaatttaactcataaaaatgtaagaaaaatttttgagaattattaggctaaagcgaaaacaattcatcaaatgcacatttatggaaaaaaattttctgcccggagaaattcatttacaaaattaaaaacgctttttgctgtaaaaatagtgaattcagtcagtcatcagtgtcattggcagcagtcatcagttgtcacacataaacataaataaccaaaagtgatgatgatgatgatgggtgaaaaatgaatgttcatatgtacatacaaaaaaccaaaattgtatagtttggtcagggatgggatccgtccttgaatggcaaggacgtccttgaaattgggccctctttcttgaaaataaaaaatgtaaattttaaatgtccttgaatttcatgaattttccccactatg

SEQ ID NO: 115455 - DNA, 546 bp, Heterodera glycines
  Promoter: Source sequence=SeqID_7878; Location=1..546; Strand=+; Gene= SeqID_66254
tggtgctaggtcgtttcgtaaaaagtgccactatgggcgtttcgtaaaagtgccaggtcgtttcgtaaaagtgccaggtcgtttcgtaaaagtgccaagtcgtttcgtaaaagtgccaccttgggacttttcgtaaaagtgccactgtggtcgtttcgtaaaagtgccattataaaaatatggttgagtatagagttatgaattcaaaaaaaatttaaaggtgccaattcaaaagtgccatcacaaaccaaaactttacagtggctatttttgggctccaagtacatataagtttattatttatttagtaatcagaacgccaaaactttgcaaaacttaaaatttttttgggattttcccttgtaaaaaatagaaatagccgatctcgaattaaaaagcattttggtaaataaacaaagcattatcctataaatggagtaaaaatatgagcctgtgcaaaatttgaaaaaaatctgaccctttggtctattattgaaaaagttataagctaaaaaaaattcataaaatcaagggtaaaataaaatg

SEQ ID NO: 115456 - DNA, 1003 bp, Heterodera glycines
  Promoter: Source sequence=SeqID_412; Location=4705..5707; Strand=-; Gene=SeqID_51753
tgagcacaaaatttaaaaaaaatgaaaattagggacaatcattcttcaggattgccgcctgggtaaaaagaggacatacattaagttaaataaatggtttcattttggatttatattataggtccgtctcatttttcttctttcttcactattaataatcatacacaataggcgatagataatgaatgcattcattaaatttaaaaaatataactacctaattaaatttttctctttaaatttcatcaatatttttttaattaatttattattttttatattcattttattatatttaatttgatattttaaattttggcgatatgatatagtcgtaaatggtcattgtcgaaacggcattgtcgaaaaggtattgtcgaaacggtcattgtcgaaatgtccagccaccttagccacaaaatgtcggtccgcaaatgtcggctaaccatttatttccattttcccaatgactttattttattttacataaataggtatgtgtagcatccaatcatcaacacataaacaaagattaaagattttgacattgccgatgagtgagtgatccatccgcccccccccccccccgccattctttttgcatttatttccattttcccatttcgttgttctcctccgtcccccgagcaattaattacgaatgatcagaaatgatttttgctttagaataatttaattagcataaatatattatgaaaacaaaatcaaatcatcatttaaataattttttattcacaaattatttttaattgcaaaataccgtatttcctgaattacaactccccttttgaggggggttgaaaaatagaacccccgggggtactaattcaggaaatacggtaaattaaatacgttatttcaaatttaaaccaaaatacaaaaatttcactgatccgtttgcctaatgaagcttacttaggccttgtgcccccccccccccccatttaggttttgttttcgtatttgataatttttggcaatg

SEQ ID NO: 115457 - DNA, 206 bp, Heterodera glycines
  Promoter: Source sequence=SeqID_20865; Location=1..206; Strand=+; Gene=SeqID_51450
cggggacctctagagtttacactgaatttgcatatggcattgaaagccgtggacccatgcaaatgtggcactgatggaaggccaaaaaatgccaggattaatcagatttaaggacgaggcactttattttgagcaaatgaacaaatggaacagctggctgactggctctgctgaggactctgttgaggaagaattgtcgaacaatg

SEQ ID NO: 115458 - DNA, 165 bp, Heterodera glycines
  Promoter: Source sequence=SeqID_11457; Location=1080..1244; Strand=-; Gene=SeqID_74855
cctgtaaaatacaaaaaaatttcgttgagtttcaaagaagttgtggtcaaaaaggtttaccaaatcaattttatgaaatttacaagccgcaacttttttgaaacacaaccaaattttttgaaattttaaaggcaaatagaggacactcagggctatcaaaagatg

SEQ ID NO: 115459 - DNA, 478 bp, Heterodera glycines
  Promoter: Source sequence=SeqID_19046; Location=1805..2282; Strand=-; Gene=SeqID_83787
tgagaatgaaaaagtgattaaaaacgcggagaaacccttcaagtgcttgacaatggtaaccaagggaataaattaaaatctgaaaccccaaaagtcaaaactaaaccagtagaaattaataaaaaccaaaaaaaatatgtaaataaaacaaaaacaaaacaagaaacacctaccccaactcagcaaaatatgataccaaaaacccaaaccacgcaaatccctctccacaaaaagattttaacaacaacaagcccgagagttgtatttacaataaataagggtaccgtcgaaaagacaacgcacaatcagagtacgacgttggaattaaatcaagtttcaccaaaattggccacaaacaatgaaatgaagggacagaaaaacgccaaagggaaagtcgaatcaatcaaaaaaagagcctaaaaacacagaaaatgacaccttgacagaaaacaaacagaacaaacatttggaaaaaatg

SEQ ID NO: 115460 - DNA, 988 bp, Heterodera glycines
  Promoter: Source sequence=SeqID_30059; Location=345..1332; Strand=-; Gene=SeqID_60510
attacagacatataagtatgaatcagacaaattatttaggtcaaagagattattatttttgttggatgatttatgtcaataatttcgtttgcaattttgatgatttttaaagaaatgttgaaaattgtcaatttatgtgtttatcggaatataaaaaacaaagaaataaaataataatttgtcaacttcaaaacaaaaataaagattataaataaattatttctaattttcatccttcaaatttcactcataacaccttttgaactcactgaatcaccttgatcatatcactccttcatgtgatcgggagtgatccgaatttctgcaccccaaggggaattgggtcctcaattctccaacatagtaaaactgcacccaattaatagaacatcatgcacagacattctacaatcgttttgatttgaaaaaatcagagaaataagctttataataaaaaagtcaaataaataaaataaaattttagctatgaaaaaacgccgttttggcgcatttaacaaatgcttaaactgaatacatatttagccaattcccagaagttctgcgtagcctctcattctcttattgaattttggcatttgacaacattatttttgtcactattttaaaatttaataaacaaatgcccactttctgtggatccgactttaattgttgaattgagaaagagatcagtctgtacctcaatttgaagtgccacgtaaacatttcgccatttatttgttcacctacgattatttaggacggaaatccattatcaaaatgaaaattcaaaaaaacagcacgatttttaaattatgaaaaacgtcaaattggagagtttgatgtttgaacagaagacaggggcaaaaatgaagcaaaaagtgtccgatcatttagaaaacggagtataaaaggcgagggaaaagagaaaaccgtacaaaggcataattaattaattaatttaattggcttttttctctcttaaatg

SEQ ID NO: 115461 - DNA, 1003 bp, Heterodera glycines
  Promoter: Source sequence=SeqID_38726; Location=115..1117; Strand=+; Gene=SeqID_67451
acgcgacttttttttgaaacccaaacctattgcgggttgcgcgactttttttgactgcgcgactttatgcaaattattttattaatttaaattaattttaaattaaattttaaacatcttaaaggtcaaaacatcttaagaacatgaatttaaattcatttaaaattcatcaaaaattccccgcaccaagcggatccgaaccccagggggggcggccagactgacgcactaaccactcggccacattggcaatggatgataaacattaatttgctctcataaagggaaaatttgacgtcaccagcgggggcagggggggggcgagagcgagcagcgagagaggggaggggggtcaaataaacaaatcaattattgaattcacaattttctcttttaaaagcaaaaagaaatgggggaccgtataataaaatataatttagaaattaaaataatttaaaggttaattaattaattattttcctaaaataaattttttttattacttctaaaataatataaatatttttcagtgaattaacaaatacatttaagtttaattattgatttgtctgttaattttttatctcctcaaaaataattacagcaccctttcaggtgttgggcgtttgtttatttgaccaataatttttaatttcacatctttacgttgcccctccctcacacctgctcatttgtgtaatttgacaccgtttcttttatcttttcgttaaaaattaaaaagattgtctggaatttgtcttgcgccacaccgctgtgccattcatttatgtaatttgacaccagtctgataataatttcgccaaaatttatttattatttgtccatttattacgaattattttgcatctatcactccaaattttgttaaaaaaaattttttattgtcccaattttgaccattttgtgttttttcaacaaaataaatatttgttcaaatttaaagaattaatttttaaaattttagacacaaaaacaaatcatg

SEQ ID NO: 115462 - DNA, 669 bp, Heterodera glycines
  Promoter: Source sequence=SeqID_25189; Location=381..1049; Strand=+; Gene=SeqID_55927
agaaattataagatgatcgagagggggagggagtacataaacatttttcgggatgaagagggggaggggattcgcgaaatgaacacattacaaaaaaaacaaaaaaaaaaacaaaaaacgaaaatgtcacaaaaatattgtttatacgatgagtgaattttttggtaggcatttttatcattattattaggcaatacacaaaacattttctgcttcgttaattaattaatgatttaatattttaaattaaataaatgctgttaataattatttttattattattttataattaaaaaaattcctttgttgggaatttgtcattttgatgtttttaaatttcaatgctcatggcgccaatcacaaaatgttttttgcttaattaattaattaatgctttaatattttaaatgtattaattaatgaaaataaatgttttaattaaaataaaattgttttaattaaataaatgtttaaaaaaattcctttgttggagttcttatttaaatgtttaaattttaatgttgatgaataaattaaaaaaaaattaatagaattaatgtcaattatttttttaaatttatttaaaattttaaattatccccccccccccccccgctcatccaattgtttatcgtttttaaaattttttctccatgttttaaagaatg

SEQ ID NO: 115463 - DNA, 859 bp, Heterodera glycines
  Promoter: Source sequence=SeqID_5782; Location=1..859; Strand=+; Gene= SeqID_59199
taaaacgctcgtcagactgcttcctccgccctccgtcttgccccactacttgctccgccttcgcatgctcgccaaggcgggcgccgcgcgcactcaaaaagggatttttatgcgttttaaggctttgggcggttcagtcccacagccccattttgcacttcagccccgggtcggtaactctgttcagaattgtgaccgcgccttaaaaatggtaccattcgacttctctcgcagagaggaatcgattgatatatacataattcgtatgcaaaatcaaagttggcagtattctgaacttttaccagtttttttcttactattatattataaaaaaaactattgggttggttatggctttggaccgataaagtgcattcgaatcttttatgtttctttgtgtttatcaccatttcttcgttgcctttaggtttcaattgggttcgaccacagacgccgcttctccgaccgttcgtcaaccaccccaacttctttcaaggttctaatatcgcattatcatttaaatgaaattttaccaaatccgaaattattcagtcaaataacagagaattaagttatcagaagctaaatatgagaaaaaccctgagaatacgacgtttaaatgaaaaatttaaaaaaaacaaatgtcgcttaattgacagtggcttttttaacagttttaatcattgaaaatttttaattttaaactaaaacttggttataagcattaggaatctgtgaattcttgataatttataattgtttgcttttatagggattggagcgcaagcccaacaattcatggggggacacaatggaggtcagggttttccggataagctcattttgtttacttaacatg

SEQ ID NO: 115464 - DNA, 93 bp, Heterodera glycines
  Promoter: Source sequence=SeqID_37039; Location=435..527; Strand=-; Gene=SeqID_66221
ttttctttttttaaggttttacaaaatttacatttttttttcgcctcctactaacaatgggttccagcagcagcagtagttcaacaagtaatg

SEQ ID NO: 115465 - DNA, 61 bp, Heterodera glycines
  Promoter: Source sequence=SeqID_10833; Location=2431..2491; Strand=-; Gene=SeqID_74106
ggtagaccagcagaaaagagtcccacaaacaaaaactaatttgacaatttgaattcagatg

SEQ ID NO: 115466 - DNA, 322 bp, Heterodera glycines
  Promoter: Source sequence=SeqID_41452; Location=1..322; Strand=+; Gene=SeqID_69567
ttttctgtcataaaaatagctcatgacaggatggagttacgcggccctaaaaaactagaattaaaaattcgtgcacttaaaaaatttggaattcggaagtcagaattccggtagtcaagcaaagtgatttacgagcccaaaaatttatggaaggttgggcgtgaaattttttttatttccaaaaactttaaatgcaaaaaattgagaaatttaaatttacctaaattttcaagtttttctaaatcttttatttggtaagatctgtaaacaactttattaaaaaaaattttgccgcacttattctacaaaaaaaaaacaaatg

SEQ ID NO: 115467 - DNA, 405 bp, Heterodera glycines
  Promoter: Source sequence=SeqID_13222; Location=1159..1563; Strand=-; Gene=SeqID_77049
tcatattcgtgatctctgtctccgataacccccgggtggaaagaagaaccgtagaaaaacagcctttttattctttttttatgggaccagtaaaagtcagtattacccaattcattagtcatttcctaattactttgaccattcatcagccctttttgcgcgttggccccttctgtcgcccctctgtttcgtgccgttctccgtcctttctctcctcgccctctcccttttggttggtctccaattcgcctttatgtttctcgttctccatttgttcgtcgtccttttctgtccgttgcttttcattcgaatgcaaagcctaaaaaggtggtgactgaccatctctgaagtgattggaaaatcattgtacacaaattttattttcagcacaatccatggcccatg

SEQ ID NO: 115468 - DNA, 1003 bp, Heterodera glycines
  Promoter: Source sequence=SeqID_2199; Location=1738..2740; Strand=-; Gene=SeqID_78461
acacaattttggctgcattaattaagctagtaataatctcccaattttttatatctgttcaaacaaattttactaaaaattccaattttatagtttagtttttatggttaaaaaatgaattcaaaatggataataatcacgtgcaaatgaagccaattaaaatttattggaagaaaatgtttgcaaatcctacggtaaacgtcaataatgcaccgattattaatatgtatgccatttgtacaagagaaataattaaactcattgctaattcattaatttagtataaaatttctagtatgtaaaaatataattaaataaaaatattaggaactcgaaagtccgattcgaaaagcctttcttagatttcacttattatttaattaaaatattcaaaactcgaaagaatggaatttataggggggggggaagtcctataatagtggcttaaataggggcgaaaatgatgaaaaggggagttaaattttaaaaaagcatgctttattcaaagaaaactaaatgggaaaattgtgtaccgacacttgcgccgtcccacaaaatccatttgcgccattcatttcaaaataagattttaaaataatataaaaaattttatttaaatcaaactcatatgttttaatttgaaaattaaatccattcttcgtaacctttcatgccaagataattttgtaaatgcatgaatgtggcttattattattataatcttcattatctttgttttccttggcatcggatttgccgttgctgctgatttacgcatttacaaaaacaaaaattagatgtctatctttgattccttttttctttttccgttcctttgattagcttttttttgtttgttatttcacaataaacggcgctaatgcccgcggcgcaaaagttgcaacacggaacaaatagcttaattcacttcttgcatttgaatcattaaatttatgctatccttagtgttttgtattatatttcagagacaaaatgtaaaatg

SEQ ID NO: 115469 - DNA, 1003 bp, Heterodera glycines
  Promoter: Source sequence=SeqID_21; Location=3419..4421; Strand=-; Gene=SeqID_78595
ttgctaaaaactgccaaaatagttgctaaaaaaagttgccaacaattggaaaaacatgtcaataaatatgtgaattttccaaaattttttcatctttgtccttttcggttgcacaattgtaaatcaaatacatttgaagattttcaagcgtaaaaagttttcgatcgtccgccaaatcatggccaggatttttgctttttgaaaaatcaattcttaggggtgcattttttgaaaaaatttatgtggattcttaggggtatatattttttaaattttttttattattgcattttcataataatttgaaaaaatagtttttttttaaattcacaagtcaaaagagttattaaaaagtttcataagcgaaaattctgtagttgaaaatagttgctaaaaaggcgctatatatcgaaaagtgttcgaagaaaatttgttttttgcgcttatcagttgggactggatttgtatggatttccatttttttttttgcctacaaaccacgtaaatagtgtttttagctttgtttgatgcttctaggatcctgttttacttccatatttttccatatttcagatttttgtccatatttccatatttgacaatgtgttggactcataaagtttaatagagttaaaacatttgttttaattaacccttattttcctaaataccaatattttaagtgaagaaatattgtaaattttcaactttcaacttcaaacgtcaaaaatcattgccagaaaatgaggaaggagaacaacaaaagcagtgccgcctcagcagattctgatgccaatgccaaaagtggtggcgatgcttctctcaccgcccccactgaagaggaggcggaagaaatcagtttaattacttataatacgtttggcttcactaaaaattctttctttaaattaaattgtcaaaaatatttggaaaaataaatgtaacgctaatccctttcttcgagcaaatttgcacctaattaatttatttacatatagatatg

SEQ ID NO: 115470 - DNA, 105 bp, Heterodera glycines
  Promoter: Source sequence=SeqID_10863; Location=249..353; Strand=+; Gene=SeqID_74143
actgaaaattagccaatttataggtaaaattttgaaaaattttatgggaatttaatccaattcttaggggtgtaaaagtcgctttacgcgccaaaaagcgaaatg

SEQ ID NO: 115471 - DNA, 607 bp, Heterodera glycines
  Promoter: Source sequence=SeqID_21050; Location=247..853; Strand=-; Gene=SeqID_51637
ttcctaatgaatataggtgaacgaaaaattcaggaaattatattttagtttttcaatatttaaaactttttgaaaaaactattaatttttgagaaaaatcagttaagattttcgataataaaaatgaaaaatgcttttttattgctttatttcattatttttattgtatgtttttaatcagttttagactgaacataattttgcaccgattttggcattttttaggacatttgcaaaattttcgtaaatcccttaacaaaaacacaatgaaaatgaaaacatactgataaatatagacttaaataaatttagaaaatttgattacctctacgaaaatgagaaaattttctcaaaaattaatgcataaaatttattcatgaccaattttgattttaaatattggaaatttataattatatattttattttcaaattaaatacaaaattttttgttcatttttgtgatttttcatgcaaaaaaatctccttctctgttcattataatggattgaaaagttaccgtattgataacaaattaagatttttatttaaatattttttaatttaccatccacagtaatgttcagccatttcacattcatttatg

SEQ ID NO: 115472 - DNA, 396 bp, Heterodera glycines
  Promoter: Source sequence=SeqID_31095; Location=230..625; Strand=-; Gene=SeqID_61476
tctgcaaaaaaaataaaacaaaatgccaaaataattatttaaaaacatattttctatctcggaaccattttcacattccatgaattttgttagccttgaaaaagaaattttttttcaatcattctcaaaattggtttaaaaaccaatttaaaaaatagaatagtacgattatttgtgtcgaaaatattgaaatttgatttgtttaaaaaaaaaaaaaaaaataaaatttaaccaaaaaaaaattcctaaattgataataattttataaaaattatttttttgtgaaattttcaccaaaaatcctaaatgaataaagctaaatttttgctattttaaaaaataacaaatatttattttttgccctcctcctccacctggagcgtggtcaacggcatg

SEQ ID NO: 115473 - DNA, 110 bp, Heterodera glycines; identical to SEQ ID NO: 99093
  Promoter: Source sequence=SeqID_32108; Location=913..1022; Strand=+; Gene=SeqID_62433

SEQ ID NO: 115474 - DNA, 297 bp, Heterodera glycines
  Promoter: Source sequence=SeqID_14898; Location=1018..1314; Strand=-; Gene=SeqID_79061
gctgaaaatataatatttaatacgtttttgattaaatagaatgtaaaaacaactgttttgaagcagtttcgcaaaatgttctggttttcgaccccaaaatctgatttttgaaactcgaaaaccaagaaacttgttttatgacaataaaattttcactgaagcattttacactgacgcattttccggcgccgttaaatttccgcttgcagttgaccaaccgcccgaaatcgtggagacgaggatgagtcgtttcgcggttgacttttccttttacgttgccattgcgatgggccaatg

SEQ ID NO: 115475 - DNA, 325 bp, Heterodera glycines
  Promoter: Source sequence=SeqID_29336; Location=533..857; Strand=+; Gene=SeqID_59848
agaaagagtaagtccgtggaaatgaatggttaagtatgagtgtgaggcccggggacggtccctaaggggtattggaggagagtagaccgttaagccgtgttcaaaaacttttggcagtgggctatagcccaatacgtattttgaggtctcctgcgttgtctttcttttctcaaaatcttatttttgtccactattgtacctaactgtcttcttccgctttattttctattgtaaaataatacatttaacttttcttaatatgaaataatgactagtgagctacggcccaaaagtattaaaaatgacgtcaaatatttcagcaatg

SEQ ID NO: 115476 - DNA, 313 bp, Heterodera glycines
  Promoter: Source sequence=SeqID_45563; Location=1..313; Strand=+; Gene=SeqID_72836
aaatatttaatttgtttattttagtcggcgttcgatcaaaattttttcagatcagagcagaatttttttagataaacttttgtggtcaaaatcagaaaaaaacactacaaaaaaggagcgtaaggtgatttcaaaggacataaggagacaatttttgaatttaaaggacttttcaaaagggagccggaaaatgcgacaccgagagaaagtttttcatttcaagaaaatgcgacaccaagaaaatactacatcaaacttagatttttaaaaatataaatttgtgtttttttttgaatttaaagtcttgaaaatg

SEQ ID NO: 115477 - DNA, 111 bp, Heterodera glycines
  Promoter: Source sequence=SeqID_26356; Location=120..230; Strand=+; Gene=SeqID_57097
ggtaccaaagcatccttctcattaaaattcacttttcttccctaggctcccgatgtctcgtggaacaagccgttcaaggagcgaattcggcatttctacaacacttggatg

SEQ ID NO: 115478 - DNA, 235 bp, Heterodera glycines
  Promoter: Source sequence=SeqID_32062; Location=1696..1930; Strand=-; Gene=SeqID_62378
ggtgaattaaattaaataatcttttgaatttccgcttctcaaaaggtcatttacggcattttcaaccgcgactttcggagggcgttcagccgaataatggcgaatttgctgaactgtctgagagaggaaagtttcagtccgaaagggtcggccaagagaaaaagtacgaacaacaacaacatcattaacaataacaacaactacagcagcagtgaaataaacaacgcagaaaatg

SEQ ID NO: 115479 - DNA, 153 bp, Heterodera glycines
  Promoter: Source sequence=SeqID_7378; Location=1..153; Strand=+; Gene= SeqID_64655
agaataaactgaaaaatttttaaattaccatcattttttcgcatgcttttttataataaatattaaatgttcatgttgtttttagtgaaaggttttgaccccaaatatttaatcaattttaatttattatttttggtagaattccagaaaatg

SEQ ID NO: 115480 - DNA, 78 bp, Heterodera glycines
  misc_feature (9)..(9): n is a, c, g, or t
  Promoter: Source sequence=SeqID_15166; Location=1..78; Strand=+; Gene= SeqID_79364
ataaatttntttttacagtagtaatagaattaggataaaaaagcgttcagtgattttctagcaattaccagaaggatg

SEQ ID NO: 115481 - DNA, 159 bp, Heterodera glycines
  Promoter: Source sequence=SeqID_25511; Location=471..629; Strand=-; Gene=SeqID_56253
actgaaaaaattgcaaatttttattaacactaattaactaatcagcgtttaatgattatgtaagccctatctgcttaaaaattgaaaatttttaaaattcaaaaaaaagttagggcttgtggttatggtaatcagaaattgtcatgggtcttaaaaatg

SEQ ID NO: 115482 - DNA, 383 bp, Heterodera glycines
  misc_feature (54)..(55): n is a, c, g, or t
  misc_feature (58)..(58): n is a, c, g, or t
  misc_feature (61)..(63): n is a, c, g, or t
  misc_feature (67)..(67): n is a, c, g, or t
  Promoter: Source sequence=SeqID_23287; Location=1..383; Strand=+; Gene=SeqID_53998
ttgaaatactttttttaatttgtattttttgtcttcattttggggtgcgatagnncgnaannnaggngaaacaaacatcatagataaagagaggaaccccgaaaagcgcccgaaacaagcgccacaaaaagggcccaaacgccacaaaagaaccaagacggggcagaggaaagcaccaaacgaatgaaacaaacaaacaggggaccccaagaaacagcgaacatcgcgagggaggccgagaacatttggtgcaagactatctgcgtgactctgatggtgtgtcactgcgtctgagcatcaaccaacggttgcccgttgttggcgacctgtacacaaaactggtcgagtacgaccgcactcagttggcgctgatgttcgccatg

SEQ ID NO: 115483 - DNA, 295 bp, Heterodera glycines
  Promoter: Source sequence=SeqID_29508; Location=1..295; Strand=+; Gene=SeqID_59999
atcatcagcaaaattgatcaatcatcacatcaaagcattttttaattcaccgcaaaggaataataaaaattaatcagcttttaagacaaaaaaaaaagcgaaaaaaagaaattagcagaaagacagaaaaagagaaattgtaaagattttgaaactttttaaagatacttaactaattggcattatgtcctgatgattctttttttcttttgcttttgcattttttcagatcagaatttgtttttcctcctccttattttaatttgttttaagaatcaaacatttgctacaaatg

SEQ ID NO: 115484 - DNA, 131 bp, Heterodera glycines
  Promoter: Source sequence=SeqID_823; Location=2079..2209; Strand=+; Gene=SeqID_62115
attgattattttattataccacggcgcacgttgcgcgcgctgttggtgctgcgcatatatacagcgagctcacgcgggaaaggctcacttttttcgcaaaaataaattaaatatattaataaataataatg

SEQ ID NO: 115485 - DNA, 98 bp, Heterodera glycines
  Promoter: Source sequence=SeqID_8860; Location=824..921; Strand=-; Gene=SeqID_69447
actaattaattacctattatacttactcatgttaaatatatttaataatatttttgatttaattttttgctttttagcaaatttggaaagagcaaatg

SEQ ID NO: 115486 - DNA, 179 bp, Heterodera glycines
  Promoter: Source sequence=SeqID_30521; Location=929..1107; Strand=-; Gene=SeqID_60935
ttttattttttaaaaaaattttttattttttaatagattatcccagaaaaaaggctattttttttttttgagaatttttttatccaccaaacgcttttgaacatgaaacgaagtgcggtgcgccatggccttttatttttcaaataatttttatttttaatagatattccagaaaaatg

SEQ ID NO: 115487 - DNA, 431 bp, Heterodera glycines
  Promoter: Source sequence=SeqID_256; Location=2671..3101; Strand=+; Gene=SeqID_79947
gcatatttatttttaaaaataaaaataatttttgcaaaaggttgccctcccgtggtgtatttgctgctgaacaaacgaattcggaatgattgtgccaacttttgccgtgccattttacgttttttgcgcaatgacaataattcggtgtcaaacggaccaattgccatggcatggatggcaccaaattatgtcagaaacaatgccaacaacagaaacaataacaacaataatgtgcaacagcaatgctgactttttaccgattaaaaaatcaccaatttttgtgttactgtatatttttagtgtatattttttttgatgccatctttttacgtccttttattccttggaaataaattttgagtcacttttttggtggaaaattagaattatgtttgcttggaactcgttgttcccggtttttgggcaaaatg

SEQ ID NO: 115488 - DNA, 435 bp, Heterodera glycines
  Promoter: Source sequence=SeqID_39145; Location=674..1108; Strand=-; Gene=SeqID_67784
ttttcctaacttttctccttttcacttcgcttgccattcaatttccaaaaacgtacatttgcgccgcacagcgaaaccggatatttgtgccgttaacaaaaatggatatttgctccacctagaaaaaatggacatttaagccacctagcaaaaatggacatttgcgcaccgctgcgaaaatggacatttaagccacctagcaaaaatggatatttgcgccacctagaaaaatacactgttaagaatgggggtcaggaaaaagttgaccaaaattgagggaaagataaatagattaaaatttttaatggtaatttacaaatttgtacgttttttattaatttatgaaaatttaaaatttaattgtggattttttaattatcattaatatttggaaatactttgaaaaatttgctgacgaagtttaattgtaaaatg

SEQ ID NO: 115489 - DNA, 82 bp, Heterodera glycines
  Promoter: Source sequence=SeqID_44843; Location=1237..1318; Strand=-; Gene=SeqID_72260
attcatttacagtgatatttttctataataaatccgtttttatgtaattaattttttttgacttgttttcttagttactatg

SEQ ID NO: 115490 - DNA, 1003 bp, Heterodera glycines
  Promoter: Source sequence=SeqID_20368; Location=161..1163; Strand=+; Gene=SeqID_50886
cttcgtgatcgtttcgtccatctttaaccgtttcagttgccctaaactcgcgcaaaaaagcccagaaggctgtttctatgcctcaaaacataaaaaattacaaaaaaaacttcattttgatcacgttaaaaatttcgacattttgaccgacttgtcgacactttgtcccactactcccaaacattgttagacctgtcaaaacattgtttaacccatttaaaaacaaatatcaagctctacgcactcaattacccccaaaatcccccactcactgcgaaaagccgacttttttgaccaaatttttagacaaatgaccaactcaactttgggctagggactcaaattttttaaaagaaccgcctcgaaatgctctaaccaaaaaccacctcgcccattacccacggcaacttaaaagccgctacgggcgcaaaaaaaagatgcaactctaaaaaaattcggaaaaattccctttttgaccagtttttcggacaaatgacctacttaactttgagctaggggtccaaaatttttttttaaatgtgactaggtgagctctacaataatatacaatagcgcctgagctaacatttcgctaaagcacacccgcccgagtctaactttttgagaccccttcctggccaggggctaaaggggggtcaccccttcaacttagtgctggcgcacaattttttttttttaaagaccaaaacgattccatattttcttaacttttcattaaaaattccaattttttatgcataccggaagcaagaaaattacatatttttgccattttggggtcattttcagaagttctttaacaaaaaattcaatagaaaaaatttttttttgacgcgatgacattttttggcgacatgttcaacatattcaaaaaattttccactaaataaatcaaccgaaaaataatctcccagtctccattagtctgccagtctccaattatatacccccttctgagaaggttgaaaaataatataccatg

SEQ ID NO: 115491 - DNA, 92 bp, Heterodera glycines
  Promoter: Source sequence=SeqID_31410; Location=787..878; Strand=-; Gene=SeqID_61763
tctaaatgatttaattgattaattcattttttaattgatcatttctttaaacttacactaatgatttgttgtgccccattttggtcccaatg

SEQ ID NO: 115492 - DNA, 95 bp, Heterodera glycines
  Promoter: Source sequence=SeqID_10944; Location=2682..2776; Strand=-; Gene=SeqID_46914
agttactccgtatgattgtttttatcttttctaatttgaacctgggctaattttaaaccagtattgcttgaccaaatccaggttgccgaaaaatg

SEQ ID NO: 115493 - DNA, 246 bp, Heterodera glycines
  Promoter: Source sequence=SeqID_15381; Location=452..697; Strand=+; Gene=SeqID_79637
aaacaaaaagttctgttcttttcaaggccactgaaaaatgcctccaaataattgccttctcccaccccagttcttagtcccccaccctattaattacccctttaattaattgttctctttccgctttctttttaattgccccccttttctgttaattaaggtgcgcccgagtcggaagtgcacaaatatttcggcactttgctcaaatcgatcgcaagtggacagaacagcaacactttggagatg

SEQ ID NO: 115494 - DNA, 311 bp, Heterodera glycines
  Promoter: Source sequence=SeqID_273; Location=1..311; Strand=+; Gene =SeqID_80988
caggaaaatttatgatgaagctgatgacaaaaaaacaatcatttggccattacaatttgccaaaaatggcgctaatttaaaatggaaacaaatgcgtaaaatgtgtgctaattgcacatttgtttcccagctttagcgccatggtgaaatttatacaaaaaaaaaacaggttggccaattggtcattgaacaaatttttgttgtttgattttaggcggggaaaaaattttatttatggaaatttgtaatctcaaaaaattatggcttttaaaattttctaaaatgcagagggtgagtcagggccaaaaatg

SEQ ID NO: 115495 - DNA, 249 bp, Heterodera glycines
  Promoter: Source sequence=SeqID_27503; Location=1..249; Strand=+; Gene=SeqID_58194
gggtcaggggttcggaatcggttgaaatggatgtcggatttgtgatcagtgtttccgaaaacctctagaaacatgtttttatgattttttgaaagttgaaaaaaattcataaaaaagggggggtaccatctaaactattaccgatatcaatacaaaatatgaaaaaattaaaatgctatttaaagattttcgtaaaattttcttgtttagttttgcctttcatcaaattgatgttaaaaatttcagatg

SEQ ID NO: 115496 - DNA, 666 bp, Heterodera glycines
  Promoter: Source sequence=SeqID_6097; Location=204..869; Strand=+; Gene=SeqID_60327
atcacggcttcaagaaggagggacgaatgtggtgttgagagaccaatcaataagtggagtgaactttgttcactcctttcccttaggcactgttcctccccacatataagcgatgctttccttccctccctcgttcattctgtcatttatttctcccattgcaattctcttcgccttgaccattttattattatatttgtgtttcaaataaatatttgttttattcatatctgttgttctcggacacaacacatttcatttaaaaatcagttaaatattgatatatttttcagaaaaaaaacccattgtaacttctcctttgttaaataaatatatttgatcaaaaatcagttaaatattgacatatttaatatatcttttttcaaaaaatatcatttacccctttgctttatccaaacatatgaattaatatgatcaatagaataaaaatatttcattcaataagtaaccgcccaagaaatcactcacactccaaaaataatagagaaggcttatatatatattggaatttgcttctaggctttattcatttagacatacatacatttagcagtttgcaaatagtattttttgaattctaaataaatctaataaaaaatagaaattcatttacattttttagcaattttaaaaatttcattaatg

SEQ ID NO: 115497 - DNA, 142 bp, Heterodera glycines
  Promoter: Source sequence=SeqID_3669; Location=470..611; Strand=+; Gene=SeqID_51371
agcattcttacatcagtttcttattaattaggttcgtacctttgatgactactttcggtttcttcgaggcgttcggattccaactcctgcaagaagcccaacacctataaaaatttttgatgaatcatgcccggaaataatg

SEQ ID NO: 115498 - DNA, 260 bp, Heterodera glycines
  Promoter: Source sequence=SeqID_2884; Location=3189..3448; Strand=-; Gene=SeqID_82174
ttttgatttatatacgattcttcctgatgcttgccatcaggagtagaaattaaattatatgctgatgatgttaaatttcaaatttgtcattctttcaatttgtcattctttcaaatttgtcattctttcaaatttgtcattctttcaaatttgtcattctttcaaatttgtcattctttcaaatttgtcattctttcaaatttgtcattctttcaaatttgtcattctttcaaatttgtcattctttcaaatttgtcatg

SEQ ID NO: 115499 - DNA, 1003 bp, Heterodera glycines
  Promoter: Source sequence=SeqID_4870; Location=2438..3440; Strand=-; Gene=SeqID_56022
cttcctttagaatctcttcattctgtacactctctcgcttcctttttcatctctctctattgttttcctcttcttctctacctccttattcccaagcactcctacacactcatcacacacataaacaaactcgcacgcattcaatcctgcgtgacaaccgcacgcgttacccactctacccctcccatccgcgccgacagagaaacatacactgcactctctcttctacccatcctttctctattaatctccaattatattttttaattttctgtttctttttcctattacaacaaaacagcatttaaccgccaattcaaaaataggggcggggcttcggctgacttagtatatagttaagggattttttgtgtgggatccgcgggatcccttgcattttttgaatattaagacagaatgccaaatatttttaaataaatttaattaaatttaaacaaccgcaaaaatccaggttgccaaaaaaatggccaaaatggcctggacctgaacctggatccatgacaaaggtcgaactctagtgataacttaactgaaaaacggacatactgacaacttcgtctgaaattttaaaacaaatcctttcccttaaaactttttgtagattatttaatggcagaagaagcaattattaggaaattggtcgccgatggggatggcactggggatgaccggcgaattgtccaattattccaattgataattatgttgagcaaatcaaacgctgatacgaaaaggttggctatattcaattcaaaatttatgctctttattcctctaatttagtattactaacaaaattctaatcaacttggaccaaattgaactttctttccaaaaacaagcacagatttccgccataaccgaaattgaaattgcaaattatgaacaactttgcaccgaaattggttgttaattatgtcattttttataagttagttcgcaaatatcagatgaaatgatcacccaaaataacaacaaaatg

SEQ ID NO: 115500 - DNA, 260 bp, Heterodera glycines
  Promoter: Source sequence=SeqID_21567; Location=356..615; Strand=+; Gene=SeqID_52178
ggtaattaagaggttacgcttaatatttgtttaaaatgaaaatttaaacatgggcggcactaatattatcgttctatgaaaattcaattgaaaattgcattgagtttccagaacaattcaagctttattaaagtttagctgcttgtaatctcaggagttacgcgaattttaatagatttcgggggacacttcgaattagtaattttgttgctatagcttatgtttattgtttagtaaagtgctgtaagagacctcaaatg

SEQ ID NO: 115501 - DNA, 540 bp, Heterodera glycines
  Promoter: Source sequence=SeqID_1563; Location=820..1359; Strand=-; Gene=SeqID_74474
ggcaaaatctgtttaaaaactatctaaaatttcaaaaaaaaatttcggctgcgcctatcggcactgccggaccctaaatccttgattttcttaaaaaaatcgtccagaatcgtaaaattagacaaaacaattctttaggcaaaatctgttaacaaattgcactcaaattttcaaaattttccccgacgctgcctatcggcaacgccggacccactccctcgcccatttcccaaaagtttttttaggggaaaagtgccgcaaaaaattcataaaaatctgattttttgagcccgattccacttaaatatattatttgcttatttcctccccaaaattgttaaaatcgataatgggaggcgaaaaataattgatacatttttgataggataaattgtaaatcgcgaatgttttggttttcgaccccaaatttcactcactgactgttacatgttttttaccgtttgcgtgtttttcaatttttattcgcttaacaattgcctaacgattgcatcttctttcttcttttaagccaaaaagatg

SEQ ID NO: 115502 - DNA, 440 bp, Heterodera glycines
  Promoter: Source sequence=SeqID_20750; Location=650..1089; Strand=-; Gene=SeqID_51318
atatggtctacaaagctcaaaaatgtccaagatatggagcaaaatatggtataaaatctaccaatatatatctttgtagctataaaaaattttgtaaatgagtatttagtcaatatttgcttaaacagtcttaaaaatacaataaaatctgctaaaaatggatttagccttaataatggcagtttatttaatctagcaaaaatatcgaaatatggatttatttccgaaaacccccaaaatatggatttatatggacaaaaaactttcaccagatcaaaaaattttaatgtagaaatgctatttttgagctcctttcttcatagtatatgtgcagaaaatatgtaaatccatataattataaaccctatttattacctaaaccaaaggcaccaacaaaataaataaagcgtggaaaagaacaaaaaaccgctcccaaaatg

SEQ ID NO: 115503 - DNA, 719 bp, Heterodera glycines
  Promoter: Source sequence=SeqID_9307; Location=1293..2011; Strand=-; Gene=SeqID_70946
aggaacagttcaaattcgtgtttagctgtgttgcggaagagatctcttcacgcattaagggccttcaacagcagcaacattaaaagacatggccaaaaggagggaagaaataaaagggggagggaaccaaataaatgaccaccccgtcccctttccccgtttattgtctcaatttcacacaatggttctcttaatccgttgaagaagcgccattaacaaagccgtttgaataaaaagacatcgctaaagcccccatatagcgccataacacccacaaaatccaatctcaacatcaaattccccgtgatgatttatttaatgaattccgatggttggttgattaattgatcattcttaatgtgtttgaaatgaataaaggtgtcatgttgcaactgtgttcattttcttctaacaatgcttttcctctccaatatcggtttttgaatcggttattgcaacaaagggaaaattttcatattttgaatgaaaattttgtaatgaaaaatgttaaatttaaaattttttcgcaatttggcataatgttcttagaattttcaaaaaatgcggatctcacggaatcacgcacaaacacaaattttcgcatcccgtgcgtgaatgtatgtaatcagatttttttgcggcatgggaccccgcgggattaatcccgcaaaatccgcaatttcaaaaacaaactaaaaatttttcccatttttgaaatg

SEQ ID NO: 115504 - DNA, 74 bp, Heterodera glycines
  Promoter: Source sequence=SeqID_17805; Location=1761..1834; Strand=-; Gene=SeqID_82337
aaagcaaattgatggcttatttcgatttttttaaagaaaatcctcaggcacctaattatttgtatcctgaaatg

SEQ ID NO: 115505 - DNA, 254 bp, Heterodera glycines
  Promoter: Source sequence=SeqID_41219; Location=239..492; Strand=-; Gene=SeqID_69394
tcaaaaatcggcatatcgtacatggcgtatatctttgcacagatcacaacatgacgggttaaacactcattttctttagctaatagatatcgaacaaaaactcgaaattcatttttttaattcggttttcaaatttatgtaaggattcggaattggttgctcaggttaaatacaacaatttcagattgcgccataatttattgtatgtatcagtttctttaaaatttgagaattaataattttgtgttcaaatg

SEQ ID NO: 115506 - DNA, 309 bp, Heterodera glycines
  Promoter: Source sequence=SeqID_18324; Location=1..309; Strand=+; Gene=SeqID_82929
tttaaaatttttgattggtcttcttaagtctgttctacttacgggtttctcttcgcatttccgatgcttctcttttcgatgctttcttagaaagaattggtactcaactgaaagctcttttattggaaacagtcgatggaaaggtgccgtttaacttttgtctgtgtcgtttcacaatttttaggtttcagattctcaaaattattgccaaacattgtccaaatttagaacatatttcctttgacttcttcccgtgctctaattcatttcgagttggtgatttactacgatttatgggttgaaactatg

SEQ ID NO: 115507 - DNA, 330 bp, Heterodera glycines
  Promoter: Source sequence=SeqID_4471; Location=1850..2179; Strand=-; Gene=SeqID_54562
ataactcagtctgttgataagccattttgttatcattcgtaatggactccccgagaataaatgagcgtgaactcaaatttcccattccctccgggattgttgtcagcgggccctcctcttcgggtaagacgcagttggtccttcgcctgttggggcatgcccgcgagatgtttgatcccccgtcgaaagtgataggtaagtccccaatgccatgagtaatgagcagtccccttgggtttagtttgggcttacggtgagtactcctcgcagatccccgagctcgagaggcagggcgtagtcccgcacgctggtcctccctccgaagaaatg

SEQ ID NO: 115508 - DNA, 241 bp, Heterodera glycines; identical to SEQ ID NO: 108708
  Promoter: Source sequence=SeqID_31238; Location=1273..1513; Strand=-; Gene=SeqID_61612

SEQ ID NO: 115509 - DNA, 67 bp, Heterodera glycines
  Promoter: Source sequence=SeqID_5730; Location=1591..1657; Strand=-; Gene=SeqID_59055
tttggtaggtcattcagttcgctggccttttcgtcgtcacttttgccctccctcccttcagcagatg

SEQ ID NO: 115510 - DNA, 69 bp, Heterodera glycines
  Promoter: Source sequence=SeqID_28931; Location=852..920; Strand=-; Gene=SeqID_59500
atttagggctaattgtcgcctgtgactcgattttcgccaatttatctgatcgattatcttttgatcatg

SEQ ID NO: 115511 - DNA, 66 bp, Heterodera glycines
  Promoter: Source sequence=SeqID_823; Location=939..1004; Strand=+; Gene=SeqID_62116
aaaggcgccgatttagtgtatttctctcacatttgttacattcgctgttcaccagtaataaaaatg

SEQ ID NO: 115512 - DNA, 259 bp, Heterodera glycines
  Promoter: Source sequence=SeqID_13282; Location=255..513; Strand=+; Gene=SeqID_77122
aatgaatgtgcattttggacacattcaatgggttgccactgactgaatccaataactttgcagattgtcagtcatttacgaattttattaatctctccaatggcgttcattctcctttttctccgacatttataaacacgtggataaattaatgaatgcgcactttttgacgaacaaaagctttgctaatttgaccgaaatcatttttgcttttgattgcccatttcccatttggtttcattaaaattaaatttaaatg

SEQ ID NO: 115513 - DNA, 192 bp, Heterodera glycines
  Promoter: Source sequence=SeqID_40904; Location=1..192; Strand=+; Gene=SeqID_69137
gagtaaacagcactccccccgatccgggtacagaccccgaaaggctgccctcaagaccgagctcacgcaagctactccgagcatctcagcgccactccgcctgcaaatgccccattcgccactgaacagaaggacagcaaacccccagtctggaggctagcaggccaacgtacagcaacaaacgggtgaatg

SEQ ID NO: 115514 - DNA, 95 bp, Heterodera glycines
  misc_feature (43)..(45): n is a, c, g, or t
  misc_feature (58)..(58): n is a, c, g, or t
  Promoter: Source sequence=SeqID_24628; Location=1..95; Strand=+; Gene= SeqID_55367
gaaaaatgaaattaatgtgagacaaaagcgattttgtaattannnattcaggaattcnatgaaaagttgccaaattgggaacgggaattgaaatg

SEQ ID NO: 115515 - DNA, 298 bp, Heterodera glycines
  Promoter: Source sequence=SeqID_30790; Location=976..1273; Strand=-; Gene=SeqID_61175
aagaggtgcacttttaggctgcttgaaatcattgcgttttaatttcgacattcccttctcctgctaattcccccctcctccctttttccgttttagtgccgtccctctccccctccttcggcacattccgtcgttcctttgccctccccgtcgacgacccccgtaaagccaattttggcacgaaaattggacccgtgctgctcgccgtcctcgttgtccgtctccgccaccgttgctcctaattcggtggctgactttcgtcggcggataaacactgtcacaaacatttgcgaagatg

SEQ ID NO: 115516 - DNA, 75 bp, Heterodera glycines
  Promoter: Source sequence=SeqID_11788; Location=448..522; Strand=+; Gene=SeqID_75287
atcttttgtaataaaaaatagccctataatctaacaacaacaaaaaaagtttagtatcccgaacatttctatatg

SEQ ID NO: 115517 - DNA, 479 bp, Heterodera glycines
  Promoter: Source sequence=SeqID_36488; Location=695..1173; Strand=-; Gene=SeqID_65783
tttgttcttttgtatttaaaaagttattttgtttttggtatctttccataaagtataaataaagttttattttatttattattcattctctaataaaaatgtctgaagaaaaaataaaaaaacaaagaggacggcctcctaaagaaaaaattacaataaaaaatgaaaataattatgatgtagaaaaaacaaaaaaaacagaaacaataaaaccaagggttgaaatcagagggacaaaaatcatattatgtataaaccaagctgaaaataagacaattaaaaaaataaaactaccacctatctatataaaattctaaaattaaaaaataaatgaaaagtattttgaaaaggatacctcccgaaaggaagagatttttaaattatataaaataataaaaaatcccgaattactaaaagtacctaggcacaataaataaaaatataaaagaaatccgacaaaaaataaataaaataaaatg

SEQ ID NO: 115518 - DNA, 663 bp, Heterodera glycines
  Promoter: Source sequence=SeqID_42186; Location=1..663; Strand=+; Gene=SeqID_70138
ttctccatgattctgcttgaaattaatttccgtcccatcatttgaattgctgaacagtgtttgaattgtaacattagtggactatgaatagagaatagggatgaataaatttattggaaaaaatgaacgaaatttaacaatgttaaaaaccccaaaaaggaaaagaatcaatcgattttaatcaaatttaaattttcagtcaaataaaccacccgcaaaacaacggttgtcattcgctcgttgttggcccttaagcaagccaagataaaaaaatgattgcaaaaattaagcagaaccattggagaaaaaattaagttgaatggaaatatattatgtatagatttttgaaattattaatattaatttaaaaaaatattgctttaaaattaaatatttttactttaaaatatttaaatttaaatatttttattcacactaattgtaagaatattttcggttcgcccacactgagaccattttcggttcgtctcagcacgctctccttacactgcaatattgaggacttttttgacagattttatcaaaaaatgctttaaatttttaaacgtaaatattttttttccacgcagctaaggcaatgggttgagctgtcgttggatgagcaggtgccgccctcactggttgttgttgacccgtgccatg

SEQ ID NO: 115519 - DNA, 373 bp, Heterodera glycines
  Promoter: Source sequence=SeqID_3898; Location=2876..3248; Strand=-; Gene=SeqID_52343
ttttggtgcgatgttgttgagaatggcgctgttgttgaacgtgagcaactgtcggttttctgtaaaatgaaaaataaaataaaatcagaaaaattgcaaaaaacaaaacaaaaaaacatgcctcagaaattacgcgtgcacacaattggtggcgatggaaaaatgaatgtgaataatgaagcagggaatgagaattcgtagaaattcctttcctctttatatacacattagtttttgctggcgataatgagacaaaaattgcatataaataagcgaaatattcgctaaattttcattcccccattatttcttcaacaacaattaatctacttgccgcacaattcttcaagcacaagtgagcagcaaccaaatg

SEQ ID NO: 115520 - DNA, 566 bp, Heterodera glycines
  Promoter: Source sequence=SeqID_12239; Location=1817..2382; Strand=-; Gene=SeqID_47023
agacaaaaacttttttctaccatatattttcttttttcgaattgcgtctaaatatttccgaatgtttaatttttttagcgttctgaagcaaccaaatgcggataaagcgttgtctcgtttggccactattcaattggacattgccctccaggagaagtcgttggaccaatattttggccttttgcgtcaaaatcggtttgatgagaacacatcggtggccgaattggaacgcattgtcaaatactttcaggtgtcccattggatatgcacagatgaaaacagattcctttgtctttagcgtcttttctccgccaatttgagcactgagtcgtacaatgcgcgagatgacctgcggaacatattggtccaagtgaaggagggactcggctgggcccaattcaacactcaacgacttcgaaactttctcgttacaccacaggcaaatgcactgataaattttttcccaattttgcttttgtaaattctgacattggcagacttccgattcgacgagttcgggtacttcgtcggaattggttgcctcgacaattcattcgtctctgatg

SEQ ID NO: 115521 - DNA, 104 bp, Heterodera glycines; identical to SEQ ID NO: 98209
  Promoter: Source sequence=SeqID_21405; Location=1434..1537; Strand=-; Gene=SeqID_52016

SEQ ID NO: 115522 - DNA, 150 bp, Heterodera glycines
  Promoter: Source sequence=SeqID_4603; Location=2225..2374; Strand=-; Gene=SeqID_55056
cgttggacactttttcaacaaaatattatttttattttggaaaaattttataattttttgtcaatcctattttactaacaattgcttcgactcaattttatagtgaccatttgaattattagtttaaaaattgcagcatttgtctgtatg

SEQ ID NO: 115523 - DNA, 65 bp, Heterodera glycines
  Promoter: Source sequence=SeqID_992; Location=993..1057; Strand=-; Gene=SeqID_65598
aattatttattttaatattttatcttttacagatttattttagcttaatttttcttcctaaaatg

SEQ ID NO: 115524 - DNA, 117 bp, Heterodera glycines
  Promoter: Source sequence=SeqID_3669; Location=1..117; Strand=+; Gene= SeqID_51372
gcaaacagtgcgtttgtcaacacattatgcggccttaattttattgtttagactgttaagcgtgaattgaacaacatatttaataagcctaaccctgagcaccacatttttggcatg

SEQ ID NO: 115525 - DNA, 1003 bp, Heterodera glycines
  Promoter: Source sequence=SeqID_14318; Location=515..1517; Strand=-; Gene=SeqID_78347
ggttctctctttctctctctctcctctttctttttattcttcgttctctctccctctccccactctctctattcctcgtttctctctctccctccccattctctctatcccccttctctctctattctcccaattttctctctctccctccccactctctctattcccagttctctctctctgtccctcctctttctctccatccttcgttctctctccctccgtccactctctccatccccgtttctctctctccctccccattctctctatcccccttgtctctctattctctcaattttctctctctccgtccccactctctctattcccagttctctctctctgtccctcctctttctctccatccttcgttctctctccctccgtccactctctccatccccgtttctctctctccctccccattctctctatcccccttgtctctctattctctcaattttctctctctccgtccccactctctctattcccagttctctctctctgtccctcctctttctctccatccttcgttctctctccctccgtccactctctccatccccgtttctctctctccctccccattctctctatcccccttctctctctattctctcaattttctctctctccctccccactctctctattcccagttctctctctctccctccccactctctctattctcccagttttctctctctctctctctctctgttctctcacattcactctcttttccactctcttctcagctgctcgctctggcttctgctctttgtcatccgcagctgaattggcctgtcaggcgttgaactgcgctttcggttccgagggattgtgcaaattcaaaaccctttttctcgctgccggcgatgttccgtttgtggtgcctccgtccggcgaaggtttttcgggccttagatttggtgggcaattaattagttgctaattatgtcaaggaattgttgcgcgtttctcccgcggaatg

SEQ ID NO: 115526 - DNA, 167 bp, Heterodera glycines
  Promoter: Source sequence=SeqID_2381; Location=4694..4860; Strand=-; Gene=SeqID_79444
ttgctgccccagcgcttctttcggaagaagagatgaagggttttccgtctgttgcggttgaaaatttctccacttccgaaaaaggaaccatcaaaaaattaactgatgatttcacaatcgagtttaaccactcctccgttgccattacatcgcaactcgaaagcatg

SEQ ID NO: 115527 - DNA, 123 bp, Heterodera glycines
  Promoter: Source sequence=SeqID_13964; Location=1..123; Strand=+; Gene=SeqID_77921
ttcactcatttatgtaaaaaatattattaagtaatttattatattaaaaaaatagaaatttagcattaagaatcttcaaggaattgtaattaaaaagttgttaatattttactcataattatg

SEQ ID NO: 115528 - DNA, 71 bp, Heterodera glycines
  Promoter: Source sequence=SeqID_19365; Location=452..522; Strand=+; Gene=SeqID_84096
tttttatgacattataaagaatccataaatcctttcttcccctccccacgccatttcagctcgggccgatg

SEQ ID NO: 115529 - DNA, 1003 bp, Heterodera glycines
  Promoter: Source sequence=SeqID_9654; Location=2511..3513; Strand=+; Gene=SeqID_72208
cctgatgagcagcacaccgccacccatgaagcacaagacaacagggcatctgaaatgtctagaatcttagcaaaataatatgagaaacctcatggtctaaaatacaaattgaaattgctgccaggataaacggagctcattaactagaactaccgccctggttaacagcaaacgtggaataattgtcaaaatgtaaccaatcttggcctgaagagcagcgcaccgccacccatggagcacaagacgacagggcatctgaaatgtctcgtgagattagtaatgtatgaataatcacctcaagacctaaaaacaaaataattttgttgccaggataaacagagttcattaactagaactaccgccctggttaacaacaaaacaaaaaaaaacaattaaaaacaatatagaagcatgaaaaaatgaaggaaagtgtgtgacgcatccttttatatgcggcccgtcctcaaatataggtcaagtgttactatttatagaatatatatacaagccatatttgaatttcccgccaattttttgaatttgaatttcccgccatttttttaaatttgaatttagtgccaaaatgttttcgtttcaataaatttaagtgtattatatcatctttgcagcatatagtggacaattatcctttttctggcaagtggtctcgtggcagagtggtagtgtgttgggtttggtggcagagcaaaagttcgaatccgcttgcctgcgacttatttattgcgattttccctgggctaccgtacctctcgcagtggtgacgtcatcatctttacagcatatagtggacaattatccttttttggcaagtggtctcatggcagagtggtagtgtgttggtttggtggcagaccaaaagttcgtgtccggttgcctgcggcagaatttttcgaataaaaatttgaaaaaaaaataaaaattattatttaaaaataaaaaaataataataaataattttcagaaaaaattttacaaaaaaatg

SEQ ID NO: 115530 - DNA, 65 bp, Heterodera glycines
  Promoter: Source sequence=SeqID_28785; Location=1504..1568; Strand=-; Gene=SeqID_59364
taaaagaaattaattatttatttattttttattactacgtttcagagtataaaaatatactaatg

SEQ ID NO: 115531 - DNA, 59 bp, Heterodera glycines
  Promoter: Source sequence=SeqID_34483; Location=1..59; Strand=+; Gene= SeqID_64261
tttaaaatttggatttgacacagtttaatttctgtaatctttttttggtgttaatgatg

SEQ ID NO: 115532 - DNA, 176 bp, Heterodera glycines
  Promoter: Source sequence=SeqID_25787; Location=957..1132; Strand=-; Gene=SeqID_56528
aaaaataaaaatgaaattgagcaaacattgggcaatctcatcgaatttataaagaaaaatgaaacattttgtgaggtgaaatatttggaaatggcaaaaaaagaattggaagccgtgaaaaaggaaaagacggggcggtgataagaatcaagcagattttgaaaaatcgcataatg

SEQ ID NO: 115533 - DNA, 304 bp, Heterodera glycines
  Promoter: Source sequence=SeqID_20487; Location=608..911; Strand=-; Gene=SeqID_51028
tgttgtcgtcttcctaattaaaaatgattagacaaattaattaccctgattaataagcttactgatgcaattgcattgaaaagtgaaataaaaattgatgtataataataatatgaaaaaagataatagaaaaagaataaaacattatgtttttctttaataatggtcaaaattcaattatttacataaaaagtaaattaaaaatatttatatgaagaaattaagcaatattttgcttataaagataaatatgaatatataaataattaattaattttttaagaaaaaattatattgtcaaatg

SEQ ID NO: 115534 - DNA, 116 bp, Heterodera glycines
  Promoter: Source sequence=SeqID_10375; Location=676..791; Strand=+; Gene=SeqID_73564
gttaataaaagcttaactgtcaaaacattaaaagtaattttaaaaaattaacaaattatttgaatgtaattttttttttgcatatccgctcgtacgaaaacggcggtacgaaaatg

SEQ ID NO: 115535 - DNA, 345 bp, Heterodera glycines
  Promoter: Source sequence=SeqID_4922; Location=3510..3854; Strand=+; Gene=SeqID_56203
ttcattatacctatattctccttaacgaaacacctcaacaacttttggaaaccaaacattcgttcattcattcatcggtcagtttttgcatgcttttctcctttatttcgctcaaatgttttgtttatgcgttctttttgagacaactcaaagccttaaactgaaaatgctgacaaaaaggaggttctaataatttcagcaaaatgcctttttttgttgttatttttggatgcataaataaaaattgtttgctgtctggacgcataaacttcagtagagcaagcacttaatttcatcatttctttaataaaagctaaatccctttaaacatttcagttcataatg

SEQ ID NO: 115536 - DNA, 1003 bp, Heterodera glycines
  Promoter: Source sequence=SeqID_5997; Location=234..1236; Strand=+; Gene=SeqID_59965
ttattttaattaccctaaattttgaaatttttcttagtgaaaataagtgaaaacagtcaattcaaggattgggagggtatcattaaaaactgaacaatgttggaactgggctcccagtatgcctaaattttcgattttagaggccctgtaaaactccttggggttttgctagggtgaaaaataataaaaattaaaaaagcataaactaatattcaataacaaataagtttttaaaaaatgaaattgagaagcaaatgtttgggtcaaaataatctcaaaatgttgtataatctgcttaataaaatccaaaatgattagatttcactattaatgggccatttatttatttgtgaaatgattttaaaaaaataaattggttttctaattaaaataaactataaaacattacaaaactcaactgatcaccaaaaaataatatttattcatttaaaaataagtatattttcaatgccttacaaagatttgcattcgaatcagaacaaatttaaaattcatgacatttttatattttcaataaatcaaattttcacataataaaatcaatggaaaaaattttgtttacttttctttatttaaaaaaaacatgccaagccaaatacaatacaatgatttataaaatataagaattgaccagtttttaaaacataaataattttataagaaaatttatccatttttttcaaaaaatatttttttgctttcctccaaggcgcgtctggccaccaaacacttttcgaagaaacattccaaagccttcttttgatcttcatccgttgggtactgtccggtcgccacaaaatctccctttttggccacaaataagcgaatttcttcttttggctcgccttcaattattacgcaattagggacaattgcaaaaataggcggtgaaggagggataatgaaatctgatatcccgggaattttggctccggaaatcaataaaatggagaaacgcaaaaattgcccctttgcagtgatg

SEQ ID NO: 115537 - DNA, 128 bp, Heterodera glycines
  Promoter: Source sequence=SeqID_16150; Location=601..728; Strand=+; Gene=SeqID_80515
agactatacaaccggtggcagtaaaagcggacgggaaagtaggcgcaaatcgtaggctttttaaaaatacgcatcattagcccaacggaaaggccccaccaaaattggcacaaccgatcacttcgatg

SEQ ID NO: 115538 - DNA, 279 bp, Heterodera glycines
  Promoter: Source sequence=SeqID_15939; Location=538..816; Strand=+; Gene=SeqID_80290
aatttaaaaatgtattttttacttcgaaatttaagcgaattgaacaatacgtttaataaatatgcgataaaaacataaacaatattgccacttcatgacttaaaattcattttatttcaagtgttctaagtatatttgttacagctccagcaattcttcaagaatttaaaaatttaagactttattaataggttttgttcaaaaatggcccagttttgttggaggctttgcacaaatttttgaatttaagtgaattttaatagaatttttactcaaatg

SEQ ID NO: 115539 - DNA, 488 bp, Heterodera glycines
  Promoter: Source sequence=SeqID_5140; Location=2748..3235; Strand=-; Gene=SeqID_57062
attctgatcggattggttcctcttgcttggacttggaagattctgatcactatagattgattctgactgatcactttcatgtaattggctttctaaatttaccgatcacatcacagcagattgatcagcgcatttataattgatccatgggccgaaatttttgaaattttatggtcagaggttcggagattagccccgcccctggatattgattgattagttactagaaatgtcctgatcaacgcatgtaactgatacatggtccgagaattttgaaatcttgtggtcggagttcgggattatcccccccctggatattaactgattagctaatataattgtagaacataatccgaagttttgattccatctgctgctgatcttgttctatataatagcattttgtgctctgacactatcctctcccttcgatcatacaaatgtgcgcttgattcattgatcccttttttctctgatcagatggcatg

SEQ ID NO: 115540 - DNA, 766 bp, Heterodera glycines
  Promoter: Source sequence=SeqID_1435; Location=621..1386; Strand=-; Gene=SeqID_46858
tctgtaaaaaaaactttattttatttttaaggattagtcagatataagaaaattaattgaaaaaatttaaaaataaaaaacgaaatttataagtgaaccgaagcatagaaaatcgatcaaaagataagtaaaccaacgaaggcggtcaaaactgcaaaaaaaagctttaaaaaattctcaaaaaccaaatgaaggcattatgagaaatataaaaaaaaagtgaaaatcaaaaatttcaaattaaaaaatttcaccgaaattaatttgtacttatgagcttaatgacaattaattaacagaattttgaattttaaaacttttcggctttaatgcaaaaatcgccaaaatttattgtattttcaagaataattaacttaaaaattgaaaaaggaattaattaattatctttaggaattttttgattaattttaattttttggttgcaaataattatgtctttttcaacttttttttttgtccattaaagcaaaaaaaggaattttaaatactttctttggcataaaaagagaaatacattttacggcatacatacttatgtctagggatgcaatttatagttgctaaaaactgccatccccaaaataggtgctaaaaatggcaaaataggtgccaaaaatttcaaattagtggtgttaaatcgtaaaattttatccaaaaatggaaacattgccaaaaaaatttcaaaattattttataattttcatttaaccgttcaaatttggcgttttgctttaaggacgaaatg

SEQ ID NO: 115541 - DNA, 77 bp, Heterodera glycines
  Promoter: Source sequence=SeqID_40462; Location=1320..1396; Strand=-; Gene=SeqID_68791
tcattctgtcgcccgcggcaccgatgccgtgatttctgtcgccctatgtgcttagtccgtacattttgtcaccaatg

SEQ ID NO: 115542 - DNA, 258 bp, Heterodera glycines
  Promoter: Source sequence=SeqID_20026; Location=922..1179; Strand=-; Gene=SeqID_84801
aaatgtttaaaagtccaagtcatactcaaaaaaaaactactcatttaagaatttgtaaatggaactaaaaattacgcaaagcgagtacaattccatttgatataaattattattttaacaggaattaaggtcattaatgggtaattaattaggtattaatgggtgctttcctttcagtgcaattccaagacaaagttcaaaaatgggcgcgaggaggcgctgtccaaagtgacgcgcgagcagcagcgacgcgcaatg

SEQ ID NO: 115543 - DNA, 699 bp, Heterodera glycines
  Promoter: Source sequence=SeqID_28065; Location=469..1167; Strand=+; Gene=SeqID_58722
atggatgagttggtgaattggcggatggaggcaaagaattggccaaaatggcgtaaaaagatgatgttggcatcgttactataatgctaatttttattgtttgctctagtatttttatggttggaattaaagaagagaaacagtgtgtttttacattttatatcggttgtttgaatggaaattctgggcgaatgcattttcatattccttaagttggttcccatttttagattttattctcagagtccttttaaaacaacaataacagatcctgtaaatgtcttctttttttgtcacctttgacacagcgtttcaatttttgctttcaagttccaaaaaaagatttgcatgtgtgcggaattctttttgtaagatagtagtaaagggacaaagagcggccgttgcgcaatattaattttttttttttgtccaaaacattaaaaaagtgtacgccaaaataagaaatgtatttttctcctctgcactctcttacaattagtgctttttagaaaccaaaaatttagggttgttgaaataaacaaattagcacacaataaataaggtttgtcagttgattgaattcataaaatgcaacagaaacactcgtgttgttagtttctttccacactcaatctttaagcttctggaactgctttatacgtatttatattcgacattgcgatttgcagactccaaatg

SEQ ID NO: 115544 - DNA, 131 bp, Heterodera glycines
  Promoter: Source sequence=SeqID_15243; Location=2155..2285; Strand=-; Gene=SeqID_79453
ttatatttttagagaaaactggcaactcaaatatttctatcaaaataaaaaatttatttttaaactaaaaatactcaccattaattatcataaaaaattaaattaattttcaggacatttatcgcatgatg

SEQ ID NO: 115545 - DNA, 762 bp, Heterodera glycines
  Promoter: Source sequence=SeqID_2124; Location=4871..5632; Strand=-; Gene=SeqID_77975
ttgagtgaagttgttgtcagaatgcaatggcatcgccaaggaggtcagaggagagtgctcaatgttcgtgccctcccccccccccccccaatcatccgaggagcaggggacacaaacatttggggaaaattcgggcttctttaaggtttgagaaatcggaaatttatcccagttttgggcgtagtgcctgatttttgcccattttttgaattttacgcccggtcttttgcttttttttaaatttttacctgaatttgaattcgtatgcccagttttgggttttaccgatagaaaccctggaagaagccttgcaatatatgcacttcttcaggtattgcaaaattgtccaaagacaccaatgaaatttcggcttatgaaatatgcaaatttaaaagcaataattttagaaaaatttttgtgtcattggaattgtatatttatgtggcgatataatcagagttgttttgtgaccagcagaaaacagttagcaaagaattgcatgaaacaaataattggctccaatttacaaaaaagtaacagataattaagacagattaaataaaatatgacgagcttcatgcttgagcgatcactataatttgtaagggaagaatttgggtggactaaaaatttgtagaaatcaatagcagaagattttttgtgattttcagaatgtttttgaactgcgcagaaaatacgtttacataatttaccaatttacaaccaaaaatgttttaataaattcatctttttagcctgatg

SEQ ID NO: 115546 - DNA, 326 bp, Heterodera glycines
  Promoter: Source sequence=SeqID_8353; Location=3561..3886; Strand=-; Gene=SeqID_67780
ttctggaaaaattcgaattttcagaaaaaaattaagaactgggatcaaaattagcagcaaaataattttagggatattttagggtcatatacgaatctgaaatcaggtttcgttttgtcatcgttaagtcccagaaaccgggcgtgtctggaacaagccctccttatggggcctttaattggaggggtctattgttcaacccctccaaaaaggtagcctttaattggggggagcagagcttcaaatagcggattcacggtattttttcttcgaattccacctaactattaattattttatttaaataatatattttttagtttatg

SEQ ID NO: 115547 - DNA, 110 bp, Heterodera glycines; identical to SEQ ID NO: 98226
  Promoter: Source sequence=SeqID_5873; Location=156..265; Strand=-; Gene=SeqID_59509

SEQ ID NO: 115548 - DNA, 139 bp, Heterodera glycines
  Promoter: Source sequence=SeqID_11143; Location=1582..1720; Strand=-; Gene=SeqID_74490
agcatttattacactgacaactgattgttggagcggaagcacttgcaaccttctgtggtacattattactttgtttattaatcatcatgggttttactgcagcctaaccgcgcactcaatttctaaatggaagtctatg

SEQ ID NO: 115549 - DNA, 290 bp, Heterodera glycines
  Promoter: Source sequence=SeqID_20663; Location=731..1020; Strand=-; Gene=SeqID_51222
tcatccagaacctggatgtggcgcgagggacggacgtcacaacattgtcggtctgttttcgctcacattctgctctcgtccgctgcacggaggccggtttttacaaaccgcacggcgagcagttgacacctggacgcgacgactccgagcgggcgctcatgaccgaccaaacggcattcaaattgccgaaaaagggagtccccctcattttagtccatcagaacacgcctgcgcaacgcgatgaagtgtccacctcttcggccaatccgggccaaaccgacacagcgatg

SEQ ID NO: 115550 - DNA, 511 bp, Heterodera glycines
  Promoter: Source sequence=SeqID_17739; Location=1548..2058; Strand=-; Gene=SeqID_82278
ttcattgggtcatttttgtgcttcatccccaaagtggtgtctacgttgtgcagggcccactcttcaccgcactttatctcagcgctgcgctggcgcaggtgttttttgcgccgacaaaaaaaacaataataacgccaaattttcggaaatttcaatttttgggggtaggtttttaacaatatttgtatccctttttgatccacccacatacacatcttcctactcccatgcattgtcaagaaacatgggactttaaagtagagagggggggtagggggattttaaaacaaattttcctttaaaatttaccaaattttatgtcggcgcctctctactgtcgggggcacaccatttggccctcaattttccaacattttttttttttttgaaaaatagctcggcaaacattttaaaattttcgcttggcctataacaaaaaaaaaaggatcagctctggaaagaaataagggtaaaaaaataatacttttatattgcaataaatatataaatg

SEQ ID NO: 115551 - DNA, 323 bp, Heterodera glycines
  Promoter: Source sequence=SeqID_33516; Location=1..323; Strand=+; Gene=SeqID_63557
caaaggaagaagcaaatgcagaaaagcaaaggcaacccctactagggggaggaggagcacttgtatactctgtccggtacttactttttacatttccacgggggtccaatttatattgcaaaaaattcataaaatgaaaactttcaccgaagtattattttttttggttgatttggggcaaaaattgtccaaaaatacatcattaatattaattatttaaatggagtaaaattgtaatttttcgttttccaacagcagcagcagcactacagccaacaacaatagcatcagcaaaaaacccccgaacaaaaagaagcaaaatg

SEQ ID NO: 115552 - DNA, 1003 bp, Heterodera glycines
  Promoter: Source sequence=SeqID_9800; Location=452..1454; Strand=+; Gene=SeqID_72738
ttttaaatttgagaaaacagaacgccaagaatttaaataatttttaaatttaaaaaacagaacgccaagattttaaatttaaaaaacagaacgccaaaattttaaataatttttaaatttgaaaaaacagaacgccataatttaattttgaaaaaaaagaatgccaagaatttaaatattttttaaatgagaaaatggggaaaacaaatgcaagaaattggcaagaaataaatagggaaatttggcacaaaaatgtgcaaaaatttggtaagaaataaataggaaaatttggcacaaaaatgtgtaaaaattggcaaaagatagtgttaaaaattgtggcaaaataatgccaaaaattggcaagaaataaataggaaaatttggcacaaaaatgtgcaaaaatttggtaagaaataaatagggaaatttggcacaaaaatgtgtaaaaattggcaaaatccaggtttaaaaatttgggcaaaacaataccaaaaattggcaagaaataaattgggaaataagggggcaaaacaatgccaaaaaattgcggcaaaatggcacaaaaaacgttaccataataatgccaatctggcacataaataataaatggcaaaaagtaatgggtaaatgggtaaacaaatgccaaagaaggaaaaaattaaggcataaataaatgataagggattattgattggcttttccttccgtaaagtgaattaaattaaatgaaaatgaccaaatggacaaaaaatgagttagaccataaatttcgacttttatataccttcccccatcccatgcccattaccccgtctttattcactacaggtattttctccatattataaaatggtccctcatgtttgtcgtttgagtgatggaccaagccaactaaaagtaggacattgctcgagaacggaaaacattatgtatgatatcactccagcgtcattcttatttgtttttcctctcttttctacctttttttcttaatttagcaatg

SEQ ID NO: 115553 - DNA, 210 bp, Heterodera glycines
  Promoter: Source sequence=SeqID_1909; Location=3791..4000; Strand=-; Gene=SeqID_76712
aaatgcattttcatattttttgcagccctgttaattactttttactgtcattttaatttgtcagattgaagaacgcgcaattgccgaatttgttatgggtcagtcaaattttgaagaattttggaatgaattgaaaaacgatgatgtaatgcaaaggaacaattggcgtaaattaagtttcgacgaaatcaagaaaattatgcgcaaatg

SEQ ID NO: 115554 - DNA, 545 bp, Heterodera glycines
  misc_feature (96)..(96): n is a, c, g, or t
  Promoter: Source sequence=SeqID_700; Location=1..545; Strand=+; Gene =SeqID_59220
taattgtctttcgatgttttattccgattcttcttctgtctctcctttcattttcacatgtgtagaatctttcaaattgtctaaatgcttctttcncagattccaagccgattttgataattaattttacaaaataactcgtatttttgctattccatgggaaccagtcaaagaaagaacatttgggggagcggagggcgaaatgacgagtgagtaattaatggagttattgggcagggcgcggaaaggataaattgggaggggtgagagcatccgtagaaggcggagattccctgtgattagtcgaccgattcccgtgtttttgcgaaagaaaataacttgctgcgccttgtgattgaacttgacatttcttcgttttccacaatgtgtggcattttgagtgggggattaattaacggaaaggacacggcttttccctttttctaagccgctccataaaaaacacccaaatacaaaaattgttcccaattccgcctgtctccgattagttttctttttctgtcaccgccctttttcagcggatg

SEQ ID NO: 115555 - DNA, 196 bp, Heterodera glycines
  Promoter: Source sequence=SeqID_3979; Location=2289..2484; Strand=-; Gene=SeqID_52675
aatcgagggcaaaatgcgaaagggagcaaaagttgcgcgggcagaaatacgggagttacagcggcgactacaactcggcagaagagctcgagcaatggcccaggcatggcagcatcccgaacggggccatggggccaggacgggagtagcggcggcttcacttctccctcttctgatcgtcttcggcaccacaatg

SEQ ID NO: 115556 - DNA, 188 bp, Heterodera glycines
  Promoter: Source sequence=SeqID_17655; Location=3071..3258; Strand=-; Gene=SeqID_82184
gtgcgggactgagtgaaagtgccatctgcaaaaaaagtgccatcagtaggtccgtgagttgtgccattaccaaaaagtgtgttgccaaaagtgtaaagcatttacaggtcagagtgcgagagacgtgcgtgactgagtgaaaattttgccattgccgaaaagagtgagagcatttctccgtcaaaatg

SEQ ID NO: 115557 - DNA, 1003 bp, Heterodera glycines
  Promoter: Source sequence=SeqID_12564; Location=1537..2539; Strand=+; Gene=SeqID_76225
atttaaaaagtcgcttaatttccaaactattttataaaaaaagctcctgcacacaccgaattaattctaggctcccagttcaaaagagatttgcatgtgtgacgaatttgtttttgtaagatagcaaagggataaagggcggcggttagagtccgttgtgaaacatgtatttttatttattttttgaccaaacagttaaaaaatcacggttttcaaaaattatttttgaaagtttttgccaatcaaattggacaacttggtatcagtcgaaaagaagcttttttaagcaaatattaagcttttttacatataaaagtaaattcagttattctctaataatagagataaagaaatagtaccccaaaatgagagatgtatttttctctgcactctctatttattggttcatttctcgttttttgtgcatacactaaaacttaacaggctgcaagacgccaaatttttcagtttatgccaattttagcctattttgaaagtgtttaagaccgcgggttctttatcgggcccaaaagtatcagaatccatgggaaaatatcccccggctaaagttagttttgaaatgtccaaattatgaccaatttattactaagaatttattaataaaaataaatttaaattctgacataattaaaaagaaaatggttatttaaatgccgtttttttgccattttttaattataaatatacttattacttttgttaatttatttttgtccctttttctaccaaattatcgacttaattagaattttccagctggcctattgtgtgtatatgtttttctataaatattaaagcgtaattgacctgaatcactttgttgtgatgccagaaggaacggagtgtgggagaaagtgggataaaggacctgagagaacctctaaaagaggcgcccgtagctcagttggttagagcacggcacggattgctggggtcgtgggttcgagtcccaccgggcgagttaccttttatgttctacatg

SEQ ID NO: 115558 - DNA, 792 bp, Heterodera glycines
  Promoter: Source sequence=SeqID_2; Location=15401..16192; Strand=+; Gene=SeqID_50781
agttttgggattgacaggcataaatgtcaccagggaaattcttgcgcaaaaaagaatttcgacattctctttagcactatttttatatttggtaataaattgaaatttgctaacaatcaatatgagtgatttttgaatggtaaaaaaataatatgaattttcataaatcccttgccccctcctttggaagtgaatttaagtttttaagaaaataacgcaaccatctttaggcaaacgaattgcacaaagtgagcgcactattgttaggtcaaaatggactgatgttcaccaatgcaaaagcaaaaaaagtgcaaaggtcggcggtgaataattccaattttttcgtacatttatttcttttcgtttttggcggggctcagccgtggagtttggcaaatttgcacaagaagaacaggtaggagagtgataccaacccataaacagtgacgtttacgagccatggcaaaacgcccaatttcacccaaccccggacacactgacaaaaagaaattcgaattttttttggggttgaacgcctcataatttgggagtcaattttatgcagccaatatgacttttctatttgcagtttttttgggttttttaactgacaatgagatatggacatttgaaatgagacaaatgccagaaaaaaggaatgatttttgaatgataaaaaaaaataatagtaattttcataaatttcctttcccccccttccccttccaatgtaaatttaatttttttttaaaataacacgtcccattttaggcgaacgcattgcgcaaaatg

SEQ ID NO: 115559 - DNA, 351 bp, Heterodera glycines
  Promoter: Source sequence=SeqID_1817; Location=2002..2352; Strand=+; Gene=SeqID_76153
acttgtgtttatgcccaattttttgctttcactggaagtattaattcatttataaatctgttttggataagcgttgatcgatttgtggcattggcatttcccgttttgtaattatatcaattattattaagaaaattaaatattcaggaaattaatcaaactttctttaagttttcgtaacatatcaagattttccggaaaatatgtgctaattgccaatgtcttttccttgtcaattgcattttatattatttatttgtcgtttttatttgctctacaaaatcccgaaatgtaattattaataattgattaattgactaattaataataattttaccaattgaaaggatg

SEQ ID NO: 115560 - DNA, 285 bp, Heterodera glycines
  Promoter: Source sequence=SeqID_20879; Location=615..899; Strand=-; Gene=SeqID_51462
ttttttgggtcaccgtttgcccaacaccaaaaggcaacaatttaaataaataaaagatgaaaacggcagaaaattatgagttattcaaatatttattattcctatcttttgccgtcgcattttctccatttttgggtcatcgttttgcccataaatttatttactttttggcctataaatatgtgcacaattacagcggctatagcagaatttagccttcatttgctcatatttttctaaatttattaaataaattaaaataaatttttagttaaaattaaaatg

SEQ ID NO: 115561 - DNA, 179 bp, Heterodera glycines
  Promoter: Source sequence=SeqID_11478; Location=23..201; Strand=+; Gene=SeqID_74881
ggtacagcgaatttcaactgtctacgcaattctaaaatgcaatttcaggcaacaaattttgcgttttggtggctgtagggcaaaaggttacgcctctaatctatcgactcgaccacggaaaaccaacgccacaactcattggcaagatcgaaccggccaacggactgaacacggcgatg

SEQ ID NO: 115562 - DNA, 67 bp, Heterodera glycines
  Promoter: Source sequence=SeqID_20199; Location=147..213; Strand=-; Gene=SeqID_84994
atgcttcattgacacgatcagatgtgagcagaaggcgattgatcaggaaatttcgcggtgtgtcatg

SEQ ID NO: 115563 - DNA, 237 bp, Heterodera glycines
  Promoter: Source sequence=SeqID_19063; Location=1..237; Strand=+; Gene=SeqID_83808
aaatggaaatttttggacaaattttttttttaatttgctcaaaaaggatcacaaatttttgtttttgatatcattcaaattagtttgttaaaaaatcgaaaaatttcgttattccaaaaagttagatggccaaaaaaacgttcgatttttttttttttttttgagttttcctggtcatatatatttttttgaaatttaataaaaatcaaaaaatttaaatcgaattttgtcgaaatg

SEQ ID NO: 115564 - DNA, 856 bp, Heterodera glycines
  Promoter: Source sequence=SeqID_12502; Location=3314..4169; Strand=-; Gene=SeqID_76140
ttttatcgtcaatatccgggaccgattaagtcctcaacgcagcggccgtttttgtttccgggaccgaggccgatttggcgaacaaaaaagccgaaacagtcgcttccgggattagaatcgggtccgagatcagcagctcttggtaacttacatttgtgcacaaaaatgctgaatattgaaaataaaaataatttttcaaatcatcggtccaatttactgttattaataagaaaaattggcataaataattttttaaaatttttttttgatacataattgaaaaagctgtttttgtcacatggcctatagcacaaaaaacaatttggtgtttaaaaacgtaaaatcttcaaactgtcgcattgagatcaaaattaatttatacatcatgcttttttcattgatgacatttcctacttttaatcaaaaaaatatttgtaaaaatttatttattttgcttttttctcaggaaatgaacacgaacaacagcgatctgctgttctctctcaaaatgatgaatattattaagaatttattaataactttttttaattaattttttcaaaaaattaaaatttttaaatttatttaaaaggaataaataatttccatatttttaaaattatatttgatcagattacaagaagaagagagttgaacaaaaagatctagaattttttgctgcctctcgagcaccaaattatgctaatgaatttttaatttaaatttaattttgtaaaaattagttgttgacactgaacaaaatgatcaatcttttttcaatcctaatggcggcgaattagtttaattattaattatattttatttcttaataaaatatttatgttttaaagaaatg

SEQ ID NO: 115565 - DNA, 141 bp, Heterodera glycines
  Promoter: Source sequence=SeqID_37874; Location=1..141; Strand=+; Gene=SeqID_66855
aattgccctccccccagaaaatttgtctgaagtggtcaattcactgcagtttgacacctgttgggcgaaaactcgggtttcctttgcctttgactattttgtattggaaaggcaacgaatttgggttcgaaaccaaaaatg

SEQ ID NO: 115566 - DNA, 327 bp, Heterodera glycines
  Promoter: Source sequence=SeqID_16041; Location=2099..2425; Strand=-; Gene=SeqID_80400
tctgaacaatcataaataaatcagcaggcaatgtgaggtggatttaacatataataaagaaattaatagaaaaaatttttaaattcattattttttaaattaaattaaattgagttaatttaatataaattatttatataatttaattaattaatttcattataattatatttataattttaaatccttaaattttaaattaatttagttttaatttaactttagtttaggtagttcaatttttttaaatttttaaatttatttttttttataatttaaattaattaatttcgctttttgtacccaatggccactgttcgtacgatg

SEQ ID NO: 115567 - DNA, 68 bp, Heterodera glycines; identical to SEQ ID NO: 109495
  Promoter: Source sequence=SeqID_41225; Location=350..417; Strand=+; Gene=SeqID_69410

SEQ ID NO: 115568 - DNA, 345 bp, Heterodera glycines
  Promoter: Source sequence=SeqID_4922; Location=3508..3852; Strand=-; Gene=SeqID_56204
ttatgaactgaaatgtttaaagggatttagcttttattaaagaaatgatgaaattaagtgcttgctctactgaagtttatgcgtccagacagcaaacaatttttatttatgcatccaaaaataacaacaaaaaaaggcattttgctgaaattattagaacctcctttttgtcagcattttcagtttaaggctttgagttgtctcaaaaagaacgcataaacaaaacatttgagcgaaataaaggagaaaagcatgcaaaaactgaccgatgaatgaatgaacgaatgtttggtttccaaaagttgttgaggtgtttcgttaaggagaatataggtataatgaatg

SEQ ID NO: 115569 - DNA, 370 bp, Heterodera glycines
  Promoter: Source sequence=SeqID_35765; Location=1..370; Strand=+; Gene=SeqID_65243
cccttaattaagtgtttttgttattgatgagaaaggtgtggggttttcagtggcaaaagccccaaaatatttaattaaataatgacaacattggcaaaaaaagcgaaaaatggcaaaaaaatggtataaaattttaaaataagaattttttttttctgtaaaatgaaattaaaattgctttaacaatttattcaccgattttaattttcaaaagaatgaacttttttttaattttgcaaaaaaaaaacctaaaaattttttttcaaggacataaaattcaaggaaacgcacaacttaacgaagaaatttttaaatcatcgaaataagtattaaaaaatattttttaataatttattatttaggggaaatg

SEQ ID NO: 115570 - DNA, 248 bp, Heterodera glycines
  Promoter: Source sequence=SeqID_30934; Location=1..248; Strand=+; Gene=SeqID_61305
taacttaaaataattgattaaatttttgagattgtcaatgaagacggaagcacaaccacacggacaaaaagctcaaaagcttttaggtaaaaataaataaataaatatattaaattagataattaaattttcaaagatttttttataatttgccaagtttaaaattatttaaaatttaaattttaatccaaattaagctcacgttacacccgtcatgaaacatttgtgaatggggttcgccaagaatg

SEQ ID NO: 115571 - DNA, 544 bp, Heterodera glycines
  Promoter: Source sequence=SeqID_10852; Location=1..544; Strand=+; Gene=SeqID_74127
tccctaaatttgaaactttttgacacctattttctcatttttagcaattattttgggggttttttagaacctaaaaattaactattttggcaattttagcacctaaaaatataagcccaattgatggttttgaaactcaggctgagtttatagtcaaaaattaatttgaaagtcaggatggttatttttgggttttattgtatttttaaaagatggaaaccaaatatatgtcaattaaataaaaattaaaaaatcataatccgcataacattctgtcaattattagccaatataatttgtaaaattttttttttattaccctaaagtgcactttataaaaatggatttatataaaaatcaatcaaatgcacttttcaaatattcaatcattcgttcaaaatcacattgtatctatatttttttatttaaaaaaatcgcacattattaaaaacgtaaatcataaatttttgtattattttttaaataaaataattaaattttccaacatttttaataaatttaaaattaagaaagaaaaaaaatg

SEQ ID NO: 115572 - DNA, 63 bp, Heterodera glycines
  Promoter: Source sequence=SeqID_17013; Location=1..63; Strand=+; Gene= SeqID_81435
cgcaaatgaatggcgaattttcagcgaattcctttgagcgtcgatgagaaagtgtccaaaatg

SEQ ID NO: 115573 - DNA, 805 bp, Heterodera glycines
  misc_feature (32)..(32): n is a, c, g, or t
  Promoter: Source sequence=SeqID_8619; Location=1..805; Strand=+; Gene= SeqID_68695
ggaataataaaaaagagtaatttgatggtttncatttaagtgtatgaaagctgctaaaaatagggcccagtaaaaagataaaaacagataaatgaatgaatgtaattcccaccgatgtatgatgggttgggtgatttgtggtgtcattgtttatttattgttttgttgtttttggcccaattatgtaacgatggtgacaacaaaacaaattattgcaaattgtgggaagaaaattcagaggccaatgagctttcagcagatgaggttcaatagcaggagacaacggaatatgaaaaaaatggaaaaaagtacgagcgaaacttttaaaaacggaaaaagggatctacctaggggtcctatagccaccatgccattagtgctgatcgagacagaaaattccccgatactcgagaccgagacgaagaccccgaggaagaaaccgagacctttctagagtcgagactcgagaccgcgagtctcgagcagcactacatgccacaattctgatgcctaccttattttcaattcggaccaagtcattgcatgaaaaattgaaacaaaaaatagagatttttgatgccaaagtccagtgcggcacgaaatttaattgtgatagaatttcaaatttgtcatgtcacaaaaaattatgtcaccaaaacgtcgaggaaaaccctaaagaagagctgctgctgctactcatatcaaatgtgaatgcatttgttttgtcactgctttttggtccattaaaagtgtcgttcttcagtggtctttgaacccttagagaagaaagaaaacaaaaaatatg

SEQ ID NO: 115574 - DNA, 152 bp, Heterodera glycines
  misc_feature (15)..(15): n is a, c, g, or t
  Promoter: Source sequence=SeqID_13240; Location=1650..1801; Strand=-; Gene=SeqID_77069
ttttgtattaaattnaaataaatttccattttcgaaattctcgccaatttttagaaaaataaattctgtccaataagattttaaatttaaaatttataaataataaaaatgttatatagaaatacaaaaaacaaaagacaaaatttagtatg

SEQ ID NO: 115575 - DNA, 373 bp, Heterodera glycines
  misc_feature (4)..(4): n is a, c, g, or t
  misc_feature (41)..(41): n is a, c, g, or t
  misc_feature (66)..(66): n is a, c, g, or t
  misc_feature (93)..(93): n is a, c, g, or t
  misc_feature (147)..(147): n is a, c, g, or t
  Promoter: Source sequence=SeqID_22032; Location=1680..2052; Strand=-; Gene=SeqID_52668
tgcnaaattataaatatttcgtctatcgatgttaatgaatntcatcatctttatgttttgccaccnataattttttgaatgatatccgacaanaaagagaatggcacctagtaatttaatgttatttattttttaattatatttttntaataaaaaatttaacattatagaggcataataaaataaataattggcaaaaaagatgatgatgtaattaaaggaagtcgaaatgaagcaaataagttatgttggcatcttttcaggtcatcaaattaaaggtgtataaaaggaattaaataaacacatacaaacatagattcggattttacaataatattaattcttaataattaattaaaaatctaaaaaaatg

SEQ ID NO: 115576 - DNA, 882 bp, Heterodera glycines
  Promoter: Source sequence=SeqID_29752; Location=1..882; Strand=+; Gene=SeqID_60219
caaaatagtgatttctagtgacgaaaagtgacgtccaaatgaaaaaattttaacgcagaaatgcgttttttgagctcctttcttcaaaacaattgagcaaaaaaaagttttttcaataaaagttgctgccctaataatgatgatacattgtacaacattttccccccaagttgtctttctcccccatcacccatccctaccccattatcatttttaatttcatcttctctctcttttcggttgttttgctctgccgggggtatgcacaacaactgacagctttgctggagtctgtttcaattaggatcatacgtggcccacgaaaaaaaagactatccatcaacaaaaaatttttattttattaaaattaaaaacggaaaaaatttagaattgggccctccaaaaacgagttccaatcaatctataatgacctataatcaacataagaaacactcccgaggtgtggaaaaaaacgggtttttgaatcggtttaaatcacgaaaaatggaccacaaatcagccaaagaaaagattatataaaaattttcgaacaaatttgctcattggaaaacccttgacgagctaatcattacgatttacatacataataattaataacaagaagctttgccgtccctcctcacatttaaaaaaaatttttgttttcaaattctttaaaataagttccctggcttttcggagtcgctaatcatgaatgcggcatccaagtttgttttcatgatgatttaacaccaacttatgtttgttggtcgaaatttttcttatttcgaaattttttcggccctttttgattggattttttttacacattttcttgctaatttgaagggttgttttaaattattttgtttttgataaatg

SEQ ID NO: 115577 - DNA, 610 bp, Heterodera glycines
  Promoter: Source sequence=SeqID_18964; Location=2157..2766; Strand=-; Gene=SeqID_83698
cggtttggtacatcacatattagagatgcaattcagcgtgtaggttattatggcgcaaatcggcatgggcggattcactgcatcagcaattgatcagggcataaggaggttcaagagcactggcggtccccctgcattttatgtccacatacattttcgcgcgcgtccgtgcctttctcaatttcattttcgtcattcttctgcctgatgagggggccgcataaaaactgattgtggcactaccatttttaccattcatcatttacccggcgaaatcaaataactttccattccatttgcatcataaaaaataaataatatacatatttacccccccccccccccccaattcctccaagcaacagcacttgtccatcagggaggggaacggattctggaatttttttaggagaatttcaggggactttattagaagaaatagatatttctatataagagtgttttatgttcattcatttaacgaaaagagttataatttttagtcaatttttgtatgcctcttttatacaattctaatttcaacagattttcaaccaaaaagcaatagaaattgtcgtcaattgtttaatttttgatgactaattccatg

SEQ ID NO: 115578 - DNA, 188 bp, Heterodera glycines
  Promoter: Source sequence=SeqID_21064; Location=1..188; Strand=+; Gene=SeqID_51654
attaatttcaattatttcaacaataaataaatgaaatcaatttctaaaacataaattgaattcggttgggttttccttttggtcatttcaaaaataaaaccataaattcttttttttataataataatttggtttatattttttatgtgttcgacaaaagtggtcgattggtggagcattggaagatg

SEQ ID NO: 115579 - DNA, 106 bp, Heterodera glycines
  Promoter: Source sequence=SeqID_10458; Location=966..1071; Strand=-; Gene=SeqID_73662
ggtcagcggaggaagaagcgaacggaaaggcggcggaagcgttgtccatgccaaacattcgtcggatggagcaatgaatgaatgaacgaaatgattggaatgcatg

SEQ ID NO: 115580 - DNA, 53 bp, Heterodera glycines
  Promoter: Source sequence=SeqID_18918; Location=1019..1071; Strand=-; Gene=SeqID_83635
gttatgcttttattcatgccggtgtcattctcattaatccaattttcagaatg

SEQ ID NO: 115581 - DNA, 537 bp, Heterodera glycines
  Promoter: Source sequence=SeqID_9304; Location=4289..4825; Strand=+; Gene=SeqID_70922
actttaattaagacgatcaaaaaataattaaagtgaataataggcatagtttcatattaattctttgattggttcttaaatttattatattatttgggtgatgtaattccgtcacaaaaaatgtcaattcaaatttacgcaaaaagaaacataatgccaaagaaattttttattgtaaataaatgaaagaaagattatgggcgcccccacaaaatgtccaagccacgaaatgtccaagccacgaattgtccaagccacgaaatgtccaagccacgaaatgtccaagccacgtattgtccaagccacgaaatgtccaaaagagtaaaaacccacgaagtgtccaaaactcgaaaaatctattaaaagccggaaaatgggtctaaattaaggtgttaggggtcgctgaatacgaatacgacatttatataacccatttcctaaccttcgacccacccgaataagaaaaatctcaaattcggttaaaatatatgctgttttttgtcttcagattttgttattcattgatcgaacaaaatg

SEQ ID NO: 115582 - DNA, 73 bp, Heterodera glycines
  Promoter: Source sequence=SeqID_5288; Location=1..73; Strand=+; Gene =SeqID_57579
catttgtttgataaattattttttcagctttttctttggaaattttgtctacctaattacccgcaaaaaaatg

SEQ ID NO: 115583 - DNA, 495 bp, Heterodera glycines
  Promoter: Source sequence=SeqID_2724; Location=829..1323; Strand=+; Gene=SeqID_81278
ttttttaattatttcattttttttttatttgcctgctctcgaacacttgtttcatttcgcctttacaattgtaggcaattgttccataataaaaattttctctatattcaactttcacatttatggtacgacaatttttgattgctcccgtaatgcaaccgtccaaaagtacaagaattccttaatggttttatcaatattttaatttagggttgcgtccccgaccccgccccgaccccgaaccccgacttttttgcccatttttcggggttaaccccgaccccgaccccgacgctcccaaccccgacgcaccccgaccccgacccttaaccccgactcggggtcggggttaaatatacacccctaagaatggcatttttgtgggagaaaaagcaaaaaatatatacaaattttgaattttttaaccattttgccaaatttttataaaataaagtaatttgcttttaccaattcatatgcagtagtggcgtaatg

SEQ ID NO: 115584 - DNA, 145 bp, Heterodera glycines
  Promoter: Source sequence=SeqID_13441; Location=1926..2070; Strand=+; Gene=SeqID_77331
tttgaggatgattttgcaagaatgatttgattgtgcgagaaaatctctgcttaaatagctttcaaaagtgggcgtggcctaattttctgggagtataaaagccccggcaatttgtcagctatgtctcatttgttctgctacaatg

SEQ ID NO: 115585 - DNA, 119 bp, Heterodera glycines
  Promoter: Source sequence=SeqID_17998; Location=1208..1326; Strand=+; Gene=SeqID_82568
ttgttttttgaattggttaataaaattcaaataaaaaaatgactgaaaaataattatccatcttcaaagttaacgatcgaattaaaaatttaaatttagcacgtcaaaaaggatgaatg

SEQ ID NO: 115586 - DNA, 86 bp, Heterodera glycines
  Promoter: Source sequence=SeqID_32073; Location=857..942; Strand=-; Gene=SeqID_62387
tttttttgccatttccatttcagactctcgtcgacacgaagcaggaggcgttggaccgcgagctgaagcaaatcactgcccaaatg

SEQ ID NO: 115587 - DNA, 748 bp, Heterodera glycines
  Promoter: Source sequence=SeqID_16742; Location=1429..2176; Strand=-; Gene=SeqID_81153
tattgacggatttctactgacggattgtccgtgggagcccatgagagtgggagggggggggggaagaaaaaaaactcactgaatttgggtttaagagtcaatttaaaatttttaatattttaatgattatttcatgtttaaagagtttttggatgcttaattaggtacctaattgctttaccgttttttgttcttaaatttcgggccttatatttaatttaaatattttttctggcgttttgtttgttgagttttcaaattgttttacgttgcgtttgcttgtttttatatttgtcgggtcgcgtcgtggagatttcggcagtgactgaattcggcaactttcgacagtaaaacagttagataaacctattatttgctcaaaaaccaggaatgaacaccgacccaaaaacgaaaataataccgatcaagaaaacaaaaaaacaacaatttttgggccttattctctcgatcagcatcaaatttggccaaatcaagttattataataaaagttttgttttttgtaattaaaccaacattgaattgttttcaaatttacagtcgaaatctaaaatttcagaaacctttaaattagggtacctaatttcgatggcattggttttttttttaaatttaattcctcgccttttaggtgtttccacctcttcagacatttgtgtcttgtaaattttgtttgttttttatttgttatttccttttttgttcttcgtctttcccctcgtcacaatg

SEQ ID NO: 115588 - DNA, 82 bp, Heterodera glycines
  Promoter: Source sequence=SeqID_5340; Location=1644..1725; Strand=-; Gene=SeqID_57726
agtgcctttcgagcccaatgtttttttcgggattgggcggggggagtctttggcctgtttgctctctctcgaaccccaaatg

SEQ ID NO: 115589 - DNA, 790 bp, Heterodera glycines
  Promoter: Source sequence=SeqID_14592; Location=1406..2195; Strand=+; Gene=SeqID_78663
gaccggaaaaattaaagtcgaatttttaatccattcaaactaaaagtgatttggtcgctatttatttatttgtattgatttcatattatattttattttttggcggcgatctcgtttttaattgttttgcgctttcttgaggacattttttaaattaatgttttgtcctcaatgtaagcggatttttcccttttgtggactttttctttattgacaataaacaaactttgcgggagtaatccctgcggggtcacatcccgcaaaaagtttgagttccaaacccgcaacatgattcgaaaatttgaaatttaaggcaggggtgcgatctgttctgagttgtcagaaatgttctgattttggggtagcgaccaaaatttgttttgatttcttaaaatccttcagaattttgtaattttatggcgtaatgtcaggctacatgacatttcgcctactcgacatttcgcctactaagccaaaaacattcatttcgcctactaacccaaaaccggacatttcgcctactgtcatttcgcctactattcatttcgcctactgacatttcgcctactattcatttcgcctaccaaaccaaaaacattcatttcgcctactaagccagaaacattcatttcgcctaatggaaatacataatgccaaagagaaaataaaaaaagagaatatacaatatctacctataatgtttttgcatcaaataaatcattcatttcatttttatgtcatttcaaattttcttcaaaaacaaagaaatttcagattctaataagaaatg

SEQ ID NO: 115590 - DNA, 120 bp, Heterodera glycines
  Promoter: Source sequence=SeqID_6297; Location=1108..1227; Strand=+; Gene=SeqID_61062
ggcaaacaaaataaaaacacaaaataaacaagtgaaaacgatttaagaaaaagtcaagattggagagttctggggcaggcagtggagtggaaatcatcagaaacgagccctatcagaatg

SEQ ID NO: 115591 - DNA, 839 bp, Heterodera glycines
  Promoter: Source sequence=SeqID_15184; Location=1..839; Strand=+; Gene=SeqID_79383
tttttatgtgcatattttgtcatttttggtgcatattttgcgattttatgtgcatataattctatgctctagtaattactatttcattttaatgaaattgaacattaaattattaaattctgcttctcgacaatcttcttaaaatcagtccatatttattcattccgatgacggatttagcaaatatcttagcgcgccagttttgtacacattgtataaattacatttaagccattcaatattttccaataaatccacgtgaaaaaattaaataaataaaaaattaaacaatgggaaaagatagtcgttataattacaaaatcaatgccaccagatataaaattttattgccatttatgtacatttttatatttcaatgaaaaaaaaagatttgcgattttgttatagctaataataaaaataataatataataataaaaataatcattttttatataatttacatttaataacaaaggagtagttcattaaaactttttatattaaaaaataataatatttcaaattttactataaaatattattgaaaattcacttaaataaatctttaaaattaaatcgaaaaaaaagaacgaagtctagttttcaaatagatttcctaattcaaatacagaaaattcttaaaaataaaatcggtgtccatattttcaaagactgataaagaagtgatgcgattgcgcgacgttttgctcacttttgtcgcttcatttctttttggccattcatttggcggcctttgcggctccaaaccgtccaaatttgagcgttcggcgagtgcgccccatcgacgggcgtcggcaccgccgccgacgcaaatg

SEQ ID NO: 115592 - DNA, 594 bp, Heterodera glycines
  Promoter: Source sequence=SeqID_19428; Location=2480..3073; Strand=-; Gene=SeqID_84149
attatttctctttttttgagttcatttcgttgtttttcttccttttcttcccattttcccccgaatatttctttaaatgatttttcttctaattttttcttttctgttccgatttggttaattcgagtgatcaaaaatataattaaactaaaaatttttcatttggcaataattttgttaattaatttattttatgacaaaaattactaaaattattgcaatattatttaacaaatgaagaatatttagaaaaaactttaaattatttaataatttcatttacaattgaaatatgtaaatttttacgtgtttatacctaaaaagcgttaatttaaatttttttttttttgcctatatttgtgcctatttgcggatttttgtgcctatttgatgcctattttgcgattttgttctgcctatttgatgcctatttcgctattttttgtgcctaaaaaagaatccctaattatttttatatataataaactaaaaaataatttttcaaaattaagtggcaaaaaaatttcgtcccttaaatattttttgctgctttttctgatacttttgttcccgtttgcatattgcgttaatatg

SEQ ID NO: 115593 - DNA, 421 bp, Heterodera glycines
  Promoter: Source sequence=SeqID_4503; Location=3252..3672; Strand=-; Gene=SeqID_54691
ttgtttccgtcgcctcttcgaccgttgccactcgtctaaattctttttcgataaagaaaaaaaaaaaaaaaaattgccatcagaagggcgggaaccacttactctgatgactgatcacagtaaaatagtcacagagtaagtgaataaatatcaagtgagatcacaggttaaagataaacaataacgaaaaatttatatgaaaataaaatcgaggtcaaagtcaataaaatgcctcaaaagttaataattctttatacattggtgctttcagaatcaagagtcaattctaataattttttaaaggcgtttaaggagctagacattaacgttttatcaagggcattccaggccttgactgatctgttaacaaaagatttggaagattttttagattgtaatttaacatttaaccggaaaaatg

SEQ ID NO: 115594 - DNA, 177 bp, Heterodera glycines
  Promoter: Source sequence=SeqID_876; Location=778..954; Strand=+; Gene=SeqID_63147
aaggacacttacggtgcacctgaagagcacatcagagcgctacactttgagctggctaatctcaagacgtgccgaagtctccgagacacaaaagactttctgcttcagctcgaacgactgacaagagagctgaacaatgccggagaggacatcgagggaccgcaggtgttcctcatg

SEQ ID NO: 115595 - DNA, 898 bp, Heterodera glycines
  Promoter: Source sequence=SeqID_17454; Location=960..1857; Strand=-; Gene=SeqID_81938
atcatttttatgcataaaatacaaaatacactcccccagttcagcctttataagcgcatttgtttatgctgactatcattcactcaatttccagattgaaaataacaattggaggcgacgtgaagaagccttaattaataaattattttaattaaaatttacatatacggtatttcctaaaataccccctgggcttctgctgttttttagttcctctccaaaggggctccttttcaggggcttctaatttggggggggggtgacaataattatggcgttttaaattctttggctaataaaaaaagcaaacttcactcattttggccatttccattgaatacttttcatttaattcatttgatggttaaacaaaaaagttcattaaattctttacagttaacattaattttttttcaatttttaaattaaataaatttgctaggtaaattttatgtaaaacccaatctaacattgatgagttaagtccgtcgctttttaaattaatgattctgtttttatacacaaaaacctaattgaccaaaaaaatactcaggctaaattcgaaaaaatagtgagatatcccgctggaatcccagcactaaaagactcccggatcgggaccatggcaaaatcgggattggaatccgagcaaaaccggggtattcatcacggaatcctattacggccttctgccaatcccaaatcccgatttttttcaaaattccgggctctatgaccaacaaacattttttttaaatttctaatttaaggttacagaatgaaatatacctttggtcccattacccagtgctaataggggaattaattccaggagaccttcttacgcgtccgtaattagaccccttagggcttggaagggaatggatgatgatagatg

SEQ ID NO: 115596 - DNA, 302 bp, Heterodera glycines
  Promoter: Source sequence=SeqID_40915; Location=1..302; Strand=+; Gene=SeqID_69142
cgctaaaattatcagagtgccgaaaatcgcatgtgatctttacctagaaaaaatggtctaagtaaaaatcgtaattacgctcaaaaagcttctcaaacaattttagcgcttccaattccttctacaatcgcctttatacatcccattatgagcgctaaaattatcagagtgccgaaaatcgcatgtgatctaagcctagaaaaaatggtctaagtaaaaatcgtaattacgctcaaaaagcttctcaaacaattttagcgcatccaattccttctacaatcgccgttatacatcccattatg

SEQ ID NO: 115597 - DNA, 1002 bp, Heterodera glycines
  misc_feature (31)..(31): n is a, c, g, or t
  misc_feature (108)..(108): n is a, c, g, or t
  misc_feature (114)..(114): n is a, c, g, or t
  Promoter: Source sequence=SeqID_6628; Location=1..1002; Strand=+; Gene=SeqID_62259
attccttgtttcttaacccgatcacagaatncgtccctacaatggtaacaataaagtatttttacaggaggcggtgcctttagcaagctgtagtgttttaaaagtttnaatagncattgagtttttccacttcccgtagcgccggataaaattaatgtaaacggtgcgttgaacattttttttataaaatttctttgtgtttttttttgcttacaaatatccctttatataggcaaaacggagaatgtcgcctgcatccccctctcccgtccatttttgactcttgcgacactttttttactacataattgacaaatatcctttttcggatgactatgtcctcggtcaattggttgtgcggtggatttgacctcttgggttcgaatccccctcctgttggtgaattatttaatcgattttaaattatattatatataattgctaattatcctttttcggataactgtatcgctggcccagtggtagtggtttggattagacctcttggattcgagtccctctgcctctggatcaattaatttaattaattctctcatggatttggaccccggcacctgggacaaaatcatgatgaacaaaaatgggtgtttttttaagcaggggcaggggtctggaccccggcccctgggaccttatactactagcatatcatcttcggtttttcatgcttagaatttcacaaaatgctcaaattgatcatggacaatcaaaaatataacatttgaacattttaagcctgttttgaataatttttgtaaaaatgaggcttttttacctacaaaatgaggcttttgaaaattttgatctgggaaccatgatttaaacctattaaaaataaaataaaacaatagccattttcccttcctagcaaaaagctatcctctcaatttccatttccataattacttacaattagactggttttaagcttttttaacaagatttctcattttaaatttcggagtttggttttcaaaaatg

SEQ ID NO: 115598 - DNA, 525 bp, Heterodera glycines
  Promoter: Source sequence=SeqID_22381; Location=1..525; Strand=+; Gene=SeqID_53051
cagcagttttttaaatttttccgtttttttctgtatttaaatgtgtcagatcaccatgaaggattaatctgatcatgttaatgcaaatgtaatctgcataaaaagtgaaattagagcatttttcagagctttttggcccataaatgaattgaattttcgtacataggcttaggctaggcctgagttttaggctaggtgttttttaaaatattccataaactattttcttacttttgcttcatttgaaaattagcaaaaattaattttacgatataattaagtttttgcatttaaaatacttatacctatattgatatttccaaatattttactttaatctaataattagattaaaatcaagtgcatgaatcaagtgcttgatttttgcacttttcgtcgatcgacatagcaccaaaaaaagttagaaatcgagacgaagagaaaatacagtcaatacggggcttatcccttcccaagccattgagtctaggaccaataaactaaatgtggcaaagtgccaaaatg

SEQ ID NO: 115599 - DNA, 775 bp, Heterodera glycines
  Promoter: Source sequence=SeqID_7638; Location=1..775; Strand=+; Gene= SeqID_65490
attgaacggtcgaaatgaccgacggtgagagaaaattaagtctaaaaaaaagaaaaagcattttgcattttcagccggacattcaactgttatggcgaccacgcgagcggcaacttgtgagttaattaattggtcatttaaaagtaattaaagaaaaattggaaaatgaaaaaatcaacgattaaaacgacccattctgttctggtttgtacacatccgctgacaaaatgttgatcaaaaacaacaacaaacaaactctcgacaaaaaatgacatgacctttttaattttaaaatattttattacacaaaaaaacatttcaaataaagttaattttctttcaaaaaaatcatcactttttttctcattttatcagttaaaatgattgtcattttatcgggacccaattatgcttttaccaattttccgcttctttgaaatttaatcctttcttcttttcttccatattaattagaaatgaaatgccgcctcacgcaaaggcaaaattggagaaaaaatatattaacgagaaggataagcacccatccgttttcgttggcatttcctccatttgtcccacaattgattccccccccctccgttggcatttttctctccctttgcctttgacattggcacaaattaataaatgatacaaattcatctgaaaatttggcacaaaaataaattctgagcggtttcattctcgcgaaatggcatatttgctcaaatattacacatgtaaaaagcgaataattcaaaataaagtgccaatg

SEQ ID NO: 115600 - DNA, 729 bp, Heterodera glycines
  Promoter: Source sequence=SeqID_7808; Location=1..729; Strand=+; Gene= SeqID_66030
taattttacatttaatccatgccaaacgtagcgcaattgccccataaaatgcgaatgaaacgatcaaatacgtccaagagtaggggtaaacatctaaattaaaaaatgttttaattgttttattaattaattttacataggtaaaatggaactgaaatgatggccaacagatgcattacaatacactggatgaaaattgtcctaaaattgaaaaatatatctgttttttaaagttatctaattagcatgattcttggtaatttcggtagtttaagctataagcgaaaatgtcaaatttgctgattccgctgagggattgtaattcaaaatatttttgtgaacacgatatcccacggcattaatcccaaaaatgccgcaattgccaaaaaatgctggattgcggattggaccccgtaaatttccggcgccgaccttttattagcattatttttaggggtatattttatgaaatttttgaatcgattcttaggtgtgtatttttggtatttaatgcatatttgctatgaaatttcaggaaaaggggctctaattattagcattaattcttttcgtaagtttgatattttaggcatttgaccaattaccgtacaaatgtacagtaagtatccttgtagtgtttttgttttctctcacttttttgtgactttttgtgcataatgaaacgggaacagtacggcatgggcacggtttgcagccactgcaacaatg

SEQ ID NO: 115601 - DNA, 52 bp, Heterodera glycines
  Promoter: Source sequence=SeqID_16680; Location=3849..3900; Strand=-; Gene=SeqID_81081
tcaagcgcaactccttgtttgttttacacagctaacactacttcgatcaatg

SEQ ID NO: 115602 - DNA, 153 bp, Heterodera glycines
  Promoter: Source sequence=SeqID_44854; Location=1338..1490; Strand=-; Gene=SeqID_72268
tttgcggattttttcaaaaatacagctttgacgatgtacgcttcgaacacagccttaggatcgtttccatactacagaattttttaaattttatttattgttttctcttgattattttttaccgtttccacaatatacggtaagcacagaatg

SEQ ID NO: 115603 - DNA, 160 bp, Heterodera glycines
  Promoter: Source sequence=SeqID_30486; Location=1136..1295; Strand=-; Gene=SeqID_60892
atttgacaaattgaacgaatttaaaattttgaaaagaaatgctgaattatatcaaacgtattattacggagaatacggattatgtttttttggggaagaattcctatataaatcagttgttgaaaaaagggattttgttgagaaggaatttttaccaatg

SEQ ID NO: 115604 - DNA, 114 bp, Heterodera glycines
  Promoter: Source sequence=SeqID_1503; Location=3516..3629; Strand=+; Gene=SeqID_74021
ggtgcatgtgaccgtgacgtggagcatcacgtttccaacagcgtccagtcactggtcaggattaacaaccccaacgaccggcactgcctcgcgcgtgccgttgtcttggggatg

SEQ ID NO: 115605 - DNA, 420 bp, Heterodera glycines
  Promoter: Source sequence=SeqID_42745; Location=723..1142; Strand=-; Gene=SeqID_70568
ccaaacatgcacgcgttttgcgctcgagctatttatcatcgggctgtcaaatccaaagcgaaacacaaaagatgctgttttgacgaaataaaggggcataggtttttttgaagaagtgtcaaagaacatgcagcaataagcctgcaaaatctaataagtggaaaatacatgagtatagaatttattttcaaaaagtgtcaacagacttttggaaaaatatatttgcaatttatcaacaattttgagaagtgagttagaaatgataaacttcacgattcaaaccaattttcggtgctctaattaaccgcgataaaaacatccgaatcaattaaatagcttctgagataataaggtttatcataaaatttcatttaaaaataaacactcaattattggtatgaacgatactttccaaacatg

SEQ ID NO: 115606 - DNA, 1003 bp, Heterodera glycines
  Promoter: Source sequence=SeqID_44030; Location=160..1162; Strand=+; Gene=SeqID_71582
aataaaattaaatttgtttgatttgatttggtttcaattaatttatttgttggattaaattatcaaaatcaaatcacaaaatagagcaattccaaccaactgcaaattgacaagcaaaaatatccaaaatataaagaaaatcaaatctcggcatgaatttcattaattaattaaatattaattaattaagtatttttcagttcataaatttttgtacaaataaaatgtaataattttacatgtcaattcattacattcacttttgagaaaatataaccaaatggttgtcctttcactaattggccaattacctaacttaattaattaattagtgttaattaccaatttcgccccattttcacttccattgactctgcgcaacgcccaaaaaaaaagaaaaaaaaagaaaacatttgcccgtcggcggagtttcgtcgcccattttctccgttttcatttacgcccattcggcccgtctctccgtttttctgttttcactttttttgctgcgcattttacaatttttgagttccaccgctgcgccctttcccaacccaaaaaatgaaaatgaaaatgcaattaattaatttaaatttttattttctttttttaaattttcttttttcgcccatttgtttgcccctccggcgaatttccaacggccgaatgttttttttgtgtcaccgccgcgtaacggcccaattttggggcgccgaatcgttccactcccgcaacaaaatgacgacaaccaaaacgacgacgacaacgatgacatgaagacgcaaaagatgacattgccccgggcgatgggccccgggggaagaagcgtatttaagcggagagaagtgggggaagggcatcagttgcagttcaaccaacagcagcagaagcaaaagtgaggcaatagttattcaaaacaatttaaaatatatttaaaataattaaattattcaaattaaattaaaatccaatttcaatttaatttaattttcaattttagatg

SEQ ID NO: 115607 - DNA, 731 bp, Heterodera glycines
  Promoter: Source sequence=SeqID_11670; Location=1..731; Strand=+; Gene=SeqID_75137
tcttttagtaatcaaaagtatttggaattaattattctgagcagtaatggttggttggatgattcacattcaatcagttgtcatcacaaaaaatggctaacattaggcaaaaaatccaaaaaaaaagtaatgtgttgaattatacaattagaagaaaaaataatttatcgattttattaataattattttttaattaaatgatggagctgaaagaaaaaataatttatcgattttattaataattattttttaattaaatgatggagctgattgtgagttattttttgaggttttttgaaaaaattttttatgtaagcttcgtcggcggcataacaaaactcaaaaaatttaaattttcattatgtgaagcaaaggaaaattatataaaataaattaaattgaatgaccacaaattaataatttcattttgctattttatgaaagcgagaaatcaaatgcatttgtctcctctgaataatcaaaacgaattatgcatttgcgaaaagcaaaaataatttccataaattccattagagcaatgcgttagagaggagttttaagcaaataaatattctgattttcaatcacaaattctcttcacttggaaaatttttataaaaagaattattttgtataattaacataatttataataaaaaattatacgcattttaaataattaaaattcacagttacagtaaccaaccaaccaaccaccgtgtgcgcaatg

SEQ ID NO: 115608 - DNA, 108 bp, Heterodera glycines
  Promoter: Source sequence=SeqID_41882; Location=1..108; Strand=+; Gene=SeqID_69921
cttatgaattattttgcaaaaataaatattaatgaaaagtcagatttcgaaaaattttaaaacaacaagcgttggcattttttcaggttaagttagtcctttacaatg

SEQ ID NO: 115609 - DNA, 230 bp, Heterodera glycines
  Promoter: Source sequence=SeqID_15396; Location=1..230; Strand=+; Gene=SeqID_79658
tgagtcaaagactcgagactctcgacaagcgctaatgtgatttttaattaagaaaagcaaccacgtcattgtgacaatatgttctgcaatatgtcttgaccttttccccgcattgatcagcttcgctttctacattgtaagccaattatttacaatatatccaaataccaaaattggaatttaaaatattttaaaatattatattaaattatgaagatgcaaaaattatg

SEQ ID NO: 115610 - DNA, 84 bp, Heterodera glycines
  Promoter: Source sequence=SeqID_6121; Location=4221..4304; Strand=-; Gene=SeqID_60437
tggggaccccgactttggtaaatgaattttaattttaattaaattgtaaatttttatttttattaggtcactgtgcgacgaatg

SEQ ID NO: 115611 - DNA, 665 bp, Heterodera glycines
  Promoter: Source sequence=SeqID_24789; Location=1..665; Strand=+; Gene=SeqID_55530
ataataaagttgagtgtttgtatgtatccgccttgctttgaattggcgtggcgttttgttattattttgcgttaaaaaatgatttgaaaatgaaaatgtttttgttttgttttgcgttaaaaaatgatttgaaaaatggaaatgtttggttttgatttttcaatttgttctgattaattaatgcatttgcatagtattttatgtctatgcttatagttagtctattattgtgctttagtctttgtctattttttatgatttagccaaaaatgaattgtttacttaatttgaattttctacaggtttgatatattgactttctctctgccgcttcggcatttttttttttcatcaacggccggtcggccatccatgtcttacccaatacttttgatgtgtgattttagttgaagtttgttttgtttggtttttatgcaaaattatgtttataaaatttagatatgacatgaagaactaaagttttatgatcgctcatggttttgtattcgttgtgaattcattcacaagtttgaaatctgccgtggccatcattcaacagcttgtccagattgagtttaagtgcctcatcaaagtttattgggattaatttgtttcgaattatattttgctttgttatgttaattattatgtaaaatttagaaatg

SEQ ID NO: 115612 - DNA, 580 bp, Heterodera glycines
  Promoter: Source sequence=SeqID_11709; Location=631..1210; Strand=+; Gene=SeqID_75199
aataaataaatacaaattaaataaaaaataaataattaattaatggaaaaacaaataaaatatttgttaatatgaaatacaaggttcccggtgatttcgtcagtggaaattaattcataaaaaatcgtacacttagccaaattttacaaaaaattcatggagtcgtaagaataggcttgtaaatattctaacgagtcacgatttgcaaaatcctctgcaagtattctcaaattgttgccctgcagaacccattatgatttgtgcttttcatgtgccccttcttcggtcagcggggctgcgcgaaaattagttacttgtacacactcgaaaaggtgaacgccacttccaacgtgatcggctgacgcctacgattcgatttgcagacagaaaacgaactaagagcatcaacatactcaaagtgcagacattcaaaattattagtaaaaaacaggggtggaacgctgacagaaagatcccgcggttgcggatcacgcattcaaattgccgggttgcggatcgcggtcacgctccacccctggtaagaaatttaaaagctaaattccgacattaaagcagaatg

SEQ ID NO: 115613 - DNA, 87 bp, Heterodera glycines
  Promoter: Source sequence=SeqID_14340; Location=1..87; Strand=+; Gene= SeqID_78370
tttgatgtcgtcaaacaccgtataacagccagttccgctagcacctgccatactgtagccaaaggatggcttcgtcgcggcgctatg

SEQ ID NO: 115614 - DNA, 252 bp, Heterodera glycines
  misc_feature (50)..(55): n is a, c, g, or t
  misc_feature (57)..(58): n is a, c, g, or t
  misc_feature (61)..(70): n is a, c, g, or t
  misc_feature (72)..(74): n is a, c, g, or t
  misc_feature (76)..(76): n is a, c, g, or t
  misc_feature (86)..(89): n is a, c, g, or t
  misc_feature (91)..(93): n is a, c, g, or t
  misc_feature (97)..(97): n is a, c, g, or t
  misc_feature (99)..(101): n is a, c, g, or t
  misc_feature (103)..(104): n is a, c, g, or t
  misc_feature (179)..(179): n is a, c, g, or t
  misc_feature (191)..(191): n is a, c, g, or t
  misc_feature (237)..(237): n is a, c, g, or t
  misc_feature (246)..(246): n is a, c, g, or t
  Promoter: Source sequence=SeqID_35360; Location=1..252; Strand=+; Gene=SeqID_64930
atatatttaaaatttaataaaagtgtttattattttattcaataagctcnnnnnngnnttnnnnnnnnnngnnncntctttaaggnnnntnnnttgntnnntnnttatttatttatgtgatatataatgagtatgtaattgaaattgtttattatataatataattttatatgatttantgagtttataanatttaaattttattattttgattataaatgatagttttttaggttngtagagaanggaatg

SEQ ID NO: 115615 - DNA, 277 bp, Heterodera glycines
  Promoter: Source sequence=SeqID_10028; Location=571..847; Strand=-; Gene=SeqID_73078
tttgcggcaaactagtttactggtcccgttttttttatttgaaaagcctggaaaaatttttctagggctattttatggtgctgagcacgaatccggcattatttttgacaaattctgaacccctaacccggattcgaacatattttcaaacaaaaaatttttttttattgtgcatataatatgcctaaataaatgtgatttgctgcatataagcgatcatttgatcacgcattcacggggtaataatgggaaatttgatcaacaatgttgtcgaatg

SEQ ID NO: 115616 - DNA, 426 bp, Heterodera glycines
  Promoter: Source sequence=SeqID_42920; Location=583..1008; Strand=-; Gene=SeqID_70712
ttaaacccgaattaatccgaagcgacacgaaccgaccaaaagacgctgaaaagcaccagcaaatacagaaaagtgggaagaaaacggcggacggtaggacaaaacaattcaaatgatttaggaagagtttctcaaagaagtaaaggtaattaggtaatcaagttacggaatttagataattctgggaaaaaggctgctgaaaatctgaaacaaaacaatgtccaacaggcgaaaaacggggagagcaaacgcagtaaattgcaagaaatgatcggccaagccaaaaaaactgttgaaaatgcgctcggtccttcgcacggatcgttgggtgagaaaatacaaaaaaacatttttgaatgttttcacagagagtcaccaaaattcgattgaccttcgtcaagaagtggcggaaatcaattcgaaatg

SEQ ID NO: 115617 - DNA, 573 bp, Heterodera glycines
  Promoter: Source sequence=SeqID_11292; Location=1..573; Strand=+; Gene=SeqID_74664
atcattagtggtggtgaagacggtgttcatgttgattttctttgtccagtgagtgttcgggttgctggaatagcatcattaaaaacaatttccaaaattatataaaattttttaaatgccagccaacccattttgtttgaaaatttaagaaaattttcggtggaaaacgaaaggctcccaacccgctcacccatatttggcaaaatttgtgaagaagccgccgatgatgcgcatcatttgcttgtcatcccaattcggtcgaaatttggcgtacaaacccttgcccagcaaatagcgcgcgtcatgacaatgggtggcagctgaggggggggggggaaatgctaaatttaacacaaaatttttggatttttaccgaaaatcgattttaagaatttttttttatttaaacaatgtcgagtgaatcacttgtccggtctctaatactaattcatacccgaaatatgaaaaattcataattcaaaatttaaaaaaaaatcataacaaaattttaacaatttccaaggtttcgtatggacgtacattctttccgaaattccccccccccccaaaatg

SEQ ID NO: 115618 - DNA, 74 bp, Heterodera glycines
  Promoter: Source sequence=SeqID_15901; Location=1987..2060; Strand=-; Gene=SeqID_80247
tcgacgttccgacgctccgttgcgcagtccaccgccttgtcaaccaaattcgccgccgtttcccagtggaaatg

SEQ ID NO: 115619 - DNA, 493 bp, Heterodera glycines
  Promoter: Source sequence=SeqID_36327; Location=1..493; Strand=+; Gene=SeqID_65670
aaaattcaagttaaaaaccaaccatccattcccgcaagtgattgtcgcacccacttttccttgcgggaatgttcccacaccgttcatgcgcccctcggcattttgcacgacggcaccaggatgcttgatggtgtaaatcaatgcaccgaatccgtcactggtcagaaaggcacgccagtcaggctcaacctgcacgaaaaatggattacctataacataatcaccagttaatttttgtcaaattaaggattaaagggatgatttcatcaaaattaaattttgttttgccaaatgattttgtaaaagaactttttttttaattcatttttttttgctcttttataaaggtgcattttttgtattttatttaaagcgcttatgtattcattagggttgtaaattatatggactaaaaaacgcgaaatatggacattaaatatggactaaaaaagcccgaaatatggactaaaaaggccaaaaatggccaaatatg

SEQ ID NO: 115620 - DNA, 463 bp, Heterodera glycines
  Promoter: Source sequence=SeqID_11930; Location=972..1434; Strand=-; Gene=SeqID_75451
ttttagattattataaattggtttttaggttgtccaatttgagtccgatcagcctttctccgatcactctcctcctgctggtcatccgcctgatcagaatttctctgatcactcttctcctgctgaccaccagaatacatatgatcagagtttatccgatcattctcttcccgctgatcatcgtcactcctctggccaacctatttctgatcgctcgctttccgctgatcaccgctattcctgcgaccgttccgtgcctttgccgacggtctcttccccgtccgccacagtcttttccgcctgttcctcatccgcttcatccgcttcacttccgtttgcgcctcttccgtcctcccagcccgtggcttctcctccgccgctgacgatggcttcagttccgtcgccctcctcagcggttcagcaccaccagcctcccgcttcttttgttgcttcttccggcatg

SEQ ID NO: 115621 - DNA, 130 bp, Heterodera glycines
  Promoter: Source sequence=SeqID_7407; Location=749..878; Strand=-; Gene=SeqID_64732
ttggttcactcacatttcactatttttgaataattacggtgacaattaggggacggaaatcctttgaggatgacagttatgacgcgaccaaagaagaattggactacagcgactgggaagagggcaaatg

SEQ ID NO: 115622 - DNA, 362 bp, Heterodera glycines
  Promoter: Source sequence=SeqID_1177; Location=1071..1432; Strand=-; Gene=SeqID_69399
ttacggggccacggtgggacaaatagcgaaaacagacaagtaaaaattttagcacgactgaaagaatttgaacaaaagttgtttgttgcgattgttggagatcgaggatgtggatcagtcaaaattgccctccaaattggaaatttgctctccaacgtcaattcgcccaaaaatttgactttacttgcgttttgggagggacccgagacccgctcggaaatggaagcgcgcctaggtccggtcttggaacagcttgagcaaatcgcggatttgtcatttgatcgaaatttgacgattgaatggtcttataattttttaattcttttgcacaatctttcttaaggtttctgaccggcgacatg

SEQ ID NO: 115623 - DNA, 315 bp, Heterodera glycines
  Promoter: Source sequence=SeqID_4037; Location=3752..4066; Strand=-; Gene=SeqID_52922
ttcttcaaaaaagagcaaatttgccttttagatgaagatgactagaatgtttttgcaaaaatttaaaaataaaattgtaatataatagcaatttaatttttaattggacctgtttaacattaactcgacctatatacctacagtacattcctatcagggatggcacggaatccgattaccgaaaaaatttgaggcctcgaaatgccatcccggctacatataattagaagcagaagtattttttctagtggtttttcaataatttagtattctacaacaatatatttttgtaaatttgtgcagcactttgttatg

SEQ ID NO: 115624 - DNA, 60 bp, Heterodera glycines
  Promoter: Source sequence=SeqID_2209; Location=1..60; Strand=+; Gene =SeqID_78485
catatatttatcggaattttcgtcaaaatttgtaaatgtaataaggtgagtctaaaaatg

SEQ ID NO: 115625 - DNA, 260 bp, Heterodera glycines
  Promoter: Source sequence=SeqID_13086; Location=1..260; Strand=+; Gene=SeqID_76873
gggttgcatttgtgagattttgtcggatgattctgtccgtaatcagtattttttcatcacaactttgctcaattttgcgtgcattgtttgttatgtggccattggagggataataaaatacaaaaaagggggcaagtgccgttaattaattgccaaattttaaatttttgttaaaatttgccaagcttaatttgagtttctcataattcgaaattgatcattcttcgaaaggcaattttccagcaccttctcaaattatg

SEQ ID NO: 115626 - DNA, 252 bp, Heterodera glycines
  Promoter: Source sequence=SeqID_17160; Location=876..1127; Strand=-; Gene=SeqID_81599
cgtgtcgttgtcgatggagtcggtgagcagcagaaattagatgtaatagtgcagagaatagaattaagaatgtgaagagaatgaaatttctctcaatttcacgcctttttatattcaaatttcccactgaaaaaaagtgcaacagaaaatgcatataaaatgggcgaatttttgtccatttgcacatttgctgctgacacgacacccaatcaacgaacgaacgacttcagtgcgcccaacaacaacacaatg

SEQ ID NO: 115627 - DNA, 1003 bp, Heterodera glycines
  Promoter: Source sequence=SeqID_7826; Location=2172..3174; Strand=-; Gene=SeqID_66086
tataaataccgtacagagtattaatttatttaaggccaattttttgttttttcgtaaacaaaaatataaatcaaatatttgaaataaaacttttaaaattaatgtttagcaaaaattttattatcattataaacaaatctgattattttgctaaaaaatttaattgcgttattaaattaaaaaaaccaacaattattagttttcattattatatgttttttatttaacttgaataacccatatgcgattttaattaaaatttcattgatcttatttactgctaataaattaacgacataactttatttagtgaaggatttcagggagcgcctgctttaacaaatgaatatttttctaaaaatatttgatgatgaaaatgtataaagcagtagaactttcaattcctatatgtgtattttgtgaaaaatttattattaattgaatgcttttttaaaatttaattttttttttgattaattgcgacaaatgaaaacccagcccaaaattgttaatttgattcattttttcctctttcattttaattaccaatttcatgggttcggatccgctgggcattattctctccattattttttatttttttatgaatttttaaaaatttggtcatttttatctatttttcgaaactttgatcacttttttctgatcatttttgaatattttttttcaaaattggattagtatataaaattggaaaaaccgaaaattttttaaggaaacactatgagatagaaagcacctctgatcacttctcgaaaaattatgagggatgaaattttcactaaaattaaatttgttcatatgtagattattttttcaatttattttctttagcaatcaatttttagtacactaattgtcaatttttttattttatatattcgactaacatataaagccaaaaaaatagagaaaaaaatacatggccatagaactagatatagtgagaaaaagatattgaagattcttttttttaaaaatg

SEQ ID NO: 115628 - DNA, 60 bp, Heterodera glycines
  Promoter: Source sequence=SeqID_9477; Location=1153..1212; Strand=-; Gene=SeqID_71559
tccacccgttttttcttcttccttcatttcccccattttcaggttctttctgttggtatg

SEQ ID NO: 115629 - DNA, 1003 bp, Heterodera glycines
  Promoter: Source sequence=SeqID_3308; Location=2507..3509; Strand=+; Gene=SeqID_84155
gaagccgaagtttcgcctagccctgcctataatgggcaatttgcccatttactcactttgaaaatgcatgcacctgtcaatttgttaatgcatttgtccgaatttctcaatattaattcataaaattgtttgccgaagaatttaatgttgaagagtaacaaaattctcgataaccttttcaagaaaaagaaagtcataaaatttttatataatattaaacacctaaataacggcaagaacaaatttatggttaaatttcctttttaattaaattttgaagcaaaaattaattagtattgaatatggttcttttcaatattttagttgttttttttgctcattttcaagggcatcttgaattcaagggtattttcaaattttcatgtgaggggcccagtttcaaggacgtccttgccattcaaggcatataggagcattgttcaaaaagtattatccttattttaagcctaagctggtttgatgatttttcttaaaaactccccccacgtcctcgccagttttattaattaccctcaacgcgtttttgtcttccttccttccaagatttgttgcttttgttcctcatttgcttaatgctttttcttatctgattgtgctttcccttacgttgaattcaacaaaatctctgcactttttcattaacttttgcttaaatgcaacaatttgtttcctttttatgtgcaagaaatatcgcattttgtgtgttattaatttcctcgttaatatggtaccatccttttttttaaaaattttcatttaaaaatcatgaagaattttccgggcttttcgaggtcactattcacgaatccggtatccatttcggcaaattccaaagcccgaagccaaacttgaacaaaaagtcgaaagtccaaattttcgagtttcgcatttttggttcaaaaccggcctaaacaaacggaaacaaactgaaagccaccaaccctgcaataaaagataacttaaactattagatataaaaatg

SEQ ID NO: 115630 - DNA, 258 bp, Heterodera glycines
  Promoter: Source sequence=SeqID_16680; Location=295..552; Strand=-; Gene=SeqID_81082
attgcatgagaaaaatatttttatttatatatttatttatcactatgtcgttgttgtgatctgactttattttcatgtgtgatctccatatattctccatttttgtattcaccgatcttcagagtaagtggctaatgcccttctgtagatattttattgactgaataaaattatgcgtaattttcttaagcacaataaaatcacaatcaatttttttttaaaaacgccttactttaacttatttaaatctgagaaatg

SEQ ID NO: 115631 - DNA, 540 bp, Heterodera glycines
  Promoter: Source sequence=SeqID_10268; Location=1261..1800; Strand=-; Gene=SeqID_73428
tgaataaagatttttgcggaaagaattttttcgttttagaaagtggcaatgaaattgtaaaatggcagggcaaatgcttataaattctattatcaaaaagatgatgttgactttcatttcgttaaataatgattttttatgcaaaaaaaatttcattcatctcagaaaaatatacattttggtgccaataaattatgcataaacatgttcatttgacagagagttaagccattgatttttattttagccacttaatttattacctaagtgaataacggtgaaaattgatttatataattttattcatctactgtcatctactgacaatatttttaaaatgcaataaacactaaaactgcaacccaaagaatcggtcttgtttgaaattttaaggaaattttcagggaggttttcaaacttaattttttcaaagacccagcaaaaatatgtcgttttttggtgattttgtgctggtaatgcaaaaacgcctgttctgggcgcaccattgccggaaatgctcaaaaccatgccattcaaatg

SEQ ID NO: 115632 - DNA, 418 bp, Heterodera glycines
  Promoter: Source sequence=SeqID_4996; Location=6629..7046; Strand=-; Gene=SeqID_56488
aattaccaaaaaagttataacatgaaattccaaaaaagtcgaaatttttgagtttttttcttaataacttttttagaagctaaaatttttgtttgttttttgtaaggctaatagagcttgtgaagggctttcgaatgataccaagattgttagatttggtcaacaagaaaaaaagttataataaaaaaactgaggctggcgccaaaacgtcggcgccaaaacgacccagtcccaaaaatttttaaaacttacccttttcatgtctttgagctggttgataattttgcatgaatttcaatgcctttttactgagctaactctctaaattgtccctcaattttatcgtaaatttccatttttagataaatttttccattttaaatttggccacgagagcagaataaaaaaggagagaatg

SEQ ID NO: 115633 - DNA, 497 bp, Heterodera glycines
  Promoter: Source sequence=SeqID_22846; Location=1785..2281; Strand=-; Gene=SeqID_53552
aagggtccctccccccttttgtttcaaaagtccttcttttaatatagcgcctccatacatatttgaggggttcttttgcatattttaggcgcatatttggaatttttagtgcatacaacgtataactagggagtctaaaaaaatgaatataaaatcttgaaatatgcgcataaaagtgaaaaatatgcatataaatttttccaaattgaagcttcaatttagttaaattaagctaaaaattccgaaaatagctaatattgctcaccgatgtctttttttccaatttctccaactttcccaataaattttatcggaaaattttttgttgccgaataagcatgcctcaaaaaataaaaaatatatttttttaaatttaaaacttgtttggtagagacgtactgacgagacccaaggcccgctcttccattctacatatttccaaacaaattcttttgtaaaaatttttcaataaatatttttatctttccccgaaaatg

SEQ ID NO: 115634 - DNA, 718 bp, Heterodera glycines
  Promoter: Source sequence=SeqID_14758; Location=818..1535; Strand=-; Gene=SeqID_78887
aaaccatagtacgctccaatttataatttttaattaaaatctgtttttgttatatccgtttgggttttgcgattttcccattaattgtttgttttccactttttcctttacaattccaattcctttaatatattcaattaattattaataatttgtttagaacgcaatccttaacagaattcgccatttaatattaattaattttcgttcctttcattcctgaggaaatgcacttttccttttcaaacaattttccgttattcatttcaaaaggttttcaagaagtcaggaaaatggagaatgggccgggcttttataccctcacaaatcaatgggggcggggccaggcacgtgaaaaatgtgcacaaacaaatagaaaaaaatccataaaaatatgaggaagagagaagatgactcataattaacgagcgagcgaatgcaaaattgatcgatgaaaaggattaaaaaataaatgaaaatttccaagaaatttgtgtcgcttttggcgacagcaaatattaatttatatttgcgtagcctcaaatgagcattctgccttcaatttcgaagggaagtgaatttttttataataaattgatagagagcaaaaagcacgatagtataatattcaaaaaatttatctatgcatttgttgaatgttcctaaacccgatcaaattttttaaacctttatatgaaaacatttattgcaggaaatg

SEQ ID NO: 115635 - DNA, 355 bp, Heterodera glycines
  Promoter: Source sequence=SeqID_13597; Location=2370..2724; Strand=-; Gene=SeqID_47144
ataaataaatgaaaatattcatagttgcactttttgactcgaaccaccaccctttgtccctttactatcttactaaaaccacgtgagccacacacgcaaatcttttttggtacagcagctcatttctgggatggtgtgtcaatgtgaatgaatttcccttctcgtgactttcctgacaaaatctccaatcgaatgaatgactcatcatattttgttttctttgattccctttttaattatccctttttggcatttcgttaattttttgtttttcccttttttcagtgatcttttgcttctgatcaccgactgatcgatcaatcgatcacttcgttattttctcggcaataaaatg

SEQ ID NO: 115636 - DNA, 151 bp, Heterodera glycines
  Promoter: Source sequence=SeqID_25624; Location=1..151; Strand=+; Gene=SeqID_56377
taaacatttaaagtttcgaccccaaaaaaaggattccgagttagatttttgaggtttaaagaacatttgtacgaaatcaactggctcagattcattgtctaatcatttacgcataatttaggtctgatttcggcacttagttccgcgaatg

SEQ ID NO: 115637 - DNA, 138 bp, Heterodera glycines
  Promoter: Source sequence=SeqID_16960; Location=1871..2008; Strand=+; Gene=SeqID_81390
aaaagaaaataaacaccaaaaatttagattctctagcttttgctcatcggaaggggcgctgtccgttggtggaggggaaatttttggggtaaaacataaattttgaaacgcatttaaattgtggttttaagggaaatg

SEQ ID NO: 115638 - DNA, 63 bp, Heterodera glycines
  Promoter: Source sequence=SeqID_13328; Location=1707..1769; Strand=-; Gene=SeqID_77192
acacaattaattgattaagagctcaatttgttaatgggttgacaggtaaatttgactaaaatg

SEQ ID NO: 115639 - DNA, 401 bp, Heterodera glycines
  Promoter: Source sequence=SeqID_2238; Location=1933..2333; Strand=-; Gene=SeqID_78644
ggtattaattttaaaaatttaaaaaatgacattttccttttaatccgtccgctctcattttgttggtttagaaatgcggaatatgtgccgttcgtgtcgctatgacttgtgcattcggctcggcatgaacagagagggtcagtttttaattggatgggtttctattacgataatcgatgcattccgaacccccggcccaaatcgaacgaatattcgggttttctttgattcaaaatgaatgttgcattttcgtttttagttttctattagcctgcaaaatatcaaaaatataatttctatttttacaaaaaatgccaacattgggagggagggacagggggcggagacccgactattacgaaataaaaaaatttaaattttttttttcagacgtccaaatg

SEQ ID NO: 115640 - DNA, 65 bp, Heterodera glycines
  Promoter: Source sequence=SeqID_28796; Location=1..65; Strand=+; Gene= SeqID_59374
cattcaaggttggttattaaattaatttcttcgcttttcttttttcagcagaagcaactcaaatg

SEQ ID NO: 115641 - DNA, 1003 bp, Heterodera glycines
  Promoter: Source sequence=SeqID_23900; Location=862..1864; Strand=-; Gene=SeqID_54592
aagtgcgaaattcaaaaattttgagtttttcgccttttttgttcaaatcattattcggggctcgaaaatggtcgaaattaacaacaaaatcatgttcagaacttcgaaaaccattagaaacttattttttcagtgacttttaaaagctaaattttattcaaaaatggggtcattccatcggcagtattaccgaaaagagcaaaagtagttagttaccagggcgggtagcgggtagcgggtggtgattgatgggttgcggtttctttgaaggtgccgccgtgattaatgagtgcgggaatgagtctatgcctatggggggggggggtaattaattagcgtgggtgcctgagggggtagtttttgcgggaaaatttcccgcatttgtgggggagaaaacttttttttgtgaatttttttaaacgtttattaattatgtggtaattaagggtgtgcctgtgggggtagttttttgcgggaaaatttcgcgcatttgtgagaggtgtcatttggggggggacgaaattaatatgcattgtgaaggggagggcgccgcagcatgtgtgagagaaaagtcagagagaatataaatcaaagagaatgtgagatagttagagaaaattatgagagagaaggggggggagtaaaaatgtgtccttttcgtgtcatacgccggggggggggggtgaaaaagtaaaaaggtatggagcaaaactttttggccaattacatagatcagataaatattttgtttatgtttttgatcaagaggatgtgtgtttattgggaatggaaaatgaatgaaaaagaaattatgcatgaagttggaggggggggggatggtgaagttttgttcaaatgtggataacttacatggcatataaacgaaaatctttggatagaataaagaaatctcggataataaaatccggaattgattaattaatgttaaaaatttgtttagaattctttagtgatataatattcaattttagtgttaaacatg

SEQ ID NO: 115642 - DNA, 1003 bp, Heterodera glycines
  Promoter: Source sequence=SeqID_7166; Location=893..1895; Strand=+; Gene=SeqID_64026
aatgcggaatgtcaccctgctcaggaaacacagacatagacgggtgttctgtgattgcgtatcgtatcaaactctcctcccaatcgcgtttgttttgcgcatccaaccgacggaaaatttcataatttgtatcaataccatcacggatctaattaaaaaacaaaaaaaaaatgaggaattttttttttttacctccgaccgaacgtaagtatgaggttctgggaaaggcggtaaaaaatttggataatatgacggaagcggaaaagggtcagaaatgcggagaacgggcgacgcttttgtcggcgattggggcagcactgaaaagacagtgttcgaattatacaactttcaccgtacacagtaaaggggggggggggggacgtaaaaggacaattgggcacctccgactgtgcaccatagggcctaaacctgggccaaaaagcgaagagggaccagtatgttttagaatttctaataattttatttaaaaagttctaaatttcaattttttctctccctggaccactccccccccccaaagcaaattatcccgactcattagttaataatgaatgaattcattgaatgccaatgtgttgcactcacatgaaaatgtgtgcggtttgctttggtgaatcgtgtccaaaaatgtgtcaaagtcggccaattccgggcgcccctcattcaccaaggccatcaaaacatcgccggcattgaccagcgaacgacccgtatgttcacacaatttcctcgaggattggcaagttttggagaaaactgaaaacattttttgatcatatttaatgagggataacaatgctaaaaagtggtggtacattggtgaaataaaaaggataaagcctccaaagagcccttctgagcagagtcaaaaccaatggaatggcaaatggaagcggcacattggcgaagaacccgtctaaatatttaaaacaaatttttcaaaaatatatgaaacaaatccaggaaaggccttgaaaagatg

SEQ ID NO: 115643 - DNA, 921 bp, Heterodera glycines
  Promoter: Source sequence=SeqID_4475; Location=382..1302; Strand=-; Gene=SeqID_54578
tattaaagcatccaaaatcaaaaaaaaatccctccatttaaaaaaacttttcttatcttatttaaccttttaaacaaaaaaaacaaaataatttaaaattgtgcctctttcaatcggcggcgttttttcaaaatccggcaaaaaaataaaataaaaatttatacgcaaaagccgccaaaataaaaaccacaaaattaaagtggtcaattaaaacgatccaagtcaataaaaattaagaaattttgaaatgaatggcaccgaattttaattaagcaaaaaatttagcaaaaaacgctaattcattttcattatgcttaatctgaacaaaggacttttattatttcatgtaaaactttatttaaaatccattttaagaattgtttttgggaacaaagaaaggagcaattagcgcaatttttgccccctttctttgtgaatggcatttggcacgtgccatcaccaccgggcccccgccgtttgtttattggcattattttcttttgtttatttatttgtccattggtcggtcggttggctttgtgtgatgatgcactttttgcgcgttgccgccaccacaatgtaacactaattgaataaataattataattgtgtggcaatttgtcggggcgggcggtgattgataaataaataaatgccgcggggccatatttatttatttggtatttatccccaacaaaaagtgcacaaattccccccccccccccccagcatttgtttatatttatgtatttgtgtgtgagtgattcaatgtgttttttttgcttccttttatttgccttagtcgagagtctcgacagaccgagaaagagccgaaaaggtcgcgaatctcgagactgattcagagccataacttaggttattaatacaccctccctgtgatcatttttagactgacaatg

SEQ ID NO: 115644 - DNA, 116 bp, Heterodera glycines
  Promoter: Source sequence=SeqID_23641; Location=916..1031; Strand=-; Gene=SeqID_54337
ggtttccgatggtggcacgtgagtacgaggcgtgccgggaaagtgttggtgcgacccgttttctaattttgactatctaaaatgcttcgaacccattgttaggcatcatcgacatg

SEQ ID NO: 115645 - DNA, 330 bp, Heterodera glycines
  Promoter: Source sequence=SeqID_12523; Location=985..1314; Strand=-; Gene=SeqID_76171
tcttgaattttttttttttgctttttttcaattcatacacattgtagaattatttcagtatttaaaattttattttttaatttattcatttaactttttaaaatttgtgtaatttcctttccaaacagggatggacgaaatttcgtttcgttttcgtttcgtcctacattttcggcactttttgagtttcgttttcgtgtttcgttttcgtctaccaaagttttttcgtttcgttttcggttttcaaaattttgtttttcgtttcgtgtttcgttttcgtcagagcaaaattggacgaaaaagacgaaaatacttacacccttaagaatg

SEQ ID NO: 115646 - DNA, 352 bp, Heterodera glycines
  Promoter: Source sequence=SeqID_3497; Location=1964..2315; Strand=-; Gene=SeqID_84911
tgtgcgctcttttccgatccccctcaaatggaatcacaaaatatgggcaccatcattttttgggagttttttaactgaaaatatagaagcatttttaagattttttggaaaaaccctatgtttaacataagctaagaaaatcgataggtttggtacggttcccaactttttgtaaagattaacttacaattgggtccaaacggcggcgcccgggcatttgtcccccttttcttttttaataaaataacataatgccaaaaatctttttttttttgccagacttttctagtgcataattttccgtgtaaataccttcttttatctagcagttcaagctgaacggcgcccaatg

SEQ ID NO: 115647 - DNA, 253 bp, Heterodera glycines
  Promoter: Source sequence=SeqID_38433; Location=1069..1321; Strand=-; Gene=SeqID_67249
aacattttattgttagttgttagcataaggactaacagactgcaaatttcaaaatattttgatcacgaaaacatttataaaaaaaattcgtcgtttcttttcttttttgtaaaacttgaaaacgtaaaattatttaaattttttaatttaaaagacgccaattgttttaaaaagattagatagagttgcggaatatgtaaatttccttaggtttttgtattctatggcggaacagcaagaaaaccaacaaatg

SEQ ID NO: 115648 - DNA, 1003 bp, Heterodera glycines
  Promoter: Source sequence=SeqID_6029; Location=1697..2699; Strand=-; Gene=SeqID_60058
aacacaaactcggaaaaatgttccaaatttatgtaatataaaacactggattttaaatttaaaaattaaaagcccccttaaagaaaagtgttctccaatgtccccgctatccacacattttcattacattatatctctctatctattcattatatttaatcccattcaccaaatgaatcgatgaaattgatttttttttcgtttttttggggcggggggaggaggaggagtttatctcttctcttctcttctctctcttctgtccatcatcattctcatccacgatttttagcctacaaaatattattttcatcattttgttgttcactaaaatgtagtttctttcttcgcccgttatctaattattaggtaattgaggagcaacagagaagtgttcgttgatcaactctcactctattccttgcttttttgtttattatgtaatttgggagggtttgctctcttctaattgccaaaggaatttctaaatttgatcataatttgctaatagattttgcccaaaaattatcgtttttcaaaattttacaaaattcaagcgtgaaaagtttctagactaaaaaatttcaattttatacgctatttataaataaaactttctattttttaatgataataaaaattaaccatcctttataaaggacaatcttagaaataaggacaatttataattacgatttttactaataattaattatgttagcgaaatttacccctcctttaaaaagaaaggacaatcttagaaataaggacaactatttatttataaacattgctttttcaaaataataaaaaattaacttatttttttatcaagacaacattatttttaaaaaaaatatccatccaacttaaaatggcttctccttcacaaggttttaatacgggggagggaggctgagggtgtaaaaaaaaattaatttaattaatattttaataaaaaaatattttacaaaaaatttcctccgccttaggccgaggtatg

SEQ ID NO: 115649 - DNA, 418 bp, Heterodera glycines
  Promoter: Source sequence=SeqID_11640; Location=1940..2357; Strand=-; Gene=SeqID_75090
tggaaaagctgttttagggatgcgtttttaggcacaaccttacacgaaataggcacttaaaaaggaagaaaaaaatcgcacctgcattaaataggcaattaaaaaaatttttatgaacgcattttaagtggaaaacacgtaaaaacttaatcaaaacacttatcattaaaataaaattatggtttagttgtaggcactgtgcaattaaatcgtatgataatctgcggcatatgatttatcacatatattgtcatatgcatgttcaaattaatcatatcatctcatcagggataaattacacttaagaaaaatcacccctccgaaccacgtatgagcggcctttttcaagtcttaatcgaaaggaagtgaattctaatttttaaaattattttttaggaattcctggggctttaaaatg

SEQ ID NO: 115650 - DNA, 368 bp, Heterodera glycines
  Promoter: Source sequence=SeqID_3653; Location=1506..1873; Strand=+; Gene=SeqID_51298
tttctaagaaaacgaaatgaccaaaaatattttttattttttcactaaaaatttgcgataattttaaaatgttaaaccaattgaaaagtttggaataggatgcgtttttctgtcacttttagcccagcaatttcttaatggcaagggaacactttgtcatgcttcacactttgttcagttggcactttttggtgctaaattgactttaatttgttgtggcatttgtcaatttaatttttcttcaccaaatctccgacgaaaataaaactcgaaaatctccccggattcttcctttactaatttcagcatattacaattacaaattgatcacccaaatttagggcagcaaagtctaatttgctgctatg

SEQ ID NO: 115651 - DNA, 761 bp, Heterodera glycines
  Promoter: Source sequence=SeqID_14223; Location=3069..3829; Strand=-; Gene=SeqID_78238
ttatagggcggggggggggaggtcgagaatgagggtcgagagtgagtgagtggccgcggacggactgaccaactgcttggaatatttgcaaataaatgacctactcccgcccgccgttaagggccagccagtcgcgcacatcacaacacacttaaataacgcgccgccacccaccgccgcggacgcgcaaaattttacgcaccacgccgatgcctcgtcgccccctccctctctaattttgatgggacagctgctaatgaacttttcggttactaattgtcagctaatgtagtgtttgttgtaaatgtgaaattattgttaatttctttattgttttattacaaagttaatttcttttattttttattttatctgcaattgaatgtttttaactattcattttattttttatgcatcctggtataagtgcaattagtttttatattaaaaaaaattaaatttaattttttttttaatttttttttggaatttgcggtctctttgatttctgatttgaaataaattttttgaccatttaaaaacaaccagttttaatcgaaaaccaatttttttttttaattttttaaagtaacgcactttttggttgttttgagtaacgatacaatcaattatacatatcaactgttattcttaaacaataattttttattttacttatttaaatatttttttaatgggaattaaaataattcattcataaatgtacatttttatttgcacgatcagtctattttaaaatg

SEQ ID NO: 115652 - DNA, 1003 bp, Heterodera glycines
  misc_feature (607)..(607): n is a, c, g, or t
  Promoter: Source sequence=SeqID_1479; Location=1049..2051; Strand=+; Gene=SeqID_73798
ttaattactgaaggattttgcacaccctttaattaattagcaattaatatttctgcggaagtttcacattagaaaatgtctttctcatttctaataagtccaatgtttttattcatcatgccaatcaacaccaccatcattatcatcaccataattactcattaccatcactaatatcattcatttcatttaaaacccaataaaaacacaaaaaaaaatgtctacaaaactttcattgatgcgtaggcgagaaaaataatacaaaataacaaaacaattcgctgctccatgactgatgccgctgctgcctgtgacattggcctttcatcacatgaaaaaaggcattttctcgatcgccacaaattcttaggggagccggggggaaagagatcaaagttcagcggcaaaagaaaaattgtggtgcgcgaaaatatcgtcggtcactgctgctgacacacacataccaaatgatgacgatttgcacacacattagcaaaattaattaaacaattatttaatagtgatgggccattaagtgttgaatgaagaaggtggcgaagtgaaatgcgcaaggaaaagtgatggattgtccacatcccccgggggnggggggggggagagaacgacagcaaaatgacatgagtgcttgccggtgacatttttttgatcagttttattccagtttttggagcacaaatcggcgactcaaattgagcgcgtagcagcgaaattcgccggatggtttcgattacgtaatgatcaaggttaaaaaatcttgatcgtccaaaaaaggtatgtattatgctcgaatatttgatgatgaagatgatgacggtgatgatgatgatgcccggagaaacgccctcacgctcccaaccggaccgtccgctataaaatgggcagatggacgagcatttgacaccacaaattacccacccaattagttgaaaaccaaaaattaattggccgtgacgaaaacaatatcatcaaccacagaaaaatg

SEQ ID NO: 115653 - DNA, 954 bp, Heterodera glycines
  Promoter: Source sequence=SeqID_2613; Location=4052..5005; Strand=+; Gene=SeqID_80721
ttgccaatcagtaataaataattcaaaaaaataatttaattgaatattacaaaaaataatatatattattttattaaaaacgtcgtaaaaaaattattgttagcactgacaaaatcattttagctttgtgcaatataaattagttacatacgtcaaatgctcatcacatacataaattgattttattccaaattatccgaaaattattaataaattaaaaaaaaaagatcaacccctccgactcgtccttctgcagctgatgcttccgaaatttttaattagcataaaaggcaaaaataaaaaaaggaaaataaatttacataagaggggacacgaacttgtgaaagcaaaaatgaacatcgagaacacaagctccgcgccgcctaagcacaaagcaatgcaaatgattatttaattattgggataaaaaaagtttgatacgtcataactcggcactcacgttcatttggcaagaaaataaaaatcatttttcttatgaacccatggctgttctcttgccacccaccaagtttaattcggaaaccagcacggacttcatcattattattttcttaatactagggttcgagccccgtccccggtgatgggacagttttagccgaggaaatttgtttgaaattttcaagaaattctgtctaaaaataacgaattattagattggataaaaaaacccaaatgaatggataaatttttcatagtttgttcccccattgtttttgtcgattttttaataaagaaaaatttaaacaaaaaaggataaaaaattgtaaataaagcagtgtgcggatctgtccttcagaaatagaagggtccaaatctgataaaatgaaaatttcctgatttgtcagatttgccttgatttggagatatcgagcaaaatttgttctgatttcttaaataaatttataattttttaaactttattgcagaatg

SEQ ID NO: 115654 - DNA, 182 bp, Heterodera glycines
  Promoter: Source sequence=SeqID_10326; Location=3063..3244; Strand=-; Gene=SeqID_73505
agtgcgttggtttattttcagagggaacggccaatgccttggccaattggctaataagccaaaaatgagttccccgcccgttgttcaattcatttgcgcgtgtatatcaattcctaatttgtaaggtccatgaggttgtcccagcctcggcattggccgaccgtcccagcgcatgtcgaatg

SEQ ID NO: 115655 - DNA, 544 bp, Heterodera glycines
  Promoter: Source sequence=SeqID_20039; Location=95..638; Strand=+; Gene=SeqID_84813
ttcggaatacagctgcgttaaactgtaatgcacaaaaatggaaaaagaaatttggtgaaaacattttttaggcacacaggtctctacattatctgttcttctgcacagcgtggagaggtgctaaaatttgttaccaaaaatgcaattttgtgtggcaaagacaaagtcgtgcaaacagcagttgggaacacgcagaagtaaaagcaaaagcaaaactaataggtttttaattttgtccattatttattgagatttgtactcattcctgtgcatggtggtaaaacaaaacgcagtcgttttttgtgcttagaggccggcgttgttaatgcttttaaatgcttgtattattacaatacgcttaaacaaggagcaacaaacgcgacaaacactttagccgagggccttttgcatgcaaatgtatcgcactgtagcagcttgaatgatcaagcattgttgaaagacaaaaacattaaccggtataaagtgaataaaataaaaaaacaatgctaacaacaacattgtaatcatcgtctttagcacaatg

SEQ ID NO: 115656 - DNA, 648 bp, Heterodera glycines
  Promoter: Source sequence=SeqID_28076; Location=455..1102; Strand=-; Gene=SeqID_58734
ttcgctctcctctccgtcgattggtgttccatcttttgtcgccgaagatgatgaattatctatattgagaaggaaattacaatattttttggcgaccgaccagcattattcgattgaaagtgcaagagatctaattggggaagaccaaagtaagcatttgcacgtttaaaaagctcatatgggttagcatgcgactccgaggggtcggcgggtggaaataactgattttagcttcttatttttgtagggaaaaaaatatttttttttaatagcctggaaaattttttgaattttatatggtctaaaaggattgagccgagaatgtcgcacttcgctccaaataaaatctaatctttttgttcgaattaagtaatcttggctttggaacacttattatttacaattaattgtttaagatttaatggaggagagagcgatcattatggggaaattaggacagcatttaaacgcattgaaaatttatacggaaattttgatggatttcaatggcgcagaaagacactgccaaacttattacgatgaaagaaatgcatcgactcgcaacgtaaatcaaacggacaaacagaacgatttaatgaaatttagattttcttcgaccttttccattattatataaaaggcgaaatg

SEQ ID NO: 115657 - DNA, 330 bp, Heterodera glycines
  misc_feature (10)..(11): n is a, c, g, or t
  misc_feature (13)..(13): n is a, c, g, or t
  Promoter: Source sequence=SeqID_38605; Location=588..917; Strand=-; Gene=SeqID_67373
acatgctttnntncaagtttttcattttttctctataatttttaatagtttattaaataagtacaaaaaatataaaatgataaaaaatttttccagtaaagaaattatttgtttttttaaaaagcaaatatttatttcttttaatgtttttttcttgtatttatttcaatataaaatgctataaaaaataattcccttgaaacaaatttttttataattattaataaaataataatttttaaagaaatttccttttacaattttttcattttttctctataattttttattttaattagtattcattttttattattaatttaggcaatg

SEQ ID NO: 115658 - DNA, 75 bp, Heterodera glycines
  Promoter: Source sequence=SeqID_8379; Location=1..75; Strand=+; Gene =SeqID_67863
ctgtctaatcgtgaagtgattgagaatttcccacccccaactaatgtcaaagaaataaaaagattccttggaatg

SEQ ID NO: 115659 - DNA, 718 bp, Heterodera glycines
  Promoter: Source sequence=SeqID_13675; Location=2068..2785; Strand=-; Gene=SeqID_77589
tcaaaaatacatacctcgaaaatgaccatttttacattatcaactctaactccttaaatacttttctaatgggatttatcccttgcccgataaatagcaaactcattctcaataataatgtcagatatttcggatcatgattgtggttttttaaatttatattcataaaaaaattctttaaaaaaagttgtgcggaaacttatgttacaccctaagtaataccgaaaaaaatttgcccacataaaatatctatgtaaattcgtaaaagtgtgaaaatagttagatcaaaatgatggataaaaattttgtaaatgttctatatgatactactatattgaagaaaaaagttgagacaaaaatattttaaatctaaaattgagaaaaagggaattaaaataatccctccacatttaaaattttaaaaaacatcgccatcacttgagcctaaggtgctacagtatcagggctgcacgcaattgcggattgcggattgcggattacggaaattgcggggtttttggacccccgtaattgcggattgcgggttgcggatttttgggatttatccgcaattttgatccgtaatttgactattggattatttttcgagacgatttcttgtaagattattttttataaaatgaatttttttctatttttatttaaagaaaatatatacatttgtttaaattcttatttctttagcaatttaaaaatg

SEQ ID NO: 115660 - DNA, 101 bp, Heterodera glycines
  Promoter: Source sequence=SeqID_44303; Location=672..772; Strand=-; Gene=SeqID_71802
acaacctcattccggtggggtgcccagcgcacatttttaatctggagattttttaagcttttcttatttttagacttttctgaaatcaacacttacctatg

SEQ ID NO: 115661 - DNA, 391 bp, Heterodera glycines
  misc_feature (10)..(10): n is a, c, g, or t
  misc_feature (38)..(38): n is a, c, g, or t
  misc_feature (68)..(68): n is a, c, g, or t
  Promoter: Source sequence=SeqID_2635; Location=1584..1974; Strand=-; Gene=SeqID_80835
atttttttanaagtaattaataaagtttttgggttttntaaatttataaattgcacacaaaaatccantaattacaatactaaaaataaagaaagaaaaaaaggcatgagcaataaaatgcattaattaaatgctaattgcctatttgttttcgttgttgttgcattaatgaatggtatgaatgattagaaaaattaattaatcatttcatacaaaagaattttgaggtgtcaaaattgtttcttcttcaattgaaatttcattataaatatacgtttatgtttttaaaattattaagaattttatttaatttatattttaaaaatttatggaaaaataaaaataaataatttagcaaatagaaataagtctaataaaaagctgaaaaatg

SEQ ID NO: 115662 - DNA, 171 bp, Heterodera glycines
  misc_feature (4)..(4): n is a, c, g, or t
  Promoter: Source sequence=SeqID_17758; Location=731..901; Strand=-; Gene=SeqID_82295
actnaaaaagaggaaaaatgcatttaaaaaaataattaggggattttttcattaaaaattattttaaaaatttattcaaaattgaagtgacactgttaacaaaaatattttcttttgaaaaatttaaatcattaaattaaaatgaatttattaaaatttataaaaaaaatg

SEQ ID NO: 115663 - DNA, 557 bp, Heterodera glycines
  Promoter: Source sequence=SeqID_17402; Location=1998..2554; Strand=-; Gene=SeqID_81883
tgttggtaggtcgtccgtcaatacaatattttaaataatatttattttaaaattcctatttttgttagtgccttccggcgtgttgaccagtgacgagttggtcggcatttttctgacccacgcccacgcggaccgtcgtgccaactccgagttgtaccccaaccaatttcccacccaccatcgcactctgctcagcgcttttttcaacgaaaaattgattagtcgataaagctattttgcaaattgttctgatttttaaccaaaaaattcattaaatttatatcttttctttcttttgtcgctttaagttttgacttttgaaattaacaacaatgaaagatcgaactttttttggcattttttgcgatttaaatttgatttttgacaattttattgcacatcaacattatttaatgtgcaagaaaaatttacgcatttttcccctgaacatttcggcgacgggatcgaaagtttaaaattaactttttttttttcagtatatcatacatatactgtacccaaagcaaagtagtttttgaaaatttttcaggcaaatg

SEQ ID NO: 115664 - DNA, 316 bp, Heterodera glycines
  Promoter: Source sequence=SeqID_17933; Location=1186..1501; Strand=-; Gene=SeqID_82490
aatttccgatcactgagccgatgatcacttccccatcaaccgctctcagtgatcgcctatcagcagagctcgtcttatctccaagttttgatttattatcaaaccaaaagcatccccttctcctccccccttttatttccctttgtcctatgcccactcttttcgcggattattcccaaatgaatttgctgatgaatgtttttttaaaaactttttgacgcactgaataaactaaatccaaacagtctcagttaaaattcgcataaaatatttaccgtatgcctcctcccgtcactaccgtagctgtgaatgaatg

SEQ ID NO: 115665 - DNA, 1003 bp, Heterodera glycines
  Promoter: Source sequence=SeqID_3267; Location=418..1420; Strand=-; Gene=SeqID_83971
aaaattaaataaaattgtaaatataagatataagagaatgttgcaataaaaatcaattatttattggcaatcaatacaattaggttgtccttgtctttaaaaatggttttttccattctaataaaatataatttaagcaagtgatattgaagaaagccaaaaaatattttttaaaaataaaatttaaattttccttttataccttttttatcatccggttaaagggctttgacttggaccaggaaagccgagatctgtatctgattttgaacagggacatggataaagggtttggcaaagttcggcttagtgctcaaagcagttcaaatgcaaaaaaggcgaagtggtcgatgttcaaagcacaagtttttaaaaaaaataaatttgaatataaatttaatgtatggtaaaataaatgtttttattctcgccttatcctaccctctcttctgggcggctcgtttcaagaattagagaatctatgttaagaataaaggacgatccatcaaaatataaaaaaatatgtcatgtttaaattgttgcatgagttcccgacccgggaaatttcctgatttcaattcttggtctcgtcggtctttgttttttggattctgagaaatttttatgctgttaaggattggagttctgttgaccaaactcttcacgttaaaaattggtatatgtacaaatttggataataattaattctagagttgagcgggaccgggaattttgggcaaacccgggaccgggacttcggtactcagttgtccgtgttccccggtcgcgctcaactctaattaattcttttaaaagttgaatttgacgaattgtcaattgtcaattttctttttttaaatgattaaattaaacggttaatttagggaatttaaagcaatttgaaatttcttcagactttttgtcaaatttcttatttataatgcaaaattatttactgttacctcttttgcccctttaccaagacaatgggctcagaataatg

SEQ ID NO: 115666 - DNA, 114 bp, Heterodera glycines
  Promoter: Source sequence=SeqID_12735; Location=512..625; Strand=+; Gene=SeqID_76435
tttttaaaatgccaaaattaaaatggaaaaacattttttaaaatataaaatgtttccctgcagaccatcgcctttctgcgcgagggggtcacccaatgttcgtgctgccaaatg

SEQ ID NO: 115667 - DNA, 339 bp, Heterodera glycines
  Promoter: Source sequence=SeqID_29043; Location=1..339; Strand=+; Gene=SeqID_59612
tttttcatttcattttaaaattggggaagaaaaaaccccaatttaaactgctaattgtttagtcgaatacatttcgaattaaaaaattattttccaaaaattcacacgcagaagaataattaataagtgaaaattttatgtgtgaaataaggttcggctttaacatttgtaagaaataacggaagaattaattttattaaaataaatatttgtaatttttgatatttttacattttgtcagtatttgataatgacatcagtctgatgagtcattatttggtcgttctgtgcccatcgccgggtgctcacactttcgccgatcaattggcccacaaaatg

SEQ ID NO: 115668 - DNA, 1003 bp, Heterodera glycines
  Promoter: Source sequence=SeqID_7930; Location=435..1437; Strand=-; Gene=SeqID_66411
gaataatcgatattgtcggccctttttatccgttaaattcattttttggcattttactaatgaacgataagggccaaagtgtgccaaagttataaaaaaggagaaaaacattttttggttgcccccaaaatcctaagaaatttatgccctaatttcttttggctatcaaaagcttcatttaaaaaattatcctaatgtaaaaaataaaaatgaccaaattatgttaaaatcttagttgactatgatttgcgctaacggattcattctttcgatcattttttgccgcaatataaaaatggtaaagagaggggcctcaaaaatgttaaatattttacaaatccaaaagaggttgagggccttaagaccgctcattgtcaggcaaaaatgaaaaattttgaatgaaaataaatgaggtttagaggcttttgttccaatttcaaagcctaaaagcctcacagtgcgagtcctaaaagaatgaatgccgatcagttgtggcctttgctttttaaaatttgttattgttttaacccctttgatgcataaatttttattttatttgcaattatttaataataaaaaataaattttaaattcaaatacttcatgtttgttgacactcccattttccttaaatttaaaaaatttctgatctcgaatactactaaactcaacttaaaccactgtgctaggttgtgtttcacgcagtcttggcattttctctcaccaaaaaatataaatagtattattacataacaaaaattaacaaaaaattgatttttttataatttattatttttataattttctttttttccatacatatgtataaagaaatatatatgtaaaatgtacattaaccaattaaataaattccaaacgcgaaattaggccaaataataagtttttactcaccttcactttttattttattttcaattcatttttatttctctttttcagtaaataaataattttctgatatatttttcccttggttcgaatg

SEQ ID NO: 115669 - DNA, 152 bp, Heterodera glycines
  Promoter: Source sequence=SeqID_5575; Location=2556..2707; Strand=-; Gene=SeqID_58535
tgcaggcaaaaatgctcgggcaactaaaaaaatgctaaattaaaaaaaaaaattaatatggaagagaaaaaaatccctattttcattgaaaatttaaatacctaaattaatttttaaggttttttattttgtaaaaaatctatgttagcatg

SEQ ID NO: 115670 - DNA, 875 bp, Heterodera glycines
  misc_feature (13)..(13): n is a, c, g, or t
  misc_feature (18)..(22): n is a, c, g, or t
  misc_feature (44)..(44): n is a, c, g, or t
  Promoter: Source sequence=SeqID_6329; Location=1..875; Strand=+; Gene= SeqID_61158
taatttttttttntgttnnnnnattttgttaatgtttatttttnattttttgggtattttctcaaaataacaataaaatggaatttatgttaaaataattcaaaatgagaaactttggttttttacttaattttcttaaaaaattactaaattttagctttatttatatatatttttttaaatgagtttcataacagatttagctattttcaatttttttttagcttaaatttaacaaatttgaagaattttggaaaatttatttgaaaaaatacaaacattttcaatcaattttgatggcgccgctgcaaactcagcgacggcggcgccgggaggcacgggcgcgccaactgctcgcccagcaatatacattttctgattttttattttattttaaatttttttgttcataaatttttcataaacatttttgtcttcagagatattggcccatattttataaagcataaaataataaataattaaatgaataaaaaaatacattaatgtgtcatttaaaaaaataataattacaaaacatgaaaaaagatgaacaaaaaaagacatctccacaggcattaattaactttttaatttgtttgtatttaatatattttcgatgcatttaatcaaatttgacaaactttgtacataataatatatatatatatatttcttgtctatttaagtgaggatatttttgtactttttgccaaaaaaattatatagcacatgctggtggatgatgtgttaaaaatgcgtatagggctgaatagagagggactcaaaacactgacacctttaaaaaaagataaaaatttgctgattggaaattggccaatgctgatcagcggcagcagacagatcatccaatg

SEQ ID NO: 115671 - DNA, 311 bp, Heterodera glycines
  Promoter: Source sequence=SeqID_5960; Location=2181..2491; Strand=-; Gene=SeqID_59841
atgggtcataatttgaggcaacaaaggaaagaattgatcgctttgaaagtggcgaatttgggagatttgccagcttaaaaactaaacgatcggaaagggggttccaattaatgcctaaaaacttttgatcggggccgtgaaggacaaaattttcggggattttggaaattatttcattagaatttgaaacaaattcacgcagtggcattcctgccttttcaaaaagagaaattgccgctacggctttgtctacaccttcggtttcggtttcggaggaaagaagaatattatcgacataaatattagaaatg

SEQ ID NO: 115672 - DNA, 1003 bp, Heterodera glycines
  Promoter: Source sequence=SeqID_17965; Location=1153..2155; Strand=-; Gene=SeqID_82527
tttctaaattagccgatcctttctaacgaaatcattttttctcacatttttctttctgagaaaaacagtcctattacaaaatttatttcggagccgttatttgaactttgaaccttaaacaacatgaatctcttcattaaattaataaaagcgaacaaatttcgttcattagcatgcttttacaagaaaaacgatattcaggcgacaacgaataataagaaatactttttatcaggatcagacggccaacaataaaaaaaaattattttaaacttttcagcattccgcaacaacacgttggctgtagcccgtcatggttttcggaaaaacaaagaatagttaaaaaagacattgcagaatttcggttataatttctcaatcccagacaggacgaaacacttttagaagagaacttgttgaaaagtagggtttgcattaaataattctttttattaaaatattttatgtttaataactagcagaaaatttaaaaaatttatcatttaaacttctgttctgaagaaagaaataaaaaatacgaaatacattttgagaaaacacggtcgtattttggtaaatcaaatgcatttccttggcaacctcaggaggattctggcaataacttgtgaaacgagaaaagagaagtaaaggtttacaaaggtttgctatttattaatttggcctggcttttatgaacaattgtgttttcttaacttttttctgtagaaaattcaaacattactataaaatttatttttacaccctctttctctaaagataataaaatagattattatatgattttttaaatatgcgtgttgaatgtattcgtatttagcagatttccttgaaaattgcagcgagggttttagtaataaaattccagttccattctaagaaacaaaggtttgctttgaataattttttcctgaatttgctgggtttttataaagaaagattttttttggaacatttttcttcataaaattacagcacccatatg

SEQ ID NO: 115673 - DNA, 102 bp, Heterodera glycines
  misc_feature (29)..(29): n is a, c, g, or t
  Promoter: Source sequence=SeqID_29215; Location=1..102; Strand=+; Gene=SeqID_59748
aattaaatgcattttcattctaaatacantttgaaaaggataaaatgaatgacttatctttttaatatctctaaactttaagcatcatctggccttccaatg

SEQ ID NO: 115674 - DNA, 412 bp, Heterodera glycines
  Promoter: Source sequence=SeqID_35776; Location=731..1142; Strand=+; Gene=SeqID_65249
ggtgaggtggagaaaaaaatcataaatttataattttgaaacggagcatattgtttgaacttttgtctcaataaaatagccttgatttttaaaaatcctctcaaatcacaaaaacttaaactatttcccctaataatcaaaataacataaaactttaaatgtattgaaactgaatctcatcaaaaaaatttttgaaaaagaacattgctgaaaaataaggattttaatgcaaaaataaaggacattaaaaataatgatttttttagttccattccggaaaaaaatttgaaatttctttagctttttaaaaaaatagagtttgtcttaaggcaattttgtacagttttaaggctaaaacttattacttcctgtcatattttaaatatttaattattcggtccctctaaaaatg

SEQ ID NO: 115675 - DNA, 125 bp, Heterodera glycines
  Promoter: Source sequence=SeqID_16326; Location=1777..1901; Strand=-; Gene=SeqID_80715
cgttcgttttccatttttctttttttcacatttttttttttgcctttttagtgcttttgtccgtttctctactgaattgtgtcgccagcgcagtaacggcacaaagtcacggcgccagtcgaatg

SEQ ID NO: 115676 - DNA, 252 bp, Heterodera glycines
  misc_feature (140)..(140): n is a, c, g, or t
  Promoter: Source sequence=SeqID_34913; Location=1..252; Strand=+; Gene=SeqID_64597
cgaggcattcagccatcattacaaaatcaaaaaacaaacgtggaaagagagaagccaaggctgaagataccaaagactcaaaaaattgatgtcgcaaagagggccgcagaacgcgccgggagagacgtagaaagacattntaatcagatcaacaatatctcgaattccatccaaacccaactaaacacactacgagaaacaaatcctcaaattttagaagagcctgatataaaaatttggtttgacaaaatg

SEQ ID NO: 115677 - DNA, 379 bp, Heterodera glycines
  Promoter: Source sequence=SeqID_40788; Location=169..547; Strand=+; Gene=SeqID_69030
aattttacaaaaatcaacctttatatataacttagaaatttcttgtaaaaactgaaatgaaattttaaaatttaataacatatggaattttgaaaaaattttgtactcttttagacagttcgcctttattctaacaatttcctgtaacattccaagtcattctgacaactaagaactgaatgagaaaatcatctttttaagcttcgcgaacgagaaaaccctaaaaatattatccctagaaaactcgaatccgactttaaaccacgcaggttttatcccgttcaataattccgtttaatctgtcccgctcccgtcttttcgtccgatttaatcccggcccgactaatattctttttataagcaggctgattcgataatg

SEQ ID NO: 115678 - DNA, 52 bp, Heterodera glycines
  Promoter: Source sequence=SeqID_28391; Location=1289..1340; Strand=-; Gene=SeqID_59016
cttttcaaaattaagtgacaaaaatttgaccgttctggatgaattgggcatg

SEQ ID NO: 115679 - DNA, 508 bp, Heterodera glycines
  Promoter: Source sequence=SeqID_10754; Location=1882..2389; Strand=+; Gene=SeqID_74005
ttcctttaatattttttaattttaaaatgtatttttaattacaaataaattaataatttacattttgctctactgatcaataagaactttaacaactgtcttcagtcttctgatcagtaggatttattattttcattaatttacattttcctccttcctactggtcagtagaaaattttttgccatttgatggtatttaagccaaataaaagtcaagctcttaattcataattcaactgtttgaaaacaaatattttccatcgaatttttaaattgctttttcaccaaaattggtaattttgtgcatttctgaaaaaataggccaaattttttggtataacgaaaattttcagcaaaaaacaaaaaaaaatttaatatgaggtggggtactttggattcagtaagaaaaggcaaacattttattatttccatagaaaagaggtgatgagaggagatccagttcatcaataaaaattatttttcatacttaataaatttaggaaaaatg

SEQ ID NO: 115680 - DNA, 1003 bp, Heterodera glycines
  Promoter: Source sequence=SeqID_21078; Location=1573..2575; Strand=-; Gene=SeqID_51665
ataataaattataaaggccaagaaacttcagccaaagaatacaacgatttgatcttcgattgcgtcacgagtaattatgacatccgcaattatctaattaaaaaaacacttaaaaatgaaattaaaatttagcaccccaaaaagccttagaaaattttataaaaagttaactgattttctatagaaaatataaaaaaatgtgctgttaaaaaatgttttttttaccgatttgttagataagaaaggttttaaatttttgcattgttaacgaaaatattataaataaataaatgatttaaatcaaaaataattatgcaatattttatccttaatttttataaaattttatattacaaaacacaaatacttgacattttcaccattttattattatattatgataattttgaatactactttttaacaataaatgatttaaaaatttcacataataatcttcggaaaattaaacttttatataatttatttgattaaaactgatttaatagtattttaataaaatatatctttaatttagctttttaaacattaatcgaataaataaatcagtttaaattattcaaactaatttaaatatacataaaaaagaatattgaaatacatgggtatctgatgagcagtggggtggaaattacgcttgaataattaaaagtaattagttaaaagattaaatttatccaatacgttttattaaagttttaaacgctttatttcaaattaattatcttcaactagaaataaaaaaacattttaaaggtatatagttataatcaaaaaattgaggtttgtgccaaaacaatctagtttctaaaaaaaattataaatatttttacaaaagtttataaaattcttatggtactatactatactttataaattatgataaaattaaataaagaacctcatgcttattagataagtttataattaataaaaaatttttaaacaagcaaacgacaacgaagcaacttttactaaaatg

SEQ ID NO: 115681 - DNA, 768 bp, Heterodera glycines
  Promoter: Source sequence=SeqID_19284; Location=1..768; Strand=+; Gene=SeqID_84026
ttgttaaccacttttgtcaaaaactgaaaaaattttggggtttttaaagaaaaataaggatttttttgcgccgccggagaaaaattttggaatttttaatgaatttcagtaaggaaatttattcaaatttaaagtttttcatcttttctccttcgctttgaccccccgccattacgacgaacgaggatcggggctgtctttttttttggggggggggggtgagaaattgtaccaaattcaacggcaattcccgctacaaaaacaggcgctgtccgcgctggacaatgccgtgctgactgctgctggccatcgacgcgatgcggccgcaattgttgcccaacaccagcaactgctgcagggacaaggacagctcggtgcaatgggaccgccgccaccaccacgggtcagtggtgtttagaggggacaaattggcatggatttagctggggtggggatttaaccataaatgcacaatctatgcattggccaaaaaatgtgttatttttccgcttgtttactaatgatcggcaccctatgtaagaattttgggcgaaaaattgttattttttgcgcccgtgttgctataattttgaaaaattacactggaaaaactggacggatagaaaaaacaaaatgtaagacttttgttgcccagactctgctgattgtgagtatatgaaattattttactacaaatagtagcatcatgatatataatgttttttgcgttcgtttgtttaggtgttgatcaacgagcggggcgaaatg

SEQ ID NO: 115682 - DNA, 881 bp, Heterodera glycines
  Promoter: Source sequence=SeqID_25387; Location=511..1391; Strand=-; Gene=SeqID_56126
ccatcaacagtccttcatacaacagtcgcgctggaaaggacaaagcattaatcattgtgaataaactgcaggacaaccttacacatcaccaccgttttttgattggacaacaaaaaacagctgaattcctccgaaagacatttaaaatcccgctagaagacgaaccgtccactagtgcgaacaatttggagaaaaaagattgattttttttgacattatttgaaggcgatcagataccaagatttttgatcactattgttgatactgtgatcgtattgttaataaaaaaaaaaaaattccaaataaacgtcaaactgtgtcggccaaagaaactaatttctgaactggaaaaggaagaagaaaattttgaaaattttgatcaattggaagaaattattgaagaagttgaagaatttgtacctattgtagaaattccggttttaacacccgaagaaattgttaccgagcttgaaagaagggcaaactttccctttccaatagtgcatatttacccaggaatttccaaagtaacgaaccaaattttaaaaactgaacccttcccataccaaaacaaaaccgtatataaattcactttgacaataactatttttccatactgcattttaaataacctagataaagccgattctttggaaagaatatcacaggaagtaattttagaagcttacttaaaagtaagagaaacactcaactctaaccctgaaaaacgactaaaatttgtcaaattcattctaaaagttttatcaagagaaagaaaaagtttattaaaaaagtggagaagatctgaaagaagtatagtattacaccctattaattcattagtccacaaagagtatataatttaaaaacttacgaaaatg

SEQ ID NO: 115683 - DNA, 456 bp, Heterodera glycines
  Promoter: Source sequence=SeqID_4108; Location=1364..1819; Strand=+; Gene=SeqID_53218
taatccgctggtgatcactgaataccgcgccgattcactgttatataagcaaaaagcggagcagggcgaaggggtggaaaattcaaaaaaatgcttcaaaaacgaataaataaattccacttttatttatttatttatttattattctgatgttgttttgtttcctttattcagtgtgaggctttttcaacctgttgtcgttaatttaataatatcaatttatttattgaaaaaaaattttaattgctgggtgacataattttgcctaattacttttggttaccaaagccccctataaaaggcgaacatttcaatgcaaaacagcaaatgttcattcatttatatgcactgatgaaatttatttccaatttttcattttaatataaataaattaatttcaattttttataatatatattcgataacagaaagcattttctttattttgaaaaaatg

SEQ ID NO: 115684 - DNA, 319 bp, Heterodera glycines
  Promoter: Source sequence=SeqID_11116; Location=4964..5282; Strand=+; Gene=SeqID_74459
ttgcttttccgttgagtccaatattttcttggcacaactgtcacaagttcccaaatgtttgcatggcaaaaagacgatatcacgctaaattaaaaatccgaaaaattctttttggcattctgtcacccacaatattttccaagcattcaatacagttgatcttttcatttgattgttcattcgttgacggagtttttgcgttttgattggattcgttaggtgatggcaactcggatgttaatgttgacgaggctggtgaagttaggctttggctccctatgctcttaaattagcaaatatgacaataatttaaaaaatg

SEQ ID NO: 115685 - DNA, 1003 bp, Heterodera glycines
  Promoter: Source sequence=SeqID_10477; Location=647..1649; Strand=+; Gene=SeqID_73683
tggtacttttttgattataatacatacgaaaaaaaatctgatttgatttttgatatttgtttgaatgaaaaaaatgttttgtatagtaaaaagagaatgaacaagcctttaatggattgaaagaaagcaatgtaaatctacatctcaaatttttctgttcgggtggataattatatgcagttgggatatattacgtgccgcttgctgaatgaaatttatgtggaatattttaaattaacgtttacaggtcagtttttgttttgaatttgggggtgggtgcaataacgattctcttttatatgtttttaaaaaaaaaacccctccccatctgcaaactattaacttaattactgctttttttgagcgaaaaaagaaaaagttgaaatgcttcttttttttgtttttgtgtacattcttttattctcaaagtttgtttcaaggtttaaaatatctaccgctgatttttgtaatgaatttaagacctagaattggaatttagatttgattgtgtttgtaaatgctaatgaattgtttgtgaaaaaagtcacatttaatttttttaaatatgaatttaattgtttggttatcagcagaaatttttgtttatgttatgattaattgaaaacgaattgttagtaaatgaaagttttgttgtttgatatgtatcatgttgtgctgattcaagttgcaattttttttacaaatggatgttttacgatatcgaagccaatctacaaaatgtgatgtttttgaaaattttaaaaattaacgggataacaggtcagtttgattttttctctttttattgagagataatttgaccttgcattatttttgacccactcatttttttttaattattttattaaattaaataataaatattcacatttgcttgaatatgttgtttggttcacatttatatatttgttattttgtaaatgcttttgttatgtaatgttctttcaggtttaaactttctactgcctcctttgttataatg

SEQ ID NO: 115686 - DNA, 204 bp, Heterodera glycines
  misc_feature (79)..(79): n is a, c, g, or t
  misc_feature (84)..(84): n is a, c, g, or t
  misc_feature (93)..(94): n is a, c, g, or t
  Promoter: Source sequence=SeqID_31117; Location=1..204; Strand=+; Gene=SeqID_61497
taattaaaaaatgttaatatttacgaattgtggcataaaaaatgctgtgattatttatgattctcccgccagaaatttntaaanaatgtgatnntatatttctctaaatgcagggaatttgtgtgttttaatcacaaatcaacgcaaaattgatgtgccgccaatgcatggcacaaatgttgtgccgaattctttgaggaaatg

SEQ ID NO: 115687 - DNA, 98 bp, Heterodera glycines
  Promoter: Source sequence=SeqID_14930; Location=1..98; Strand=+; Gene= SeqID_79094
ggggctagcgctcgaattttaaaattcattgaaaagttttcgagcagcagaagcacttgtatctggagcaattggcgcgacaaagtggtgcttccatg

SEQ ID NO: 115688 - DNA, 538 bp, Heterodera glycines
  misc_feature (135)..(135): n is a, c, g, or t
  Promoter: Source sequence=SeqID_20255; Location=1642..2179; Strand=-; Gene=SeqID_85059
aaaaaaataatttgaaaatcttaaaaatttgggtcttttttaatacaaaatttttgtaaccaaatccacatacaaaaatttaaaaaatttttcccggggggcgcctttcgcccccgcccggccccccccaaatcncaaaagttttttggaaaaagcacgccgcaaaaacattattaatttttaaattttgaataaaatttttcaaaatgctgatttacaaaattttcagttcacaggccttcgtttttatgccaataaaattttgttttaagtcgttttttcatgtttttattgcgtttccttcgcgctactatcagttttagaaaaaatcttatttttggggtccgaatcttagttttagcctcatctgtccttattttgaaaataaaaacttggccgccctgataatgactgaaattaaatttttctcacaaagcagtgccggattaattctccccgatataatcaagttttttgttatttagcaaaaatgtcaaagtctttgaagggttgttaatggtgtcagtttaagaacatg

SEQ ID NO: 115689 - DNA, 333 bp, Heterodera glycines
  Promoter: Source sequence=SeqID_17228; Location=1285..1617; Strand=-; Gene=SeqID_81694
attaaaagaggtacaacagtaaatagaagcggtcaaaagtgattagaataggtacaacagtgatgagaagaggtacaacagtgattaaaagaggtacaacagtaaatagaagcggtcaaaagtgattagaagcggtcaaaagtgattagaagaggtacaacagtgatgagaagaggtacaacagtgattagaagagatacaacagtgattagagaggtacaagagcgattagaagaggtacaacagtaaatagaagcggtcaaaattgattagaagaggtacaacagtgattagagaggtacaagagcgattagaagaggtacaacagtgatg

SEQ ID NO: 115690 - DNA, 723 bp, Heterodera glycines
  Promoter: Source sequence=SeqID_9357; Location=1011..1733; Strand=-; Gene=SeqID_71107
tttggctagcgggatttcttacgggagcgagagttttgcgtgggtcccattcctgctcccgtaaaacttccttaattttcatacataaaacttaaggcacaacattttaatggaattttcctgattaattacaccgggattcttcactactcatttgtccctttatttattcgttgacagtagggttgggtcaccggccgtcggggttgaaaaattcggggttgggggcccaaccctagttgatagaattgtcaagtgttatttttatcgccctttaagcgctatatagaaagttaccgtttttgaaaattttttcacttttttttggtaaatttttttttgtttaaaaagtcatgaaaccaagtacccgggggttttagaggtcgctgatcatgaatatgacaattatttgggcctattaagaaatttggcgctagttataaagtgacagatttttaattttatcaaaaacaaagggggacccttttgttttgcaaaaatttttgagataaaaaatcgtgaatatactttttattcaccataattgtaatagaatatcttgaaactttaaccatttgctaaaaaaaagttaaaaagcatttatataaaaaaaaaattgcatgaaaaaagtttgaaaaaattttaaaaaacggtaactttccatatagcgccgacctttattttacaatgctttagtcaattactacaaaatttgtaaaaatg

SEQ ID NO: 115691 - DNA, 240 bp, Heterodera glycines
  Promoter: Source sequence=SeqID_19526; Location=1437..1676; Strand=-; Gene=SeqID_84256
aaaaaaaaattattttttagggaatcaatttttatttttggggaaattctgaaatatgtaggattaaccataaaaaagtccaaaataggcaaaaatagcaattataaaattgatcctaaaagcttcaaaccaagctaaaaactcattttttatgcttatctcaatgttacatgcacccaaatttaggcatttgcctaaaaataacattatttttaattcattttcattttttttagaatg

SEQ ID NO: 115692 - DNA, 236 bp, Heterodera glycines
  Promoter: Source sequence=SeqID_32084; Location=360..595; Strand=+; Gene=SeqID_62397
agtgagtgtctccctacctagcttcctccctgcctcccttttccaagtgccccaaaatacgatccctgaaagtggttaccatttatagggcgccaattttgcaatttttggaatggacacaaccatcccccccccattttcaagttgaccaaactgctgcgtccactgctggagagaacgatggggaggaggaggaggacgacccggactacaaagaggaaaatgatgccaaaatg

SEQ ID NO: 115693 - DNA, 82 bp, Heterodera glycines
  Promoter: Source sequence=SeqID_21476; Location=1092..1173; Strand=-; Gene=SeqID_52089
ttcgcatttcagctggatttggaacgacgtgtggatggacattttccctcattttgaccatcctcaactcggcctcaaaatg

SEQ ID NO: 115694 - DNA, 323 bp, Heterodera glycines
  Promoter: Source sequence=SeqID_10202; Location=3084..3406; Strand=-; Gene=SeqID_73321
agtttttgagtaattaatgtcttccgaaaaatgagtaatttctaatgtcaaaaatttagtgaaataaataggaaattttttgagaaataacctgacaatatcaatcaaattttttcaatttttttgtattaatttttttttgtcatatctagtatttaggcacctatttttaggctatttattttttgtgaaaattgttttaatttatcaatattacttctttttcttttaaaggttggcgctccgttttcggaaaagacccaattttgttgagcaacaatcccagcggcactttttattttgaaatttcaatcatcgatatg

SEQ ID NO: 115695 - DNA, 158 bp, Heterodera glycines
  Promoter: Source sequence=SeqID_43898; Location=1..158; Strand=+; Gene=SeqID_71466
agtggacgaaattacggaccaaatcttcgtgaaatgggtcgaccaattggtgctgcgggtgcgttgccaatcattacgacattaaccccctcaaaatcggtgcactttttcaggatgagccgttgcctctttttgtgccgctcagagaccgtaaaatg

SEQ ID NO: 115696 - DNA, 478 bp, Heterodera glycines
  Promoter: Source sequence=SeqID_1672; Location=3359..3836; Strand=-; Gene=SeqID_75230
taataacaccccaaactggctgctcatcggctgttgcaaacggaacagtcaagcgtaaattggtgactttgttccacacggcgattcaattttgggctccaagtacaattgccgtatttgctctttttatatgccagtctccattagtctgccagtctccaattatatacccccttctgagaaggttgaaaaataatataccatggtatataaaaagagcaaatacggtaagttggttttttcgtcttagtggtctgtgagttagtcaccaaaaggggggtcccaggttcaagtcctccctatgttgtgtgttaatttcaatttcttcttttaacggcataatttcgtgctgcgcaagaagacatcagtttgtcagaaaccgccgtccaactatgcagaagcggtggcaaaattcatcaattttgttgaacaaaggcgaaaggcgaagaacaattttcccggcggcatctttgcaatg

SEQ ID NO: 115697 - DNA, 257 bp, Heterodera glycines
  Promoter: Source sequence=SeqID_23313; Location=1018..1274; Strand=-; Gene=SeqID_54017
cccccccctccgacattttttaatgttcaaaaaacaaaagattttgaaattttctaacgatttttctaaattaccgatgaaaattactatggtcacaaaaaaattttccttaaaattttattatgaaaaatttaaaaagttttttttgaaatatttctgtttcaattgtttgtttgttttttgattaattattcctttttttgtttttcaaaagttttataatattttaaaatttagacgcacagacgcccctaatg

SEQ ID NO: 115698 - DNA, 285 bp, Heterodera glycines
  Promoter: Source sequence=SeqID_1229; Location=1..285; Strand=+; Gene= SeqID_70238
aaacaaagtttttcttagaaaaaacaaattttgaaagataattataacaagtcccattttttcaaggcatcaaaaattgctaaaaattagtataaaagtggttgctcctcctccgccactttcattattattattttccattcgccatttatttgtgttcgtctctctgtcttcgaccttttcccatgacaatgtctttaaaagtgattctgtacgttttgcgcatttcttctcgacatttacccttttgcgttctcattttttagactcatcgctgtgccaatg

SEQ ID NO: 115699 - DNA, 92 bp, Heterodera glycines
  Promoter: Source sequence=SeqID_41789; Location=937..1028; Strand=-; Gene=SeqID_69836
aattaatccgaagaaggaacatgaatgcggagagacctattgccaactttgtagtgtgagccacgaccccaagcgggggatgttatataatg

SEQ ID NO: 115700 - DNA, 1003 bp, Heterodera glycines
  Promoter: Source sequence=SeqID_15104; Location=1778..2780; Strand=+; Gene=SeqID_79282
taacaaatttgataatgaatggtaccattgaaagcccataaaaaatactacaaaaaccgtgaaatgtgtttcccgttttgcctgcaacttcagcttttattacgcatctaatcaatattcactctttgagtctaaacatatgaccatgactgtattttttccatattttggaatttttttccaaaaaacccctattagaacggcccccataaactaaattggccgttttggtccaaacgaccggaaattttccaaaaaattttaaattttaaactttcttaaaaattagtagatttatttcaaaaataatcaaaaaattgaagatttcgtttttttggtcagtttcctctaaaattgcttttttttttcttctaaaacgagttattataccgtatttactagaatttaatgaatttggagaaattttggaaaatttacccctcaattcggaaaatttataacatatttttgccatttttgtccatattttcgggttacggtactacttttttcacgctctgttccatgaaggagtggtctgatcaagttggggtaaaagacttttttgatcagcatcaaaagttaagctaacctgaatttttgcagatttttagagccaccaaatattgagctttcattgattaaatattatgtttccatacttagcaccgccaaaaattggatcactttggttgcgcacccgtaatccgatgatcggaacttttgccgtttttagtaaggtgatattagggtttgttttggtatagaaaagatactccatccaatcactcatttcttatgaatagtaaaatgattgacccaaccaaatttcccgccttttatagacacaaaaacaacgatgtgaagacaatttttatcaacgttttttgccctataaaagcgcttcttcccccgcatttgccattcattccacaacacttttattccaccaacttcattcttcacccacaacatcctcgtccctccgcttcaatagcaaatg

SEQ ID NO: 115701 - DNA, 106 bp, Heterodera glycines
  Promoter: Source sequence=SeqID_37061; Location=1..106; Strand=+; Gene=SeqID_66235
cacttgaagctccaacattttaatttgcatctttttacattgaaaatgtgctcagcggacgttctcaggcggatgtgtattatttgcagtgtaacagttgccaatg

SEQ ID NO: 115702 - DNA, 675 bp, Heterodera glycines
  Promoter: Source sequence=SeqID_9670; Location=1..675; Strand=+; Gene= SeqID_72283
gtcgccaccggcttcatttcgccactgtccgccgtttcgtttaatttccgccgttctcggcacgggccattccctcccctcctcccctccctcctccccccgccctttctccattttttccaatttcaaaaaattatttttcaatgattttgattcattcacttcgtttggtttctgtcagctgttgtttgttggtcattatctctcattatccatctcattatccatcattatctctcattatccatcattatctctcattatccatctcattatccatcattatctctcattatccatcattatctctcattatccatctcattatccatcattatctctcattatccatcattatctctcattatcctttctctttctttctctctctgctcatttatttccctttggcctctcttccatctctctgctgagctttgttttatccatttccttctcaatccctttcactttctttggttcatttatctcattatttacttctttttcccaactttgtccctttttctgtcatttgtcgtcgtccactgattttgttgccagtaatttcattcattaattcatttttattgtttatttttcagtgttatttaatatattttgaaaatgaaaaaaaatcttaattttagtggctttttcttataaaaaaaaatg

SEQ ID NO: 115703 - DNA, 550 bp, Heterodera glycines
  Promoter: Source sequence=SeqID_5257; Location=2734..3283; Strand=-; Gene=SeqID_57473
aggtattcgaatgggtaattaaatgtttcaattcaaaaaacttttggcttttataatttgtaattttgtcgatggtgcccatggacggtaaaaaacgaaaaaaattgccaaaaaataattggcgtaaaacaaaacgccaacacactcaaattgaaaaacaaagtatatttgatcatctgataataattaaattaatgaaaattttgaaatcaaattttcttcaattatttcgaacaattaatcatttttggactaagtgatcgaatattattagaaattcagagaaaattcaaaaaaaataatttaatttctgtagagggcttgaaccaggggaaagaagaagggaaagtcaaggagactagccactaggctatttgcacaattggcagatattaattaccgtatatgctctaattatagcccatgggggattattggcgctagttaaaaagttgtcctttttgaattttttttgcacttttttttggtcaaattttttaaaattttttataaataataatgaatattaaacattaacagcacaattatg

SEQ ID NO: 115704 - DNA, 294 bp, Heterodera glycines
  Promoter: Source sequence=SeqID_32227; Location=606..899; Strand=-; Gene=SeqID_62554
gggaagttagaatctgggcggtgtaacattatttttttgtgcatttttacgttatttttaatttttatttatttaaaatatttttattttattaataataaataaaaaattttcatttgaattaaattattttttggtgaaaattttatttaaaaataattatttttttaaattaaagaatttaatgttttttaaattagaaattgtcaaaaaaattatatttggtgtaattttcaaaaattcgtaactcgggttagggagggtgaattttcacaatcaaataattaaaaaatg

SEQ ID NO: 115705 - DNA, 123 bp, Heterodera glycines
  misc_feature (27)..(27): n is a, c, g, or t
  misc_feature (97)..(97): n is a, c, g, or t
  Promoter: Source sequence=SeqID_10990; Location=1..123; Strand=+; Gene=SeqID_74298
tgtttggcctgactgacagtgattttntaaaaaactttttgctttcaaaattaataaaaaaggaaatttggagtaaagttattttttataataccancaccgaaaaaattctttgcccccatg

SEQ ID NO: 115706 - DNA, 501 bp, Heterodera glycines
  misc_feature (14)..(14): n is a, c, g, or t
  Promoter: Source sequence=SeqID_362; Location=1..501; Strand=+; Gene =SeqID_84436
aagtgcaataatantggacaaataataattcacaggtgtgaaatgctaaataaagtctgaagtccggatgatcaactgaaactgaagaaaatggaaaatgtgaagattgcgaaaaataaatatatataaaatttgcatgcgaatgtttatcgaaattccgattaaattgttttttgagcgcagataaatcgcaaagcataagcaatcgtttgtaacgtttgataacgaaaaggaatagagatattctcgagtttgacaatgatacgaattttccttataaaatatttttgttttgtaaataatttctgtaaattcttaataaaattcttctggtcggttcaaagcttcaattcttaatctctggttcatatttccataatagcagctggtccctttgaatcaaaaactgattattaaaatgataaattcaaccgaaaaattgacaaaaaattttaacaatttatgccaacgaagtattttaagaatataaaacaaaaaatg

SEQ ID NO: 115707 - DNA, 65 bp, Heterodera glycines
  Promoter: Source sequence=SeqID_23472; Location=1..65; Strand=+; Gene= SeqID_54171
cccctcggtaacgggcctgaataaatattatttttttaattttattactatcatttccaaaaatg

SEQ ID NO: 115708 - DNA, 417 bp, Heterodera glycines
  Promoter: Source sequence=SeqID_15413; Location=3103..3519; Strand=-; Gene=SeqID_79677
ggttggttggaagagattgaatataaaattaaaaaatataattgggacactttggtgttaacatatttaacaaaaacactgtgtaacggtaattcgaatatttatgctttattcggaagtgaaaagggaagaacgtacagtcaattgtgtgtatatctccggattgtctttgtacaattggagactggtggaataaaatgaaccggggggggggggtgaacaattgtgagggaacagcttaaatagtgatcgggaatggactgccctctgacaaaacaatttctgtcactttatgataaatgcgcaagcattggggctcagatcattagtgcctaaatgtttggccaccaacagtaaaccatagaatgaatatccattcgagatttgattttcaaagaatcatctcttggcgaaatg

SEQ ID NO: 115709 - DNA, 226 bp, Heterodera glycines
  misc_feature (35)..(35): n is a, c, g, or t
  misc_feature (59)..(59): n is a, c, g, or t
  Promoter: Source sequence=SeqID_6153; Location=1848..2073; Strand=-; Gene=SeqID_60524
tccataattatagttatctcatattaattactacncaattcgctgataaaaggaaaatntaataatgaatttattataaaatgttatcaaattaatgaaataatgattaaatgtggttaatattgattgaagaaaaattaagccatgctataaaattaataattacaaaattcattgcgaaaaatatttttataaaaataattcattatatttttacaaaaaaatg

SEQ ID NO: 115710 - DNA, 253 bp, Heterodera glycines
  Promoter: Source sequence=SeqID_671; Location=9278..9530; Strand=-; Gene=SeqID_58681
actcaacgagaagaagtatggtctgctgactcaacatctccccttcgaagtggccagcaaagcgcgtgctatgactctgtctaatgtgctgaataaaatgaacatgaagtgggcttagcgaacattcagtgactttattttgttttcaggcttttcggcttcaattacatgcctatgttcccgcaagcgtcgttcgtttttctgcattaaaatttcttatattctatcttatagtaagagcaaattcaacatg

SEQ ID NO: 115711 - DNA, 244 bp, Heterodera glycines
  Promoter: Source sequence=SeqID_1325; Location=4274..4517; Strand=-; Gene=SeqID_72560
ttttgagaatttggaagctacaattttggaaaaattaacgaaaggaagagtgcaatttatagaggaaaaatgcaatattaatgagatgaagacaacaaaatgaaaaaattaagcaagtataaatgctatttataatgatttcgaatgagccaaatttattttatgggttaaataaacattgaaaggtataaaatgcaaaatttttagttctttgtattattattcttccattttcctaaaaatg

SEQ ID NO: 115712 - DNA, 59 bp, Heterodera glycines
  Promoter: Source sequence=SeqID_13577; Location=1777..1835; Strand=-; Gene=SeqID_77480
agtaatcattttttgagttttttataataattttaaatttttttaaatttaaagaaatg

SEQ ID NO: 115713 - DNA, 1003 bp, Heterodera glycines
  Promoter: Source sequence=SeqID_2964; Location=224..1226; Strand=+; Gene=SeqID_82530
gccaacatttcaacttagggccctcacagcgggaattttttgatccgagttttagaaaaaaagttatgggctaacaaacgcaagaaaaagtgagaaatcggtccccgggactcagtcgtccgcgcagaatttttttctatagttttcccgaattctcctcaaaaagttgtaagacccttccaccactttcagggcgctcccggccttcggccgggagattttgttttttgaaacgaaactccttgtcaatataacatatatagtaactagcgggtgcgtgaaccgtcggctatttagctgggaaaaagcgcttcgcgctttgggagcttcgctacctagactgttacggggaaagaggtacaaccacgggtgggaaggtacaattgtgatcagaagagttacaactacggttttttcagggatttttaggccgcttcgcggcctcgaacgggcgctttgcgcccgtttttaaatttagttgggccttttcggccgcttcgcggcctcagacgtgcgcttcgcgcccgttacaacggtgttagaagaggttcaatagtgatcagaagaggtacaacagtgatcagaagattacaactttgataaaaagggtacaccagtgattagaagaggtacaagtgattagaagaggtacaaaagtgattataagaggtacaaattagaagaggtacaacagagattagaagaggtacaaatttgatgaagaggtacaaaagtgattagaagaggtacaaaagtgatagaagaggtgaaacagtgattagaagaggtgcaacaatgattagaagaggtacaacagagattagaagaggtacaaatttgatgaagaggtacaaaagtgattagaagaggtacaaaagtgatagaagaggtgaaacagtgattagaagaggtgcaacaatgattagaagaggtacaacagagattagaagaggtacaacagagattagaagaggtacaaatttgatgaagaggtgcaacaatg

SEQ ID NO: 115714 - DNA, 526 bp, Heterodera glycines
  Promoter: Source sequence=SeqID_16393; Location=1558..2083; Strand=-; Gene=SeqID_80786
gttcgcccggtaaagaagaagcattgacaaagcagcagaagcgctctgttgcatgtattagcgcgattaggcgccaaaattttaattttaattttttccaaatttaaaaacagtcggcgacggatttagcggccccgtaggactgatggacttcatcggcacgggcagtccacaagacccgacattgccaatgacaatgatgaacgatgttggcacaatgaatcgaggaagtaaaaatgggaaatttatataaatatttcttacaaaaaattaaatatataaaaattattaaattttgtttaatactattaatcttatcaaatcaagcgaatgaatgaaatattaatttaattaatattttcttttttttaatttttaattaaaattttatttttaaaatactaattaaactattaattacaaacaataaccacctacctaactaagaattgaatttaattttgcttttaacaagttcattaaattaataattttaatttacaaaaaacccacctgcacagtgatg

SEQ ID NO: 115715 - DNA, 721 bp, Heterodera glycines
  Promoter: Source sequence=SeqID_10047; Location=696..1416; Strand=-; Gene=SeqID_73112
ttgcttactcgtagaaaaacaaatttgttttcgcttaaaaatttagattttgtcattttggcacttctctagagaaagggccgacaaaaaaccgagaatggggtgaaatttctacaagtgtttttcatgggatgaaattatgtttttcaatcatttttacaatttttcttttccatagcttaagggtagagaaatttaacctttttgatgcattttgtatgcaatttttaccataaaattagggattaaaattgttatcatgatcatcgaccagaaagcattcggctaatttttaatcgtcccctagtctaagacgaaaaaattaaaatttagcttttttatttgttaagattaaaaagatttcttaatttgttggaatttaaatccaaaaaaatggcataatgttgttacataatatggctaacaaataagcgactaggtgcatacctaacttttttcgctttggtgtgtccttttggcacccgtgtaaaatgacttttttacgccgtaaaaatttcgctaaaccgggttgggtttcgaattcatgtcaatacttgtataatcgaatttgagtcgggattctagatttcaaggtcatgatcactgatcaaggcggcccaaaactcataatttaaaattttttttcgaaaagggagcccaccattacattattaccataatatctgatgagaatttaggtacataaattacatagaaaatg

SEQ ID NO: 115716 - DNA, 1003 bp, Heterodera glycines
  Promoter: Source sequence=SeqID_18110; Location=680..1682; Strand=-; Gene=SeqID_82692
cgcgatccgcggtcgcggcaatttgaatgcgcgatgcgcggtgcgcggccgcggtttttttttttgcgcggtgcgccgcgcatttttaagcacaggtaagaatgggggtctggtgagaaaagagaagggaattggagaggaatgagaaattttttagaaaaaaaaatattttttttatttcatttaaagtattcctccataatcttatgtgttgtagtggctaaaccttctgaccttcagtgtttgtctcttgggttcaattcctcaacggaacagaaagttttttcatattttctttacattatttcaattgaaatttaattaataaagaagatattccaacttttatttttctttaatttttaaacagcctaaaatcacaaattaaccttggtcattttttgacaaattatgttaactaatctcgctgaaaatatcaaaatattccggcggcgcctatcggcaccgccgcccccccccccacaatgttcccaaaaagttttttggaaccgcccacaaaaacgcgatttaaaaaattaatagattgttaatttattcaaaaaaaatccagaattttgggactcagaaaatccaagattcccccccccccccccgcatgaaaatttaaaaaaaaatttctatataatggaaaaattcttcgaatgcctcccccaatgagtacatattttaatataggcaattttcgtaacaaagtgcagtcaaattttcaaattttttttcaaaaaaactttcacttgggaaaattttattgattaaattgaaaattttgtttttaaatgcgtggtccgcggccgcggcaatttgaatgcgcgatgcgcggtgcgcggccgcggtttttttttttgcgcgatgcgcggtcgcggccgcggcaatttgaatgcgcgatgcgcgatgcgcggccgcggtttttttctgtgcgcgctccagccctgattaggactaaaattgtaatgacgaagtaatcgatgtacacaccacgatg

SEQ ID NO: 115717 - DNA, 1003 bp, Heterodera glycines
  Promoter: Source sequence=SeqID_5232; Location=1935..2937; Strand=+; Gene=SeqID_57375
ttataaagtatttcataatcatttaaaagacgaaaatatagttttttggttaatttttacgtgttttgctccctaaaaatccgtaataaaaaaattttaaatgccttttttcatgcctttttcgggattttcgtgccttttcatcccttttttgtgagctctagttacaacagttcttttttttgaaaaatgcatacagtcagattgcatactgtatgtttgacaccactagccgtttcgagaattggtcttctcaacattcatggaatttttttgccgtatttcaatttccttttcaacaatcgaacctttattttcggcatcttgctggaattcaaattttgtctttaaaatgaaaagtacgaaaagccataagcgtaaaaagccaaaaattcaaatctcaaaaagaagacaaaatagtcaaaccttgacccatgtagccgtatttaaattaaaaaactttgtttagtgaagtgatacgaaccttttagcttaaacttatttaactataaaagggctttataatgccgctacgacaagatgtttggactcatgattcctgtttggtctgttaatatttaataatttttggtaaataagccaatttaaaggtgtgccagtcagtgcattctacggaggaagacaaaaacaaacacgaattggatgcatcgcataagaaggcataaatctccaattttaaaatgaaaatccttttttatttgaagaaagttgtagtctacgattttctgtccagggagctttcttgcttgacggcaagcaaccaaagatcctttctttatgaacgatattatcgtgcgaatgcctccgttgcgggtcagtcggatttacgatttatggcactatctgatgataaacttcatgaatttaaataggtctcgactgcatttgtgagctcaacttcagctggtcggctgttcccctgtgggcgtgtacaatttgttacgtggccggtgaaacattggaatctgcggatgaccacatg

SEQ ID NO: 115718 - DNA, 194 bp, Heterodera glycines
  Promoter: Source sequence=SeqID_1638; Location=762..955; Strand=+; Gene=SeqID_74994
tttttgttttatgtttttatggcgctgtgccgcccgcgcccaattcatcaatttcaatttgtccgtccgtccaccgttcacaaggcgcttcctttctctctccttcctctttttgcgtctttccgcttcttttcccccaaaattttacatccaaatgaaaaggaaatttttttgttcattttcaaagcgcaatg

SEQ ID NO: 115719 - DNA, 71 bp, Heterodera glycines
  Promoter: Source sequence=SeqID_10843; Location=3509..3579; Strand=-; Gene=SeqID_74114
ttatccaattatttttgttaaaataattaatgttttttttcattttcagccgtcacgtttttccccacatg

SEQ ID NO: 115720 - DNA, 305 bp, Heterodera glycines
  Promoter: Source sequence=SeqID_4721; Location=1355..1659; Strand=-; Gene=SeqID_55523
tcccattgctgatgtttgttttctattcaatatttagtttgaatacttcatctttttttctttttagatttatttttttgttttttaaattaattaaatttattaaaataaaataataattttttttaatttataaaataataatttttttaaattaaatttaaaataacttgaatattaaataaatacaaaaataacattaaaataaaataaaatctaaatattttataaagaaaaataaaattatgcacttttggtcgagctttttgcaataaaagaaaggaagggaaaagggcattaaaatg

SEQ ID NO: 115721 - DNA, 531 bp, Heterodera glycines
  Promoter: Source sequence=SeqID_16926; Location=2163..2693; Strand=-; Gene=SeqID_81356
ggttagcgtagtaataaatttaaaataaatcattcttcattaacttaatttttgtttaattgtatttctttcgcataattaataattaaaaataattctttgcacggtttttgaattttaattttcatttacattttttataatgtatttttaaaatattgttattaattattgtttttaagtatttttccgttactttatgaaactttgtgataataatattataaaatactatagaattttatgaaaatgttatttctttcctttgtttaccttttgacgtttacattaagtttttagattgtgtacattaattgtttcaattcagattgattcatgacttctatataaatatttttaattaattgttcctaaattaaaaaatattttatatttttcttggtcactccctcctttataatgtttggtgttgtccaatattgtcaagtctataattatagattttatattttcgttaatatattttaattttgttttcaaataaataatattttcaataacagaataatg

SEQ ID NO: 115722 - DNA, 382 bp, Heterodera glycines
  misc_feature (28)..(28): n is a, c, g, or t
  Promoter: Source sequence=SeqID_24476; Location=1544..1925; Strand=-; Gene=SeqID_55210
tatatataactagcgggtgcgtgaacgntcggctatttagctgggaaaaagcgcttcgcgctttgggagcttcgctacctaggctgtgaagcgattcaaattgatcgaatggttggagagattttttgaatttttaaaaaattattaggggtttttagtccacatcgaggctcaagacgggcgcttcgcgcccttcgcgtcctcgaacgggcgcttcgcgcccgtttctaatttttgttgtgcttttcggccgcttcgcggccgttttttaaattgtgttgagtcggacgggcgcttcgcgcccgatatttatgggttgtggagtttcgatccgaagcaatttgggattgcaaaagtgattagaagaggtacacatttgatg

SEQ ID NO: 115723 - DNA, 569 bp, Heterodera glycines
  Promoter: Source sequence=SeqID_28492; Location=285..853; Strand=+; Gene=SeqID_59107
tttgagtaataatggcatttcagggacaaagtcattctccaatcaagaggtgaccattttggcatggcaaatgaatgggggagagcattttgaactacggaatttttaataaatagggaaaaatgaatgaaacggactcagaatcagcagatgatattcccaaaatgatcagtgaatgagaattgagtttgactgatcattgacgccgtcgtaatttgatcggcgaaaattttcccgtaggcatttgcatttttttgtccaaattgccaaatttgcattgcactcactcattaattgccatccgaaaaattgataaatttccaaaacccagagaaaaaacaaaaaaatttttttttaaattttatttgaaaatttaagaaaataattgttactaaacgtccattatatgaaactttcccattgagcccatagaagcaataatttgtcatgccattttgcaggccaacaaatatgaaaaatatgtagaaagtgatgataaaaagaacaaaaaattggccgaaaacttccaaaaaaggcaggcggacttggccaaattggccaatgaaatg

SEQ ID NO: 115724 - DNA, 976 bp, Heterodera glycines
  misc_feature (9)..(9): n is a, c, g, or t
  Promoter: Source sequence=SeqID_15211; Location=2651..3626; Strand=-; Gene=SeqID_79412
tgattttanttggcacttcacttgatttcgggtttgaatgtgtctattcttagcttaaaatcccttttctttttattttatggcattccactttatttttggatttctatatcccatattctttgcttaaaatcccttttcttcttattttatggcattccactttttcagtctcagtaatgaaagtttttttagatttttcttcaaattttatgggtttctatcttttcttatggttgaataattaaattgaataccatttgtttgaaatcattagtggtgtgctgctctctaaattctttgattttttttacacaattaaccaacttttaaataaaaaagcttcgaattttcttatattttgctttgatttatttaattttcacatataaggctatgaagactcagttcaaaaagcattaagaaccatcccataaattttggatacaaaatttttttgagatatcttctattcttatttccttttttttgctttatttagccaacaattttattttataatgtttacaaaatttgtataaaatggcttattgtaatttgttcaaccacagaaaaagttttccttgtaatattttatgacttcagtgaatttcaaaaataacttgtttaatttaatttataatcaatttaataataaataaatttcaatgaaaatattaaaaaaaatttttacatttcaaatttttatttaataaaacccaaagttaaagctaataaattaatgaaaattttcaaatcaaatttacttcaattatctcaattttatttcttttaaaaatgccacgtgaaattatgataaatattgatcgcatttttggcaatgcttctccacattcattaaaaattaaataaaaaattattttccgaagaaattagcttaattttaatacaaatatatatattaaaaatattaaaaacttattaattaattattaattatatttttttagtgatg

SEQ ID NO: 115725 - DNA, 636 bp, Heterodera glycines
  Promoter: Source sequence=SeqID_40306; Location=1..636; Strand=+; Gene=SeqID_68680
tatttatttttatatatataaattttacataataccaaatattttcgcgttcatattcttacagataaaatcgcgtcttattctggagtttgtcacagttgagacagaaaaatgaattatttatgtataattttcattttcaaattgttttaaatcagttttttatattaatgtttatttattgtttttattgtattaggatgagtttgaaacaaaataaatattatttatttaattactaatttggtaattctatctttaaacatttattttatgtaattattaaatgatcttttaagtgttaaattcctttttttaaaacatttttttttttttttgtaaatggtttgcggtacactagaaattttattttatttctttttgtattagtacattagttcaattttgttaatttcttttaaatcattaaattatatttttattttatttgaaaattttatttcaacttttttttaggagattatattattttttaaattcaagatcaaattttataaatattttattttattcacgcgcttctgcgacaatttcccgagttgagattgagttaatgtaaaatatttttaataattataattataatatgtataatagataatttccttcaatatg

SEQ ID NO: 115726 - DNA, 611 bp, Heterodera glycines
  Promoter: Source sequence=SeqID_16428; Location=468..1078; Strand=-; Gene=SeqID_80840
attggaccaaattttatgaaaatattgactaagaattgtgtcaaaaattaaaatgatggaaaatgaaggggaaaaaaccaaaaatcaagaaaaattaaaagttagcatctgatcaaatgaacggtttaagcatccgaacatactcagtgataaaatgagcgaataaatcgacgatttttcggcacaatgatttttttcgtcctagggctaaaattaggttttactaaaatgcttctttttggacgattttgatgttttaaatacttaggaatagaaaaaaagattttacattagtacttttggattaaattgaaaatcagtaaaaattaaattttcagacagtttttttccctccctattaagaaaaaatgaaatggaatatgtgtaattgccatatacatagcaaatatttttcaaaaattgtaaaaatgaatttttattattttatttttgttttaattttcattatttataaaattaaatccgtcaaaatcccaccaaattttgatgaaattttcggcaacggatgggacaataaaactgaagaaaatttgatgaatataaaacaaccaaaaattgatcaaaatgaaaattgggcagttcaacaaatg

SEQ ID NO: 115727 - DNA, 361 bp, Heterodera glycines
  Promoter: Source sequence=SeqID_2514; Location=1..361; Strand=+; Gene= SeqID_47319
taaatccgcttaaaccttgcatatcatagagaaaaaattctgcatagattctatgtgaattttgaatttatctgtagtcaaattataggacaaacaaaaaataatattcttttcctctcatcttggcgttcttttttcaagtctctaacacatgaaaaaacatcaatttgcaaattctaataattttgcttataaagatacaaatcactttggacatttagaatcaaagaaaatgattagttttagcattttggttgaaatcatcaaaatgattaattatacatttttaagatgctttcaaatcgcataagcattttgttgccgcattgtaaagtccaatttggcatccgaaattggcatg

SEQ ID NO: 115728 - DNA, 71 bp, Heterodera glycines
  Promoter: Source sequence=SeqID_1766; Location=799..869; Strand=+; Gene=SeqID_75830
gctctaattaagactcatcttcacttccggcggacccaattggtttgattgcaaaggcattaaatgaaatg

SEQ ID NO: 115729 - DNA, 243 bp, Heterodera glycines
  Promoter: Source sequence=SeqID_24651; Location=577..819; Strand=-; Gene=SeqID_55387
actaaaaaataatatatatttaaaaaaattaattattaatttcaattttaaattataaattttacgcgtgccgatgaggtgaagggccttggccgaaccgccaaacttttcgattccgccggcaacggcggcggctgtaacaacacaaataaattaatatttatattttgtaatatgtatgcatagcttaattgaaaaaaggtcatttaattgtttatttagttggcattcttttcgaaaatg

SEQ ID NO: 115730 - DNA, 374 bp, Heterodera glycines
  Promoter: Source sequence=SeqID_17176; Location=575..948; Strand=-; Gene=SeqID_81616
aaagaaaattaaaacatttttgaataataaaattaatagatcgacagatcaccagcggaggaggaaacagccaaaatagtaaaaaaaaataaaataataattgcaattaaaaaacaataataattgcaattttttgccctagcaaattacaacaacggataccaacagcagcaacaaacatcgcaaaattattacaataataatgcatacagcagaagcctgaattacaaccaaaggtaagaaaatggtaaataaaattgaaaataaataaaattattttagacctttggagcaaagcaattacaataattatgggtaaaaaataaagaaaattaaattatagagtaaaataaaattcattgtcagcagtaatg

SEQ ID NO: 115731 - DNA, 1003 bp, Heterodera glycines
  Promoter: Source sequence=SeqID_346; Location=6840..7842; Strand=+; Gene=SeqID_83552
ttaaaaccgccaactcatatgattatgtatgtatatccgttaaattaaatattcaataatatctattaatttttatttgttgtgcaagtaagtgtcagccggaaatattattagtctagcagtgacagactaaaaatctttattaaattaatttacaattatttacttaatttttatttggttgtaccaattacgaattagcaattttatattcgaaaattttgcagttgataattgttgctataaccacgatgtgtgctacataaataaatatcagaaacgttacgattgtgatattaaattttgcaattgccttaatgaatatcctaattgctttctaacaaaagtctgttctccaactcatatcttaaatattttattttttagaatatattatgctggtcagttcatattgttggagaacgttttaaagaaggataaaaataattattttattttaccgtcaatagatatgcatatgtattttaaattttttattgttatgtaaacttctaatatatatatatttatatacataatcatatgagttggcggttttaagaaacgccctggcggttttaagaaacgcccacctggcggttttaagaaacgcccaaagtggcggttttaagaaacgcccacctggcggttttaagaaacgccctggcggttttaagaaacgccctggcggttttaagaaacgcccaatgtggcggtttttaagaaacgtcccagcaccttaaatttttattatttagtgaatttttaaataatatctattataattaaatttcaattaatgtattattttattagtttgatacatgcacttttttcgtatttcgcccaccacgcttgcactttcgtactaccttcatcttaacaagtatataaccattatttatctatcaatcctaattaagcggttgattttttcaatcggataaatttgctgtacggcattctcgctgattcttgcactcccgacgcttgcccaacaatg

SEQ ID NO: 115732 - DNA, 152 bp, Heterodera glycines
  Promoter: Source sequence=SeqID_13694; Location=449..600; Strand=+; Gene=SeqID_77610
ggttattattatttttgtttaattaaataacctttattaatatcccgttattaattaattagtcaatttaattaagtcagtttatatatattttttaccaaaattaagcgattcaacatttggacaaagtcaaatggaatggcaaaaatatg

SEQ ID NO: 115733 - DNA, 107 bp, Heterodera glycines
  Promoter: Source sequence=SeqID_28635; Location=1..107; Strand=+; Gene=SeqID_59233
atttttttcatttcaattgggacaacaaaaaaaacttattttcattttaaatgtctgataagaatcacttaatattagcccttttaattcatatttcagttgatatg

SEQ ID NO: 115734 - DNA, 1003 bp, Heterodera glycines
  Promoter: Source sequence=SeqID_1073; Location=1194..2196; Strand=-; Gene=SeqID_67238
cattaaattattgtcatgacacctacgtaaacttaagccgacccaataagttcattaaaattttgcatttttggtcaaacagcaataaaaaaagagataactaattgtcatttgagagctattatggtcgttaagagtgttcagtgagtaaaagcgggaaaaagtgaacaatgacagaaataattatatgtatggcagggaaggaagacgagaggcctagggctaatctcttaaaaaatttaaaaaaaatggaaagttacaaataaaccgccaccttgggcgtttattggattttgaattttatggtaaaagcagcaaacgaatcaatgtttacgcggtaagtggataatggtggacaatgaacagcgaggccctcatatttgagagtttagtctaaatttgggctttttgagggtattgatggcaaaatttcaatcaacaagtgaagttttttgaaatttttgagcaaatccgtaaaataaaccctttctttattcttgactaaacgaaaaaattttacgcaggtaaagaacgaatttttaaaagtggggtgagcaatggacaaaaagtgcataaataaaacatttgacattatcaaagcaattaaatataagtgcatttgtttccttttgaattatttaatttttttacataatttgaaaaaaaatcacctgttttcgcactttgtgtcccatggctgcatctgaagaagaaagacaaataaaaagccaacataggaaataaaaataaaatttattaaaaaaacaattttcagttttattagtttttaaacttttcataaaataatatttgactgacgaattcacaatgagattctcatataattttgatccttttaaattataattatttaatgctacagaatcttatcttcaaaattatgtatcactgactttttttctgggagccaaaaggataaaataaaatacttttcattgatcagcacaagaaaaacgacgagcatccattcatccatgacatg

SEQ ID NO: 115735 - DNA, 90 bp, Heterodera glycines
  Promoter: Source sequence=SeqID_41893; Location=23..112; Strand=+; Gene=SeqID_69929
agtgaacaacggcaaatggccgggggatgggctaagggaaggtaatcacccgagggaaagtcgaacaaaagcacatcgcaatgtcaaatg

SEQ ID NO: 115736 - DNA, 897 bp, Heterodera glycines
  Promoter: Source sequence=SeqID_18540; Location=1196..2092; Strand=-; Gene=SeqID_83167
ttaattttgcgggcacaaaattcgatggtcggtcggtcgcccaaattgcgcggcgatcatacgaccaatgaacgccgcacaacaaaattgtgaatgtgttgttttgtgcaagaaagtagaaaaaacacatttaagaaataattgaatgaaagttttattcaatttccgatcagcccaaaaaaggcattgatcaaaaaaaacaacaataaaaaaataacagaatgggaagagttcgccaaataatgtgaattttttgtaaaatttagtaaattgccaaattaggcataaataatttgatgaaatacaattaaataccaaaatgtaattaaacatgaaaaaattgtttaaaagaaattatgcaagaaattgtcttgaaaaataatcaaattcctgttacggatcaaaattatggaaaaatcgcaaaacccgtaaccaatacgcgtatttacgtggtccaaatatgccgtaatttccgtaatccgtaatttcttgtagccctgctaatcacaattgaattactcgaacaaaattgcacaaaagttttttttcaaggcacattgacaatttttaatcactttatgatcaaaattattcaaattcctatgatatttattatagtgtccaatttcctgaaggccctaataatttatttctaggaataatttttttaattcatacgtcattatattgattatggagcatacgcacataatttttttattttttatacattcattgatatcattatatgccattttaaaattcatttcattatttttatttcattaatatattaagaatatgactttttatacaggttttaataaaaaatttaaaaatatttctatatttttattgaatatttaactcaactctttgtaattcagagcaaaaatg

SEQ ID NO: 115737 - DNA, 163 bp, Heterodera glycines
  Promoter: Source sequence=SeqID_9614; Location=2602..2764; Strand=-; Gene=SeqID_72092
ggaacagaaagtggaagagaaagtggaagaggaacaggaagcggaagagaaagtggaagaggaacagaaagtggaagagaaagtggaagaggaacagaaagtggaagagaaagtggaagaggaacagaaagtggaagagaaagtggaagaggaacagaaaatg

SEQ ID NO: 115738 - DNA, 169 bp, Heterodera glycines
  misc_feature (20)..(20): n is a, c, g, or t
  misc_feature (152)..(152): n is a, c, g, or t
  Promoter: Source sequence=SeqID_14360; Location=1..169; Strand=+; Gene=SeqID_47191
agtcccgtctgtgcatgcgnttgatcgcgctcacttatctgctcgcatcactttacaaattggacacccaccagccccgggacccttctctaatcgctccgatcagtcgtgatcaacacactcatcgacttgcacctcccaagccgtactcnccgcagttgtggaaatg

SEQ ID NO: 115739 - DNA, 305 bp, Heterodera glycines
  Promoter: Source sequence=SeqID_13351; Location=798..1102; Strand=-; Gene=SeqID_77217
taattaggagccttttttgtcatttatttattattttttttttaattttaaaaggcactccgttgggcggacaatcagtgccttaaaaatggcaaagaaattacgggagcaaatcgtcgggaaatgcttggcacggcactgtacaaaatccatgttcagaacattccgcataagttttttacaagaaatattggtataacaaacaaatatatttgacttttttaattgaaattttgtaaagctttttataaaatttaattaaaaagaataatgtccaaaaaaaatttacagaaaattagtaaatg

SEQ ID NO: 115740 - DNA, 188 bp, Heterodera glycines
  Promoter: Source sequence=SeqID_22099; Location=1367..1554; Strand=-; Gene=SeqID_52748
tataaaaatttataaatatttaaaaatttaacccttaaaaatgtatagctaagaaaatccatattttcataaaaaactgcatgcgtggcattatgtataagaatataataggtaagggaaaagaaatattcattttacacaaaccaaattcattttcatttgtaatgtgccctcattttccaaatatg

SEQ ID NO: 115741 - DNA, 238 bp, Heterodera glycines
  Promoter: Source sequence=SeqID_13997; Location=1193..1430; Strand=-; Gene=SeqID_77965
ggtcagtgacctcgaaaacgcaaggaacttgtttttaagacaataaaatttcgctgacgcattttctgctgacgctttttccactgacgcattttccgggcgccatttgatttacgctcccttttttgtttagacatttctccgtgccaccacttctgtcgcttacaatgttcggcttgaacttctagtggctagccaaatgaatattgttgagccatttgagttggtgaacgaaatg

SEQ ID NO: 115742 - DNA, 197 bp, Heterodera glycines
  Promoter: Source sequence=SeqID_7193; Location=1..197; Strand=+; Gene= SeqID_64103
atagtcatagttggctataaaaattttagaatttattctttaaatttctttaaaatatattttatttttttattatattgaataattttaatatatttgctaaataatattcgaatgaaaatttttaataattatattaaagctaattataaataatttatttcaattagtcatataattaccgttttcaggtgatg

SEQ ID NO: 115743 - DNA, 807 bp, Heterodera glycines
  Promoter: Source sequence=SeqID_13898; Location=1759..2565; Strand=+; Gene=SeqID_77850
agcgggagacacgtgaacaaaggcggatgaattatgaagaaagcaaaaagaacgaaatggtgacgacgcggcgtggaggcaaaatggaaaaaaacttttgaggtcacaaaactttctcaattgtttttactttaactcaagaagttttgtaaacaaaatggatgagtttaggcttttacttttagaaaataggtataaaattatcgcaataaccgaaagctggttgaacaataaaataagcgactcgcaaattttagaaaattttcctttttctttaataagaaaagatagaaaaaataaaaagggaggaggggtagcgtttgtcatttttaatgaaataccgtttgaaattataaaaactccaaaaatacaaaattctgatatactttgtatcgatgttttttcgcccattgccgaatcaaaaatccgtcttattttggtttatagacctgtaactactgaaacactcgaaaatgttatgcaacttgtagaattaatttcgtcactaacagcagttggtcccccattctcacttagtgattacaacactgtaaaattcgacttaagactaaatgtttttccttgtagaaaatttaaacactttaactttaaaaaagctagttacttggaaataaatgccatactctcttctactgattgggttacctttttttcggactgtatagaaattgaccaaatttataacaaattcgcagcatttttacattttttagtatcgaaatatgttccattaacagtatcaaattttaaacataatttcccagaccatattaaaaaaaaattatg

SEQ ID NO: 115744 - DNA, 675 bp, Heterodera glycines
  Promoter: Source sequence=SeqID_5541; Location=1..675; Strand=+; Gene= SeqID_58391
cccccccccccctactcatcaattccaactattttttgagccgtgggcggtccaaaacctgtgagtaggactaattcaaacagtgtcagtctgtttagttgttattcttgttcatttttcatatctttgatgaacctaatcaatgttaagatttttaatgatcaaaaataaaaaaattaatgtttatctttaagtagtgattttttgaaatttttcacttcgttatttttatcattggtttttagtaaatcgtatttatattagtgaaattgaaatgaaaaatattatttttgctaggcggcgcaaatgtcgcggcgcaaatgacgaggcgcaagtgtcgaccttgctgagcggcgcaaatgtccatttttgctaggcggcgcaaatgtcgcggcgcaaatgacgaggcgcaagtgtcgaccttgctgagcggcgcaaatgtccatttttgctgtgcggcgcaaatggcgcatcacgattcaaattaggaaaaggattttggaatatttttttattcattttagcactatttccctttactctgtgtctgtttttctttgtttgttttcatgggcagagattacaacaaataaatatttgttcaagcacatttcttctgccgattggtcatgtttcccccccccccctttgttcattgtcctaaatacaaaaatg

SEQ ID NO: 115745 - DNA, 943 bp, Heterodera glycines
  Promoter: Source sequence=SeqID_881; Location=1453..2395; Strand=-; Gene=SeqID_63217
ttcgaaaacccttaaaaattttacttaattttagttaattaataattaattaattaattatcccattttccgtctttatcacatccggcacttttgtttctgcttttcattgcgcttctctaaaatctctttgcactttccgattggtgagtaattggcacaaaaagcagtgattcatcaacaaaattggcatcatcaaagttcggcacacattttgaaaacaaatgctaatgcttaaatgtaaatctatgctcaaaaggactctcaaattatttttcggttatttattgaaaaaaatttaataatgtaaatggtttattaaattaatctttatatatatatatatatatattatatatatatatatatatatatatatatatatatatatatatatatatatatatatatttcttcatttatttagatattttgtcccaacatattacacattttgattagcataggaatttctgttttttgtttcacattaactaaaagtggtggctgatttttatttatttttgcattcactgcttttggtttattaaatataaatcacaaaaatttccgtgcaattttcatttttaatcgaaagcacagaaagtgatgatgatttcaaatttctttaatttttaaaaattaattaataaaagcgattttatgtttatacatattttgggatttacatatttttttttacatttttggcacatttttacattttttcgtacaaattttgcagtttttctttttatttatttatttttttgggatttttaatgaaatttttcttaaatgcataaaaatagaaaatttcataattttttcgtaagttttgagatcttaaggaaagttcaaaagaattttaaaaataaaatttttattttctttaaattttctcttaatatgaattggatgttaatttagaactaattatatg

SEQ ID NO: 115746 - DNA, 274 bp, Heterodera glycines
  Promoter: Source sequence=SeqID_20514; Location=899..1172; Strand=-; Gene=SeqID_51052
atttatgaagtaattgataattacaatttgataaattcgtaaattaaatccatttttattgtgaaatgctcacttgatcaagggcgtagccagggagtgggctaaagcccccccccgcccccgaaaccaaaaaaaagtaaaaattttcagcaaattttttgaaattttaagctatattcttacaattaacaaattgcattaaaatttttaaagattttccggcagcgcctaacggcatcgccggacccccattttaccatatttttgaaaaatg

SEQ ID NO: 115747 - DNA, 146 bp, Heterodera glycines
  Promoter: Source sequence=SeqID_30640; Location=1156..1301; Strand=-; Gene=SeqID_61048
tcatctatcattgactggcaattagtcatcacaaattggataccaagctattggaaattttagattcaaatgaaataaggcaacaatttgatcgactattttcctggccataacaaaaatattccaaaaataaataataagcaatg

SEQ ID NO: 115748 - DNA, 217 bp, Heterodera glycines
  Promoter: Source sequence=SeqID_3530; Location=1667..1883; Strand=-; Gene=SeqID_85051
tcatgtgcaaagcgaacgaacacaaaaaatgccaaaagattttttttgaaatcggccgtttttcagtcccaaaaagctaaaaattaaatgaaattaataaccgcatcaaacaacattcacttcttttccttgccaatccattcgcacatttccttttgttcagcgccaatgcgaaaccgtcgctgatccgcgccttgtggagcagtacctgaagatg

SEQ ID NO: 115749 - DNA, 274 bp, Heterodera glycines; identical to SEQ ID NO: 114698
  Promoter: Source sequence=SeqID_5; Location=311..584; Strand=+; Gene =SeqID_50784

SEQ ID NO: 115750 - DNA, 246 bp, Heterodera glycines
  Promoter: Source sequence=SeqID_6054; Location=3632..3877; Strand=+; Gene=SeqID_60161
ttatttatttagcgaattccgtttaattttccgaggttttccctgacaaatttttgtttttttttcgacttttgagtattttcaattcaatcgtttgctgtccgattcaaaaactcgagacctgagactgaaaaacgcgagacttttttccgagtcgagattcacaacataataattactaattgtccctcaatttgttttctgttcgctgtgtccctttacaataccatcgaattgggccaaatg

SEQ ID NO: 115751 - DNA, 295 bp, Heterodera glycines
  Promoter: Source sequence=SeqID_7031; Location=3476..3770; Strand=+; Gene=SeqID_63625
tgaatacgagaataagtgaaaagcggattacaaaagaaattggaaagggcaattagagaacaaagtgaaaaaccaatggggtacaattagacaaaaaaagggggggaatgggaggtttcccggccgttgtgtcggaattggccaatgagtgctgacccaattccgaattaaaaccaaattaagacaaaatcagaaagacaaacgaattccaaacaaaagatcgctttcaaaaactctttatctccaccaattaagtccaaggaaaaaaagcgatgaatcaaaggcgaaggctatg

SEQ ID NO: 115752 - DNA, 787 bp, Heterodera glycines
  Promoter: Source sequence=SeqID_97; Location=938..1724; Strand=-; Gene=SeqID_66806
actcatcgatgtaaaaaataattatattttaattttaaatgtatatttttttaatgttttttaatcgacccataactaattgtttattgaaaaagtaattagtagggctgcttaagagtcgaaatttccgagactcgagatcaagacccaacccccccccccccaaaaaaaaaggccgagaaatttcagtacaagtttttttgagaatttttagaatgtatataaatattttcccaacaaaacattttttccaccttttattttattatttttgtgggcaaataattaaataattatcatcattaaatatttcaaaattcataaaaatttaaaaggcctatgctcggcctaacagctaagaccaatccaaagcacccaaaaaaatataaaatattcacaacaaaatgattcatcgatttttaattttaaattaattatttttgaaaataaagaaaaaaatttttttttattattattattttcaacttaaatatttataatcaattaaaattagaatagaaaaaaataaacttatagaggcttaaagcaaaaaattgccaaataaatatatccagcctaaaggaaatttgtgcaaaattttaaggattttgtaaaaaaaccaggaatcacttattaattttcaaacatttgcatttaaaattcttttgtaaaaatattatttttatatttacatttactatttttaacatcataattttctgtaaaacattttgctagcaaatgcttcaactcaaataaaaattccaaataatttggcactaaaatg

SEQ ID NO: 115753 - DNA, 60 bp, Heterodera glycines
  Promoter: Source sequence=SeqID_396; Location=62..121; Strand=+; Gene= SeqID_51351
cataaaacaggtgcttgagaaggaaagcattcaaaatttattggatatgttgacggaatg

SEQ ID NO: 115754 - DNA, 518 bp, Heterodera glycines
  Promoter: Source sequence=SeqID_21985; Location=1462..1979; Strand=-; Gene=SeqID_52618
tagaaaaattttgctgtttttcgtgtacgtggaacaatcacaagaattgaataaaatgcaaaaatcgaaaaaataagtatagaatactaattaagatttatctatgtttatcatttgaaaatttaataatccattaatgctggaggacgaaaatagcgtcttttttgtttgttcacttagatagacaaaataaaaaagtgatgaaaataatttgaagtttgcttttactgcaaattgcaatactttttacaactacctaatttcagtactattttttaattttgaatctttgttcgcgaagaatcttgtagacaaactaaaaatgataaatgaaatttttttctctctctgtcttcacttgagcagagaaaaagagagagaaaaacgccattttttaaaaacatatcgccaattaaaagaattaaaacaaattttatacagtatatcctttttaacagccttattgaacctaattccaagaagaagcgtcctaaattcacacaacggacaaaaaaatg

SEQ ID NO: 115755 - DNA, 110 bp, Heterodera glycines; identical to SEQ ID NO: 98226
  Promoter: Source sequence=SeqID_18586; Location=516..625; Strand=-; Gene=SeqID_83221

SEQ ID NO: 115756 - DNA, 461 bp, Heterodera glycines
  Promoter: Source sequence=SeqID_28027; Location=1055..1515; Strand=+; Gene=SeqID_58688
aaatttttttagcttcattcccgcaacggacacgaaaatttgattttttgtacggtcccgcagggtcggagataaaacactaaatattttttgactaatttaataaagtcgaataatattgttaaactcatttttattgcaaatttcattcaaaacctgtttaccgcggagcataacggcaaaagttggacattttcctcattattaactctaaaaaaatagttcaacaaacgatatttagtctaacagatttgtccaaattatttttgatcaaattttgaaagtattaggggaatctatgtccgacaaagccaataaatcgagaaaaggaatttttagaaggtgaggagttcggatactccgtaaattgcggggtcagatttccctcgaaatcgccaaaatttttttggaccaaacttttttaatgtttgtaaattaagtccattatcgatgaaaaaatg

SEQ ID NO: 115757 - DNA, 964 bp, Heterodera glycines
  misc_feature (62)..(62): n is a, c, g, or t
  misc_feature (91)..(91): n is a, c, g, or t
  Promoter: Source sequence=SeqID_9845; Location=1..964; Strand=+; Gene= SeqID_72866
gatgcatagcccagcgatgccactagaaatttacaaattcaaactacagtgtcaaaaaatgngtagttaagatgaattttgtgtcaattgngagtcaaaaacaatgaaataaattaaattttagctcacattcagctcaattaaaggattttgaagtcagatttggagttaattaaaattaggattccataattacgaagttttcgaaccccccgtaattacgcattactgggtttctgtgatttaaaatcttgttacgcccatactgggtaccgaaaagcgccatcggggaaacttttggaaaaataaaacgcattttataagaattttcatttagatttaaaatatatttttaaatttaattttctccaaaataagtttatggtctagcttcttccaccccaatttttgggtatttctcgattaacccaaatttattctttgttttttaaaaatggcattttatctgtacattctaccccaccacaattcatacgttataaattatagcagaattgcccaagaattttttcgtacatttttccgctatgatggaaaattgtaaagggcggaatcattagggaataatgcgaaaaaggctgctgaatgaatcaccaacaatttttagcagggaaaagcatcgaaattccaacacaatttgtcggcctcattcaaggcatttgcttttcatctctctttcgccaaatacagccattttccgacgtttttactaatttctatcatttatgttttggcgcattcatttttttgttatactaaaagctcatttaagaaatattttgggttttttaaattttggattttctcgtaaatgaaattaaaaattttgtagaaaacttctaataaaaataaatctcactctcgtttttcaatgccctaatttgtaaattgctaaattacagtattttatatttattaatatttcttaggacgctgaaaaatg

SEQ ID NO: 115758 - DNA, 792 bp, Heterodera glycines
  Promoter: Source sequence=SeqID_3297; Location=1705..2496; Strand=-; Gene=SeqID_84110
ttttggcatataaactatttgtttttgttcatatatatttgttctaaggcgaatctcttccgaactctcggggtgcatgtcaaccaaaaggtagccaaaattttttgcgcatgcgttgcgataggcttgcataaagtgggcggtcattgacgggaagaggtgggtggctattgtacggatctgaagagcacccgctgggtttcgcattaataccaaataatgtgaatttgtgcgagcgacgcgcaactctttgttgaacaggtgttgggtcaccaaaattacgctcacgccccaattgtgtgagccgcgtgtgaaaagcgagtccaaatactgttgactcatccccactaccaaatcatccaatattagcaagagtttttcttttttggcgcaatcgcgtacctgttccgcagatgggaccccgctgtgcacagttactggcaatttgccaatttttccagtgcgttgcaaattcaaaacattagtgttcaactctccgtagccataaataacgcgctcaatgggggtagagatcattttctctaaattgcgtagaagactcattacccactctgacttcccactgcatgtactcccagatacaatcattgtgaatggatgacgaaattgcaagtccacgtgttcaaagcttggaaacgaatccattttttttttattgcgcgttgatatttaatatatatatatatatatatatatatatatatatatatatatatatagatttcatttatatatatatatagatttcattacagattaattttttaaatg

SEQ ID NO: 115759 - DNA, 294 bp, Heterodera glycines
  Promoter: Source sequence=SeqID_17337; Location=3939..4232; Strand=-; Gene=SeqID_81817
ttggtgccaattgccaatttataattaataactcattaacacataattaggatgattaattggctctgttgcactttgcattatcatagaaaatttaatgatccacgacataaagtaacagacaactttaacgcttcataactttttccaacagaggcatctaaattaatgatcatccgatagctctaagagttcgctattagccaataaattttcaaaagtttcatttgaatcttttttttcaatcacttagattaaaagaaaactcttagaataataagaattgggcaaatg

SEQ ID NO: 115760 - DNA, 241 bp, Heterodera glycines
  Promoter: Source sequence=SeqID_37477; Location=1..241; Strand=+; Gene=SeqID_66541
ctcctcacatacacttttttttgccccactaaatttttccattttcgggaattttcattttttgttactaattgtaagtgtctataaaagggaaggcattggaaaatttgctctcatttgcattcgtctgtatattcatcaatttatatttgcccattgcgtcaaagcatcgttctgctgctccttcagctacaaaatatcacagcaaacggaagaagtcgtcacacgtggtggcatcatg

SEQ ID NO: 115761 - DNA, 558 bp, Heterodera glycines
  Promoter: Source sequence=SeqID_39583; Location=428..985; Strand=-; Gene=SeqID_68118
tacttttgtttaccttatttggtccatctcaagaaaaatgtccaaaatttttaaatttttacaattaatcggcacgccgaactgaaccttcaccgttttaatagattcaaaaacccctttgttaattttaattaaaaaatgattttaaataaattgcttgtagaataactttttgaatgagtaaaaaaatattctggaaattgatataataaaacctttttacagcaaattatagaattttatatctttctcaaaacgctgctggcataacttcgttctaagcaacgagcaataaataattgaacattttcattttttgtcgtaatatattcattagagaatggacaggcacgggcaccttacgggattttactggaccacccgatccaggaacgttaaattttcgaaaatcagaatctaagcccgagcccaaagccaggcacttaaattcctgtctattttttacacatattcatgattttttctattttcccattaattatttaaggagttttcgtcactttttgctattttctacaatttatttgcattaaaatg

SEQ ID NO: 115762 - DNA, 454 bp, Heterodera glycines
  Promoter: Source sequence=SeqID_10538; Location=2301..2754; Strand=-; Gene=SeqID_73775
ggtgaggaaaaattggattaaaatgtggtttgtgattaattctagagcattcgcggatctaatgatagttcgagagtctcgacttatagaaaatttacattcataacaaaatattttgttataattctataagattttggatttggtcctatgtgttttccttttaccattcagaaaaacattagtgtttttgaacttgaaattttaaaaaaggaaaatacagaaaaattttctgtgaaaattttggaaagtatttttatgaagatacgcaaaaaaatttctactttttttgaagaaaaaaattacaaaaatgagagggagcggggggactgaagtgccccctgtttttcattcatgccattgattcacggattcttgattctttggaaattcgaaaatttacgagaaaatatttttgattgtaaaaattttctatgttttccaggtagacatg

SEQ ID NO: 115763 - DNA, 140 bp, Heterodera glycines
  Promoter: Source sequence=SeqID_5607; Location=1..140; Strand=+; Gene= SeqID_58629
aatttttgaaaattgtcggccatttgtttaatttcataaattgtttcaaaatacctacattttctattttatatatacatataataaaaaataagtgtgtgtgtgtttagatcattcttaaattgttcaaacaccaaatg

SEQ ID NO: 115764 - DNA, 109 bp, Heterodera glycines
  misc_feature (11)..(11): n is a, c, g, or t
  Promoter: Source sequence=SeqID_20224; Location=1483..1591; Strand=-; Gene=SeqID_85024
tgtgggcaaancaacgcgaaacagtagagcgggaagaacgagttattgccagcctcgacaaatttactttccaatttcggataactcagcgctcgatgaatccgaaatg

SEQ ID NO: 115765 - DNA, 243 bp, Heterodera glycines
  Promoter: Source sequence=SeqID_38759; Location=1..243; Strand=+; Gene=SeqID_67479
acaacagcgatttgtttttttaatattatatttaattattttcatttttttaattaagatctcccgagaatggatgcgaatgaacggcgcaatcgctccgttccgcaacattctccagcaggcgtcgtccgtgacaagcactccgtgcgtttgttcatatttctataattaaagtaattagccaattaattagataatcagttaattgtctctttgctcagtttgccaaaccatcggccaatg

SEQ ID NO: 115766 - DNA, 330 bp, Heterodera glycines
  Promoter: Source sequence=SeqID_28988; Location=422..751; Strand=+; Gene=SeqID_59556
ttttttgtctttttgtcggaagaaattaaaatgctgcaatttaaatgatgaaatatcttttaaaaacaattaggtaggtaataaaaaatcaaaaacaaagctttaggcatttcaaaattatatgcagtgaatactgacaccaaagcggaatgattcacgttatcattacattggttagcagttagcctaaatgggttcagcaatttttattctttttttactttatggcgttttatattcctataaaaagaatgagaatttggagtgatcgctttttatgtttgccgcgtccgcggcgtttgaaccaataacagttgtatttttgtgatg

SEQ ID NO: 115767 - DNA, 77 bp, Heterodera glycines
  Promoter: Source sequence=SeqID_44457; Location=519..595; Strand=+; Gene=SeqID_71943
ggttttgtgcattagtgaaaatgccatttagaatttttcagtttagtcttttttaatttgtaaatgtttaagggatg

SEQ ID NO: 115768 - DNA, 526 bp, Heterodera glycines
  Promoter: Source sequence=SeqID_25222; Location=749..1274; Strand=+; Gene=SeqID_55964
tgtgcggcaccgttgtgcttcatatgaccgtaatttgcatgagagaggagacgacgacaaatggtgccgaacaatttaattaaattaaaaacaaaaataatgaatgcattaattaattggcttttcccgcaaccgaaattccctcattagcaaagagagatggactctgaaatcagaatttattaaaattttacataaagtatttggtttatcggaacaaaatatttatttaaatttattttttaatttaataaagttaaatttttcataaaaaattgaaaaataataaaaacttttacaaaaaccataaaattaaaaaaaatagaattgtcactataatatttatatattctattgtagaaaaaatgacaaaataaaaaccaatgtagaaataaattttgtgaatccattgaaatttttctccctttaatttattcaaaatttattattattttaattgttttttaaatccttttttgaattacgttttcattttgcctcagcaacttccttttcggccccgatg

SEQ ID NO: 115769 - DNA, 158 bp, Heterodera glycines
  Promoter: Source sequence=SeqID_10154; Location=1536..1693; Strand=-; Gene=SeqID_73256
ttgtgtaactattaaattattttaaaaaatcatgccaaattaaaaaattttccgttgaaatgccaacaaactataattaattgccttcattttcaaataatctttttgctttttagcatataaaatttgccaatttgtttcccattttggaagaaatg

SEQ ID NO: 115770 - DNA, 1003 bp, Heterodera glycines
  Promoter: Source sequence=SeqID_17046; Location=346..1348; Strand=+; Gene=SeqID_81476
tagagtagagcgggacagggacctgatactgaaaaaacgtagccaaaaagtccagggttttcaacccgaaagtcccagtcccggttttacccaaaaggcggagttccgggatctgattatccaatatatgagaatttgatttcaagatgagtgtagagaagaatggggattgaatatttacacaccgagtcaaaaaacgagacatgtgtcaataaagagagagtgcagagaaactttttttctctaacttttctctccttttggcgtactatctaatattttcattattaggaaaaataatattcacttctctccatataactttttttctatgcatacaattttcaccatattttgcatatcgatagagaaaaaaatataggatttttcaatcgcttttttaaagaaaataatcgctttattttagtctaagatttaaaacaaaatttcgaacgcctatatcttttttctaactcattaaattgcttggcttttgcttagaaaaagcttcttctcatcaagagctttcgaatgataccaagattatacaatttggttatgaaaaccctccaaaaataattcccaaaaagcgtcattttttaattttttggacaaaaaaataaaaaatattcatgttgcacaacggactcgaacctccgccctttgtccctttactatctcacaaaaaccactccgccacacatgcattcactttttgaactaggggctcaaaattgactcggtgtgtttagtaggtattttcttagttcagcggattggtctgaatatcatttttttttttttgagtttagggaattttttttaaatatttgctgttatgtttgctctttcaaataaattttttaattttattttatgaaaaaaaatgaaatccgttgattttgatgatttaacaagccataacaaagcttaaatgtgcttaaattaaggttgctaaaaataaattcaaccttaaagaaggactttttgtcttaatcaaatg

SEQ ID NO: 115771 - DNA, 242 bp, Heterodera glycines
  Promoter: Source sequence=SeqID_10901; Location=2045..2286; Strand=-; Gene=SeqID_74182
tgtgagcaaaatttttgtgcattaaaattttgaattaaaatacctatcgtttttacacctttttactcactgttttttttaggatttgcaacgacattttggtggacattttccctcattttgaccgtcctcagctcggcctcaaattggcactgctttcaccacgttttgaagcgctggtggacaaatattttgacggcaaatccgaactgacaatttggcgtccgatctccgttcacatg

SEQ ID NO: 115772 - DNA, 101 bp, Heterodera glycines
  Promoter: Source sequence=SeqID_7637; Location=1283..1383; Strand=+; Gene=SeqID_65489
agccgctgggcagcagactcttttggctttgatggttcggctttttctaatcactttctctccaactttgaatttatttgtctttcagagcattgaaaatg

SEQ ID NO: 115773 - DNA, 235 bp, Heterodera glycines
  Promoter: Source sequence=SeqID_13280; Location=3024..3258; Strand=-; Gene=SeqID_77113
ggcggcgccaaaccgcccgattcccctccctcgcgccaaagtggcttttaaaaagtgcgcttaaaaaaaagaaaccagtcgcctgggggcaaactcagtaaatgaaatgtcaaaatttcaaaatatccccgtttaaaatgctcaattttaaagttccttacagaatcataaatattaataatctatgaatttagtttaaaatttttgtaatttttcaaaactttttcaaaaaatg

SEQ ID NO: 115774 - DNA, 759 bp, Heterodera glycines
  Promoter: Source sequence=SeqID_20736; Location=1039..1797; Strand=+; Gene=SeqID_51304
tttcttttctttcgttataaaattcctttgttaattagttagatagaattgaaatacttatgcctaaaatcgcaaaatagacattaataggcacaaaaataggcaaataaaaaatcatagacatcctaaatcaagcggaaaacgcgtttttcgtgcttatctgagcttttttaattctcgggggtgggtgaaacgtagcgcacccaaaaacgaaaccctagttattattaggcccggatcacggacaaaaaattaaaaatacaggcagaagtgtttgaatttggtaaacttgacaatatggacaaaaaatttagttctttaatttttgtgactaaaagcgaaaaatagtaactttcacgaaaacaaaaataaataataaaattaaaatatttaatatcaagagaaagatatataacaaatttttaatattttaaacatggaaaaagagacaattttcgaattttgcaaatgcccaaaaatggaagaaacataatgaaatatggacaaaaatgaatttgttaaaatccacgcaaatcacagagaaaacaatcaaatccgtctgaattttaagtccagaatttccgtcactttcagttgcgttgacagaatttttgtgtcaaaaatggacatttttgggtatttaaacgttctattcattaggccaaattcatttctactcacaacaaccatttgccattctgctgactggtgtttcgtatttgcttgtggcttcttcctttttcgttatgcaatggaatg

SEQ ID NO: 115775 - DNA, 191 bp, Heterodera glycines
  Promoter: Source sequence=SeqID_39726; Location=1191..1381; Strand=-; Gene=SeqID_68227
aaaatcccattttgttttaacaaaaaaaataaagaaaaatttcggaaattttagattccctgtaaattggcgtttttattgccaaccaaatctcgaattattcaaaatatgccgaaatccggtctcaccaccttttcagtgttcctacgtcaagtaatttacattacgatttgttcacagcagaatcaatg

SEQ ID NO: 115776 - DNA, 270 bp, Heterodera glycines
  misc_feature (9)..(9): n is a, c, g, or t
  Promoter: Source sequence=SeqID_14241; Location=1..270; Strand=+; Gene=SeqID_78257
ctctatccncatctgaaaacccaaaaatttgggatttttccctctataaatatcagaccctgtcaagttatttcaagattagtctaacctttgaaaaatgtagcctgatcaaaaatcacaaaaatacaggatttttaacccaagaatccgggtctaattcctggaacctagccctaacaaaatttttgaaaatctatgcaaatcctcataggttcgctggacaacaaatggagtatggacacgccgcggcgcgcgtatgataaaagtatg

SEQ ID NO: 115777 - DNA, 511 bp, Heterodera glycines
  Promoter: Source sequence=SeqID_8974; Location=770..1280; Strand=-; Gene=SeqID_69879
aatacaataaaagtaagcgaatttctaactttttaaaattatttattattttcagcgctaattaaaccttcaaattatgacaaattaaaaaaagatgaagcaatattttgaaattaaaggaaaattttaattttatttgtttaattaattaaaaaagcaatttacaaaatttgttggatatgaagccaattatggtcaattaattattttttttgaattatgtgcccaaaaaaaataaatcattttgagtaaattgctacactttccttttaatttattttttccataaaataaattattttataaattattattttttgcaataattatttcttaaaaaatttgagtaaaaaattgatttccatattatgtatgaattacgtcgtgaatcacatattaatttttaaaatattgttgaaaagaaaaataattgcgtaataacatttaatgcgaataaaacattaaataaattcatttaatgcaataaattcaatttccaaaagtaaaaatg

SEQ ID NO: 115778 - DNA, 144 bp, Heterodera glycines
  Promoter: Source sequence=SeqID_10499; Location=1782..1925; Strand=-; Gene=SeqID_73715
actaatgaacaaaacggggaaattatatgtattcaagtggaattggaaaagcattgacaaatgagcattgtattgaatggagataaaacaacaaaatgaaaatggacaaatcactggagaaaggcgcaaaagatcaaagaaatg

SEQ ID NO: 115779 - DNA, 700 bp, Heterodera glycines
  Promoter: Source sequence=SeqID_42452; Location=168..867; Strand=-; Gene=SeqID_70342
aaattgttgaatcccaattttcaccctttttttattcattcgctttttgaaatattcctttttcatgcaaattttattatttttgttatttgtttatgcgattctgataaattgataatgaacttagttttttataattttttaaaatgtagttttcgactttttcactaatttttggcttgggcgacatttcgacgcagcgacattatgacgcggcgacatttcgacgcggcgacattttgacgggcagcgcattaggcagagcaactttcaagagcatacatatttaaagattaaacattcgtcataatttgtcttctcttttttatcggttcatttcatcttccgccctcccctccccttttttcggccgatctctcccccccccccattctctccctcttttctcccatcagtcgttcattttcaattatttctttctcattttctgttatttgaaattgcaattatttacggttaaggagatgaatttattgcgtttgttaagaaagtgcagcgaagtgaagtgaaaggggcgcccatcgcttctcaattctcagcaaacgccggcggataatccgtcgcatcgattgacctttctttccccgcaaaatcgcacttttctcgcgccgatcacttctcccccccccctcctctgctcatattttattattttcaacagatcacttaaatactaatg

SEQ ID NO: 115780 - DNA, 1003 bp, Heterodera glycines
  Promoter: Source sequence=SeqID_12724; Location=2139..3141; Strand=-; Gene=SeqID_76422
taaaatttttcttctaaacttttcaaaaaagcaatattcatggataaatctcaattgaattttataaaaatttgggaacaaacttataataataatccaataacagtatgttggttgttttatcttagttttcgaactttttgaccaattcaaaacgagattcttaaacaatttatgaccgtttgtgctacatacaacacttaaagctacagttattttttaaataccgtataggactgagcacagcggacggccaaaacgcttaaagcggaggcaaaagacccaaaaaagggtagggtgaatgggatggcttgatagctcagacggctccctgaaaatccgacaccggtaaatacgacactggaaaatgcgataccgtcgaaaaattagacaccgagagaaagttgttcatttcaagaaaatgcgacactcgtaggataaataatgatttatccttattttattgttttttgcaacgattgtttttcgcgttaatttaaaatatttttgcatccttcatttaattttccttttgattgttgtcttcgttttcgttcttcgtgttctctcaagttttttatattttgtgcttttgaattattgtaataaaactacaaaatttggtgcttttccccgtggactttcattcaacaacaacaaacgcccaaaggcttaattggtactgttatttgagttcctaattgcaatttgccttattctctaattccttgtcagtaaagtggtgttgaaaattaagtaaatctttccttgaccccaaaatctcaacccgaaccccagcaaatcccaaagtccctccccgaatatacgccctttctccaacgtggcgctcctgcaaaagcgacgtaaaatccaacctttcgacgccgaattgcaaaccgattgtgtgcaagcgacattggaaatttggtcaacactaattttggaggatttttgttttgaattttttctttctccttttcatttcaaagtttagaaatgtatg

SEQ ID NO: 115781 - DNA, 1003 bp, Heterodera glycines
  Promoter: Source sequence=SeqID_8033; Location=3931..4933; Strand=+; Gene=SeqID_66765
aatatttcgaattaatccaattttatgaaaatttaatagcattttattcgaggaaaatttttttgcgtccagaatttacggacagaactcgtctgtacggtctctttcggctaaaaagtactaaataagtgtgtttcggcccaactgtagaaactcctaacttaaaaggcgcataacaacacaaacaaacaaaaaatgtaaaacaaatatatttattttcttggctaaattaataatataaatttattaatggcttgccgaaggcccaactggcaatttaaacataatcaaagacactcaagcaggttaagtttttttatcattctgaatggcatatagaaacaatgtagtcagtccatgcttgtcggacttagctcttttgatttgtccatcgggcccttaatacctatttttatatctatatgtcccatacaattattaccgaaaaacatatttccttaagtgactcacggtccatatacgaagcaatttttgaaataaaatttgaacccgaaattcgtattggcttacaaaaaactgtatccgttacagagaatttgagtggggaaaaagtggcagttagagatgttcttaagataagatgtatctatctattttaataaaaatacaaaaccttcgcttaaaacgtcaaataattcatccactattaagccgactaatgccccagctccgccaattaagagctcagatttttttaatagccgaacttcacggaagttttcccaaatttaaatttggccgcggaatattttttacctatttatgtacatattttgaccaatgttagaggtggcttattatatatttttacctagtcacacaaaattttcaaggtacttagaacccgtcttcgcactaatccaaagtctgttcttattgatttcgagctcggttttttatttttgaacttttgaatttattaaaataattaggagcgagaagcgcatttaaacatatttggcctcaaattcaaattagaatg

SEQ ID NO: 115782 - DNA, 952 bp, Heterodera glycines
  Promoter: Source sequence=SeqID_14945; Location=1835..2786; Strand=-; Gene=SeqID_79109
tttctcttttttttttgacggggtaagtaaattttagtttttggatggcactttttgatgataattatgatgccatcatcttccttatctattctgtctatgaaaaggggcaaattgtgtgataaagaaaaaaggcattgcggtaaaatcaaaagaaaaatttaatggactatatgcaaatattctttttgtgacgggccagccagattacatttgggctaaacaaataatttcgtgtcagtggaaaaccaattcctaatcccgaactcgaacaagactcaaaattcgaagttttcgatttggttttttttaatttgcgttagcatcgggtcagttcgccgccccgtatcgtttctcccccggccctcggggtttttttttaaataaacttttgaaaaaaaaattaatgattttttttagaaaatttttgcataataattcatgaacattcttgattgaaaaaatcgctagaaaattttaatttatttttaaattaaattttcttgtaaaaaaattttcgtggtgggagaggggtacgaactgttccattttggggtcgctttcttttgattttaccgcaatgtcttttctttatcacataatttgccttttttttaaagactaatcagataaggaaaatgatgccatcatatttatcctccaataaaacgaaaaatgtgccaccaaaaaactaaaaattactcactcacccgtcaaaaaaaaagaaaatgccaaaacttcttccagcagagctgctcttagaaatgactggctttgtcaaatttagccgaaaatgggcaaactgtcgagtgtcatttctatttgacaaatttctgattgaaaaaattggccattggttaattcacatgcaaaaaattgtataaaaaatttaaataattaattaataattaatgcagaaaatttttaggcgaaaaaatgcaccgacaaaatg

SEQ ID NO: 115783 - DNA, 75 bp, Heterodera glycines
  Promoter: Source sequence=SeqID_29369; Location=1..75; Strand=+; Gene= SeqID_59873
tgcaagtataagcgcagaagtgaatgaatgggaagaacaaataccaaggaaaaatgacagaaaataattcagatg

SEQ ID NO: 115784 - DNA, 336 bp, Heterodera glycines
  Promoter: Source sequence=SeqID_33782; Location=655..990; Strand=-; Gene=SeqID_63736
aaaaatttaaaaatttagcctattaaatattttttttaaatttattatatttttttttttgaaaaattccgagttccgacttccgacatttttggggtcggaattccgacttccgaaaatttttagtgcctcggaactccatccctgctatatagcataagtattttggaattggcatacattttgtatttgcaataattttcccaacatcatttggtccttcatagacttgccttaattaattagccaactaattaccaataaatacccaaaatatccatcaaatataattcctttttttaactactaattaataataacaccacccaaaaaatg

SEQ ID NO: 115785 - DNA, 557 bp, Heterodera glycines
  Promoter: Source sequence=SeqID_20268; Location=675..1231; Strand=+; Gene=SeqID_85075
ttttgttcacttcgcgcgacatttcccgacaaatttagagcaattaacaaataacaagcttattgattttctaacacagcaaaaaaggcataaaataaaaagttataataaatatttttctccatttgttttctatattaattaactaattaattaggacatataaacttgtttaattacgtaattactcataaagtgaattgcattccgtgatcagcataccaatttgcgggttacttgagcctgggacatgtgaaaacgttgcaaaacatgatatcgatttccgttttctccaaaaaaagaatgtgagaaaatgaatggttaaagaataaaaaaatatttattaattaaaattctaataaaattattttaattgtgaaaaattttcattttaacaatttttatcattttgttttcaaattcactttttaaaaacacttttaaattctttgattgccatggaaacgaaaataaaaaccaaatttttacttttgcccagggtaaaacaacaaaatcatttaaaaatattttatcaaattgtttgctattaataaatg

SEQ ID NO: 115786 - DNA, 1003 bp, Heterodera glycines
  Promoter: Source sequence=SeqID_4045; Location=755..1757; Strand=-; Gene=SeqID_52951
attattttgggaatttttgtcactaaaaatccgggccctatttatctaatatgaatttaacggttattttttgtcaattacaaaaatatttcaaaatttgttaaataaaaaaaaattctgtgagaaaggagacaataataggagagattttagagtaatattaggtattgatgaaaaaattgggcgattgtttcatttttgtaattgaattctattgttttatatattttatcttgatttgacattttttaataggtaaaatcagtgtccgtaagcttaaaaaactttattcaatgccggcttttgccttctgatgaaagactctgctattcaacaactgacagatccagaaattgaatctgctctacagagatcgaaacaggtgatttttaaggaaaatttgcattgggtagggaatattttgtttgttattcgcattttgcaataagtgagtgttttatgttcacatttgattttatcacatatgtatatgagaatgcggcaattttggtgaaatttcttttatatttgtttttgatgatatttgtgttgataatggaattacattatacatttacattgcattgcatttccatttttgaactccaattttctatttcgttgttacaatatatctaaaattgagcggtcctatttagagtatacaacaggcgaggtctgcctcgttgcgaccattttatcattatgcatttatttagcttgctgcttctaacggaggacaaaagagaacattttccgacgacttgaattgtacgtacaaataacatttgtcgcttcacatttgccacacattttccttcgtttttttcattttcatttaccacgcgatttcatagtgtttgtacggtttgcaaactttgaatttcatgtgcattttcgatttaaaacattgacatttggttttggggtcaatactcaatagcggtttaatgtcctttttttagtttatccggccaagcgaaagagtaacggtaccgacatg

SEQ ID NO: 115787 - DNA, 752 bp, Heterodera glycines
  Promoter: Source sequence=SeqID_14836; Location=599..1350; Strand=+; Gene=SeqID_78987
ttgccaaattgttgaaatccaaataaccacacctggtggctccctacacttgctgagtgttaaggatttttgaagatttgaagataaaaccgcgtattgcggaacctcaccacaattgtgtcttttggtttttagttgaattgaactgctatattagcagacctcacaccacctgggtgctattggttttcgatgaattgcagtgtcttcagtagagaagatggctgctgactgcgccaatttgttgtgttcctccaattgaacacacaaagaataaaaatatttattgatcggtcggtggacaaatgcaaataataataaaaacgaatgaatgagggaagagtccaaaaaggaggggaatggtctccttataaacacaatgagaaggggggaaagggcgtggagaacaaagtacaaatatgaaaataattaaaaaggtcaaaacgccaatttaacatttccaacaggcacaaatgtcggggctccgggtaaatttagggaaattttgaggaggcgcggaattgccaaagacacatcgtaaaaatgacgcgattggtcagcagattttccctaattgttgcaaattaatgcacaaccgagccatttggcacttctaaaaatactgtttttatgaaagttttccaattttcaatgaattttcctgattttctcgtattccccccccctttttaagatgggtggacaccgccttttggcatttgttcttctgctccattctcattgtcattatg

SEQ ID NO: 115788 - DNA, 1003 bp, Heterodera glycines
  Promoter: Source sequence=SeqID_5161; Location=1414..2416; Strand=+; Gene=SeqID_57112
atatataaattgtcctatcccaatggggaattgaacccaagggacagacaacgaaagaaagaaggcttaaccaccagactacatatatatgtttactttataatttgtaagcagcggccggaaaaaaaattgtaatttttaatgcgatttgtttacagatatttgtcaaaaaatgaccaaaatttaaaattgtgactttatgtcataaaatttcaaaaattctcaaccatgagaaaaaaattacattttcattgacataatgccataagtaattaaatattgttgaaaattacaaaaatttgtcaaatttctttgaattttttaaaacttttccaaatgcttatttccaaggacgtccttggcatccaaggacattttttattttcaagaaagagggtccaatttcaaggacgtccttgccattcaaggacggatggaagccctggatttacctattggttttatggttttttatacatttatattaaaaggaaatgaacaataatataattttgggattagagggggccagagactcgttaaaatttaggtaacatgtacttgagaattacggttccaacaatcaaacgttttatgtcttgaccatacttacctagtttcttatgccacaactttgttttctaacttagtcaaatcttacattcttgtttcttgagcacaaaatttagataatcaaaaacttatagactttaagctttcgattgataccaagaatgttgtggtcttgatcaagtatgaaaaaaagttatggcctaagaaatatgtgtggtcattaattggacgcataaactgcagtagagcccttttttctgttatagccacccctccattaaagccacccccatacgctttctttggccacaaaaataagttgcgcatttacaatgccttttcaattcaggagaatctcagcatacaaatacatattttttgtccaaattcccgtccattgttgtaaatacacaataataaacaaacgatg

SEQ ID NO: 115789 - DNA, 160 bp, Heterodera glycines
  Promoter: Source sequence=SeqID_7459; Location=187..346; Strand=-; Gene=SeqID_64889
tttataagtgccattgattaagccaaagtaaaaaccgcttattaatttcggtaacatttattcaataatttttatttgaattcgttaagcaaaaaaaatatatataattgtgcaaaaaaagcattatcattgaattgttaagtgtgcgggcgcaacgatg

SEQ ID NO: 115790 - DNA, 518 bp, Heterodera glycines
  Promoter: Source sequence=SeqID_12983; Location=1851..2368; Strand=-; Gene=SeqID_76746
ggtaatttcgaaatgagaaaatttgctgaaaaaaattttcatttttcaaagttggcaaacgcgcaaagaattgctgagctggagcaacagttggtcacacaaaaagtttgcttctttttccccgccgaaatccatccaattttgagcgaaaatttaagggaatggaaaagcaaaaaattgcgcaagcggtcgaagaacagcggaaattggacgaaaggttcgcacgattaggaaaatttaaaaaaaaaattttttttttttgtgattagtctagttggctcagtggtttttgtagtatagtcaatggaaaagggttgaaggttcgagtccgccccatgaattactaattttcttctaggcaaaggctaagcgatttttgacgatttagaaaaaaaaatatgggcgttcaaagaaaaaaaaattttttttctaaccgacccacttcaaaatttcgacaatgtgtattgcaatttttttatgtctgtgaaattatgtgttcgttcagtctttccaaaatg

SEQ ID NO: 115791 - DNA, 205 bp, Heterodera glycines
  Promoter: Source sequence=SeqID_1267; Location=161..365; Strand=+; Gene=SeqID_46739
agtacgtcaaaatgagagatgcatttttctcttcattctattttttcgttaatccctcgttttttgggacgaatttttcaataattaacgcttaattattgcagttgcagcaaattttctcagattggcagtactaatacgtatcaatgatgttaattttaaacaattgcatttcctagagataaagaaattggagtttgaaatg

SEQ ID NO: 115792 - DNA, 208 bp, Heterodera glycines
  Promoter: Source sequence=SeqID_5821; Location=698..905; Strand=+; Gene=SeqID_59335
aagtgaatgttctaagaattgtgactaaaagacgggggcaatcgtaaaatgaaaggcattgccaaagagtgggctttttatagcaccaaaagaggaggggggggattcgctgagtgaatccggcgacgtttcccttctcccctccacagcttggcaatcgcagtgtgcgcgaatgcgtttctttttactacacgtggaaaaaggcatg

SEQ ID NO: 115793 - DNA, 298 bp, Heterodera glycines
  Promoter: Source sequence=SeqID_8932; Location=1..298; Strand=+; Gene= SeqID_69693
acgccaatgcaattaaatgctaaatgtcataccctcaagtcaatttgctgcagtgaaagtgattcgtcggtaagcatccccgacggcgcttgtgacgcgtccccttggcacttccaaaccaaatagtccaccaaagcgtttgttgaccggtgcacgtcgcggttgctttgcagagaaagaagtttgtagcaaagggccgggaaattgggcgcactttggtgggactgcttgccggggggcaattggggatggaaattggtgaattcgtggaggcagcgaaagattgagacgagcaatg

SEQ ID NO: 115794 - DNA, 79 bp, Heterodera glycines
  misc_feature (28)..(28): n is a, c, g, or t
  Promoter: Source sequence=SeqID_41800; Location=1384..1462; Strand=-; Gene=SeqID_69842
attgattaatatcaacattattttattntggtcgaattaaaaaaagttatgaatctttaaacttgtctgcgccaaaatg

SEQ ID NO: 115795 - DNA, 74 bp, Heterodera glycines
  Promoter: Source sequence=SeqID_947; Location=635..708; Strand=+; Gene=SeqID_64753
tttcttttactgaaatgaaataaaaaattcaaagattttcagtcgctttgcaatttcccgagggcctcacaatg

SEQ ID NO: 115796 - DNA, 158 bp, Heterodera glycines
  Promoter: Source sequence=SeqID_36034; Location=936..1093; Strand=-; Gene=SeqID_65479
cgcacattgaagaggtcttcaatttgaaaattttgggttccgtgtcaagccagagaaatgcctctttcgtcaaagtaagagatcaaaaatctcggatttatcattgatcaggacggaagcgaccggaccaaacaaagagtcaggctatttctgaaatg

SEQ ID NO: 115797 - DNA, 148 bp, Heterodera glycines
  misc_feature (46)..(46): n is a, c, g, or t
  Promoter: Source sequence=SeqID_22405; Location=1..148; Strand=+; Gene=SeqID_53067
tgggatttcgattaacgcaattaggtaattagatgcatttatttcncattaatatcaataaaataatttaataaccaaaaaatagacgacgacaaagaaggagaagacaaagaaaaaggaggaaaaggaaagggaggagatgaaaatg

SEQ ID NO: 115798 - DNA, 54 bp, Heterodera glycines
  Promoter: Source sequence=SeqID_924; Location=5734..5787; Strand=-; Gene=SeqID_64149
aagctgaattaattcaattccttaacttaatatggtcgatttaggcatataatg

SEQ ID NO: 115799 - DNA, 501 bp, Heterodera glycines
  Promoter: Source sequence=SeqID_8683; Location=1389..1889; Strand=-; Gene=SeqID_68840
gtcatgttgtgatctgttgcaaagatatacaccatgtaaaatatgccaatttttgacggtgcaaaagaataggcttagactcaatttttttaatcgtttaaaactcaatttttaaatgactcaaattttaaatcgtttaaaactcaatttttaaatgtaactgaaaagtccctgctatgctaataatcagggcttctttttttatgtagatgtttttttcctgcattctccatagcctaattagtaggaaaaacactttctttttcatgtttgcgaacaaaaatcgggacttttaaaaattaaaaattttttttgaaaatgtacccctaaaaaatcgtttttttaaagatattaaaaatcaatttttaaaataaaaatgtgaacgaattgttgcattaaaatgagaatttcccgactaaaaatgtgttttttgtgcacttctcagtgaaacgaagcaacagaaaaaaaaatgaaaaactaaaaatcccatccctgcagatg

SEQ ID NO: 115800 - DNA, 242 bp, Heterodera glycines
  Promoter: Source sequence=SeqID_9694; Location=3236..3477; Strand=-; Gene=SeqID_72379
tctgaagaacaaaaatgtcaatttgttcggctggaaaaaataagcaattttgaggactgttaaatttaatttttaaaatttgcccatttaataaaaaataatattccgttattttggggcgctttccccctgctgatttggtcttgctggagcacttttcttaagaacccaagattcactagcaatctacaaaatttgtttccaaaactccacggacacttggccatcctcccctgtaaatg

SEQ ID NO: 115801 - DNA, 1003 bp, Heterodera glycines
  Promoter: Source sequence=SeqID_1869; Location=1705..2707; Strand=+; Gene=SeqID_76464
aattaatcaaagaagtttttaagtcaataatttagttaaaaagttaaattgaaggggggtgacttaattttcttggccgggtcacaaaaaaccaatcgctttttttgtgtccaaatttattcattataagaagtttaaatgtttacaacgaataaagaagaggcagttaacgaattaactaattatgatggcacgggaaatttaaaaaagaaggaactgctgcaatcaacaaaatctctggcgaaaaaacaaaacaccaatctcactattctaaatttatttaaaattaaaaaaccaattaatttattaccaaggctgagtttttaaaggctgcctattttatgtgttccggaaaaccttaacgttaatccgcctgataccggtcctaaaaattttatatatacctattctttccctaaaaatagagtttttaaattcatccccttcatttatatgattttttatttgcaaaaacccacaaattcatttttttagttcaaatctgttaaaatatggccataattctcaaaatttcccccgggcgcctgtcggaaccgccgggcctttccttagtcggtccgatcaattcttggtgcaatttaaataaaaatgaatttttctttttcttttttccttttattaaaaaaacatttttgaaatattgcatgctaattagggttatcgaatgatgtcacatatcaacgaacaggtttttattagttgactctgagaaaatatggcattagctatgtatgttagctgttctttcgtgatcattgcttacaagaatttctgctttgatactacctgaagatgcgtgcgttttttctcaaacatctcctaattcgtcgcttcttcttttctgattccacacgttcctctatttatgaaattctgccttgtctttttttctaatataatttttgttgtatttatacgttgtatatatatatatatatatgaatacgtcatatcttttttaaaaatttctctccaggcaatg

SEQ ID NO: 115802 - DNA, 1003 bp, Heterodera glycines
  Promoter: Source sequence=SeqID_7034; Location=1190..2192; Strand=+; Gene=SeqID_63640
ataaattattgttgaataattaaatttctttttttctgtttccaagttctaaagcctaaataattcccctgatcgaaatcatttcgaggagggctctggaatttattaaattaggatttttgatgcataaattattgttgaataattaaatttctttttttctgtttccaagttctaaagcctaaataattcccctgattgaaattatttcgaggagggctctggaatttattaaattaggatttttgatgtgtgctaatattgtgattttaaaatatatttggcgttttgttatttaatttgtttcatttttgtttgtgatttttgtggagtgttggttgttagtttatgctgtcgcagttttcctattgattgtcctcgccctaattttatttggaattaaacgataatcatcttcggcattgggctgtattgttttgtgtttgctttgggctgttgtcttttgccgtgggcagtgcaacaacattattaaaagccccctgacaacaatcatatctgtttttacgacttggcgctcctggcaccggtgaatcagcagtggacaataagaaatttggacgtggcctcgaattgaaaaaagggaaagtaaatccctcgacaagtgttgaagaaatcggaaaaagggaaaacaaattcccaacaagagaagagcctaatcaaccgactgtggacagctaaaaattgtaaacgggtaaagtaaaacccacgattagacgagccaaagcgacattccggtaaacgggaaacatcccccaactttcaacggactgtcgacaaaaagggtgaacaaaaacccgggaaacgactcgaggagcagacgaacaaggcggaatttttttgtttggaaaacgggaaaagcaaatccctctacttcaaaaggaaattgtgaaagaaatcacgcaattttgtcagtccggtaaagtaaatccgtcgacaaaaactgactcgcaaaaccgggaaaagtaaatcccaattcgacatg

SEQ ID NO: 115803 - DNA, 150 bp, Heterodera glycines
  Promoter: Source sequence=SeqID_8187; Location=1..150; Strand=+; Gene= SeqID_67246
cggattgattatcggtgccatttttacgccaggtgagcgcaggccaatccacggtcaatatcattggccaattggctatgtttagcatggcgacaggtcaagtcgaacctccaacagggacagctgaaccaactgcccccgttggacatg

SEQ ID NO: 115804 - DNA, 133 bp, Heterodera glycines
  Promoter: Source sequence=SeqID_30508; Location=1407..1539; Strand=-; Gene=SeqID_60910
gaaatttgaataaaaaattgaaaataaaaaattttcaaaatttttttttttgttttaaattggattaaaacaaaccaaaacgttttggccccacgtttttgacgcccatgtaggggggggggggtaagaaatg

SEQ ID NO: 115805 - DNA, 248 bp, Heterodera glycines
  misc_feature (160)..(160): n is a, c, g, or t
  Promoter: Source sequence=SeqID_7107; Location=1876..2123; Strand=-; Gene=SeqID_63861
ttaaagaaaaaattactcatttatatctataattttgttatcattttaatctattaaattttaaaattgtaaaacacgagactcaagtggcacaatccgaaatcccttcattcaaatcatcatgaacgaattgttaaggttggtaagaaacaacgaattntgggcacccgacgtttcggggccgtacggcgagggcaaggataagatattggcttttctactgcgtgccagttgacggcacattaatg

SEQ ID NO: 115806 - DNA, 136 bp, Heterodera glycines
  Promoter: Source sequence=SeqID_52; Location=1279..1414; Strand=-; Gene=SeqID_56550
ggtaataatttaaaatatttcgaattttaattgatttttgtctttttctcaggaattggccaatgcccgtccaattggccgaaattagcgacaaaaaattcggcggatttttgagttggtcgccgtacagagaatg

SEQ ID NO: 115807 - DNA, 138 bp, Heterodera glycines
  Promoter: Source sequence=SeqID_32238; Location=1..138; Strand=+; Gene=SeqID_62562
gccgccgccaccaccatcacaaattgaagatcgtgttgccgttgccaatgccaccatcaaatgccaaagtcgccgcccgacagaaggccaagacttcatcgacaacaacagtagcaaaagtcgtcgccacccaaaatg

SEQ ID NO: 115808 - DNA, 387 bp, Heterodera glycines
  Promoter: Source sequence=SeqID_11009; Location=704..1090; Strand=-; Gene=SeqID_74327
ttttctcgccatattcatgcgaattttctaacattttccgcacgggcccagcgaggacagagaaagaatctgaaaaaaacaaatgccaagcaaattgtgagacggattggacgcgttaccccaggcgatgtccaacaaaatgatttgccaaattgtgttgtggggaaaacagcggagcaaaatgacagtgataaaagaacaattgagaacgacgagaagacgctgaactcgtgccgaaagtcggtcagtgaacaaagcctaaaatggacaataaaagggaagaaaatgatggaattgaaaaggaaacgaaacgaaaccaaagagccaaatgtgaaatagaggaagacgagaacaaacaacgaaaagagttgaagggaatagccaatg

SEQ ID NO: 115809 - DNA, 1003 bp, Heterodera glycines
  Promoter: Source sequence=SeqID_17518; Location=1044..2046; Strand=-; Gene=SeqID_82024
aagcgaaaatttcgcttttcaggttgatttttttgctaaattagtaaattttaaggtgtatcgtgttttttcttcaaaaatggtattttaataccatatttagctatttttgaaagttttaccttacattgagcgaatttgaagaaatttttaaaatttacaccccaatttggaaaaatttatgtccatatttttgccattttatgtccatatttcgcgatttttggtccatattttatggccatattttgcgattttatgtccatataaatccccgccctaactattaccgacaaaattatgcaagatcacaaaagatgaaagtgaaaatgaagaaattaaatttaatatagactattattttattgacttcatcttctgaaacaaaacaaaaaaaaattactatttctgcgtttttgatttttggcgccgaaacgaccctggcgccgaaacggcggcgccgaatcggcggcgccgaatcggcggcgccgaaacgacccgttcccatttccttcaacttcacttcgccaacatttgctcgcgtacatacataccacatattgattttcattcacatttttcttctcgacaatattcctttgtttttccgtaattttaaattaaaaaaaacatttttaatcatttatttttaaaatttataaattaaatttatatgcattcattaattaatagggattccttttttaggcacaaaaaacgcaaaatatgcattaaataggcacaaaaataggcaaataaaaatttttattttgtctatattttattgcaaatgaaagtaatttaaatatttcaacttttttttgaataaggccaatttttaaataaaaaattttatcaagaaaaaatttctaaatttagaggatcaatttcttggaaaacttttttacttcttaggcgtttattgtaaatcttaaaattattttatgatatatacgcgacgcattttacaataatagatttcaattaaattaacctgaaaatg

SEQ ID NO: 115810 - DNA, 118 bp, Heterodera glycines
  Promoter: Source sequence=SeqID_41663; Location=1306..1423; Strand=-; Gene=SeqID_69741
ggtgctcctttcggcccattctttcccattttctctcttatttagtcaacgatcaccgcaactgtgccaatacattcgtcgtcagtgttaagagtgccaaaatcaaacagaagaaatg

SEQ ID NO: 115811 - DNA, 62 bp, Heterodera glycines
  Promoter: Source sequence=SeqID_19299; Location=264..325; Strand=+; Gene=SeqID_84041
ggtaatccgcttaatgtacatttattttattattaattattttgcttttgccttcagaaatg

SEQ ID NO: 115812 - DNA, 542 bp, Heterodera glycines
  Promoter: Source sequence=SeqID_2998; Location=1..542; Strand=+; Gene= SeqID_82706
tcatcattttcgcctccccccatcatatcgatgtcccgtccgacagaaaaaagggggtgccgccgtcgtcgtcgtcaacttatgcgaggtcgagagcgatgggagaagacaaaatcagtggagaatgaatgtcttaagcaaaaaaggcgctaaaaggcgcgacaaaaaatttttgatgacaaaagacggcatttttcggagataaaattgggttataatttaaagttaattcagaaaagaattaagctgataatgagattttattttggtaaaaaaagggtggtataattttgatttaagacggcgacattttttgaataataattgttttttttttggagaatttaaatgataaattatgcagaaattggcattttgagggaattttttttatataaaatgcaaagaagatagtatatttttttgaatatgacaatctattttaaatcataatttaaccgaaaattgaattaaatttatttattttattaaattataagtaaaaaaaaatcaaagttaattaggcatttaattgaaaaatg

SEQ ID NO: 115813 - DNA, 1003 bp, Heterodera glycines
  Promoter: Source sequence=SeqID_15653; Location=393..1395; Strand=+; Gene=SeqID_79956
gtgtgcttcccctcccctccgctttttccatctttccgtccccatcggtccttgggtggaaaagctttcattttctaaattatacttttattcatttttatgcaaaaattattttaagtttttctttaacattttaaaattttcattttaaatttttgcagaaaaattctgattattacgcaaattattcattaaatataaatgtcgagcagtttggctgatcggatgaagctgatgttgagcacgggcgaggacgcggatgtgcactttttggtggggcaagaagacgcaaatgaggcgagttcggaaaaaatgtatgaaaaaatgaattctatctaatttgaaaccccctccccttgcaccgaaattgacttcaaaatttaaattttttgttttacttttcattgtttgtttcaatggatttttattttaattacatttgtgggcgtgttggaaaaacaaaaattaatgaagccgatgggggggggggcgctaggaaaatccaacactacaccaactttaaatttaaaaaatattttgattgtttttatcaagtttcgaattgaattaaaaaaaacaaattggttgcgccattcgatgggatattgccggattgtttacaaattttttgagatgatcaaaaagggcatagaaataaatataataattatatgcctaccttaaataggttttatggcaataaaatatttattttaaagaacttaagtatgtaacttttattgcaagtattttaaacattcactaagtcaaacaatcaaaaattatttgaaatttaaaggtggtatggtgtcggttttttcagtgtcggattttccagctccgatggagtggggctttaccatttttaattgtgaattgattttaagctcatacaagcccataaagtcattttgaagcgtgcttcggacgtgtttggggcaatgttccgttttgatgcgaagaaagaaaaaacagaaaatagtaaaaactcaataaattaatg

SEQ ID NO: 115814 - DNA, 629 bp, Heterodera glycines
  Promoter: Source sequence=SeqID_7739; Location=1..629; Strand=+; Gene= SeqID_65789
aggcaattaagacattgtttaaaaaaagtgatcaaaaagaattttaaagagaggagaggagagagagagaaggagagagtggagaaaagaggggaaaatgagagagagacagagagaggggggggggagggagagagttagagagagagagctagagagagagagagagaggcggagagagagcatggggagagggtagagaggggggggggtccttgaaaaatgttacttattagaaaactaattaggcaattaagacattgtttaaaagaagtgatcaaaaagaattttaaagagagagagagagagagaaggagagagtgagagtggaaagaggggaaaatgagagagagacagagagagggggaagggagagagttagagagagagagagagagagagagaggcggagagagagcatggggagagggtagagagggggggggggtccttgaatacttattagaaaactaattaggcaattaagacattgtttaaaagaagtgatcaaaactaattaaggaatgaaaaatgcattaatcaactgagacaattttggtgcataaaaaacgctgatcaaaagagatgaccaatgtcagaaaaagcaccctgttgatcagtgggaaatg

SEQ ID NO: 115815 - DNA, 759 bp, Heterodera glycines
  misc_feature (14)..(14): n is a, c, g, or t
  misc_feature (16)..(16): n is a, c, g, or t
  misc_feature (19)..(19): n is a, c, g, or t
  misc_feature (21)..(22): n is a, c, g, or t
  misc_feature (25)..(26): n is a, c, g, or t
  misc_feature (28)..(28): n is a, c, g, or t
  misc_feature (37)..(37): n is a, c, g, or t
  misc_feature (57)..(57): n is a, c, g, or t
  misc_feature (59)..(59): n is a, c, g, or t
  misc_feature (67)..(67): n is a, c, g, or t
  misc_feature (72)..(72): n is a, c, g, or t
  misc_feature (74)..(74): n is a, c, g, or t
  misc_feature (81)..(81): n is a, c, g, or t
  misc_feature (91)..(91): n is a, c, g, or t
  misc_feature (94)..(94): n is a, c, g, or t
  misc_feature (101)..(101): n is a, c, g, or t
  misc_feature (105)..(105): n is a, c, g, or t
  misc_feature (107)..(107): n is a, c, g, or t
  misc_feature (112)..(112): n is a, c, g, or t
  misc_feature (122)..(123): n is a, c, g, or t
  misc_feature (128)..(128): n is a, c, g, or t
  misc_feature (132)..(133): n is a, c, g, or t
  misc_feature (137)..(140): n is a, c, g, or t
  misc_feature (157)..(161): n is a, c, g, or t
  misc_feature (169)..(169): n is a, c, g, or t
  misc_feature (194)..(195): n is a, c, g, or t
  misc_feature (209)..(209): n is a, c, g, or t
  misc_feature (217)..(218): n is a, c, g, or t
  misc_feature (228)..(228): n is a, c, g, or t
  misc_feature (231)..(231): n is a, c, g, or t
  misc_feature (233)..(233): n is a, c, g, or t
  misc_feature (240)..(240): n is a, c, g, or t
  misc_feature (263)..(263): n is a, c, g, or t
  misc_feature (267)..(267): n is a, c, g, or t
  misc_feature (277)..(277): n is a, c, g, or t
  misc_feature (279)..(279): n is a, c, g, or t
  misc_feature (284)..(284): n is a, c, g, or t
  misc_feature (299)..(299): n is a, c, g, or t
  misc_feature (303)..(303): n is a, c, g, or t
  misc_feature (308)..(308): n is a, c, g, or t
  misc_feature (320)..(324): n is a, c, g, or t
  misc_feature (327)..(328): n is a, c, g, or t
  misc_feature (331)..(331): n is a, c, g, or t
  misc_feature (343)..(343): n is a, c, g, or t
  misc_feature (347)..(349): n is a, c, g, or t
  misc_feature (356)..(359): n is a, c, g, or t
  misc_feature (362)..(363): n is a, c, g, or t
  misc_feature (365)..(366): n is a, c, g, or t
  misc_feature (371)..(371): n is a, c, g, or t
  misc_feature (379)..(379): n is a, c, g, or t
  misc_feature (382)..(382): n is a, c, g, or t
  misc_feature (397)..(397): n is a, c, g, or t
  misc_feature (423)..(423): n is a, c, g, or t
  misc_feature (429)..(429): n is a, c, g, or t
  misc_feature (432)..(432): n is a, c, g, or t
  misc_feature (450)..(452): n is a, c, g, or t
  misc_feature (456)..(456): n is a, c, g, or t
  misc_feature (459)..(459): n is a, c, g, or t
  misc_feature (478)..(478): n is a, c, g, or t
  misc_feature (501)..(501): n is a, c, g, or t
  misc_feature (508)..(508): n is a, c, g, or t
  misc_feature (519)..(519): n is a, c, g, or t
  misc_feature (532)..(532): n is a, c, g, or t
  Promoter: Source sequence=SeqID_21605; Location=1..759; Strand=+; Gene=SeqID_52204
aacttccacttctnancancnncanntnaattaacanataaatttctttttttaatnanactaaaanttctncnatttatnattcctaatnaanaaattcnaaantnaactnttcttctatnnttccnacannaaannnncaatatcctcaaaatannnnncaaaatcncatccataaaccaaatccaatttcnnttctcaatttcccnaatctttnnttcccatttncantnccacatnaatccttttttcaataattttancatnttttaataantncttcntcaaattcccccatnattnaactnctaaaaatttcnnnnnttnnaanttctattcaatnatannnaatctannnnacnnanncatcnatctttcntcnttctctaattttctnttctctatttctcttcacttcttttnatctcnccntatccacttcttttaatnnnatancantaaatttcaataaattctnttaataaattaaaatatttacanttaacanaatatcatttntcaattccaatanactacaaccttctttttggtcaaaaaattagcagtttatctttggcgcttttttattatgaaaaggtaatttatttgaatattttattcaagcaattagcattattattttagttaattaagaataaaaatacattgataaataatgaaaacacaataaattcggacgcaaatggagaggctgaagaatgcccaatttgcttacaatcattagacaatgaaaaaatg

SEQ ID NO: 115816 - DNA, 174 bp, Heterodera glycines
  Promoter: Source sequence=SeqID_14685; Location=664..837; Strand=+; Gene=SeqID_78797
ttttttgaattgcttcatcaacaagtggtaatcttaaaaactaattaagtgtaatataaaaagttacttttccgtaaaactttcgcatttcgacagtaaaatttaaaatttaagttttgatttttgtaaaatttaaattttaataattttacaggtgggatttatccgacaatg

SEQ ID NO: 115817 - DNA, 120 bp, Heterodera glycines
  Promoter: Source sequence=SeqID_43734; Location=864..983; Strand=-; Gene=SeqID_71340
ccaaagtcggcactggcgctggacggcgcggacgacaggggccggcgccactcgagtccggcggcgccggacggcgtcggcccggcactggaacgcgtgtccgaagtgttgacgaacatg

SEQ ID NO: 115818 - DNA, 107 bp, Heterodera glycines
  Promoter: Source sequence=SeqID_12818; Location=1..107; Strand=+; Gene=SeqID_76543
aagttgcggttttattagatatgccgaaataatgaataaataatttctctatttctttctgtaagaaatggactaaaaaatatttctttttcaggcctaaacaaatg

SEQ ID NO: 115819 - DNA, 56 bp, Heterodera glycines
  Promoter: Source sequence=SeqID_22213; Location=2134..2189; Strand=-; Gene=SeqID_45699
acctgacaaatgcgtccgaattggagcagttgcgcaatgaaattgaactaagaatg

SEQ ID NO: 115820 - DNA, 184 bp, Heterodera glycines
  misc_feature (41)..(41): n is a, c, g, or t
  misc_feature (78)..(80): n is a, c, g, or t
  misc_feature (82)..(82): n is a, c, g, or t
  misc_feature (122)..(122): n is a, c, g, or t
  misc_feature (134)..(134): n is a, c, g, or t
  Promoter: Source sequence=SeqID_24487; Location=1..184; Strand=+; Gene=SeqID_55216
ttttgggaagtgtcattcatttgtggctttccaaacgtatncgctgagggaatggcacattcgggacaaaatatgccnnnancaatgccaattgggtggcactttcaaaatgcgcagggttntattttatgttntattttattattttgaatattcatttcagacttctgaatcgttttgcatg

SEQ ID NO: 115821 - DNA, 123 bp, Heterodera glycines
  Promoter: Source sequence=SeqID_12383; Location=2409..2531; Strand=-; Gene=SeqID_47032
gaatatcctatgaaaccacaagattttctccttttgtatattttgtaggattatgttttatttttatttttagcatcacggtcataaaaaattttttaaaagtctccaattgtctgcaacatg

SEQ ID NO: 115822 - DNA, 99 bp, Heterodera glycines
  Promoter: Source sequence=SeqID_6448; Location=2009..2107; Strand=-; Gene=SeqID_61606
cttcctgatgctttgccatcaggagtaagaattaaattatatgctgatgatgttaaattatatatttgttataaagcaagaaccgaaacagaaattatg

SEQ ID NO: 115823 - DNA, 1003 bp, Heterodera glycines
  Promoter: Source sequence=SeqID_21222; Location=996..1998; Strand=-; Gene=SeqID_51812
caaaaataaaaaataaaaataaagtaaaaccatgattttttttcttgcacttcgttttcccttttttctcctttttatgacaataatttgcttttaccctttatatcactgattatttccgaatttttcatttttaattcattttctttgatcatcggttcaaattccgctcgaattttaaacattttttgttgtttcaattcggaaacattttttgtcaggaaaaggcattttccacaactaaggcatttgtatggttgttcagggttcggtttgcttttgccacaactataatttaaaagtgatggaatttcgaaggaacaatatttaaaatcttagtgagacacttgcggaccgcgttttctggattgaactgtctaaaaaataaagagtgatcattcaatttgaatttttacatgtgatttcgtcgccgaaatttcgccggacataatttagccgacgaatttaaaaaaaaataataaaaactcttaaaaaaatttttatatgaaaattcaaaggaaaaattttttgaaaaaggctattgtaaatgtgaaaagtttatataaaccgttcccaaaaaaatttcatttttcacgtccgataaaaaagtaataatttaaattttgaatatttagttatcagcttaccgtcattaatttcaattttgggaggatttgagtaatctttaaatgcattcataacttttttttattttttgacagttcggccccttatcagtccgcaaattgtcggctaaccatttaaaaagtggaatatttgttccaagaaaatttttgaaattttgcaaaaatagtttttttaggagggagggggggggggggggcgcgaatggcagctcctaatataataattaaatgtttaatttattattcataattctttttcgttttcaactttttctgtctttaaaaataatacaaataaattattttattttttctatgcaaatgtaaaccaacaagcaaagatgtttcccgaaatg

SEQ ID NO: 115824 - DNA, 196 bp, Heterodera glycines
  Promoter: Source sequence=SeqID_4349; Location=1476..1671; Strand=-; Gene=SeqID_54132
atgctgaacaggcggggattcgtgaatgtttgtcccaaacaaaaaaggttggatggtattggcacttccattttcagtcggtcttttcgtcgaactcaaaatgccacgggcgcccctcccgcgattgtccagctttggtcgagtgcacaaacggtcgagcagtgtcggagtcgggccgaattctcggctgggaatg

SEQ ID NO: 115825 - DNA, 227 bp, Heterodera glycines
  Promoter: Source sequence=SeqID_27679; Location=1..227; Strand=+; Gene=SeqID_58349
tatttcgtttcaaattgaatcattttttttggctttttgaaataaatgtgaaaaatatacgaaaattattttcggttttaattatgctgtacaatgcttttaagccccgccgtgcggcggctccccttttgtgcactattttagtttttaaaattggttccggactttttggctttttgaaataaattgtgaaaaatatacgaaaattattttagcttttaattatg

SEQ ID NO: 115826 - DNA, 446 bp, Heterodera glycines
  Promoter: Source sequence=SeqID_9773; Location=689..1134; Strand=+; Gene=SeqID_72648
aattttcttcccccactgctaattggttacttttctgttttagacccccccagaaattttcaaataaaaaatcatttctagggtaatttgtgacggtgatcaccaatataacctttgttttgcaaaattccgaacccctaatgaactcgaacaaaaattcgattcataaattacaaggaaaacgcattttggtaacagttcagtttgtcctcacattttttaattttattttaaagtcataaaaaacattttaaggggtattcgggatagctgatcacgaatataacatccgttttgaacaatttcgaaccccgaacatgaattcgaacaaaaagtcgaattgaatttcgctttttttagaaaaaaggtttaaatggtattttattccatgagtgttagattttggtttattttcatgaatttcattcgtttttagacgaaaaatg

SEQ ID NO: 115827 - DNA, 1003 bp, Heterodera glycines
  Promoter: Source sequence=SeqID_4194; Location=210..1212; Strand=-; Gene=SeqID_53547
aagaataaaaacaacccaatgactcatagagcttttaaaaaatgccttccttactaacacataaaagttccaaagaatcaaatcgtaaaaaaaaacagtttctacgaggccgattcagttctgtccatattcgtactgttttcacatgggagatgaacagacacagagagtagtagcatgttagacagtacagtttagacacacatgtacagtacgaataggggacagtatgcttcgtatggtatggtcctcccccaaaatctactatcatccgtacacacatttgctcttttcttcttccctttctcacttctttctattcatcctcctcctcctcctccgttttcctttccaattcttttccttttcctccttttctttgggcgccggacttttcgacagaaatattataaatttgaggaggggacttttcgacagtaaaaagtaattaagttgaaaatataggggttgtaaaattgtaaaatttacccaaaaatcaaaaaagttaagccaaatttatattgagataaataatttttaataatcaaaaagaaaatatataagtaaattttggagatgaatttttgagaaaatttttcatttttatgggtgtatttttctgaaacttttctatataaaatttttttgaacaaatttttggataggctaccgttatctttgtagtatttgtccctcaattaattaccttttttatcaaattgaaaaattacaaacaaagcaattatttgattgtaatgatgtttggtcggtcgatccaacaaaactcagtgtgggcataaaaaaactcagtgattgataaaataattaaattaaattaattatttctattcattaaattaatataattattgcattcatcaattatgtatataaaagtattttttttttaattataaatattgttaacatttaaaaaaataaaaataaacattctttttactttgggattatttttgagtgcaaaataatttagaacaaaatg

SEQ ID NO: 115828 - DNA, 230 bp, Heterodera glycines
  Promoter: Source sequence=SeqID_8932; Location=2967..3196; Strand=-; Gene=SeqID_69694
aactctattggataaggatatttatgagtgattaattgtgtgttcagttagtgatcgacttgattgacagaagcaaaaattattgtccggctctttttttcatcaacgaaatcagtcgcatggacccgtgccacacatccattcattttttaccggtaatgacccaattctctattaaaattctttatctttcccatcattagcgcgtttcttggaaaatccgcgaaatg

SEQ ID NO: 115829 - DNA, 136 bp, Heterodera glycines
  Promoter: Source sequence=SeqID_5240; Location=1848..1983; Strand=-; Gene=SeqID_57402
aatctcacctatgcaaaagtacgagttgccttttgtgcgagttgtcatgacaccacatttctataaattttactaaaaaaaaagaggaaatcttttgggagtgataacagattcatcaaaaatcggggtaattatg

SEQ ID NO: 115830 - DNA, 585 bp, Heterodera glycines
  Promoter: Source sequence=SeqID_17190; Location=1..585; Strand=+; Gene=SeqID_81639
cccccctccccccccccgaaaaatgtttctagatacgcccctgggtttatacatgtgcttattttagcaccggccctgccgggaccgggacatttcttttcaataattccgggacctggaaaaccagtaattcccggactggtcccgctcaactctattcaaaatcgaaaactggtcacaaacttttgcagtttcgagggctcgattttttctcaaaaaaattagtataaaagatagagaaaaatggcaatgactgccattttttctacaaaaatattggctaataattcaggggaatgccatgccatacaaaatgtttcattcttgcttttgagcccctttatattgcttctaaaatgacaattgctctttcattttgtttgtgcattgtttaattttaaccgaattaaatttttttttcacacacaaaaaacgaaaacaattccatttaaattgacattttaatgattttttcctcttatttttgtaaatatgtaaatgcttaattaacatgattttaatcagttttactaagcaattttaaatccatcgaaaactatcttaataatttgccccgacaaaatg

SEQ ID NO: 115831 - DNA, 82 bp, Heterodera glycines
  Promoter: Source sequence=SeqID_7877; Location=2803..2884; Strand=-; Gene=SeqID_66253
aagtatgctcaaattgttgtcctgtcgaactcattctgatttacgcttttaatgtggcttcgatttgcaggcagaaaacatg

SEQ ID NO: 115832 - DNA, 94 bp, Heterodera glycines; identical to SEQ ID NO: 97954
  Promoter: Source sequence=SeqID_33311; Location=351..444; Strand=+; Gene=SeqID_63408

SEQ ID NO: 115833 - DNA, 215 bp, Heterodera glycines
  Promoter: Source sequence=SeqID_9694; Location=2632..2846; Strand=-; Gene=SeqID_72380
attgtttcaattttcaaactaaaaatatactataatgttaacttggttttgcaatttctaatgttttgagatattaaaactcttaagattatgattgatgcggattttaacttttgagattagggctatacaaaagatacatagataggtgtcattttatacttgaaaactaaaagtgttttcgttttgtgttccgtttgctgtcctctgaaatg

SEQ ID NO: 115834 - DNA, 369 bp, Heterodera glycines
  Promoter: Source sequence=SeqID_19682; Location=934..1302; Strand=-; Gene=SeqID_84422
taagagcattttaaagccccaatttcatttaatgccttccatttctttaattaaatgtgtttatattttcgggtatcactcgcacattatcggacaataatgaactgactcaaaaaagcttctgttctgagctcaaaatatcgtattatcgtataaatgaaagacttttaaggccaaaggatgataatttctacagactggctaaaatttcttctctaacgatcaattttgtggaatttttttaaaactgaaaagaataccttttcaaattagccacaaaattgatatattattaattttaaaagctaaaaagatttggccatcttttttacatccctaaagattcattcggttaactaaaaaaaaatg

SEQ ID NO: 115835 - DNA, 676 bp, Heterodera glycines
  Promoter: Source sequence=SeqID_28646; Location=516..1191; Strand=-; Gene=SeqID_59240
attaatttttgatttctgtttttggaaaaacccgattttttaatatttacccaaaaaaataatttcttcaaataaaataaaaaaacgttaaaaatgacaaatttaaatactaaaaatattctatttcaggtacattttcaaaaaaaattatcaaaattttcttaagaaattttataaattctcaaaaattcccaaaatatgtaaaaaaaaataaatatgtacgaaaaaattgctaaatatgtactaaaaagtcaaaatatgtataaaatatttacatatgtaatatgtagaaaaatcccaaaatatgtaaataaaagtcccgatttttgtttgcaaacaaagaaaagaaagtgtttttcctactatttagaccatggagaagccaggaaaaaaatatgtatttacatattagcagccctactgatttatattgcaaccggtgaatgcccccccccccccccccctttccctcccttttctctctctcgccattttttgctcccttggactgccccaacccatgtgccgttatttttctctttttcattttgcattcgccatcctttcgtaattggggttcctttgaattcctcctcttcctcttccccctccttttttattctcccattttttcaaattttcattgaatgttttccaatttcagtttctgcaaatg

SEQ ID NO: 115836 - DNA, 115 bp, Heterodera glycines
  Promoter: Source sequence=SeqID_15001; Location=4603..4717; Strand=-; Gene=SeqID_79157
caaaagccaacagatttcaaaaaggaaatgctgattttcacataattttttcatctttgctaagctaatttaagcacgtccaaaactgtcttaatcatttccgctcaacaaaatg

SEQ ID NO: 115837 - DNA, 178 bp, Heterodera glycines
  Promoter: Source sequence=SeqID_27542; Location=530..707; Strand=+; Gene=SeqID_58248
ttttcagtggtcgtttgctctgaaaattgttatttttttaaacaaataaattttgtttttaatgcttaatttattttcaaattgtaaaagttaattaattaattctccaattttttctctgtttccatttcacttttcattattcggtttttaaccctttaagcgtgccattgaaatg

SEQ ID NO: 115838 - DNA, 175 bp, Heterodera glycines
  Promoter: Source sequence=SeqID_1115; Location=1..175; Strand=+; Gene= SeqID_68072
gactcgcagaataaaaatggcacaatatttgtcgatgacgcggtgttcacggagcaatactgtgccccggaatttgatggtgacaaccatttggtaaagaaataaaatggttacggtaatcaagttgaaattttattagatttctcgaaaatttgacatttggtcactcggaatg

SEQ ID NO: 115839 - DNA, 266 bp, Heterodera glycines
  Promoter: Source sequence=SeqID_28827; Location=147..412; Strand=+; Gene=SeqID_59411
ttttttgtgtcaatatgtgatggaaacgcaacaaagtaaaattataatgttactttttcagttattagcgcctgttttctagatttttattttgaagcctaaaaactttaaaaaaaattttgaaaactatattttggcgtttttaaagtttatttaaaaatgcaataaaaataattcacccttgaaaatcgaccccaaaaaattcttctgcaaaattaagtgaaaaatcctcaaaaattattttttagatttaattcttaaatatg

SEQ ID NO: 115840 - DNA, 430 bp, Heterodera glycines
  Promoter: Source sequence=SeqID_18556; Location=1104..1533; Strand=-; Gene=SeqID_83184
ggttttgagaaaatggtaaaaaatgtatttaaaataactctgtattttttacttaattatcatggactaattaataattatgactctggttaaaattttactcccaaagttggtaaaaaactggtaattatttttacactcgacttaatagcaaatatataaaagaataatttaaattataccataaattaaaaaataaatgaaaaaataattttaaaaactctgttttgtattgatcaacttcttaaaaaaatttacacaaaattatttaaaaattggctatttagattaattatttcacagctttcacatctttgacactcatattattttttcgagaataatattatttaaaaaatattttcgccgcatttttccattaaaaaatattttctttttaattttcttccaccttttagaaaatattatg

SEQ ID NO: 115841 - DNA, 193 bp, Heterodera glycines
  Promoter: Source sequence=SeqID_2765; Location=2363..2555; Strand=-; Gene=SeqID_81466
accaacgtttgggtgagtgtcggtgatttacacagcgcttttttataccactttgtgtaattaggcgttaattaatccaacatttaggcagtaatcattttattagtcccttctaattgacacagacacaaattgcaaaaaaaaaattttttatttctttcgccattttctttgacttttccctttaataatg

SEQ ID NO: 115842 - DNA, 323 bp, Heterodera glycines
  Promoter: Source sequence=SeqID_8274; Location=4249..4571; Strand=-; Gene=SeqID_67522
ttaaatgattattttttcccttttcctaataatgcaaacaaaacctttccgcctccgttttgttcgtttcgttctttgtgtaaaacaactcgcagcttatgttgagtgattttgagcagtgaatgcttttggagtgtctttttggcccatttcattcattttcactttttgatttttgcattttgaaccttcaattttaaaaatgcttttccaaaggtcaaaaatttaggaaattgtttaaacaaatcaatctttttaaaatttgaaataccaaataaaaacagtaaaattaaattattaatatttattttcattttgctatg

SEQ ID NO: 115843 - DNA, 364 bp, Heterodera glycines
  Promoter: Source sequence=SeqID_31372; Location=1..364; Strand=+; Gene=SeqID_61739
cggatcggagtcaataacgacttcgcaaaacagtgtgtcgtcagctggcacacaaaacacatcggccactcaaaatgttgagtcgtctccaagcagtaaaaaagtgaaggtcgaagatgttgaccgaccaatgtctgctattgaagcaatagcttcaacgccagtttcaactcaaagaaaccgtggcagacctataaaaaaaactcgaggaccaggcgggggaaaaacaaatgattcgttgagcgaaggctcatcaatggatcagagctccgaagccactttaaatgtagtggttttgcccaatgtgcctgaaaaaataaatttcaacacagtgccaattaatttcgccacatcgcgaaatatg

SEQ ID NO: 115844 - DNA, 75 bp, Heterodera glycines
  Promoter: Source sequence=SeqID_5781; Location=1475..1549; Strand=+; Gene=SeqID_59198
taatttgatgttttcattgttttggtttaagaaaagttcattattataattttatgtttattaagtctgaaaatg

SEQ ID NO: 115845 - DNA, 76 bp, Heterodera glycines
  Promoter: Source sequence=SeqID_37488; Location=1..76; Strand=+; Gene= SeqID_66551
gtttttatctgttggacgattcagtcctaaagacatctggccatttcagtcccgggtctgtaactcttcagggatg

SEQ ID NO: 115846 - DNA, 1003 bp, Heterodera glycines
  Promoter: Source sequence=SeqID_5639; Location=5130..6132; Strand=-; Gene=SeqID_58739
aacggattttcaattttttataggaattaatagtttttcgaaaacatttagaaaaaatcgctgaaaattttttcaaaaatttaatcttgaaattttcgtaaaaaactttttgatttttttttttgcactttttccaaaaaactttttgagaatgtgtgagggaagagagtccggcggtgccgctaggcgccgccggaaaaaaatttgtaatttttaatgcgaattgctaacaaattgtgtccaaaaatttaccaaattttgcaaataaaagccaaacgacgactttttttgcttttaaaaatgcttttttttgcggcacgcttccaaaaaattttggggacagtggctcggcgaaaaatttgtaatttttaatgcgatttcttaacgattttgttcaaaaaatgacaaaattttacgattttgagccaatttaaaaaaaaaatttcccatcccctggaactttttacggtacctacccctgtatttacggtatttcgtcactaaaaatgtcaatgaaatggaatgttttagaacataaaaatattatatttttgatcaccgttttttcaacactgatcacaacaatgctgaacaatttacatattaataccaaaaagaaacatttaattgtccatcacatctttcgctgattaatactttaagctccaatcatattactttttttcaatttttgcataaaagcattttccctctcccattttttaggtcatcattttgctcaacagcccaagccaaaaaaaagaagagattattataaatttctaaaaagtattctaattgatgggtcataattttgcccaaattacttttttgccgtcaaatgccagcccataaatagaggggagattcagcgcaaaagatcaaatgttcatgcattcatttacatgcgaagatgaattttatttccaattttcatattttttttatttaaaaattttaatttgtagccagtccaattaataccttattaattcgaaaaatg

SEQ ID NO: 115847 - DNA, 132 bp, Heterodera glycines
  Promoter: Source sequence=SeqID_10072; Location=1592..1723; Strand=-; Gene=SeqID_73138
tgctttattcttggggtttggtgcagataacaacacaaatagggggggggtcgggtagtcttgtggactccataaaaaggaaggggctgtgtagacctctgcctactctttccaacggtggtgaccaagatg

SEQ ID NO: 115848 - DNA, 174 bp, Heterodera glycines
  Promoter: Source sequence=SeqID_14013; Location=739..912; Strand=-; Gene=SeqID_77983
ggtagggaaacttacggtagccattgggaaccaaaacaaataaagttacggtatgtttaagcgactgtggagaaattagaagaaacttttggtcaagtcagcgaaatgctaaaacaacagaagcagaaattggaacagttggacaccgcacaacaaaaattatgtgaaaaaatg

SEQ ID NO: 115849 - DNA, 1003 bp, Heterodera glycines
  Promoter: Source sequence=SeqID_2319; Location=316..1318; Strand=+; Gene=SeqID_79102
gagcaggacaaaacgtcgccagccgaaacgtcatcgggacataatgtcgccacaaaattgtttatttaattttagaaaaaatttatcaaaaatttttgttacctagcctgcctggtttgaaaaaaaatatagaaaattcataaaaattttttattaagaaaattcaagaaaaaatttttcatattttttccttcttttttctgagaaatcagcaaatttagttttaattaaaatttctaattttcaaaaaagctaaaacaattttaaatttttttttgcggcgacgtttcggagtgtacacgagtagttaacatcccgtacttgtcgtcagtgcgcgaaatgtttttcgcgcacaaacgccagggtgtcgggcggttttgtgtttgaagttgccgcttttggcatgtgttcgggattggtgggggcgggattctctttgaaggggccgacatcccgagggtattggcgggtttcgggaagtgattgattgattgatttatggtcgggagagggggagggggtgctaattgcgcgaaattttgattgatttatggactcgaaaaagggagggtggtggtagggggaatggggaatgcagcgcgagttatcgcaatgcgcgaaaacaatggaaatgaatgagggggagtgcgctgggtggcggcggtgacatctggcaacttgtcgtcgctcaacggaattttgacaggatgcggggggggggggggagagatgtcagagaaaggatggaagggtataatatgcagtggatttggctgaggggggggggaattcaatggaaaatttggagaaggaaatattattaatgtgaagctggcggcaccgtcttttgtatatggcggccattgttcggacacttctgttgatcgttgacagaattgtaagtatctttgggagaaatgggtcgcttggacatcactttctttccccaataaacatttttgtactttttttcgcttttccaataaattcccctagagaaatg

SEQ ID NO: 115850 - DNA, 588 bp, Heterodera glycines
  Promoter: Source sequence=SeqID_920; Location=848..1435; Strand=-; Gene=SeqID_64000
tatggcaacgagaaacctctgatttaatttgagttcaaaaataagattcgaaaaaagatcaaattaatgcaataaagattcagcccattaggttatacatatctagacgggtctatccccttgatctttagtggaaggggcaagcatgaagggagtttgggattgcgcctgcagcggcgagggtggcaccgttatttcaatggtgcataacgaatttggcaataagaatgtttgcgtggccagcattcgttgtgcttgccggacgattttccaaactagttatgcaatgacgaattggggaaagcgaaaaaagcaaatttattttataagaaatatttggcaccaaacatgcaaggaaaggaaaaaatagaaaatcaagagagaacaatttttgactaaacttttggtactttttaattatcggtactcacaatcagatttcactttttttaacaatgaatttgttttaggggttttcagggtaggatccgatatttatttcaaccaattccggacccggactcgagcaaaaagacatttattttgataattgggttatttagttttggagaatcaaccaccaacatg

SEQ ID NO: 115851 - DNA, 433 bp, Heterodera glycines
  misc_feature (101)..(101): n is a, c, g, or t
  Promoter: Source sequence=SeqID_30651; Location=1..433; Strand=+; Gene=SeqID_61058
gaaacaatgcagcatcagccagtggacccccagcaggccagagaaaagagagcaccagcccaacttcatcgcttcctgagtcgcgtgccttgaatgcatgnagagcggaaattggcggagggcaacagcgggctgccgattttgtggtccacatcgaactgtcgctttttgtcagcgaccctttgaggacactcgtgtggacaaacgtgttgtggcggacaacccactgcaggcgtttgtggattggctcatcttccaactaccagccaaatacgacacatacgcctactcacactttggcggacggttcgacatggttctggtctttcgcgagctattccggatcgggttcaacccggaaatgctgagacgggtactcaattaagatttttttttctaaaaaatattttaaaaatgtcagggcaacaaaatg

SEQ ID NO: 115852 - DNA, 116 bp, Heterodera glycines
  Promoter: Source sequence=SeqID_18733; Location=44..159; Strand=+; Gene=SeqID_83404
cgtttggtaaaccaatgcgagaattagggcgccattggacaactcctccgaaaggatgatcctggagttggggagatgaccaacagtccgcgttcgagcaagctaaggcaattatg

SEQ ID NO: 115853 - DNA, 69 bp, Heterodera glycines
  Promoter: Source sequence=SeqID_29785; Location=1348..1416; Strand=-; Gene=SeqID_60246
gatcggaagaaacctgaaggaagggaaagtgcgcgactacacgccagaatcccgggcggctgcagaatg

SEQ ID NO: 115854 - DNA, 731 bp, Heterodera glycines
  Promoter: Source sequence=SeqID_130; Location=823..1553; Strand=-; Gene=SeqID_73719
ttttgcagcaaaaaaatggctaatttaatctttaaaaaaccaattaaaaaaatttgagatattttcatttactgaatattaacaaaataaggacaaatgctagagaaataaggacacttgacttgacagccattggaattaaataatcggtctcacagttacagttcaggacagggcaggagagcagcaggacagcttatttgttttttttaaatccattgtggcgttatgttttactgtctattatttttgttttgtttctttttgcttcaaaatttgcgagccactaattgtgtaagctcctgttctcagcaaacgcgaaaatacatttaaatggaatttcagagctctatgcattggtaggaacgttgtgaattttcaaaatttggaattttctactttcgagttcttgtctggcattcgaaattggtcaaaatgaatggcattttcgagatcaacgtccctaaaactccaataacatgttttcaaaacctttttttccaaaaaggggtggggaccatctgcagtattaccagatcagaaatgctctaacgtcgtctaaaatctgtgaaaattggataaaaaattcctatgctttttttaatgcgcgattcgcgtactgctaccgcggcacccttaaccttcactaaatgaacggatggatgaaatggataagatattccttttttttctaaaattcatatttatagaaaatttgttttgtcaaaatg

SEQ ID NO: 115855 - DNA, 707 bp, Heterodera glycines
  Promoter: Source sequence=SeqID_9487; Location=1440..2146; Strand=-; Gene=SeqID_71600
tcgaactttccattacataaatgaaatcgtgactcctaccaacctgccaaccggtcgcttgttgcttctccttttaaatttaatataatataattattaaatatttaaagcctcatatctcggcacagaagcttattccgcagctagaaaaaaaatttggcaatacaacccaggggtggtctacccacctacaaagtttcatttggaagttccaccatcacccgaacactctcctttgtaagtggcacaatatgatgtaaaaaactatcaaaggggggggggggcgtaattcaatttacttgaaagtaagacaatatgggcatcaattgttgaatagcaaactgaagcaacaacaccataaccaaggagcagcaacaattagtgcggccctttcccaccatcacagtcatatcaatgtgccatggtcatcactttcttcctctctttcgtctcctctttcttcctctccttcgtcttcctcatccctcctttgcgagtcactcaataaatcctcaaaaaatgtgtccgttgtgttcgccctcttccgcttcctctcctccctctgtctgcttttaaatgctctcatgccctgcgccgttagcatcggaatgtccttgacgagttcctccgccgaatagcagttcagcctcgtcccgtccccactcgttgtgaccaccagtgatccgtccgtcgttttcgccaaaatg

SEQ ID NO: 115856 - DNA, 236 bp, Heterodera glycines
  Promoter: Source sequence=SeqID_19785; Location=1418..1653; Strand=+; Gene=SeqID_84522
agcaatgtgctaaaagctttcaaattcgttacgtttagatgatgaccattttgggaccattgtgtgacgtttcagccattcatttttcgttgacttatgacaattttggtcgatctcaacttttccatttaatgcttaaacttgcttattatctttgaaaccctcatcagttgattaatctctattcttaatttcatcctaattgattcacttttcttgctgttatgtttcgaatg

SEQ ID NO: 115857 - DNA, 156 bp, Heterodera glycines
  Promoter: Source sequence=SeqID_2942; Location=2322..2477; Strand=+; Gene=SeqID_82447
aattggtcttctgatgtcaattccgggatcatttctcgaaaaatttccttggaaatattgtatacaaaggtttcttttataacaatcttttttccaattggtctgttctcgcctttcggctctccttctctgtttcgttttgttccatcagaaatg

SEQ ID NO: 115858 - DNA, 380 bp, Heterodera glycines
  Promoter: Source sequence=SeqID_438; Location=856..1235; Strand=-; Gene=SeqID_52739
ataagaaaagcccaattcatgaatagataatgccgaatgaccatttcatctgcggctcaactccgcttgagggcgtcgtcctcaactcaattagctccgcaaattggattaacgggacggtagatcaacctttaaagtatgagtcatctattgcttttgaaaattatgcggaaaatttagacttttgtttgcttccgatgagtcattacgggacattttcaatgattttctcgtcgtcgttgtgcgcgcttatgtgaacctttttcagacctttggtcacaatttgtcaagacaaatggacaaatttttgcgtgtaatttttgatgagtttggtgcactaatcattgaggtcgtttattttttgatacatctcacaaatg

SEQ ID NO: 115859 - DNA, 260 bp, Heterodera glycines
  Promoter: Source sequence=SeqID_2684; Location=5163..5422; Strand=-; Gene=SeqID_81078
agtccgcttcatgagcaacggaggacagaacaaaaaatattaaacaaagcattggattttattgtttggttggaaattcgctcaattgttaagaaaaaatttaacaaataaattattctttacgttcttttacctttccatttggttttttaaatgcctatttttccgttccaaaattgattggagtgaggatgtttttgatttattttgtttgacatgtttcactgttacatttaaagtcaaaaagttgcgtaaaaatg

SEQ ID NO: 115860 - DNA, 406 bp, Heterodera glycines
  Promoter: Source sequence=SeqID_14257; Location=696..1101; Strand=-; Gene=SeqID_78273
gattaaaaatgcactgaatttgctaatttacttcccaaaatcgttaaaaatgataattggaggcgaaaaatacaaaagttgataatatattaattgtataaagtgttatacaagcgatttaagtattttttgttaaatgttcttatttttgaccctaaaatcttattttatggcctgtatgttcttattttgaaattttttcgatggaagccctgcattagaataaaaaataaataatataaatcacaattttttatttttaaaaatatttttcagagctctaagattattttaatgttttgtagtttgtttaaacagaaaatttttgcataaataaatacccatcaataataaaaatcattctttttaaaaaaatatccaatttgagaatatttttaaagaaatg

SEQ ID NO: 115861 - DNA, 75 bp, Heterodera glycines
  misc_feature (48)..(48): n is a, c, g, or t
  Promoter: Source sequence=SeqID_42225; Location=1448..1522; Strand=-; Gene=SeqID_70173
attttaatgcaataaaaaatattccacccatccctctataatgccacngcaaatgttagatgattaaaaaatatg

SEQ ID NO: 115862 - DNA, 104 bp, Heterodera glycines
  Promoter: Source sequence=SeqID_1892; Location=2914..3017; Strand=-; Gene=SeqID_76601
attagaaataaatgattgaataaatggtgacgagaatctcgtgattagtattgaaaaaaaagaatgacgaacgacagacagagaacggatggacggatggcatg

SEQ ID NO: 115863 - DNA, 458 bp, Heterodera glycines
  Promoter: Source sequence=SeqID_39422; Location=1..458; Strand=+; Gene=SeqID_67994
tggtatcttacgatagcccttaaattgagttatcagcttgccaaatttctaaaaattttataaattttttcaaaagttatgacaatttttccagttttttggctagaacttttgaaaaacttaataaaattttttgaaattagcaatctaataaagcaattaaagagctatcgtatgataccaagatttgtgcaattttgttgtgtcttagaaaagttatgagttgatttagccaaaaatttagcaaatttgcactttttgtgaagtgacctagcaccgatgctggcagtaattctgaagtttaagttttttatgaatttttacttatgcctattattttaggggggtccggcggcgccacctgaaaaaatttgtaatttttaatgcgaaacaaattcatattttttttctttttggcgtaccttaaaaaagtactatactaaaaaattccggtaatg

SEQ ID NO: 115864 - DNA, 1003 bp, Heterodera glycines
  Promoter: Source sequence=SeqID_20701; Location=1504..2506; Strand=-; Gene=SeqID_51259
ccaaaatagtgacaaaatagtgtcaaaaagtccgaaatagtgacgaatagtgacataattgtcagccaaaaattaagcaaaaataatttttattcactgattgcattgcaaatgagtagggctgggatttttaagggcaaaaaaaacaaaataggtacataaaaaaataatttttaaaattaaaattcttgcccctttttgagaaaatttttttcatttcttaggagtgctttttgaaaaatttttgctcgattcttaggggtgtattttttggttttattgcatttttgttaaggaatttcccaaaaaatgtcgaaatagtgaaaaaatagtgacaactccaaaatagtgaattttcactattttagtgacaaaatcccaaaatagtgatttctagtgaccgataatgacatcagaatcgaaaaatttttatgcggaaatgcgttttttgagctcctttcttcaaatcaattgagcaaaaaaaatagttaaaacctaaaattcacgtccctattaattaaagtaaatttgaaatttattctgttttccaattccaaaaagtaattaattatgcctttctttttcatctaccgactaattactttttatttctttagcgtttaataaaattttcaaattctcgctcgtagtgactttccatcgccaaacatattaatatttttttaaatttttgtagtcataatatgaaaatgtcagtagtcaatttacgtaatttgatggatttatttccgttaaaaaatttctgataaatttcatattgcgcgtattatagcattaatacgagcatgaatttcatgtgttttcatgtgattatccgattaaacacggaagaaaccccctcaccaacatatcatcagcattacgtaatcatcgcatataaatatattgaaattcttagcattcaattaaattaagcaataataataataatattttgtggtaattattaaaattaccattttaatacgcccccataaaaatg

SEQ ID NO: 115865 - DNA, 672 bp, Heterodera glycines
  Promoter: Source sequence=SeqID_10730; Location=3002..3673; Strand=+; Gene=SeqID_73975
atcagcccttaaataatcccaaaaaaatcgggagaaattccaaaatcatcgagactcttgagcagcacctttttctgttcaaaaggccaatttccctaattaggtgcaaatgcgtgctcagctcgaaggcgcgtgtactcagttggagcagctgcagagagaagtgaggcgaataaacatttaaaatttctacatttatccattacttagtctaatcaatttgctcctacatgctaattgcccctaattatctcattagcattttcctttgcgcagattttcgcgttgcgcttcaacgcgtcccttcttttggaacatttgcagcgggcggaaactgaactgagcacaaaggaccgactgcgcgcgcaattgcaagcggtggcggcggaggtagcggacgaactgttggagagagtgcgcatctacgaacggcacgtcaaccaatcggcacgtcattcaaaatgctttttgccctattggcactttttcacattctggcattttctgtagatgaccagcgaagtgtccagctgtgccccgttggcctcaattgcgacgaatgttcgcctcgccctttgcgattacgcgttggaccctttggtcgctttttcgctgattttccccactttatcagttcattcgctttctcagaattccctgtgggtggcgatg

SEQ ID NO: 115866 - DNA, 79 bp, Heterodera glycines
  Promoter: Source sequence=SeqID_6410; Location=4177..4255; Strand=-; Gene=SeqID_61444
tctgaatttttaacaaattcatttaattaatatattattcatttaatcaatttaattaattatagtactcaaaaagatg

SEQ ID NO: 115867 - DNA, 355 bp, Heterodera glycines
  Promoter: Source sequence=SeqID_43501; Location=1..355; Strand=+; Gene=SeqID_71140
tctctccgccggccattcgccgtttttaggttcagtcgcgttatttgagcagccgccgtgccgaccttctcagtgcgtgcactttccccagcggcaccgccgggggcagccaccactttgtgtcgacagtgccgggctcagcccgccgcgttgggcttttccccatcggcaacgatgctaatcgcccggcaaattcggcagcaagtttcggctcacgaacattcccttccctcgcgcggtcattggcgccgtttctgttaagcggagccgacgcggggccaccgccgtacgcgcccccgggacaaagaggtggggaaaggatggagaaaaaggaacagacactaacggcacaatg

SEQ ID NO: 115868 - DNA, 369 bp, Heterodera glycines
  Promoter: Source sequence=SeqID_4076; Location=1482..1850; Strand=-; Gene=SeqID_53068
atatatgttttaatcgatatcaacaatttagtgttttctggtaattcttcaataaatttgttgattattgtaaaataaatgccttaaaatcgactcaaacaaatgcttgaggttacattaagcaataaaaatacacttaaagaatattatgtaggcgtaaacccaattcctaaaatccgaaaaatgaaccgttagcgaccggtgtatttatttcacatattgttgaaaccgaaggatgcaagaatgattaaatacaaaattactgttaacatttttcaacatttattcattgtaatttttcaaaatcctaagttttcattctttcgaaacttgaattacggcataaatattttttaaatatcaaacatg

SEQ ID NO: 115869 - DNA, 67 bp, Heterodera glycines
  Promoter: Source sequence=SeqID_9169; Location=1992..2058; Strand=-; Gene=SeqID_70475
ggtaataattgattaattattaaatgaattatctaattgatcaatttgaatgccctgaggctaaatg

SEQ ID NO: 115870 - DNA, 609 bp, Heterodera glycines
  Promoter: Source sequence=SeqID_35626; Location=1005..1613; Strand=-; Gene=SeqID_65146
ctttcgccaaggtttaagccacgaagatataataaatcaatgataattaataacgagagagtcacatttttgaagtaatctgtatttaagcatcatttaattaattttaacatattaataatttaaaatttttattaatacaaacttaatgatgaaaaatcaaaaaacaatttttcatttttggacttttaataaatgtcccaattgtccatatgatagaccttaaaccattttgtattattctttcttcacatttcagttcagtgatgaatctgagtttgtctattttatatggacatgaaaatagaattaatttttatgtacgaaattccagaaaaaaaattttcaattattttttaaattgtttcacttaattcaatcatttacaaaataaattcaatttagaaattgaagaaatgtaaattaaataaaatattaaatgcaaccaaacaaaactaatataataaataatataataatattattttttgtataaaacacataataagttcgagcgataataactttttaaattctttcaatgtgaattaaaaataaattgataaaaaatataaacaaaaatatttgtcaaaatttaagacaaaaatg

SEQ ID NO: 115871 - DNA, 168 bp, Heterodera glycines
  Promoter: Source sequence=SeqID_13259; Location=1..168; Strand=+; Gene=SeqID_77088
aaaactttttggtttaaattttttttttcgtggtgggcgaggcgaattgctagaggcctcctactgtaacagtatgcctgggttaaatgacaaattccagaatactggctctatgtatgaatgccctccgtttttttttctttttcacattttcgccttctgtagatg

SEQ ID NO: 115872 - DNA, 188 bp, Heterodera glycines
  Promoter: Source sequence=SeqID_13004; Location=407..594; Strand=+; Gene=SeqID_76774
gctgaggaattgaggataaaactctctttttgtgattatatcccatcaaaatgtttattaatttaattaaattttaaagaattaaaaaagacctttaaccgttgtaattggcatttgatgcacgaaatttcataaccttaccttttttaaattcttaaaattactttatttgttgtttaacagagatg

SEQ ID NO: 115873 - DNA, 54 bp, Heterodera glycines
  Promoter: Source sequence=SeqID_26080; Location=1..54; Strand=+; Gene= SeqID_56828
tcgccttcaaattgccaattgatgtgaaactgtcctacccattttgtgtcaatg

SEQ ID NO: 115874 - DNA, 58 bp, Heterodera glycines
  Promoter: Source sequence=SeqID_18782; Location=1962..2019; Strand=-; Gene=SeqID_83458
tcgcggaaaagtgtcgagcggaagcggaggcggtccctgctcatcatatggaccaatg

SEQ ID NO: 115875 - DNA, 376 bp, Heterodera glycines
  Promoter: Source sequence=SeqID_6834; Location=1537..1912; Strand=+; Gene=SeqID_63038
aaagtatttaaaataacaaataaatattataaaattatccataaaaagcgacgaagaaattgatgcagaagtttcctaatattttttttgttaatgttttattaaaacaaattgttcaatagtttttgcacgtttctgacttcaaaagttttgaaaaaaaatttttttgaggggggcttatattcgaagggggcttctatttttcaacctccctccaaggggggcttatattcgagggggggcttccattcgaggggggcgtataatcgagtaaatacggtaactttgctgaaaaaaaccaaattttaaattattaaaagaagctatcaaaagatatcaaaatttgtaaattttgttcattctgggcgaagttatg

SEQ ID NO: 115876 - DNA, 403 bp, Heterodera glycines
  misc_feature (96)..(96): n is a, c, g, or t
  Promoter: Source sequence=SeqID_16087; Location=1..403; Strand=+; Gene=SeqID_80441
agcaaatttttactttttcactagttatagactaagaccaaaccatacaaataaaagccgtcggaccccaactgtccatgaagttaaaaaaagacngcaccgcaaaaaaaggtagtttgatgtcaaaaaaatggacaaataataaaattaaaatatttatataatatttttaaagtataagcttttatttcatgaaaaaactttaaaactctcgcctctcgtcctctcgtcaactctcgtgttttttgggactctcgcctctcgccaaactctcgctctcgtctttttggagacaagtcacacccctgctgtggccctatacctatcaattcctcaccgtatacatttactatgtgatactgtatttagccaaaaaaattaaaaagcattctctaacataatg

SEQ ID NO: 115877 - DNA, 1003 bp, Heterodera glycines
  Promoter: Source sequence=SeqID_6711; Location=106..1108; Strand=+; Gene=SeqID_62585
aaaatttttttcagaaaaaggtggggaacattcttaactattaccgaaatttctattaaaaatttttcgcaggctttttcaagaaaaatttctgtttgaaaatttaaaaaaaaattgtttaaagaatttcaacttggaattaattaattattataaaaatagaaaagaagttattttttcgaaaaaaatataaattctatttatcccccgggcagataaatagagaaggggagattatttttcaacctacttcgaaaggggtagattattggtgacttgcatataattagagaaatacggtagtttgactctttattattagggcttacatttttaggtgctaaaaactgccaaaataggtaggttttaggttctaaaaaaccccaaaaataggtgctaaaaatgggaaaataggtgccaaaaagttccgaacttaggggtgtaaaatgacaaaaattttattaaaaagtcaacaaatattaagacaaattgagaaaaataatttttaaaatcaaaaattctcgtaaataggtaaaaatctaaaaatgtaagccctatttattattacgttggtcagttttcaaatttcaaaaaacaaatgcgcgtctaacatttgcaaatgaaagttggataaaaataatccgtcaaattgattttttattgattgatttgggggtaggggctaaaacgcccggcaaatgtcatcattttgcaaaatatattctcctctgttgcgttccttccattccctttttctgctcgctttttgtcaatgattttcgtctcccattggcatattgtccaacccctcgggcccatttgcaacaatttaaggcaaacaaaattcagaaattatttggataaaatgtgattttcgttagaatttttggttttccgcttttctcattatataaaaataaaacttcaacgcaattaattcttctgctatttgtgtgacatcattcggaactcgtccaaattgtgctaattgctgccaaaaatg

SEQ ID NO: 115878 - DNA, 124 bp, Heterodera glycines
  Promoter: Source sequence=SeqID_20527; Location=2217..2340; Strand=-; Gene=SeqID_51062
tttcctgtcttcagcttaacattgccgaggaggcgttagcccaggtaaaatttcaaaaaaaaaaaaaaaatttttttgggattttacaaatttgactgcgccctttcagttacttcatctgatg

SEQ ID NO: 115879 - DNA, 436 bp, Heterodera glycines
  Promoter: Source sequence=SeqID_17605; Location=2387..2822; Strand=+; Gene=SeqID_82112
aaaggatggataaaaataattggagatttttatgatctattttttacatttcatttatcatttgatttttaaaaaatatattctgaaattgaattccttttctgaagtttaggcaattacatttctctaggacttttttcatgaaaatcatataaaatggtcacgaaaatttaaatatttcctatttaatacaaaattatgtcgataattcaaattcccggtttattaacatcttaattaaataaattcaaaactaacaaaatgaatattaattcttattcagtaagaacatttgccattgatctgtcgtccgtaatcatctataattagaacaaattccaatgatgttcggcttgccaaatgggctcgattctctttcccatttggcccatttttgctcatcacgcgcaattggacaacggaccagcaaaaaatg

SEQ ID NO: 115880 - DNA, 377 bp, Heterodera glycines
  Promoter: Source sequence=SeqID_25233; Location=794..1170; Strand=-; Gene=SeqID_55979
ccgccgggaaaattttttaaaattttactgcaatttgttaacggattttgtccaaaaatgacatttttacgattttaattgttaaaattgtgtttgaactcccatcgaaaaaaaacattaattttgaaaaatgagagcgccataagctccttcattcagctatattcagttttttagcgttgatcaacttccgctatttcgtaaacactcgcacccttaaattttaggagctagattacatgcccgaatagtttagtaatttgaatcactcagaatatgttatttctaatttttacattattttttacatctttttagatttggctatttactgtttcgatggcaacacgcgttggggacgtaaattgtcggagatg

SEQ ID NO: 115881 - DNA, 143 bp, Heterodera glycines
  misc_feature (26)..(26): n is a, c, g, or t
  Promoter: Source sequence=SeqID_35798; Location=1..143; Strand=+; Gene=SeqID_65268
cctttgaaattgaacccttcgactantgggaagcaaaccgtttataaattgcttataatttcagcagaagacactccaacgaagagctcgagaaaaaactgatggaacaaattgtgaatttgcagacgaaagttgacaaaatg

SEQ ID NO: 115882 - DNA, 512 bp, Heterodera glycines
  Promoter: Source sequence=SeqID_30967; Location=759..1270; Strand=+; Gene=SeqID_61327
ggtgaaaattggaggaagggaagggcgataaggattattgagggggtcaaaaattgggaatgattcagcaaaaagaaagaaaatggtgaggagtgagaacgagtgaagagccagaggtgaatgtgtgtccaaatggaatggaatggaatggaatggaaccaaaacattttccccctgggggggggcaaagattaagatgcaaaagagcgacgccgaagggtacaaaaatcggcggggagaaaaaatgccaaacaaagggaaaaatgagatgaaagaatggccaaatggaaaaatgtgatctgagaaagtgtgaacaaagagacaaaaattcggaggcagatgtgaatggcagaaaaattgaaaagaaaagggcaaatggtggagttgaagaaaacattatgtaaatgagaaaaaatgaagagaaatggaaagtttaaataaagaggggtgaaaatgttgacgaatatagaaaatggatcgcttaacatggcaatggcccttatccgggaatg

SEQ ID NO: 115883 - DNA, 73 bp, Heterodera glycines
  Promoter: Source sequence=SeqID_16359; Location=2483..2555; Strand=-; Gene=SeqID_80747
tattgacccgcaattgttgagaaccgtttatgaagtgataagaaatgtaaacccatttgcagatgcatatatg

SEQ ID NO: 115884 - DNA, 1003 bp, Heterodera glycines
  Promoter: Source sequence=SeqID_7962; Location=4674..5676; Strand=-; Gene=SeqID_66519
tgaaaggaaaaagcgacggacggacggactcgccaacaattgctaattgcacgccaatttcggtcatttttgagaaaattgcataatcaaatgaaagggacaaaaataattaaaaattacgcaataaatttaaatgataaacaaattggaatgtgagaagaagaatgaagtgaaaaatattgaaaataaccacagaaaaaggtaaaaaaggtttaattgagttgattgagtcgctttaatagagaatgttttggaaaatgccaaaatatacatgcaaataaacttatttaatttaatttaatgggggaaatttaatttaaaaatttctcatttaatctacgtaaaatttgaatgaataataaaaatcaattgcatttttacaatttttatcttttttttttgccaacgatgccaaagtgtcatgtaaaaacacggcaatttaattttcggctgtttctgcttcatcattataaatgtcagaaaataaaatatcattcattattaattataaaaatgaatttttctattttatgtctcttttttattgcctttttagtcaaatgttcaaccccaacaaacacaaaaaatgacaaaaacggttggtgttctgtttgtgcgaaaaagcatttaatagttaattaattcattatttggtcccagcgaatggtgcggccgaagtgccaagacaaacaaaggacggaaaggacggcatggggttttgtggccaaacttggcaaagccattgcccttacggcaactgcgggatttgccttggtccgtctattgttgctttttggtcatcatagaatttctcagatttaaaatttagcaaagcgcccttagcccggcattaggcgcacggttggcatcgccaagggacggaaattggcacgaaggcaccggcacggaaaatgcgaatcaaaaccaacaaaaatgtgaataaatgaaaaaagagatgctaaaaaggaaacaaataaaattctttgtgtttaaaataaaaatg

SEQ ID NO: 115885 - DNA, 487 bp, Heterodera glycines
  Promoter: Source sequence=SeqID_22068; Location=1..487; Strand=+; Gene=SeqID_52709
tcttttgtaaggattttgtgccaaaaactacccttcattttcaaaatggctctaaaattttttttccaaattccgcgtatttttattaaagtgtccgctttttagggtttttggtaccacattttttgatttaaaaaataaattttttaatgatttcaaatttttaatctttagccgatatttcggacatatttcgtccatttacaatcaatatttcactcttgatttttttgtttttagattgatttgcaacgacgtttggatggatattttccccctttttgaccgtcctcaactcggtctcaaattggcattgcttttgtcacgtttcgatgtgctgttggacaaacatttcgatgccaaaaaagtgaattatttttaagggtttttgttctattaaggattttgtgccaatttggggcctccgattctgcccgttttaaaagatttttgcacttttaattcttaacattttcagcaaccaatg

SEQ ID NO: 115886 - DNA, 480 bp, Heterodera glycines
  Promoter: Source sequence=SeqID_867; Location=2071..2550; Strand=+; Gene=SeqID_62987
agtaattttttgctgtgtttttattacaatgttccgagtccgaaataattttttttcgtaatttacgaatttaaaattttagttttttcatcatttctttggtactgaagtatctattttcacttgaacagttttcccgtcgctcaatttgcttcatttcgatttaccccaatcatttttagatttaaccaagaactttcgaatgataacaaatttgacagggttcggcattttcctccgtaaaagtcaggagtgcccacagggacgacttcagaatcgcgtacaaaagcgaattttactacattttcgatgcggggttccgggtccgaaatgatttagttttttttcgtaacttacgaattaaaaaaattcatttaattttccacttcagtcggtccgccggacctttacacggacgaagcgctgggaaatttggacacgcgccagcgaagggcgacgctcgattcactgaaaaaaatg

SEQ ID NO: 115887 - DNA, 772 bp, Heterodera glycines
  Promoter: Source sequence=SeqID_3565; Location=1..772; Strand=+; Gene= SeqID_50887
ttaggcttaggcttaggctttattttgtaaaatacgagttgccttttatacttttgtacgagttgccactgacccggaatatggatatcatatgggcaacgatgcactttatgatggacctttttttgagatttgtcaaattccgactcaatttttttcaataggatttccaaattattaatgacaaatttcaaaaatctaatttgcaaaattccaaagcttaataaaagcattaacttcccccccccccaaaaaaataaaaataaaaattccctccgtcggtcagaaaaaggcgcgttcctccaccttttccgcctcccccgcctcgcgtggcatttttccgcgcctccaccgttcgctgtcctcccagcagcagcacaaattgttccgtgccaatgcgccggcgcacccaccgccgccgttggatttgcgcgcattggacgcggcggacggaacgccaaataacacgacggactatttggaggtgattggaggggggatgagggatcgaaatcccttctcacattgatgtgttgggcttagatcgtaattgtggtggaagtttcgagaccgagtgaccataagactcgataaatgaattcgagaccccaaaacccaaccaagagtttggcgagtgaatgcctcccccggggacgggacaaatctcggcgctgaaacttttttttttttaatttttaaggtgggccgagcggagggcggttggattcgggacgcaaatttttggagcaggcagcaggaattttggcaaatg

SEQ ID NO: 115888 - DNA, 1003 bp, Heterodera glycines
  Promoter: Source sequence=SeqID_4426; Location=500..1502; Strand=+; Gene=SeqID_54403
gtgagttgcacttttgtaaaaaaatgggtttttgagccatgggttcaaatccgccggactacaaattatttaaaaattgggtacttgtgcagtttacgccccataaaattttttcttaatgtttttaaaacaattacaggttttagaggtcgctgatcacgaatataaaattagaatcgtgctatttcgaatcccaaatccgaatttgtaacaaaaataataacaaagtaaacaaagatgctaattcactttaatattaagcttataagaatgttgcttattttccgcttaatacgttttatccatattgcagctatattaataatctacattatgacatttgaacaattttaccacacaaacgctttatgtttgttttaaaaatttaaggggcgtaaactgcacaagtaccaaaaattgtttctctggctttggacagccccgatcaagaatttgacacccatttcgccaatttcgaaccaatgacctgaactcagacaaaaatacaaaatttgattcaagaaaggaattagtgattaaaacggatgatcagaaaatgattcacaataccgtatatgctctaattatagcccagtctctattaatcccgcagtctccaattatccccccttttctgaggaggttgaaaaataatcccccatgggctataattagagcatatacggtaagttgccttgctttaccaactgtcgctcctgcaatggcataacttatatgcattttcatacctccagttcgatacgttattaatagcattttttgcgcatatgggagtcattttttcacgctcaatccctgctgcctattcttaacttcaacaacaatttatttcggaatcgcaatcaacaaaaacaatgaaaggaaaaatcctttatcatgcgaagtcagtttctatgaacgaggtctctctttctttccacggaaaagtgcgagcaatgacgtgttggcaactttgactactttgaaacgaactccaggaatg

SEQ ID NO: 115889 - DNA, 636 bp, Heterodera glycines
  Promoter: Source sequence=SeqID_9005; Location=1995..2630; Strand=-; Gene=SeqID_69973
ggtgactctgcgaactttcaccggcagcaggccgatcatcagcagcaccaattgatcactttgtcccaccccaattgaaagcctctgatcactgcttctgcctataatgattaagtgatcaaagcgagagagagagaaaggggagggaatgcaacagacaccgagcggaaagtgtggcgaatggctggggaagggggtgggaagggtgcgggtgatcatttttttgttgctttttcgcgaccgctcactgtcgctgttgcgcgacgactgactcccctcctcgcaatgtatataagccactttcaaaggccaaatatggccaattttgctgacgagttgcgcaaagacaagcgcatagccaattaccttcatcttgccgctcaattgaacaataattactgcttctgccagcaaattagctttcccccacctttatcggaacgtttaataaagctatgagagtgatgctcaaaaattttttaaagattattaatttttaaaatttgagttactcagttttagttttaaagtttcatagtttggcctggttacttcaatttacatcaaaatttgactttgtgtatgccagttttgtgcctatttttaagaatatttgccaattttcaggtcaaaatg

SEQ ID NO: 115890 - DNA, 1003 bp, Heterodera glycines
  misc_feature (995)..(995): n is a, c, g, or t
  Promoter: Source sequence=SeqID_17535; Location=1066..2068; Strand=-; Gene=SeqID_82037
taaaaaggggaataattgctaaaatttacaaatttaggaggtgtaatatgacaaagttttattcaaaattaataaaattgagctaaagagtattgagatacccaattttaaaaagtaaaatccgggctcctcgactcaaaactgagcatttttatgagaaaatttttataagatttcgatttaggaataaattaatcgctagggtgcatttacaattatcattacaccgtataatgaatacggtaaagtaatgattggccaattaattgactaaattaatttgtctaaatgtttttttttgccgtgtgaagttgcccgtcgccgttttcgcctgtctgtgcccgttcatggccagcggcactgcgcttggcattctgttctttgccagcgttcggccagttcaattttggtggtcactccctttctgatcttggcactaggcctgtcaattaattaattattcaattaactaattgactaattaaataattatgaatttaatttgtatgaaaaaataaatgaatttcaaattgttgaaatttattttataataatttttatctttattggtaattaaagtactattttattgtatataaattcctgttgaatttaacttatttccaggcgttgatgacgcgttcctaatttccacgatcaatcgatcggtttttcaagcaatcattaagtggcatccattttctaaaatcaataaccgatctcttcccaagctaattaataatgatcgatttcaaaaattaacaataattgatcgcttttccaaaaaatcaacaatcaatcaaatttaaggcaatcaataatcgacttatgtacctttcaagtaaatcaataaatgatccctttcagtaaatcgataacgaacggtttttcccaaaaaatcaataaaccaatcgatttctaaagaatcaacattcaatttaaaacgccaaatatttttttctctgaaattttgtgccatttctaagaaaccttgngcatcatg

SEQ ID NO: 115891 - DNA, 692 bp, Heterodera glycines
  Promoter: Source sequence=SeqID_26813; Location=295..986; Strand=-; Gene=SeqID_57563
ttggcggaggaggaggccacattttaattaacgaaacaagccaattgcagtgttattctaaaacagaaacggaatcaaaaggaaaaacaatcgaagacaaaaaaattgaaaataaacaaacctaaaaaccaaatttaaaatagacaaataaaaaagaaattgtcggacaaacacaacagaaaaaagtgaaagcttgttgttgacttgcaaattctgacaaatcttacggcagcaattagtaagcaagctttactttctcttgaattcttgctgttcctgtaagccgttttccttcgttcccatttttttcttttctttttggcattatgttttgttattatacatatttaaaaataccacacgcatcgttttcctccgattgttttccttttttgttggtttcgccactcactaacccacaaaacaaagaatcacaattacgaaatcaatctgaactaattttaaaaacaaaagagagacccttttggtgcgcaatttttacaacttaaacatttgcgaccctgaaaagcgttcacattttggtttttgaccaattttatcacttattatttcaggttaaagattcggaattggtagaaaaaatctcaactttgtgatttaatatgaaaaactcattttgtttctcacggacgcattatttgtgatgaaactttttagaaaaatttgaaatg

SEQ ID NO: 115892 - DNA, 81 bp, Heterodera glycines
  Promoter: Source sequence=SeqID_26224; Location=1051..1131; Strand=-; Gene=SeqID_56977
aattgtcaaatactcgacaattatgataattaaggctgtctctttatgtaaatacatatttatatatttcttcagcaaatg

SEQ ID NO: 115893 - DNA, 139 bp, Heterodera glycines
  Promoter: Source sequence=SeqID_31934; Location=617..755; Strand=+; Gene=SeqID_62256
taacaaaaaacaaaaagagggacagaacaaaggcagcagaggacaaaacggtgcaaacaatctgaaaaagagggcattaaaatggtcaaaaagcgaacggacggaccaacatcggccgagttctgagccgacggagatg

SEQ ID NO: 115894 - DNA, 126 bp, Heterodera glycines
  Promoter: Source sequence=SeqID_35902; Location=1..126; Strand=+; Gene=SeqID_65353
agttgcagtcggtgtctgtccaggtaaaagtactgtagcctctaattacgataccaattttcaattcaatgaggggattattactatatgattattttctgtcaggaaggcgaacggttggaaatg

SEQ ID NO: 115895 - DNA, 302 bp, Heterodera glycines
  Promoter: Source sequence=SeqID_1019; Location=10698..10999; Strand= -; Gene=SeqID_66208
tttgatccgaggatgtcgggaaggcgtcaaggtttaaatgcaagagagaatgatggaggacaagtgccggatgagagacggtacgatttgagagaccggcaaaatcggcgaaattgggcagaaattgagaatgaatttgatgaggctataagtcaggaaattcggagattggaaagagaccgccctcaggctgtaaatgcaaacgcccagcaaaatgtgaatgaaatggctgaaaatcaaaaccgcacttatccagttttagtgaataggaatgagagtttgaaaattttggccgagaaatg

SEQ ID NO: 115896 - DNA, 164 bp, Heterodera glycines
  Promoter: Source sequence=SeqID_14964; Location=1..164; Strand=+; Gene=SeqID_79121
tattcattatttatttaatagtaagattttatttgtaattattttgctagtgaaactttaattttttaagcaaaggaaatccggtcattgtcataattagttttgggatttttagagattaatttttattagatttgtaaataatattttcaaatacagtcatg

SEQ ID NO: 115897 - DNA, 109 bp, Heterodera glycines
  Promoter: Source sequence=SeqID_23145; Location=1853..1961; Strand=-; Gene=SeqID_53850
gttatttcaaatttaaaccaaataccaaaaatttcactgattcgtttgctaatgaagcttatgccttgccccctcccttttagaatttgttttgatatttttggcaatg

SEQ ID NO: 115898 - DNA, 385 bp, Heterodera glycines
  Promoter: Source sequence=SeqID_17436; Location=1188..1572; Strand=+; Gene=SeqID_81921
ttaatacaggtaaaaacataaataagcgaagtacttttttaaatttaattaaaatttgtaaaatgacttttgtcaaagtgatctttggcgaataatttttatttaaattttttaaattacctaatttttttattcattaaaattatttatttttttaaacaattaattattagattaacgcatataattgcctatttatgatgtgcctaatcagctgaattcgttttcccttcctttgcttttacctttttccattagttcatatacaaaaacacaaaactaaatttatcagcattaactaaaataattttcttattatgaatctcggacggtgtagcatttgcactttaagctttgacttaaacgatgtttcagctctcaaatg

SEQ ID NO: 115899 - DNA, 60 bp, Heterodera glycines
  Promoter: Source sequence=SeqID_33793; Location=1..60; Strand=+; Gene= SeqID_63742
tcacttttgcttgcgtttgaaggcccataacttttttctttaaactctgatcaaaaaatg

SEQ ID NO: 115900 - DNA, 103 bp, Heterodera glycines
  Promoter: Source sequence=SeqID_6410; Location=1526..1628; Strand=+; Gene=SeqID_61445
ggtaattaatacattaattaatggggaggggggtaattaaagaaattccaatgaaaaaaaacacaaatttaaaaaacacagaactgtggccgccaccaatatg

SEQ ID NO: 115901 - DNA, 488 bp, Heterodera glycines
  Promoter: Source sequence=SeqID_7318; Location=3051..3538; Strand=-; Gene=SeqID_64455
gtcaattaccccgtttaacgcccaccaaaaatgcgcatattcaaaagtcggatgaatttaaagttaattctattatttatgataaaatggttggaatctgttaatttaaaacaacaaaaacaaccaatcaaccaacatattacatatagcttccataagcaattgaacgaacccaaacccctaattttttctcatttaaagcaaactgcaatattttaaattgttttatttatacaacgatatcccttttatttttaaattttttggcttttcgtctttgcattcgccttctttgttcctttttgttctccgcttcttccgctctttttgttagcttttctcattgttagccaatgccagcacattttttcgtcattttttctgttcacatttaaaaacgaatgctgctactttttttttatacaaaattattaatttcattttagagaatgcgaattcttaagtttcattttcctcggtcaataatg

SEQ ID NO: 115902 - DNA, 669 bp, Heterodera glycines
  Promoter: Source sequence=SeqID_18870; Location=1354..2022; Strand=-; Gene=SeqID_83574
tttcaaagtgatcacgcagtctcggggaaaatatgggcaatgtggtcaaaaatgaagacgagaacaagcgatacagtgtcagatgagcggatagaatcaagtcgtaaacaaatattatgaaatcttatgaaccaaagaatgaatcgaagaaacattcaatgcaataacaaaaacagcgttggcgacggaaaatttgatcataccataaggaacactagctataatataatatggcgttagaaattgatttctcataaaaaacacattattaattatgcttattgcaatatttgcaaaaaaagtttttgtttgaaaaatgttcgattccgggttcggggttcagaatttgtcaaaaataaggtcggattcatgctcagtaccctaaaatagccctagaaaagttttcccagaattttacaaaaaaaaaacgggaccagtaaactgcaggaattccccccacaattatgacaatgatgatgatatccttgctctttttgaggtctcacaaattttttaaaaattacatgagagaccaaatgaattgaaatgccatctctgaggtcgaattttaacatttcaaccacccattcttcaaaaattgacattaatattatataattaaattaatttttttttcaacagtatggaaccatcgaacgccagcggatg

SEQ ID NO: 115903 - DNA, 100 bp, Heterodera glycines
  Promoter: Source sequence=SeqID_6991; Location=279..378; Strand=+; Gene=SeqID_63516
tctgagattatgcaaaagcgattatcattacttttaaagtcatttcgtagtcatctactaataattaataaataaattattcaaattcaaatctctaatg

SEQ ID NO: 115904 - DNA, 125 bp, Heterodera glycines
  Promoter: Source sequence=SeqID_29065; Location=1..125; Strand=+; Gene=SeqID_59628
ggggacctctagagctattgattccctctcattctttggtcaatttgtcctttgcactgtgcgaatgggagagcagcgtggacgagctgcacccgagcgacccgcgctaccgacgctatatgatg

SEQ ID NO: 115905 - DNA, 1003 bp, Heterodera glycines
  Promoter: Source sequence=SeqID_532; Location=3507..4509; Strand=-; Gene=SeqID_55520
attttcccaaaaaacttttgttgaatgggcgaggggagggggaccggcggagccgataggcgccgccgggaaaatattgttatttttaatgcgatttttaacagatttttgtccaaaaatgaccaaattttgccacaaattttatattttcttgtaaaatagtgacattatggcataaaatttctaaattatgaggatttaggaaatcagaacaaaataagaacaatagcccaaaatcagaacatttctgataaatcagaacagatccgagccctgtttaaaatgtcaatatttgccaagaattattagaaagtaaatttacttcagttgcaactgcaaggaaaaaaatttttttttaacttatttttggctgaaaattatgtcactattttgtcacttttttggcacttttcgtcactattttagtaactattttggaatttttcgtcactaaaagttgcatccatatttatgagatatttgaatattttaaagtggtgcaagacttatttgtcactctgtaaaagcatcgtgtgtgagaatttccccactatttataggcaattctataacaacaaataaaggggaggtgctctgatttggtaaaaatggatttggtacaaatgttgaaatgatgagtagtataaaaggaagttggttcatcctttccggccattttattccaaataggcattaattaattcctgcgtattattgcggctgctgttctctgtccgtgccatcatcaaatcaactcaacgaaagctgagccatcggaagtgtgcacaaatcgactaccaaacgaaactgggcaccacaaatcaacaaaatcatcatcagcagtaaaagtggtgcagaaggaaacgcatggaccaaatgtgagaaaagcgggaatttttttttgtttttgaaaatttattttgttttgttttagcggcggcactttcagcgaccaaatttggctcgacacattggcgtggattggacgtggcgaggtcggatg

SEQ ID NO: 115906 - DNA, 237 bp, Heterodera glycines
  Promoter: Source sequence=SeqID_32106; Location=444..680; Strand=+; Gene=SeqID_62429
actgcagttttggaagagtacgccatgacgaaggaagcgtcatttacttgtacaaattggcatctgtccaagtgggccaaaaggcattgcccgtcggcggattggtgccacggcggaaaggcgaaagggcacaaaaatggcactttaaaatgcggagaaacatttcgcggaagcgtttgttgaagattgtgtagatgattgggttcaccttgagggggaagaaagtgtggtcaaatg

SEQ ID NO: 115907 - DNA, 143 bp, Heterodera glycines
  misc_feature (26)..(26): n is a, c, g, or t
  Promoter: Source sequence=SeqID_43920; Location=1286..1428; Strand=-; Gene=SeqID_71481
tcgcttcttgtagtgtttttggcttntcttattattagcatccactgaatcaaagagtttgtttttgttttgttaaaaaaataaatttatttatcattgaagaaaatgccgatgatgataatctgaataattcgaacggaatg

SEQ ID NO: 115908 - DNA, 101 bp, Heterodera glycines
  Promoter: Source sequence=SeqID_1754; Location=387..487; Strand=+; Gene=SeqID_75722
aataaagttgccgttgtgcaaaagaccattctgttgtttccaaaaaatcgtaacatcatcatcatcatcatcataaacacattgacatcacttcccaaatg

SEQ ID NO: 115909 - DNA, 337 bp, Heterodera glycines
  Promoter: Source sequence=SeqID_24430; Location=312..648; Strand=+; Gene=SeqID_55163
ttcgctgaaaaatgggggggggcaattagcacaatgaaaatgcacatagcaaaacaattaattacctaaataaactgacgatttaagtggcggtggaggaggacgaataattaagtggatggaatgaatgaacggaatgaacgtggaaaagcaaaatgtgtgggccttaaatagcaaattttttagtcggaagagtcaaatttttcggataaattcatatataaaaggcacaaaaattcatttggttgccatttttccattatttaattaccggcaattcatcttcatcaatcatcccttctctgtgtacaacgaaaacgacgacaattgagcaatg

SEQ ID NO: 115910 - DNA, 344 bp, Heterodera glycines
  Promoter: Source sequence=SeqID_38770; Location=685..1028; Strand=-; Gene=SeqID_67490
tggcattctgttgcccctcaacactccgctcatttggctggctagaaaccttgtgtaccctgacaattttgttcacattgtaatacgcagaaaaactgctccatttgataagaattcaaagaatttgtgattttatccgtttttgtctgccgttttcatccgattattccgtttttgtcttgaaatttaactgtttttaatcgttttctgccgatggtttgcgttccatgcataattctgcccgtcgtgttggccatttaccttcgatttgttcagccatacattttgcgttttatgcctcagcgatggcgtatttggtttgactcggtgctttacccgacatg

SEQ ID NO: 115911 - DNA, 583 bp, Heterodera glycines
  Promoter: Source sequence=SeqID_2908; Location=402..984; Strand=+; Gene=SeqID_82287
ggtcggcacaatttgaaatcaaaatggaatttggaatttggcgggaaagtcggcacgaatttttgaaaaatttaaatgaaaattcatatacaatttgatcgtaaaatacggcaggatttttgaacaatttaaatcaaaattcaaatgcaatttgatgggaaggtcggcacggattctttgaaaatgtaatcaaaatttatatgcaattaggcggtaaaacacgcaataatttttgaaattaaaattaaaataaaaattcaaatgcaaattggcagtgaaggccggcccgaaattttgaaaaatttaaatgaaaatttaaatgaaattttgctggaatgtcagcatgaatttttaaaaatttaaatgaaaattaaaatgcttttttcatttcagaaattcttaccattgttattgaataatttcttattccaattttaaaattcaagcaaaataaaaattattaatttgcaaaaaaaaattaaccatttattattttaatttaaatttaataattttttgatggacataaaaatctaaatcccagttaatgatggaataaaatttatctgcggatttgaaaatg

SEQ ID NO: 115912 - DNA, 1003 bp, Heterodera glycines
  Promoter: Source sequence=SeqID_9289; Location=546..1548; Strand=+; Gene=SeqID_70875
tgtattgactttgcttggtgacgaaaaatgctatcgccattggtagctgctaacttttcacccaccaaacaaacgcattttctaactttttgctgtaattttgtttgttgtttttttaagaattttctaaatttcccttttcagttgcaaataattagttttgttgactgactctgatacaatttttgagaggttggttttattcgaaattttcatttatttcaatcaattctttacttcgtttaatactttacataatgtcccattggtcagtgaaagctgtgtctttgtcttctacgacatttatttttttaagaaagcatttaaatgcccaaactttaggtttttattgaaaaatcatattttgtttggtttagtgtcactgatgacacatagaatgagtgccaaagaaatggcgaaagtaattaattatttgtaaattttaccaaattcgtggaagccattcagttcattaagacttaagaaattaaaaactgcataaacgcatttttcattcaaatttgggtgtgaacaacagacaataattgtctgaataaagacaagagatgtcaaaagataagagcgctttcaaattttctcaaccaattagtcctcatttggaggcttaattaggaaaaaaaattgttgataagcagaaaatggttatggtaatattttacctgttcgggatggcacattcttgggactcaattgaataatttacattctcacaaatacaataaaataaagaaaactgtttattttttgcaacacagcaaaattcgtcaacaatgcggtttacttaatttaatgggtgggctactttaatttctcttaaatcatttaattacattaaatgagtctccccccccccattcttttggcaatatttgagcactttgctcgaactttttttttaaggttgtatcttattttcagcaaatttatacaatttttcaatccatcataaaaaaaacttgcgctttttttcgctgcgaagatg

SEQ ID NO: 115913 - DNA, 117 bp, Heterodera glycines
  Promoter: Source sequence=SeqID_27375; Location=166..282; Strand=+; Gene=SeqID_58071
ggtgtggcccaacatttttgtgatttttgtttccaaattgtttagcattttctccgtgccaatgccatttcttccgtcagttacgaaattcatttttcttttcgcgtgccgtcaatg

SEQ ID NO: 115914 - DNA, 63 bp, Heterodera glycines
  Promoter: Source sequence=SeqID_2883; Location=1544..1606; Strand=+; Gene=SeqID_47465
tgtgttactttttaaatttattaaaaagtttcttttgtcattttttaattccttttagccatg

SEQ ID NO: 115915 - DNA, 259 bp, Heterodera glycines
  Promoter: Source sequence=SeqID_16165; Location=1254..1512; Strand=-; Gene=SeqID_80526
tctgtaatataataaagatatatttatttatgaaaaaattatatgtcatcgaattaaacagattaaaaaatttttgcttatgattcatgctcaccgaacactttctgccaagtatttaattttattattaaataatacggcccggcgggagcggggaggaagtttacgggagtcccgctcccgactcccgcttttttcggtgaacgggattttttacggaagcgggagtcttaaaatccttaatttgcttaaaaaaatg

SEQ ID NO: 115916 - DNA, 179 bp, Heterodera glycines
  misc_feature (27)..(27): n is a, c, g, or t
  misc_feature (57)..(57): n is a, c, g, or t
  Promoter: Source sequence=SeqID_39189; Location=1..179; Strand=+; Gene=SeqID_67820
cattggtgacgaaacatgtcaaaatantttgtgccaatcccttataaaaaataatantttgctaaaaatacaattaaattttgttagtacaaaaatacaaaacggaaactccgttatttttggaatttttctttttaaacaccattaaacaattgttttaaaagggcaattaacaaatg

SEQ ID NO: 115917 - DNA, 462 bp, Heterodera glycines
  Promoter: Source sequence=SeqID_867; Location=1318..1779; Strand=-; Gene=SeqID_62988
tcgaaaaaaaattaaccaaatttgtgcaaacagtcctaaagagtaaagatgaacaataagcctattcaaaagccaacataaggcaattcatgtattaccatatggaatttgtatttaaacatttcaactaaaaattcaatttctaataaatggaataaacctctaatttacattagttcattcatcatttcacttcattttaagaaactgattttttcgcgatcgcaatcaaaattcacaaactcacaaccatcagcagctgctgaaggaaaaaaggaaatttttaaagtgggttcaaagaaaacgccaaaacataatgccaaaatattttattgcgttttttcaattttatttttgtttagtttgaaaaacccacgccaattttattgcttttcggattttcgataaccatttacatttactgtttacagttgtttaaattataaattaaagcttcccatg

SEQ ID NO: 115918 - DNA, 581 bp, Heterodera glycines
  Promoter: Source sequence=SeqID_26549; Location=629..1209; Strand=-; Gene=SeqID_57286
tcgaggacaaaagtgttatcggtgcagtttttgggtatttgttagtgcattaattaatgtttcttttggcgtaaataactcttttttctcaccattcatttttgagaaaaccgggtttttcaacaaaaaaaaaattgttgttccccattacttttgcacctgactgtattttgtaccatcctgtgaactttattttattttattttatttcgtttgctttgtttttactttttttgtacttttgcaccactgtaaatgtactttttccgtaccttgtgattgctcgataaataaataaataagtacgttgctgattatattggaaaatgcccttttagaaaaggtttaattaattaatacaattacgaaatattaaaaaaaaaagttcagtcagtgattgacgaagtcattaaaatttgatatcaatttttgcaacaaaaaaaaaattaccaatttgaagtacatttgactttttttgttccatttcactagatataatcttaattaattttaaaatttgaattttccacttgttgttctagtacggggcctgaattcttcgacattagtcaataagaatg

SEQ ID NO: 115919 - DNA, 132 bp, Heterodera glycines
  Promoter: Source sequence=SeqID_1562; Location=1833..1964; Strand=+; Gene=SeqID_74473
ggtgggttcgtttgaaaattgaacaaacattcggtcgcaacattaagacaagaattaccgcatcatcaaactcctcagacgaaaataaaacactcagaaaaacatccccaaactaaatgctttggcagaatg

SEQ ID NO: 115920 - DNA, 96 bp, Heterodera glycines
  Promoter: Source sequence=SeqID_8212; Location=146..241; Strand=+; Gene=SeqID_67324
ggttgttattttttgccagatttttacattctccaattttaaggtgatatcattgagtttgtgttcgaagcagcggatggtcaaaagccgacaatg

SEQ ID NO: 115921 - DNA, 293 bp, Heterodera glycines
  Promoter: Source sequence=SeqID_30519; Location=689..981; Strand=-; Gene=SeqID_60931
ttttcagtgagtttattttgaataaccgcgatagatctttggaaatcaaatgcattggcagtgcttccgagcttccgggtgtgccattggcacaaattattcaatggcaatgggataggaatgggaaacaagtgatcaacgaagtgagcttattcgtattaaaaaaattggttttttgtgtattttgaaaaattaatcgtgaaaaactgtctggataatttttcgtattttctaacattttttgttaattaagtccacctatatgattacctaagttcttttagagtaaaatg

SEQ ID NO: 115922 - DNA, 519 bp, Heterodera glycines
  Promoter: Source sequence=SeqID_39737; Location=631..1149; Strand=-; Gene=SeqID_68238
tttccacttcagtccagccagttcagtaccaacagagcgtcgctccagcaatgacgtaatatttgcgaatagataatttctgttcaaaaaaaaataaaaatttcataaaagaaaaaataaaaatgccaatttgattagatattgaaaattaccttaaacttttgagaaaaccgtatgtactttttaattctttgaaatggtacaaacaaataagttttccaaattcagaaattctcgatttttaaatcacatttaaatacaagccttaattgagacaaataatccccattttaaatttcaatattctattatatttccttttctgtttcacaatataccgaattttggttttttgttcgtattttttaaaacctctttaaaccaaactaaaacagtatttaagtttatatttttaaaaatcaataaaacctctttaataatctcactaatcattgtaataccattacttctttttacagtacaccgccagcggtcgagcccgaagtacagttgaacatg

SEQ ID NO: 115923 - DNA, 236 bp, Heterodera glycines
  Promoter: Source sequence=SeqID_36217; Location=160..395; Strand=+; Gene=SeqID_65594
tgcttttccccccgagttattcagtcgttcgttcgtcttcgtttgtcctccccccccctcccttttctgtttcattcgctttcaccgcccctttccctttaatgtccaacaaagtgcaataaacgcaactttcgaattcgaattgtcgctctgtctgttgttactcaatggttgacaatggcatcggttgttctgccgccgttccgccgccgcccttccctttcaacgtgctaatg

SEQ ID NO: 115924 - DNA, 64 bp, Heterodera glycines; identical to SEQ ID NO: 99473
  Promoter: Source sequence=SeqID_29415; Location=423..486; Strand=-; Gene=SeqID_59917

SEQ ID NO: 115925 - DNA, 198 bp, Heterodera glycines
  Promoter: Source sequence=SeqID_19087; Location=1824..2021; Strand=-; Gene=SeqID_83831
tcattgcgcgaaatgtttctgctgagttaatcggagattttaggtaattaattgactgattagtcgcttttatcatggaattagctgaacaggaattcgacattccaaacctcgaatcacttttgttgactttttttatttgtcagatttctccaaattgccgtgttcgaagtcgaacgtaattgggcttacgcaatg

SEQ ID NO: 115926 - DNA, 652 bp, Heterodera glycines
  Promoter: Source sequence=SeqID_3036; Location=1..652; Strand=+; Gene= SeqID_82877
aacacataaaaattcatagcgtggctcaaattaaaccaaattaatttttcttggtatcattcaatagctttaattgtcctatatcagaatatgatttttcaaaattttttaaaataagtataaaaaaaattattgtcataacatttcaaaaatcttatgtcagcattttttgttcagaacttttttaaaactcaatgaaattttctaaaattttaaaggtaaatagagaattcttagggctatcgaatatataaattaaattagctcaattgcattttaaagactttaaatgtttattattattagggatgatatttttggcgctaaaaactgccaaaataggtaggctttaggctctaaaaaccccaaaaataggctccaaaaaatggaaaataggcactaaaaaccttcatttttaggggtgtaaaatgacaaaatttattcaaaaaagtaaaaaaattaggccaatcaaaattcaaatgaggccaacttagaaagcactgaagatgagtaaatgaataacagaaaaatgcaaataaataatcattagtgccagatttgggttaagtttaaaaattaattttgaaaccaattttaggcattcggaaagatttcaagaagctacacatcggtaatttgaaacttttttatg

SEQ ID NO: 115927 - DNA, 222 bp, Heterodera glycines
  Promoter: Source sequence=SeqID_3809; Location=1..222; Strand=+; Gene= SeqID_45642
ggattggtaagaggagcagcaggcgttgatcactttttccaccattaatgtttcaactttgtttagctaccgcgcgaggacgtgacggagttgctgccgaacgacggggacttcctggtgcgcacgacagaagaaacttcgggcacagagcgcgtctttgcattgtctgtgaacgtcggaggcctggtgaaccacgtcatcttccgccgacacaaagggatg

SEQ ID NO: 115928 - DNA, 681 bp, Heterodera glycines
  Promoter: Source sequence=SeqID_10096; Location=1..681; Strand=+; Gene=SeqID_73164
aagcgatgaaaaaatgggtaaaacgcgggaggaaaacagtaggagcacacgaaacattacattcattcttctggcacaaatttagaacatttgtgtattggttgtttttattgagcattggacacaccgtcccaaaaaatgagagatcaaccaataatgagagagtgcagagaaaaaaatagaatttcttcaaatttaacatattctgcattttctataatgaattcatttttgtctatggttgaatacaaaagttttaagaaaaacaaaatttcgaacgttcatatcttttttttctgattcttcaaattgcttagcattagttttgggaaagcttctcctaatcaagaagagctttagaataatgccagtatcgtccaatttgcattaaataattgccatcgaaatgttcaaaccgggtacaacttttaccacccactttatttttttaattaattaaatttttttttttttgcgattttcaaattttctccaaatatcatttggatccttcaccgttcgctcattcgtgtttattggcctggatatgtatgatgattaacctgctgctggattagtctagtaaaccaaagtaagaaattaattcatttaattagtcgtcattaaattttaattgtttttcggcactcggttgggccgattcgaagtgccgtgaaaatg

SEQ ID NO: 115929 - DNA, 122 bp, Heterodera glycines
  Promoter: Source sequence=SeqID_1983; Location=909..1030; Strand=-; Gene=SeqID_77203
tgtttgggcctacgaataattacgcaaagtgttgggctggggtaagaacaacggtatgtatttgggctgggacaagaacaaccaacaaaaatgattacggtatgtgtttgggcataaaaatg

SEQ ID NO: 115930 - DNA, 101 bp, Heterodera glycines
  Promoter: Source sequence=SeqID_37184; Location=1..101; Strand=+; Gene=SeqID_66325
ttctcctgtcgtttatcagcaaaccaaaatcgggccgctttgtttccgatggaattgtggaacatgtgagatcggtaaaataaccaaataataagtaaatg

SEQ ID NO: 115931 - DNA, 314 bp, Heterodera glycines
  Promoter: Source sequence=SeqID_43745; Location=1..314; Strand=+; Gene=SeqID_71350
tggttcaagaaaggggcattattcataagattttccaaaattgcgcgaaataaattttttagtcatgaacagaaaagtaccgaaataacttaaaaggagagataacccatctatttctataaaaaatgaacaaaaacccagccgaattaaaagtaataaatattgaaatatgatagactaacttgtaagagattgtgccgtgcagtcgtgtcttatggtggttttgtcaaatgatctatttttatgttctatagaagcctatgaaaaaataatttaaaaatatatcttggccattttgcactttttaccggatg

SEQ ID NO: 115932 - DNA, 77 bp, Heterodera glycines
  Promoter: Source sequence=SeqID_9402; Location=248..324; Strand=+; Gene=SeqID_46748
agttcaaaatacaatttatcacaattgttagttttgtcatttaggtttttctttttgtggaagcattgaaggaaatg

SEQ ID NO: 115933 - DNA, 227 bp, Heterodera glycines
  Promoter: Source sequence=SeqID_6790; Location=403..629; Strand=+; Gene=SeqID_62921
ggtgggggggggagggagaggaggaggaattggtgtcatgacaactcgtacaacggcttaggctgccaagttatagtctaaagcttaggctttattatgtacgagttgccttttgtacgaattgccattgactccattcgagattcccgaattttggcccaagaacaagcaaaattgaaatgtgacaaattagttttttccatcaatcactttccctgctaagaatg

SEQ ID NO: 115934 - DNA, 236 bp, Heterodera glycines
  Promoter: Source sequence=SeqID_25805; Location=1216..1451; Strand=-; Gene=SeqID_56566
gcctccagcgctggtccatggttttggcgaattacgattttgaaattcgctacgtaaacaccacatcatttggccaagccgacgttctgtcacggcttattgccaattattcgcgtccagaggaagacatcctgatagcaaacatctgtgccgatacagattgctacattaattctgttttcgaaaacagaatggatcagctccccgtgacaacagtcgaaattacagcagaaatg

SEQ ID NO: 115935 - DNA, 221 bp, Heterodera glycines
  Promoter: Source sequence=SeqID_34212; Location=1..221; Strand=+; Gene=SeqID_64057
tgatcgctgatgatgggccaaatgcaactgctggtcaagcgctgtgaaaatgtttgcacacgccgagaaaagatggaaagccaaagcaattgagttgttatgatgaatcagaacctccaagtttcgaattgatcaccaatttcaaagagatgtggccatattttagtaaaattaaaattgcatttatttccatttcccattgtttaggcatttctcaaatg

SEQ ID NO: 115936 - DNA, 956 bp, Heterodera glycines
  Promoter: Source sequence=SeqID_6472; Location=439..1394; Strand=+; Gene=SeqID_61713
tttgtattcgctactgtaccatttgtgaatgtaaaaaggcgttttccttgcctaagggcggctttagctgaataattttaatggcttagaaataataattaatgggacattctttgaatggtaattaattgagtatttaacgagaaaaggagggaaaggtcgtcgaaaagagtgccgcccatttaaacgaccgacaagtttcacagcccatcacttttcagtttatcaaattcaaaaagggtaataattaacgaactaaaaaccaatattcatacacaaaatacctctcacacctttattaaaccaaatgtgagcattttaattcacataataatcccctcttaacgtggccattgcgaattaaaatttctattttcggtttttgcctctaaaattgacgcatttttccaattttatttacaaattacaaaaattaaatttgacttttggagcaacagccaaaaaatgttttatgttttgtacttttaaaataaaaataaatttcggcggctcttttcggcactgccgggccttcctttattggcacttttctgtcaatttaagtgcttatttgttataatttgttaggcgcttttaaaccaagaattataatagcacgacaatccgccggcggtagacaattgagcagcgacaattgggcaaatttttttaaaaatttcttaaactaaaattcttaaaatatttcaattgaaaaagtaattatttatgaatttcttcgttatttttcacatttggcttttacataaagtgatttgtgaatttatagcttaatttacctaaataaaacagataatttagtaacccctccccctggcaattcaattattccaaaacaattccataccgtaatcacacatcttgttccccaaaaacagtattcttttttcaattaatccctttaaagctgttaaaaaaggcctttccccacaaaaatg

SEQ ID NO: 115937 - DNA, 110 bp, Heterodera glycines; identical to SEQ ID NO: 98226
  Promoter: Source sequence=SeqID_5872; Location=392..501; Strand=-; Gene=SeqID_59506

SEQ ID NO: 115938 - DNA, 231 bp, Heterodera glycines
  Promoter: Source sequence=SeqID_11996; Location=886..1116; Strand=-; Gene=SeqID_75518
ttcacagagaaaagagtactgtagtcggatgaggggttggacagacagcggaaggggaggtaagctaatttttgtattggatttttctagaaattttagaaaaattaatttacaaaatgtatgcatataattttatatataaaaaaaattggcaatttgtataattaagaaggcgatatttgcagcaggccagccagctactgtcatgaaatgaaatcataagcaaaaatg

SEQ ID NO: 115939 - DNA, 254 bp, Heterodera glycines
  Promoter: Source sequence=SeqID_3403; Location=5939..6192; Strand=-; Gene=SeqID_47611
ttcgtttgaatgaaatctaagattaaaatttccctctctattttaatattgcttgacaataaagtgaattaaaagttccttccttccctttaaattgtatgtttcagcagaccattaatgatccgattgacctttttttattttacaaatttgctgttttttaatttttttatttaatttaagctgatctcttctctggttaccaaatatttttttgttatctagtaaattttccattattcaagccaacaatg

SEQ ID NO: 115940 - DNA, 248 bp, Heterodera glycines
  misc_feature (62)..(62): n is a, c, g, or t
  Promoter: Source sequence=SeqID_4223; Location=1..248; Strand=+; Gene= SeqID_53665
aatataaagaaaaataaataaaaaattctatttaaaaaatatacttaatttaattttttttngaaaaatattgaatttaaaaatgcttctggcaaacaaaagctgactttcaattctttctagctgttcccatttctgaaaaagttaaaagcacacgataattgtattatgatgagtcctttcaaataaatgcaaaatttaatttaatttgtttattattttaaaaggaattttatttgaataaaatg

SEQ ID NO: 115941 - DNA, 251 bp, Heterodera glycines
  Promoter: Source sequence=SeqID_1844; Location=1..251; Strand=+; Gene= SeqID_76325
tttagaaacactgacagaatgcattcattggtttttgaattttgcagggcttcgattcgttgggaaccctttgaattggtttcgcagttcgacctttcgcatcagctgcatttccccttctcagcctcgaattattcttcgcaaacaaaagatggagcaaatgaaaatccgaaattgcattttctaggcatttcttttgtcttacaattagcatttgctttcctttccctcacccatttgtttaagacatg

SEQ ID NO: 115942 - DNA, 132 bp, Heterodera glycines
  misc_feature (19)..(19): n is a, c, g, or t
  misc_feature (44)..(44): n is a, c, g, or t
  misc_feature (60)..(60): n is a, c, g, or t
  Promoter: Source sequence=SeqID_17396; Location=1..132; Strand=+; Gene=SeqID_81874
tttaagtctgcttttgacnttccaaatgggtcgatgttccgccncctgcgataccgtacntaagtccaacggtaacattggtgtgctacggtgatttgttttgtaacaaggaaatgctgcaggaagactatg

SEQ ID NO: 115943 - DNA, 87 bp, Heterodera glycines
  misc_feature (44)..(44): n is a, c, g, or t
  Promoter: Source sequence=SeqID_13738; Location=2790..2876; Strand=-; Gene=SeqID_77658
gtttaaacgctttatattttcatagggaacatgtttcgcgcatntggggcatagccagaaattatcacaaaatgatgtaccgaaatg

SEQ ID NO: 115944 - DNA, 155 bp, Heterodera glycines
  Promoter: Source sequence=SeqID_26549; Location=1..155; Strand=+; Gene=SeqID_57287
ttcgcgatttttcttacctaaaattagcagctctaataataatatttaattttattttaaacgaaattttaaattaaaattatatactttactaataaattacaaataatttcttcttttttttgaattggcttcatgtttagcccgtttcgatg

SEQ ID NO: 115945 - DNA, 278 bp, Heterodera glycines
  Promoter: Source sequence=SeqID_20587; Location=1..278; Strand=+; Gene=SeqID_51140
caaaacaatcataaaaatatttttttaaatattaataaataatctgttaaaaaaggcttttctggatggataaagattccatccatctgggaatacaggtcgggtgggaaaatgagaaatattttttattctgtccattaatattgccaggaaaaatgttatcaatttttccctacagtatgccgaaattgcgcacacacgcgacgagtggtcacaggcgacgctgaatcccattgattaccccggaaaatgtagggttcagtttgccccggacaatg

SEQ ID NO: 115946 - DNA, 1003 bp, Heterodera glycines
  Promoter: Source sequence=SeqID_1153; Location=96..1098; Strand=+; Gene=SeqID_68891
aaacatttaaattgtcaaacaatttgcagagcagcataagttaataagtttttgagaaaaaatgtcttccgcacttaaacagaaacaacaaaatccgtgcgcacaatttttgttgtccggcggcgacgcggtgcccatcccggacagtctgttcatctacagtgcctttctgcgtgactacaaaaaggcgatgctgcgcggcgacatggacaacctgtgaggagcaggctgaatttgtgtggcacttggagggattaggatttagaattcccgaatcttggcagtcgggcaacagtatgccaaaaaccccggttttatgggatttggaattttataaatttgtttaaaattatcgggttttgttcatttttggcgagcccttataataaggtagatatttttgggtaaatttttcatattttccgcccggtgggactcgaactcatggcctttccacactttggaatttcatacaacaagtttctagtccttagccacaattggcacttttgtccccctcccccccattaatttttgtgctccgtttcagtgaaaatatgactattccgttgccggttgtctccggcaaacagccgttcaccaagcagcatttgaccgtcatgactcagtttttcgacctgtgcgtatagtgcttcttaaattttacaaaacctatctcttcccagcctaattacagtaccccttttcccagttacacgcgtcacaattacggtgcgggcagttccagtgccaaaaaagtgccctccacggtggacttgcagggcaaatgcggccccggcgcggcggcacacaccaaagcgacgccacggggcgtaaacaaaacggcggcgccaccggcggggggaaacagcgtcgtcggcaacggacgcgtaagagcgggggcgaatttgaacgatcagaaatttttagaatgatcagaaaatttttatcaattttcacccccccccttccctaatcgaattcgacacttttaaaggacatg

SEQ ID NO: 115947 - DNA, 349 bp, Heterodera glycines
  Promoter: Source sequence=SeqID_40471; Location=700..1048; Strand=+; Gene=SeqID_68795
ttttgaagttcgaattggcgccgcccgtcgcgcttcgcaatttgttcagtaattggatgcccatttttagaattccactgccacttttcttaattttaaaataataattattatttaagtatcttaattagggtaaaaattaccgtactttttcttttggcccaagtgtaggttcgttacgcgcaagcaccaacttcatacattcgcgtctcataagcacctaattattttctgtttttgtatatctacggatttactcgcgcgacaacatgccttacccgtttctgatcgtcaataccaacaaattgacgacgatgaatgataatccgagatggagtaggaagaaatg

SEQ ID NO: 115948 - DNA, 688 bp, Heterodera glycines
  Promoter: Source sequence=SeqID_12269; Location=599..1286; Strand=-; Gene=SeqID_75855
ggacgatcggagattcaagaactaagcaatttaacagcgccaagatttaagctttatcaaaagccattgaatcatttgtattctcattatatatgatgtacaattatatagataaaatattggtcataggtttgtacaagcttaataaaattttccaagttttttgaccatggtaatatttacaagatttctagggtattggtcattgatcaagttaaaaccaaccaaagtttcagtcttgtaaacttataaatgcttcaattattttggttatgggagataagtacaagattgttcaaggtcttagtcatgggggggggggcatttcccacgatattgaataccatgttggtcttattcctttccaacgtacagtaataactagggctgccaaaaatatgcacgaaaagtggccaaaatatgcgcataaatatgcaaataaagtcgtgaaatatgcaccaaatatgcacaaaaatcgcaaaatatgcaccaaatatgcacaaaaaaaaacttgaaaattaggggtgcaaatccaataaaaaatttttattcctcataaattttatcggttttttttgcaattgaaaatcaataatttttcaagattttcggcactaaagctccatcctattgtctgccaaaatttacttaagggatattcaaaacggaaaatatttgaagaaaaatg

SEQ ID NO: 115949 - DNA, 460 bp, Heterodera glycines
  Promoter: Source sequence=SeqID_217; Location=2288..2747; Strand=+; Gene=SeqID_77992
aacaaagagagatagagagagagagagaaaatgaattctgcacaaattgacacgttgctgagaagattgcatgcaacaagaggtaagttcatcggtgtctacccgtcaaacaaagtgccgctgattcacgacagacagagacgactgcagcgctaaccaaaccctgatctgtctgcctatctcaacaattttcgccatgttcaagtgaacacgcagcaaattcagttcccctcatcggacgcttgcggccacttttgtgtctatttcttggccagccgttgttccggtgtcccgttttgcgtggtggttgagacgttacgcaaaacgcgcgggatggcggactggttggtcaaatggtatgtacgcatgttagtccatcatgtataaaagggtgactaaaagagagggatgccacacaaatgcccgctcgctataaggcggataggcactagaaaaaatg

SEQ ID NO: 115950 - DNA, 55 bp, Heterodera glycines
  Promoter: Source sequence=SeqID_43197; Location=1..55; Strand=+; Gene= SeqID_70927
tgaaattgtgatttttgaattccaattttccctgagtcttttgtttactcaaatg

SEQ ID NO: 115951 - DNA, 71 bp, Heterodera glycines
  Promoter: Source sequence=SeqID_15339; Location=820..890; Strand=+; Gene=SeqID_79596
aatttttgttaaaactcccatctattacgtgtaattttttggagtattaggcaatgaaaattttacgtatg

SEQ ID NO: 115952 - DNA, 224 bp, Heterodera glycines
  Promoter: Source sequence=SeqID_2354; Location=4558..4781; Strand=-; Gene=SeqID_79287
tcattcaatagccctaagtatcctctattagcctacaaaatttcaaaaaatttcgttaattttcaacaaacttatgaccaaaagtacatcagaaaccgggtttttcagcttttttggccataacttttttgaaccttaacgaaatttttcgaaattttgcaggctaatagagcatgtgaagggctttcgaatgatatcaagaaaattagatttggttgacaatg

SEQ ID NO: 115953 - DNA, 93 bp, Heterodera glycines
  Promoter: Source sequence=SeqID_952; Location=296..388; Strand=-; Gene=SeqID_64823
ttttgtttcttgtttctcgattctaaaaatcatttatttttaattacgatcttagaatttatcgattttcgaaatacttattttctaggtatg

SEQ ID NO: 115954 - DNA, 186 bp, Heterodera glycines
  Promoter: Source sequence=SeqID_1247; Location=1121..1306; Strand=-; Gene=SeqID_70629
acccggaaggggaggagatacgatatcgttaaaaaaaaaaaaaagttttattctttccgtaatttacattttggcatttcttttcttggttccatcctcattttgtaagcattgtcttttctatctaatttagattttgtcctccacccaatttcctgtttttgtaatttctgttccctcccaatg

SEQ ID NO: 115955 - DNA, 231 bp, Heterodera glycines
  Promoter: Source sequence=SeqID_621; Location=9779..10009; Strand=+; Gene=SeqID_57659
agacattcggcatttttttaacccatgtacaaaagcaaaaattaccatttttctcacaataattaatccataaatctttgatagagagggaaaatgtaaatcactaagcccaagacgggcagaaaggtggagcctcattagtataaaaaggaacagttggcctacaaaaattattctcaattttactcatctctttgcttacctgttcctttccacacttttgttcccatg

SEQ ID NO: 115956 - DNA, 501 bp, Heterodera glycines
  Promoter: Source sequence=SeqID_3641; Location=1897..2397; Strand=-; Gene=SeqID_51231
tcacttaaaagtatatttaaattttgatttaaaaaataaaaaagcaattacggtttaaatctgctaaatacaaatttgaaattaagctttaattttagaaaaatatgttctctacagaaaaaaccggttttaggttaaaagggatacggggggataagcggatggcttacaaagccgcaggcaaaatttaataagtaaattaaaataaaaaatatttttaattccaatttatctaataacataatgccaaacgagcaacaatttaaatttattttgtcttttaatttgtttttaaaattaaaattttttaatttgtttagtttgaacatttttacttcgaaattaatactactctctcttcctccttcgtaaattcgtttttatgtacaacaacagcagcataatcaacggcgattgggccgctgccaacagcatttggaagaccgggcacgagaatttgtgcaaggtctgcaacgaaggccggcaccggccttccgaatg

SEQ ID NO: 115957 - DNA, 862 bp, Heterodera glycines
  Promoter: Source sequence=SeqID_8056; Location=715..1576; Strand=-; Gene=SeqID_66843
tttatttatttttttctaaaaaattgttataaaaaataaatttgataatatttatttccacttgtaaaggtcaaatgaaataatcaaaatttatttaatagaaaattccttttaattaatggtaatttatttatgttgtaatccattagggacccgtattttaggcattggttattttttttattaaattgaaatctatcaccaaaattttcatcgtaaattaataaaagagctgatttaatttaatgtttaaaaattatttattctattaaatatttaaaatatttctttattattttcaaaaattaattaatttccaaaaactgtaaaaagattattcaaaaagtttaacaatttgttattcatttatgaaccttaaaactgattgtattgtgaacattgtaaatatttttcttcgtttaaatggggttcgcttcattgacacaaaaaatgggtataacatgaataattaattgcctaattaagcaaatgccggaagcggagacggaaggatacggtaaaatttacaaatattttttgcttccgttaattacgcaaaagtgcaaaaaatgtgaaaaatgcggagatttaattactctttttataaaaattatttttttttaaacaggaaattgctacaaaaaggaaacaggaacagaattttacaaaaattaacttaaaaagttcagacgattttatgcaaaaataattagtgtagataaattaatttattgataattaaatttaaatgaaataaggcatttaactaaaatataattattttaaaaagaaatattagtttaattaaatgttatttttttgtcattttttaagaaaaataatcaaattctcagcgctaatg

SEQ ID NO: 115958 - DNA, 292 bp, Heterodera glycines
  Promoter: Source sequence=SeqID_173; Location=663..954; Strand=-; Gene=SeqID_47055
tgatgaagtgatgagttgtcgcgacgaaatgtgtagacgagcttggcgcgcactggtgttgatgttgcgttgagttgaaggctggctggcactggtgaaaagtgaagaaaaccgtcgccttttatacactttttttgctgcatgaatttttgcacccgaattttgtatataaggaggtggattttgcacattctcctcactcagcagcagcaacacttcaagcaacgctctcaacgatcacacatcaagcacccacaaagccagcccgacaacagcgacaacaacagcaatg

SEQ ID NO: 115959 - DNA, 264 bp, Heterodera glycines
  Promoter: Source sequence=SeqID_31526; Location=1179..1442; Strand=-; Gene=SeqID_61855
taaaaaaatatatgtcaagcgcatcataaataaccaataatttgatcaatctattcaaaaatggcaatatatttttaagttttcaatattttattatactcataaaaaagttatacattaaaatttacaatttttttttctccatctttgctcttcacattggcttattctacgatagaaacatacgtattgtaaaatataaaagaattatttttttttaaataagaatttttgattttttttttcttacagttacaggaaatg

SEQ ID NO: 115960 - DNA, 98 bp, Heterodera glycines
  Promoter: Source sequence=SeqID_7113; Location=767..864; Strand=-; Gene=SeqID_63875
acaaaaagagagagtggggaagagagaggagagggaatcttttgaggtgaaagaagatgagagaattgaggaaatagagagggagggatagagtgatg

SEQ ID NO: 115961 - DNA, 1003 bp, Heterodera glycines
  Promoter: Source sequence=SeqID_12717; Location=2235..3237; Strand=+; Gene=SeqID_76411
tcattactcgtgttttctgtgttgaactttgtgccaacattgcgcaaatccgtcgtaaaatgcaaatgagccgaccatcacaaaaagggaggcaaatgcatgggacaacccgaaatcattgtcgaagatgagtacggaaaaaagaatgttcaagaatttgcggagtgccaaagtcatcgaaacttgcagagaagtcgtctcggcggccagccgataaacggaacggacacaaaacaatctaaaattaaaaaataataaataaaatttaaaaaatggattgaacaaactgcaagaaaagtgtggcagagagtgagagaaaggggagaacgtagggaaaagttgacgaagtgtcggaataaacggaaaggtccgaccgaatttcaccggcgacaaacgcaaagagtggcagagagagaaagtgctaaatgcaaagccaaattggttagttaaatggccgaaatctgtccattttcgaggtaatccggcaaatgataaacaaatggaaaagcggagaaaaattaccacaaaaaacatcatttcctcgggatgctttccgtagcgcaaaacactttctcctgcacaattcccaaataggccgaagcaaaggaagaacagctgaggaagaaaacacctaaaaagcaaaaagggggagattaagtaacgaatttaaaaaccatacgaaatttattttgagtaaacaaacgaatgaatgaaaaatgaatgtgtttgccctttttggtaatactgtgccgcccccccccttttcaaaaaaattttttcgcgtatagagaatggaatttttagtcaggaccgagattaataaaaatgaatccgaaccggttcagattgacagatttggatgtctttttcgaaacaacccgggtcatgcatattcaaggccgggaaaaccctgtcaggaccctgctcccgtccggtctcgtttagcacccaagcaggacaaaccaagcgcaaagcggacaatgtgtccctgctgttgctgatg

SEQ ID NO: 115962 - DNA, 107 bp, Heterodera glycines
  Promoter: Source sequence=SeqID_41192; Location=1002..1108; Strand=-; Gene=SeqID_69377
accatcggccggcggaaagattgcaacagcctcaacagcagcaaagacagcaaagggtggtgagggaagggacggcctctcggagggtcagtggaagcaccagcatg

SEQ ID NO: 115963 - DNA, 222 bp, Heterodera glycines
  Promoter: Source sequence=SeqID_12343; Location=2748..2969; Strand=-; Gene=SeqID_75940
aaaatcccgtcaattttaacggaaatcccgccgggaacggcaaaaatttttttaagaaaaaaattttttttctaaaattttactttaaaagtcaacgtaatttggatattaaattatggcattatgtcaattttttttgctcatagttcagaattattgtttattattattattaatatggtattaggaatctttcgtgatacccatttttatttcagaatg

SEQ ID NO: 115964 - DNA, 154 bp, Heterodera glycines
  Promoter: Source sequence=SeqID_34670; Location=1..154; Strand=+; Gene=SeqID_64401
aaaacaacccaaagggagggaaaacaaaacaaaggaataacggagtgttaataaattaggggagaacaaaattagtaaatcaaatcggaaacaaaataatttaaaggattacatttctttcaaatgttttctaggaccctgaaaagtgaaaatg

SEQ ID NO: 115965 - DNA, 345 bp, Heterodera glycines
  misc_feature (154)..(154): n is a, c, g, or t
  Promoter: Source sequence=SeqID_30763; Location=1..345; Strand=+; Gene=SeqID_61159
gggcaagcagtccatgcacagagagagttacacgtgcatccgcaatgcacccaaatcattcaaatatataatccccagctgtaattgatgacgaaaaaaaacacaaatttaattggggtgggcggggaatgaatggtgttccttccccttcccncagaaagctatttaaatgccaatttttcacagcagaaccataaagaacggcaaaaaataaatttttaggtattttagcaataagaaatttatttaaatcaatgcattttaaaaaacaattaaatcattattctatttttaattattttcagttttcctaatattaacaattaataattattagcacaaatg

SEQ ID NO: 115966 - DNA, 1003 bp, Heterodera glycines
  Promoter: Source sequence=SeqID_8884; Location=1072..2074; Strand=-; Gene=SeqID_69524
aaaataattaaattggcgtgctgttgcttttgtttttatctttatttctcccaattttatgtaatcctgttttttttttgaagagttgagtgtcatttattaacagattttgttcaaaaattgtccaaattttgtgatgttgagctgagctaatttttaaggaaagcgtgcggtagacgccgacggaaacatttttgaaattttggctagttatttacagacttttgtccaaaaaatgattgcgtcaaattttaaatttctagataaaatatttaacaaattatgccataaatttcatattttgtgaagaattttaaggaatcagaacaaaatgtaaataaaaaacaacaatatttacttctttcaaatttaacttttttttctttaaatgacttttaaagattttttccaagaaatttacgtggtcttttttttattgaaaatttgctccctgatcctcgacttttctctccccaaggatcggggagatccatttcaatctgtagcctcttgtattcgtccgttcttccaaatttcgacattatttccgaccttttactttaaaataatgtgccaagtcgtaaatcccacctttccattgaggatttatggtcacgaccattgaaaaccatttcaactcagtactaaaacgggcacccgattataaaggcgggcaaaaagtttaaatgcatttttgtttgttgaaaagattgaagatgaccaccggtggcattttgggcgattagtgcagtgccaaatctatgcatgcaattaaataaagtaaaggtcggaattttgttatccattttatgcatccaacattcttgggattttttttttttttgttattcttcatagcctggagaatctgtcctatcgtgacgaaaatataattcacataccttaaataactagagcctggatttttatgtgctaaaatcctgaaatatgtaataaaaaatgtgctaaaatgccaaaatatgtgctaaaaacctaaaaaatg

SEQ ID NO: 115967 - DNA, 715 bp, Heterodera glycines
  Promoter: Source sequence=SeqID_2481; Location=1197..1911; Strand=-; Gene=SeqID_79953
gcttggtttgaagcttctaggatggatttctatatccatatttttccatatttcgcgattatgtctagagcccggcgcaggaccggatcctgcgcaggattttgcaggatcccagtccgcaatcctgcattttttggaaaaaacaggatttgcaggattgcaggattaatccggccggatccggtcctgcaaacatttttgaattccaatcctgcaacaggatccgcaaatttgaatttttgtgcaggattatgcgggattttattgattttttaaaaaattttctaagacagaatgccaaatatacagaaactttgtttttataatatacatggattaggtatgaggagacttttgcaaaggaatttaaataaatgttattttactttgatttaagctattattatgagccacccaatttggcaaatcggtctttttaaccgaattaccgaagattcggtcgagtgcttggagtgtaaacaaaaaaacgttgtattttgctcttaaattgtcgaatcggagtatcaaagggctcaagacccatctgtttgccaagcacaaagacacgccgtatgcagaaatatatttaaaactggatgaaggcaagtcaaagaaggatggtccaaaaatcacagattatacaacacggagttcgggtccaagaataaaattgtgattttaattaattaccattttaggcaaattaagtgtgatg

SEQ ID NO: 115968 - DNA, 258 bp, Heterodera glycines
  misc_feature (80)..(80): n is a, c, g, or t
  Promoter: Source sequence=SeqID_11499; Location=1..258; Strand=+; Gene=SeqID_74925
gactaatgacaagcactttagcaaaaacaaattctaattcaatatatttaagatctttttatgaagctttataatatttntaatttgcaaaaaacaaatataaaaattaaattaataaaaaaatatttttttcgattttttggcaatttttgggaaaaggtaacactcagataaaacttgctaaatatttttcaactaattttttctacgcattaccaagtcagagagccaaatatttgcgttcctttgtgagaaatg

SEQ ID NO: 115969 - DNA, 1003 bp, Heterodera glycines
  Promoter: Source sequence=SeqID_4102; Location=1412..2414; Strand=+; Gene=SeqID_53193
ttaatttatggggcacattacccattaattgttttgttgtgttggcattcgccatttttattcactttatcggggggagtttcccatgacaacgccttgtcgaatcacaaaacattagttattagtttcaattggttctcatttattcggcatccctttgaacgaacaatggccattttgcacccaaaaaataaggtttaaatgtttaataattgagaacagaagggaaaagcgtctctttacaggaagaacttgaccaaatcatttccaactctggcgaaagactcattgtcattgacttttttgcaacttggtaaagtgtttaaatttttggatttcatttttaattacgctttgttaaggtgcggtccatgccgacaaatggggccaaaattcaatgtttttttaattttgtttttaatgagtgcgaatgggaggggcgcataaataatgaaggaccaaattgttgatgagttaaactcgctttgccatatgaaagtgcggaagttgtagagaccggaaaggacaggatactgtacatgattttctcagagtcctgatccgggtactgtatttttttggaaaatcccaaggacccggatattgttaaatttctgaaaactaacattttacctttgagatataaatctttctccgttcattaaaaaatcaaaaaaattttcctagaaacttgctgccgaataccctgagccaatttacatcggcattgatgtggacgaacacgtaaagaccaacagagatacataattaccaatgccaacaaaaaaaggataatttcctatttttgggtggggaaactgcgaattggccaaatacgaattgggtttttgctgaaccttaagcacaattaattccgctccttttgtctgtttaaaatgctttttgcaggaatcagtcgcggcattttacaacataaatgtaatttgaattccaaatattttaatgatttcatttgattatctcttttaaaattcaggtaatg

SEQ ID NO: 115970 - DNA, 164 bp, Heterodera glycines
  Promoter: Source sequence=SeqID_15845; Location=2395..2558; Strand=+; Gene=SeqID_80175
cgtaagcagtgaaccatttcacgtgatactatgtgctcaattattcattcattactacaatttcatctgctgctaagaaaagagtggcgccagtcgagctttaaaagtggcggccgagtaatgcgggtaatcagcgcgtcaattgtcccccgcccccctttatg

SEQ ID NO: 115971 - DNA, 63 bp, Heterodera glycines
  Promoter: Source sequence=SeqID_25658; Location=577..639; Strand=-; Gene=SeqID_56410
agcaatgggagtcatcgaaactgccgattttccatggacgaaaggacaaatgaccggcaaatg

SEQ ID NO: 115972 - DNA, 196 bp, Heterodera glycines
  Promoter: Source sequence=SeqID_31879; Location=1542..1737; Strand=+; Gene=SeqID_62188
tttttgagaattccggtctctaattatttgtctcgattttgcgagagtgtaatttttaaataattgtcgtcactaaattggtggaagtgattggcaaatcttaaattgaatatcgatccaattaaaattgcatcccttaaaacattgcaaatatttcttttttattattttctaaatgttttctctttcgaaaatg

SEQ ID NO: 115973 - DNA, 400 bp, Heterodera glycines
  Promoter: Source sequence=SeqID_39605; Location=1..400; Strand=+; Gene=SeqID_68132
aacatttgtagaaggaatgaattgccaatgttatggaaattaattgctacattgaaatataatagataaattatttgttctttttttcgcattaaccaattaataatgtttttgttgcgtaacatttgaattgacatcactgatttttattgacttgtctggataaatccaattaatcattgtttataaaaaaataaatttattttataaaagcgcatcctaattttatttgatttatataaaaatgaatgtctgtatcaaattaatatttaattaaaataaataaacattgaacctacagaatcatttgcaaatttatttcattttgaactcagataaaattgctgtggttctctttttcatctttatatttcttaaaattttagaatatttgaaaatg

SEQ ID NO: 115974 - DNA, 178 bp, Heterodera glycines
  Promoter: Source sequence=SeqID_9194; Location=1684..1861; Strand=+; Gene=SeqID_70557
ggtaattcactcaaaaaatattttaaaatgcttttgaggttttttctgataaatcaaaggaaattcgctgacgaataaatgaaaattatttttcaataaaattttaatcttatataaataaataatttactaatccaaaaaaggacgagcggaatcagctgctcacttccctggcatg

SEQ ID NO: 115975 - DNA, 1003 bp, Heterodera glycines
  Promoter: Source sequence=SeqID_3931; Location=5727..6729; Strand=+; Gene=SeqID_52492
agtcgagactcgagaagagcttgaactgatcctcattgctggaaacccaagacttgacctcgagactgagacttaacccgggactcaaccgtaaaaactcgagccttttctcgagtcgaggccaagaggaatttgaacatatgtccattgcttgtttgacatttgacgggaaatgaatctgtatcattcattgacactgatcaattgatgtctcgcggattgaatgagctgaattccggccaccgataatttaatcaataatcacctccgatcacactcagttgcgcttcccctctgccgattgtatgctgcaacggcactccgtctacgaattgcccgtcgtttggcctgatcgatcgccgattccaagtacgtaacaaatcgagaaattcgatcaatcaatcaaccaattaagttctgatttattccgtccgcattgccaccgggccgtccaccgaccaaacaaatccggaactaattgtccagcttaatctgtagggttttcatcatcttcattattatggtttttcaataattttttggtttgataatgttaaatcttatttcgttcatttttggttttctgataaatctatcaaaatttcaaaaaatcattttaacaaatttcactaaaagatattttgcttggacagatttggtgagcatggtgatgttggacaacgaaaactaatcagagatgaactgcaagaaactgtagcttctgatcagcagcaaaaggaaatgccaccaccactttttgcgccgaaaaccgtaacacttttttatttggtagcgcgtactgtaagtgtcactattggcttcagagttgcgctttcgagtttgaggccgtttccattggggacattcattgtgccgaagtgatggtggacactgtaccaaaggtaccaaccaattcatattaattaaacggcaccctccggtctaattactaattttaaatgtgccgcaggacacagatttttgttgggagtgcacagagatg

SEQ ID NO: 115976 - DNA, 365 bp, Heterodera glycines
  Promoter: Source sequence=SeqID_1788; Location=3252..3616; Strand=-; Gene=SeqID_75976
tgtgcttgccatcctaattgccgtctagaaaaatttaattaattaattatttaaacaggaggaaaattcaaattgaacacacaattttttattgactctttgaaattggatttgaatttaagttttttcaatcttagaggtcttaaacagaatttttgggtaatgtttctcatgaacaaatgctatctgcaggccaataattaatcattaagttcatctcataaaatagagagaactctgatcactccgaccactctgatcatctttctctctctctgatcacaattttgtttttaaaaaataaatttcctccatttagtcattaattattttatatataatttatatttgtagccccgaaaatg

SEQ ID NO: 115977 - DNA, 357 bp, Heterodera glycines
  Promoter: Source sequence=SeqID_13023; Location=1..357; Strand=+; Gene=SeqID_76799
ttagtctggacacacttatgttaacagggttcatttcctccccgaaggacagataaaggggcaaacaagacaatttaataaacatttttgtccattttcaagtgcgtccttgaaatttaagggggccaaaaaaggctgaaacaatcttaaaacattattttcaaatttttcgatgacagctaaacagataacaaaaatgctcaagattcatctgttttcaaggacgtccgtgccatctgagagcaactgaaaggatcaataattgttttaattttttttttggggtttttctcatatttttataaaaatttgttcattttcaaacacgtcctttccccattcgaggggaccaaaatg

SEQ ID NO: 115978 - DNA, 1003 bp, Heterodera glycines
  Promoter: Source sequence=SeqID_20252; Location=393..1395; Strand=+; Gene=SeqID_85048
acaaaaaatgtattttttagtggaaaaaaaccaaaaaatattattaaattttaaaaaaatgatttttttttactgaattaagtaatttggtgggaaatttaaaaaataatttgagctaattttcagtgatatactctcctcctttttttccaaaaatgatctcataaaaattcttaaaacgtcaaaatgatggcaaaataaatgttactaaaaatattatatgacatatataaaaataaacagaaaaattaagtcgtgcgacgtcgcaacgacaaacgattgtgctcttcataagaaacccatgggggaaagcaaattggcgcggggctttgtccctaaattcgccagattgggaaatggtgccggcgggcatcaaaaaatatatggaaaaaaagctggacgagaacagcggtggattttggtaataaaacagggaattgaaattcttaaacgtcaaatggattaattacaatttttatatgcacaaagctttttggccaaatttggattttttgcactctttttgtcattttaatacagtaaatgcatcttaaataattaaaaaaaaaacaaaattacgaagcaaatgttctgtataattttgagactgcattttgacaatttgtattttttattttactttaaaaaaataaagaaaaattttgtcaagaggtgaaaaagttttcaaaaagcagacgttttccattttttcttccatttagggcatataaaaggcagcaaaaattatttattgcattgcatgcatttacacttaattaaacaaataattttttttttgcataatatttttatggcaatgcactaaaatacggttaaaatagcagggataaaattattttaatttttggccaattgcattgctcacaaaaattaaaattgggattattttgccaggattctgctggacgacttcatccggctgttttccaaaattcacctttgttttttggaaccgcacgcgatttctgaagtgcgtgagatg

SEQ ID NO: 115979 - DNA, 197 bp, Heterodera glycines
  Promoter: Source sequence=SeqID_21887; Location=336..532; Strand=-; Gene=SeqID_52526
atagaaaatgattgtttatgataatttgattgttagtaaatttttgaaaaagcattatttaatagagaattaattctcctaataaacaagaaaactctcttttcttaattttaagatcgtttaggcaatttgggcttgaaaatttttttgttagaatctgttttggacataggcgtaaaatttcaggggcgcaaatg

SEQ ID NO: 115980 - DNA, 155 bp, Heterodera glycines
  misc_feature (21)..(21): n is a, c, g, or t
  Promoter: Source sequence=SeqID_19128; Location=1..155; Strand=+; Gene=SeqID_83870
atttttaaaatttaaaaattnttttacggaggtataaccgccccgggtgctccgtggggcctcatttgccttcgctacgaaattcgtacgattaaaaaaaaaaaatttatttttcattttaacggtacgtcttttaaatatttccaggcacaatg

SEQ ID NO: 115981 - DNA, 208 bp, Heterodera glycines
  Promoter: Source sequence=SeqID_11821; Location=27..234; Strand=+; Gene=SeqID_75321
atttataattattaaaaaataattgaataaaaatataaaataaatttaagtataagtacaatattttaaatatctaaatttttgttattattaattaaataatttaaatttacgcattaatatttaatattacttttattgtttttgaattctataattttctctatttacaaatcaaattctaaaatattgttctaatacagggatg

SEQ ID NO: 115982 - DNA, 439 bp, Heterodera glycines
  Promoter: Source sequence=SeqID_44479; Location=491..929; Strand=-; Gene=SeqID_71967
aggcacaccacgaggccgcgaagcggccgagtgagtaccttcggtgcaggaaaattattaaggaagagagttcattatttatttgttttttgcataattaatttataaatatttttttcagaaagggttctgaaacgcaccaaattttatttacatgttagtttaggcactctgatgctttttctatcaaattgggagatgaataaaatttttaaaaatttttaattcctttttaaacaggccaaaaagtttaggcttaactttttagtgaaaattcaatcactcatttttcgagtagtgatcagaagcgcaccagattttgcaggggcctaaaaaggtcaaggaaaggcgtctctgcgttgatttagcagtagtacctatgaatttaaattttctatgaatttttaaagtttttagaaatttttttaagtgcaaaatg

SEQ ID NO: 115983 - DNA, 742 bp, Heterodera glycines
  Promoter: Source sequence=SeqID_3952; Location=1416..2157; Strand=-; Gene=SeqID_52566
ttttgccgaacctttactaattgggcccgacctataagaaggtggtcaaataacactcccataagtaagcagaacagcaacaagttcgagtaccaccggcggatgtgtgtccttttatgactaccattcctatagttctattttttctctctccgttgacagtcgggttgatggatttatgctttttttttattcacaatttttttttgttttttaaaatttattacaatattatttatgaatatattcataaaaaagcactttttccatatgtcaaataataaattatggatttagcttttaatattcacaaattttctttaatcaaattctttttctttatttttacaaaattatttatgaatatattcataaaaagcattttttcacgtgtcaaataataaattatggattttgctttttagcattcacatttatcattataagtttatttattttttatttttataatttttccaataactgtaaggcatttgggcacccaaaatcggcaccgtcaacttcattttgtcttctttaaaaacagagaatgaaaaagtcgattttaaacttcgtttttatgaaagcattaaattctgttgttttttttactagtgaaatctttattctgagcgtatgccctttatccttctcatgagtaaagaattgaattttgaaaaacccggaccattcattgacccgggtaaaatccttttcacgcatcgctttaactttttagatg

SEQ ID NO: 115984 - DNA, 504 bp, Heterodera glycines
  Promoter: Source sequence=SeqID_2920; Location=477..980; Strand=+; Gene=SeqID_82344
atgtcaaaaataaaactcgagaaatttccgagttttcgggttgtttaggtctcagttttggtgccaattcttaattttggattcgaaaatcacgcgtttctctgtgaattcggttcggtattcaaaaaatttctcgaattttttggaccccggcctctagtccaggagaggtcatcttgttcacggggctcaatgaagcgacaatttcccaaattttctcgaatttttttggagtttttggattcgtgtttccggtcaattctcagtcccgttgctctcgatagttccctttttacgtaatattttatagagttcggacccgtatacgccgggttttcccgtatttttcgacgatacgagtttttacggactatggtttttacgggttattttagcccggtaagtccgtactccgtatacgtgccctaacacgtaaccttttccctaaccagtacactcgaacaatttgctaatattttgcatatatgtaggaagcgcatcatg

SEQ ID NO: 115985 - DNA, 337 bp, Heterodera glycines
  Promoter: Source sequence=SeqID_27937; Location=1..337; Strand=+; Gene=SeqID_58602
ggagagagaagatcggggattaggggggggggggaaattgtccgacaaaagtttggcacaagcctacaatgagaaaatttcggagggggggggggatccctatttattttattttttgctctttaccccaaagttttcccatgtaattttacatgagggtttttggcagatttgtggcccaaaaatgccaattttgggaaaaaatctaaggcgtaattaggggtaggggggggggcggtgccgtgccgaaaggcgccgtaatgggaaaatttaacaaattttgaaattcgtatgcgcatagattgccgaggttggcccagcagcgggtagtgccatg

SEQ ID NO: 115986 - DNA, 957 bp, Heterodera glycines
  misc_feature (41)..(41): n is a, c, g, or t
  misc_feature (90)..(90): n is a, c, g, or t
  misc_feature (138)..(138): n is a, c, g, or t
  Promoter: Source sequence=SeqID_30043; Location=817..1773; Strand=-; Gene=SeqID_60492
atgatgtaaattttcaaaattttcgagctaggccccctagnaatttcgggaaatttttttcgacgaaaaatgggggtgaaaaatattttnctgggtaaaataaggtgctgagtacgaatatgatgtctattttaattntcataatttttggaattttttaaaaattctttattttttggcaattttttggccctcgggattttgggctaatatttgaaaattcataactcagttcagatcaggtctattttggcgaattaaagctttaaaaatagcaaaaaatcgggaaaattttatgagatttatttgaaatttatagcacaaaaacaaaaaaagttattccagaaattctggaaattttcgatttttcagaaaaaaattcgtagctgccttctgaaaagctattcgggaaaagtaaaatactacaaaaatccgcaattttttgctctattaaataaattttatttggcatttttatcacttttttgcgaattgttataaaaataaaagtgattttgagattcgggaccaaaggggggtgaccaggatttttgagtggaaaattttttttaacaaaaatcttccaaaaacatgtcattagggctatttgagggtgctgatcacgaatacgtgatcagattttacttttgacatcgtcaagtcctcagaatccctgtgtgattggggattctgaggcatcatttttgggggggggggtcaaagttcgaatccggacggtgtaacattatttttctgtgcatttttacgttattttcaatgattttaattaatttaaaatattttgttgagttaataaataaaaaattatatttaaattaattttttttttgatgaatacattttataagtttaaattaattatttttttaattgatagaatttcatgtatttttttaaattaaatttgttaaaaaatattttcattttaatttaatg

SEQ ID NO: 115987 - DNA, 553 bp, Heterodera glycines
  Promoter: Source sequence=SeqID_18218; Location=207..759; Strand=+; Gene=SeqID_82815
aatttagaatttggaaagaatttaccagaaaaattacgcagtttgttttgtttatgacataaatatcaatctccacgaccgcgacaacattataaaattacattcattaatacacaatcagctccaagcaaaaaatttaacaattggcttaattttgcatggcgcaaatcagggttttatggtgatgagcctttcccagaattcattcacccagtaaaatattgttttgaagtgcccaaacacaatgacgaatgccaaaaattaaattgtgacaataacattttgctccgttgtgctttttgtgaaatttttttatgctttaaacatttttttaatgattatcatttatgtgaaaacgaataaatttaaaaataatctaaatgggaatcaattttcctcggccaaataatttgcataaagtgcaaaaataaatgggaaaaaatatttacataatgaaaggtcagaaaattgaaattggaaaaataagggtaataaaagtgtgaaattcccacccgggaaacattcttttggcaatcgacagtttttcaaaatg

SEQ ID NO: 115988 - DNA, 204 bp, Heterodera glycines
  Promoter: Source sequence=SeqID_16376; Location=1486..1689; Strand=+; Gene=SeqID_80766
atggcgaacaaattgaaggcaaaaaagaaacgaacgaactcggatcattcgtcgaatgagagcagcatttcgacaggaacgcgcagcagcaatcgatcgcaacgcgtatgttggcgatgcggtttgagacattcgtcgagcaattgtcgacatgaaacaaccgtttgtcgaaagtgcaagaagagtggccacttggaaaggatg

SEQ ID NO: 115989 - DNA, 204 bp, Heterodera glycines
  Promoter: Source sequence=SeqID_24115; Location=1988..2191; Strand=-; Gene=SeqID_54818
accccggaaaagggggggaattccttctttggatgagagttgcaataaaacgaattgatcgttttctggaaactgtggagatcggagtacttactttcgctcagagaaagagatcgtaacaaccaagctggagaaagtctcccaagagagggggatattgtcttggtcgaagaaggggaagccccactgtccatttgcctaatg

SEQ ID NO: 115990 - DNA, 271 bp, Heterodera glycines
  Promoter: Source sequence=SeqID_8732; Location=1..271; Strand=+; Gene= SeqID_69010
caatggccttaaatttgaatttgaagaataattagtaaaataaattttgaaataaaataaaggagcggagaacccgaatttaatattaattttgagccagttggatcccgaacccggattgagcaaaactcaaaattaaatttcgaatctcgcatttttgggagagatttgattcacccccaccgctaaacaattaccaataaatttaattaaataataaaaaaagggtcaatggcaactcgtacgaaaatcaacttatataccagggatg

SEQ ID NO: 115991 - DNA, 267 bp, Heterodera glycines
  misc_feature (125)..(125): n is a, c, g, or t
  Promoter: Source sequence=SeqID_11462; Location=1..267; Strand=+; Gene=SeqID_74861
ttttttttttgtttgcttcttttttagcaaaatttgttcattcctaagggggcaaaaaaaaactaataggataaaggagacgcagaaataattatttggattttttgatttaatgtccctaaatngtggaagaggatctggcccagaaatttttttgtcaaaatataaaagctggttgatcgaatttgatttcaaataattcattttacagattttgttgacacgaaaatgttgcaaaatttttgattaaattaagacaaaattatg

SEQ ID NO: 115992 - DNA, 1003 bp, Heterodera glycines
  Promoter: Source sequence=SeqID_8957; Location=4028..5030; Strand=-; Gene=SeqID_69808
acacgttctatataattaaaattaattatttaattattcactgagattttttgtggatcgcccacactgaatttttttgtggatcgcccacactgagtttttttgtggatagactcagcacggttatggtgcccaccaatttgacctctccaatttatctctgaattattttttttatttatttctccggcaaataaacttttataatttttatcttcggacataacagttattaagaaaagttttctttatttcgtttttggattgaaagtgcgaaggatatctttaaattgtgtttttatatgacatcataaaatatttcttattatacaccaaaaacaaaataccaaaagaaaacataaaaaaatatttttaaactttaaaattcacaaagaaaaaatactgaaaaataataaaactatgaaaaaaatgaaatgataaaatagtctaactaatgactttttaaacaaatcttaaattaatatttaataatactcaaaaaaggatatgtataagatattagcgcaaagaaaattattatatataaaatcacgacgcgcgtgagcgaatgaacattgcgagccgcgagtacatatatcaaaaatatgtgaaaaaatcaaagttattatatacgatgctttgttttcgcgtaagattatagaagaaacctcagtttaacagaattaataaattaataagcatgttcatgaaaaataattccaagtattacttaatataagagaaaaaaattaacttacgtcagaatgctatcaacgagacttatcaaggcaatacttttaaatatttttttaaaaaactcataaatatgtcataataacttaaaagtagagttgctcggtaccggtaccggtaccggtactggccggtaattaccggtttttaccggtaacggtaccggtaccggttttttcaaaaatcaaagtaccggtaccggtttgtctagtaccggtaccgccggtaaaaatttgcactggtaagaatg

SEQ ID NO: 115993 - DNA, 102 bp, Heterodera glycines
  Promoter: Source sequence=SeqID_45446; Location=1..102; Strand=+; Gene=SeqID_46820
tgccattcgccgggatggtcggcgagaagatcctcccttgttttgggggagggcaatttttaggggttcaatcactggctttccaactgattttcaggcatg

SEQ ID NO: 115994 - DNA, 338 bp, Heterodera glycines
  Promoter: Source sequence=SeqID_17550; Location=1..338; Strand=+; Gene=SeqID_82059
cgtcaataaactgaaagaaaaaagttaaaatttttgtttataaggcagcgtttgtgacaaaaccaacaaaaccattcattagtcaatcattgaaaagtcaacagattaattaattaacttgatgacgattatgtaatcgttaagtcatttcgaccatttaaaacgcacttttatcaccaattaattgttttattttctaaattaaattttaatttattttttttatttagtttattctttttattcctcctccttagttaatgagtttgttcttccgatttcgctatgccattctctttttggccactttttgcatggcttgcatttcgtccaatatg

SEQ ID NO: 115995 - DNA, 1003 bp, Heterodera glycines
  Promoter: Source sequence=SeqID_16260; Location=590..1592; Strand=-; Gene=SeqID_80643
aaaacccatcttaaaattggtaattttttacaaatttacggcataaagttgtaaaaaatttggtaattttcacaaactcattgccgaaaatttatttttttcaaaaattgagttgaaattttttttttcgatagtattttaattattgttttcaatttaaaaaattttcccgtttaaaaatagtaaaatatttggtgccgttttgggcttttgtgcccatttatgctcctcgaaatatttatatacctttcttttatttttatcttttacatatttcgatttttaagccaagaaatgaaaagaatgaatattattttaatactttgctgctgcttcctgggagttcacctcgcaaatccaaattcaaaggaaaccgaagaggaaaggtcgaattgggggggggggggggggaactccgtacagtgcaaatgtgaaagaataattgaagttaataatgtaaaaatttaattaattaattagaatataggcaattatgaactcataataattccaaaattttatttattggttcgagagtctcggtcccatgtcacgagacaagagccgatatttttccaaacccagggaatttgctatacattggggctgtattttctgcacaattaatgttgtctcttaattgccataatttaaaattttgtaaataatttcaatttcattttggcacatatttttaaaataataaataatatgattatcattccatattttcactattctgagttggtccttgcacaatttttgtttattgctgacatctttaagcagatcgattcttcgcttaaaagtgacaaggcttccatcacctgctgagtcattgacgaacaaagtttaggtgaatgatagcgacatcgatgcaaatttgacaaagttcttcaattagcttaatgacccatttaataagtctaacctttggcaagatacgtaaaagttctcaccggtggaccggcccaccattatcacttctcagtggctaaccatg

SEQ ID NO: 115996 - DNA, 736 bp, Heterodera glycines
  Promoter: Source sequence=SeqID_19329; Location=1..736; Strand=+; Gene=SeqID_84067
tgattaatagggatgcgatttttaggtaagaaaaatcccagaataggtacttaaataggtaaaaaaaaatctcaaaataggtattaaataggtacaaaaattccaaaataggtaccaaaataggtaaataaaaatttttattaacgattttttagtggaaaaaagcaaacaaagagggaaaattttggttctacatatctctttgtaaacgaaaatttaaatatattaatattttctttgataatattgacattttaaattaaaaattttgtcaatagaaaaaataaataaattttgggataaatttttgagaaatttttccaattcttagggtgcatttttgaaaatttttttggtcgattcttatgggtatattttttgattttattgcatttttgttaagaattttttgaaaatccttaaaataggtaaccaaaatgccgaaataggtacctaggtaataggagaaaaatcccgaaataggtaaaaataggtattataaaagtgggtgtaaatctccaaaccaagctaaaaactcgttttttatgcttatctcaacgttacaagtgcgcaaaaattttaggtatttaactaaatatcgcatccctactgattaatgtaattaaatttaaccgattttttcgatcactgtcatggtcatgatttttggcttttcttatttcttagtgtcacggcggacctaaaaacagaaagaaactaaatatttttcaaaatg

SEQ ID NO: 115997 - DNA, 292 bp, Heterodera glycines
  Promoter: Source sequence=SeqID_21310; Location=1..292; Strand=+; Gene=SeqID_51909
aaaaaaaaattccatgatgacgacttttggcaacgcaaggacccttcttttttttacgaaatttttatttaaaaatagatttaaaaaaattcggtctaacattaagcaaaaaagatcatcagaattccctccaatacaaaatcccggggaccgtccaaaagtgaacgagaaaattaaggcaatattttgcataaataaatataaccaaagagagttttttcaacatttataggcctcaaaataccagctgcagaacaaatttgccgcgatcagacagaagggagccaaaatg

SEQ ID NO: 115998 - DNA, 568 bp, Heterodera glycines
  Promoter: Source sequence=SeqID_31945; Location=1..568; Strand=+; Gene=SeqID_62265
aattcttaaccaagtaaaaggtgactcaaaaattttccggatctatttaaaagcatatttcgctttaaaaaattattcaacgattttcatcaaaaattttaccttttttcgcggcgcgttttttcaaaattttttaaaacatcggcgggggaggtccggcggtgccgataggcgccgccggggaaaatttttataattttaatgcaaattcttaacaaattttgtccaaaaaatgaccaaatttagcaatttgaggcaaaaatttctcaagaaaaataagattttaaggtccggcggtgccgataggcgccgccgggaaattttttgaaaatttcagtgcaatttattaacaaaatttgtaaaaaattgttaattttttgaaaaaaaattcaaaaaaaatttccgactttttatcaaaaatttcggaaatcggaagtcggaattccgacgtccaaaattttttcggaaatcggaattccgtgccatccctgctgtacaccgttcacatgaaccaaagccaataatatttacaaaaaagtttattattagggtggtcgaacttgacatg

SEQ ID NO: 115999 - DNA, 229 bp, Heterodera glycines
  Promoter: Source sequence=SeqID_12760; Location=1029..1257; Strand=-; Gene=SeqID_47081
ttggcgttttgttttttacgccaacgatttttttccgctttttttccttttttaccgtccatgaaagtgctttccgcaaaaaaattctttcggattaatgcattacataccaagaggaatcgaatgatatatcatttacatttgttagatttggtgaggtttaagtattcttgaattttatcacttatttgctttttgttgattaccttggcctatttttgcaaaaatg

SEQ ID NO: 116000 - DNA, 1003 bp, Heterodera glycines
  Promoter: Source sequence=SeqID_5415; Location=837..1839; Strand=+; Gene=SeqID_57948
aaaatttgcgattttgaggacccgagcaaataatggcaacgccacggtcattgcttggaacaaaaggagttgaagaaactgaagttcatgtcgtgcttttttgcagctgttgaaagagaccaaccaactcagtgaggaaatgcttcacttgcatttgcttcccattatcaccttttctcaaattaatagggccgcaataattaatgagttaactatttttttttttgctcaatggtttttgtgaaagatgcccaaaaaacacatttatgcactgaaaatttaattttttaggggctgacggcatttttttacaccacctataaaataaaaaaaatgtttcaaaaattgatcgcaaaaattttatatttttttcttgaaaaattttaaaatttaaaacttttcattaaacgaaaaaattataaaataatttatttaatgatcatttaaatgaccaaaattaagtttttggttaagtttttcatgttctgctcacggaaaatctttaataaaaaacattttaaatgccttttttcatgcttttttcaggattttcactggggtcccgcaaaatcccgcgcgggatcccgttccgcgccgcactttttatcaagaaaataaaatgaaattttggcgatcaatttttgagtaaaagtcaacgtagaagactcaaatcaagtggaaaatacgttttttatacttaatatgtataaactagtgcgcagaaaaacggcatctctaattattatcaatgaatatctaagttttctcgactgttgactgagcatggcattttatattacgcaaaaaaaaatatttcaattattaatagggctggcaatttaagtcacaattaaactccaaaaagtcgactaatttagagtcagcaaaaaagtaaattaacttaaattgcccctaaattatcaccattcatttaacaccagtaaagaaataaatgtctttttatttgacaattctaattttaaggttcgcatggccaaaaatg

SEQ ID NO: 116001 - DNA, 211 bp, Heterodera glycines
  Promoter: Source sequence=SeqID_29391; Location=478..688; Strand=+; Gene=SeqID_59889
ttttttggtcgggaaaggcagcaaaaaaacggcaagattgacgaattgatgtttccattaattaacaattcataattttcaataaaccctttcaccacagtgtgtagagaaatgggggactaattgtaatttaaccatattaagggcttaatggcacacaaaaccattctgatgggggcatctgaggtttttgaggcaatgttcaaacatg

SEQ ID NO: 116002 - DNA, 717 bp, Heterodera glycines
  Promoter: Source sequence=SeqID_2343; Location=3757..4473; Strand=+; Gene=SeqID_47265
tttcagttatctgattggcctccagttagtatcgcacggtgtctctttccgaaaacgattatcaaggagttggtttttattttaaatgaattccctgaatacaaagaaaaggacaaaaggggaaggactccgggttcctccctttgttttgattgatttttattcgaactttacctttcaatactaattagcgcagcatttatgggaaggacccaattttttttttggcttaaatcattttttatacacttttttggtttgaacctgttggaaattgagatgaattcaatgaagttttaatgttattttaagtttgccagattaaaattatttgtttctatcgactttcatttccacaccgtcctttaataatatattttgcattttatttgtggcgttgtcgctttcttttgaattatgaaaatggtgtgcaacaacatttgttacggaattttgatgaggagaaacggccagaaaatccgccttttgctttgctttggtttttgccgcatttcttcgcttaacacacagccgcccattctgagatggggcgtgttgtttagccatcaaataattctccctctccccaccattttattcccagtgatccgctttgcacttaaatatctgatcgatctttttcaccactgattttgctatttctcagttttgtttcatttttactcacttttatttttactaatttttcagcaaatg

SEQ ID NO: 116003 - DNA, 346 bp, Heterodera glycines
  Promoter: Source sequence=SeqID_18885; Location=1..346; Strand=+; Gene=SeqID_83590
ctcaatatacattttgagacgcaccaccattgggtgcaatggaaatacgtagaagctcactcattgctcttacgttgagggaaaacgcaatatacccctttgggttgcgtttgatccaagcgctacggctgcgctttagatttgcttttggcttagaggggatgaatcaccacaaataaatattatttcaaaacaaaattgatcggttaatcaatttttggtcgctttggcgacaataatagaaaaaactgagaatgaaattgttatgtcaaacataattataaatgaagacaatttgttacaattttcaaaatatagaaattgggaaaaaattattcgaacgatg

SEQ ID NO: 116004 - DNA, 520 bp, Heterodera glycines
  Promoter: Source sequence=SeqID_7022; Location=1981..2500; Strand=-; Gene=SeqID_63587
attcctcggaattcacttaaaactgttcggaaatttgtagcgacattacgtgattcagagaaaaacagcaaaaaacgacaaaaagaaagggcattttggagaaacaacgaacggaagaaatatgaagaattaaaattttaatttgtgcttccacctcgagagcagcagaacatatgaaagacattaagcgaaaagcgcatgggttggacgagattcactgggagaagagagcttaattgggcccattcagaaacattttggagaaatggagaacagagagtggccttatgaacggatttttaacaaaaaaatgaggaattcatcagtttgggaagagccaacaaattaacaaaattttaaatttatttgctcacaaatatttttatcggattcataaaaaattcgataggactcataaagcgcaatagagccgctttttccttttaccgtctgatgtacaataaaaaaggaataagaaaccccacccattcttcagtatttcccgttttcttttccaatg

SEQ ID NO: 116005 - DNA, 97 bp, Heterodera glycines
  misc_feature (27)..(27): n is a, c, g, or t
  misc_feature (35)..(36): n is a, c, g, or t
  misc_feature (50)..(50): n is a, c, g, or t
  Promoter: Source sequence=SeqID_3307; Location=2152..2248; Strand=-; Gene=SeqID_84154
gcactgtccgtagcgttgtgtttggcnttgtgtgnnccggccaatggacncacagcgactctgtgagtgacgtgttcaccacatatttggacacatg

SEQ ID NO: 116006 - DNA, 214 bp, Heterodera glycines
  misc_feature (111)..(111): n is a, c, g, or t
  Promoter: Source sequence=SeqID_23083; Location=1584..1797; Strand=-; Gene=SeqID_53787
tttttatataaaatctttatatatatatatctctttttattttatactttttatatttttgggtttacgcctctgaaaatattagttcgacttaatttcagctaatactcntaaaatataaaaaatctattttttgaaagtgagtgaatttcatctattatttcattacagaagagtgaacaaaatggtagtcttgatgttgcttaaagccatg

SEQ ID NO: 116007 - DNA, 94 bp, Heterodera glycines
  misc_feature (24)..(24): n is a, c, g, or t
  Promoter: Source sequence=SeqID_19137; Location=2034..2127; Strand=-; Gene=SeqID_83891
atttttgaaggaaaattgatctantttggggcatgtgactgtcaaaacaggaataagtccatcaccggaaaaggttaaggcaataaaagaaatg

SEQ ID NO: 116008 - DNA, 615 bp, Heterodera glycines
  Promoter: Source sequence=SeqID_1337; Location=1..615; Strand=+; Gene= SeqID_72850
attttcaaaaaaaacatttacttttggcatagtctctagttcggcgctttcataaacattcaaatattgttggcctatagagagcgctattactctgctattatattacgtttggccctgctcagtcaaacaaggatggttcgtccgacttttgctgactaggccaatcgtcctgtgggccaatggttttataagccattcgccctgtaggccattcgtcccaaagtccaattaaaggacaatcgccgccgtgtaggccaatcgtcttataggccaattgtcctgcaggtcatttgttatgtaggccaatcgtcccctaggccattaaaggacaattgcagtgtaggccaatcgtcccttaggccattaaaggacaattgcagtgtaggccaatcgtcccttaggccattaaaggacaattgcagtgtaggccaatcgtcccgtaggccatttgtcgggcagtagccaaaaactgtttggatgttgtcgaactgccaaacaagcctaatgaaagagcatctgttaataattaaaactcaaatttagcatcattcaattatttgttttgatttttaaggcacaataaatcgacgtcaatcttcaaaataaaaaatg

SEQ ID NO: 116009 - DNA, 188 bp, Heterodera glycines
  Promoter: Source sequence=SeqID_7839; Location=1390..1577; Strand=-; Gene=SeqID_66131
tattggtgatcagcgaccctcaaaaccccatgcccaaaattagtggcataaaataaacccaaaaaaacagaacggccagactaagctgacccggtccgacctaatttgtagacaattcattatccaatgtttttgatcatgttttgattcgagattgtaaaaacattcatttttagcgattaaaaatg

SEQ ID NO: 116010 - DNA, 687 bp, Heterodera glycines
  Promoter: Source sequence=SeqID_1027; Location=2305..2991; Strand=-; Gene=SeqID_46505
ctcggctctcgctcgcgatttacctgcccgctcacctgactccttatcgagagaatgctcccgattaaatagttggacttatggaacggaataaagatggggaaaagcggggataaatggtgtgagaaagagattgaacggatgtgataactcgcaaattccttcccccccccccctttccttttccaaattttcgccctttccttttccaaatttcgttgcgctttctcttttccatcagggattcctcttcttctctgttttttcacaagcctcccatccattcgtcttgcgcactgactctgaccagccccccccccaaataacaacaatttctcatcgattctttccgtccatcgttatcgccgcaactgggtcttttagttggcgtcgcaactgcctccaccagtcgccccccccctaagtaacagcaatttttcattgattcttttccgcccatcgccgttatttccgcaactttggatggcgttgaatttgaaaaaaattattcattcgttttatgcgattaaagattttaccaaatttaatatttaattcttttaatttttttacttatattcaaataaaatttaaatcccgaatcccataataaaaattaggaatattttctgtcatgtgagtcctttttcaaaattatttaattttttcattcagtatttacaaatg

SEQ ID NO: 116011 - DNA, 784 bp, Heterodera glycines
  Promoter: Source sequence=SeqID_6737; Location=1166..1949; Strand=-; Gene=SeqID_46302
tttgaaaggacggccaaaagaaagagctgaaaagcattaaaaacaaaactattgaattacaaatttcaaatttgccatctctgagaaaaatacgacgcatagacaaaaaattgccattttaaaatattttaaattaaaaaatcggaacattttgtgtctttcattagtttctgttgtatgtatatgtttcatgtactttaaatatatcggcccattctttgtactgaaacaacatctctccaccgctcaatgcaaaagttgctgaacgcaaacaccccaacccgaacacttttatgttttgtatttgttcgtgtcttaatttgtcgctccctccaactcttccgattttgtcctcccttttttctgagtttaccttctaatcagcaactcccttccaattttcctctccaatccgatcatccaatttgggtctttctctctttcctccctcttttccctgctcttttcagtcgccccatcgtccgtccttccccccccccccccctcgtcattcacttaacatttcatttatgtcattgtatcgaccgatcgtttcgctgttatctcgttcaatctctcctcatccttctcttccttccgtttctttctcctccgcacttttgttcacttcatttcgtgacttctcctccgaatttcaacggcataccgaaggtgcgctcctttattggtacctaatttccgaatttgttttgagttggactcacacaattttcttcataaatactttcaacatatttcagcctgtcccaacaacccaaaaatg

SEQ ID NO: 116012 - DNA, 103 bp, Heterodera glycines
  Promoter: Source sequence=SeqID_11426; Location=1215..1317; Strand=-; Gene=SeqID_74818
attcgtcggtttgctgctctaccgaatgttgttcaacaacaaacatcccatggacaattgggagccaaagcgccgtttggacatggaatttatggcaaagatg

SEQ ID NO: 116013 - DNA, 554 bp, Heterodera glycines
  Promoter: Source sequence=SeqID_9740; Location=1769..2322; Strand=+; Gene=SeqID_72545
gcatgtttttggcaaagaaagctattgaaaaagggggacgggacgaaatctcgccgccggaatctcgccggccgaaatctcgccgagacaaaatctcgccgccgaaatctcgccggctgaaatctcgccggccgaaatctcgccgcagaaatttcaaaaaaaaaaaattcaaacttagaaatttttcaaggaaaaaattttagaaaatttttttataagaaaattccaaaaaaaactatttgctaagtttttttgaaattttttcaaaaaaaaaacagtaaattttcataaaatttctaaaaaaaattgctgaaaaatttttcaacaatttttttatttaaattttcttataaaaaaaattttctaagaattttttccttgaagaatttctaagtttgaattattttttttttgaaatttctgcggcgagattccggcggcgagattttggggtgcaccccttgaagtgtgcactgccgggtaaaaacgtctttccgtccattttcattgcattccattcttccatccatgcccaaatttgcccccttcagatg

SEQ ID NO: 116014 - DNA, 1003 bp, Heterodera glycines
  Promoter: Source sequence=SeqID_4406; Location=888..1890; Strand=+; Gene=SeqID_45798
gattattgtcgttccgttgctccaaattattcgctgtttgctgtccgaacggcaaaaaagcactgagcagaacgaacagtcgtctgttgagaacaataaaacataatcattcagagataaatgatacgaaatcaaatattttattctcccgtgcatttcgtctcaaaaatattgtaaaaacgcaattttcatctccaattttgcttcgaaaacaaatcggcaattgtatcattaacgtctagagattgaaaatttgctgcttatgcttaacaaattgttacacgaatcctttttcatttcaaacagaattttccgctttctttgtgtttatataaatcctcattttttaattctatcatttggtcaattttctgtacctaatccctgccgatggatttgtatctgcattttcgttgtcgttgtttctgttgccattggctgctccccgaaaagcgaccagcagttgtcccattaaaattcgttccgttttaattattaatttgttgtttatgcgataatcgaaatgggaggaacagaaaacgcataaccacgaaaaatgcgaaggaatgagtcgcagcagcgaccgacgaagggcagccggttcttccgatcagcctgatcaatctccacctacactcttttattcaaagatgtgctacttctacatatgtaatgttgctgttctgttcaattttttgaacatttagaacacaacgtcagaaaacatttaagcataaataattaaattctatttgattttaaagaaagccgaatcccggacaaaggcttccctaatttggatggaaacccataagtttctcgttgtttttcattatacctacaaaatatgtgcatcctttaacatgacaaattcaccaaggtagaaaattccaataattcaaatttaaattcgtttaaccaaatttagttcctttgtaattcgattaataatgttcttacatttaaaggggaaagcatcacatattattaaacataaaaaatg

SEQ ID NO: 116015 - DNA, 421 bp, Heterodera glycines
  Promoter: Source sequence=SeqID_40930; Location=607..1027; Strand=-; Gene=SeqID_69152
atttgggtagcatttgaagtattgtaaatgatgtccaattttttttttttttgttattcgacgccaaagttgaaaatgcttttaattgagtgtcaatttatggaacataatgcatttttgcttccaaaaaagcgggtgcatctcatttccacagccccccccccctcccccttctgtcgtccttccgagaaaattttaaaatttaataatagaatttttcaaaaaaatctagtaataaaaattttttagccagaaaaatatagtatctttaaaattttgaaaaacgctgaaaataatttttaaattgcaaatacagtttccggtttacagtttgcgagtttgtcttgtttagatggaaattttctcgagtgattggaaaacgaccgactttgaaaaattgtctaattgattctcccctatg

SEQ ID NO: 116016 - DNA, 933 bp, Heterodera glycines
  Promoter: Source sequence=SeqID_781; Location=4945..5877; Strand=+; Gene=SeqID_61116
tttggcgctgactgctttttgagcgatatttagagcgaaagtggcgtaagaagtcagcatttttcaacatcagcgggctaacattcatattatgtttaactgtacgtcttcttccttttacatgcttcattttgcaacataaaccaatggggggagcccgccctgctctccatatatattcgtttttaggcgcagcaattccggactctcggggtgcatgtcaatcaataggtagccaaactgcttttcggttgcatctcggtatgcttccgtgaaatagttgtttttcgttggaaatagctgcgaggcgagtgtgcgcacttggagcgcccctgccgggttacgcatcagcaccagatagtgcgagttgttgcgcgcaacccgtagttctttcgcgaacaaatgttgagtgaccaacacaacgctaaccccccaattgtgcgatccccgggtgaacacagtgtcaagaaattgttgccccataccaaccatgagatcatccagcaccatcagcagttttccatcactctcttttgcgcgccggttaacctgctcttcggttgggcttccagcatgtacaacaaccctacagccgccgatgtgtccacttttctgtagctgtattatatttgggttcaactccccataacaatagaaaatctcggagatgggttccgaaactagcgcattcacattcctcagcattcgcagcacccattccgattttccactccccgtgctccccgagattgtcagcgtgaacgggtgtctgaattgcaaatgtttttcatcaaatttttgaaaattgtcagccatttgtttaatttcataaattgtttcaaaatacctacattttctattttatatatacatataataaaaaataagtgtgtgtgtgtttagatcattcttaaattgttcaaacaccaaatg

SEQ ID NO: 116017 - DNA, 117 bp, Heterodera glycines
  Promoter: Source sequence=SeqID_44898; Location=785..901; Strand=-; Gene=SeqID_72300
aaacaattttatggagctaatgataactcatgtccaaaaacgaggccccagcccattctgacttattttctaaattgaattcgcaaattccatattttcagtatgatccggaaaatg

SEQ ID NO: 116018 - DNA, 93 bp, Heterodera glycines
  Promoter: Source sequence=SeqID_14646; Location=2260..2352; Strand=-; Gene=SeqID_78742
attatggcgactcaatttccttttcaaattaattatcaaaattgtcgttaattttttcaaatatagcaatgttttctgtcattttgttagatg

SEQ ID NO: 116019 - DNA, 617 bp, Heterodera glycines
  Promoter: Source sequence=SeqID_24362; Location=521..1137; Strand=-; Gene=SeqID_55085
taattgcggacctcaaaagccgcgcaatttcagcaatccctaattttaaaataaaaagttatcaattttcaaaaatttatgaattgcaaattgacaccaaaaatgaataatttcgtggttttttaagtttttctaagacgtaaaaaggttttaaatttcttagtcaaaaaagtgaagataaactacaagtttagccactggatggcttgagcttttttcgaaaattacattttattttttaaaaacataaaatttggccatctatttttattattttctgtcacaaatgtatcgaaaatttttttatttttttaacactcacgccgtaaaaagcctctgagtgcactttcgttctgaaagtcacttgtgtggacagccaagtcacggcggtgaccgctggttgcaacgcacttgtgcgacttccaacagcaaaaggcaattatctgatcacatcacatcatcaatcactcacttatcaagccaatccgttgtggtttctgaccgaagctaagcaaaatacttattttgactcaaacaaaaacatttccaaatcaaatcactctctcctctcattcatttcacttaaaatctgagaaatttttcatcacgatcaaatg

SEQ ID NO: 116020 - DNA, 198 bp, Heterodera glycines
  Promoter: Source sequence=SeqID_42789; Location=1..198; Strand=+; Gene=SeqID_70595
ggaaaaaacaatttctggaagaaattaggacgggtgagaaatccgggaataaattcttccgggggattccgggaagaaacgcaccggaagaaggaaaagccaaaattgccaccggaagaaacccagccgaagaaggaaaaggcaattttggaaaaaatacgctcggtggcaaagccggaaaagatacattgaaagatg

SEQ ID NO: 116021 - DNA, 239 bp, Heterodera glycines
  Promoter: Source sequence=SeqID_10552; Location=2608..2846; Strand=-; Gene=SeqID_73789
aaattaaaattaacttttaaaaaaatataaattaacaccaaaaattaagggccgttatgaagaattccggggggatatttgaaaggtgccaagaatatggaaaataatttaataaaaggtatagagaaaaaatatgattttaaaagcattatattttttttaaataaaaaaataatttaaataaaatataataaattgaagaataatttaattttgaaattaaaattggatgccttatg

SEQ ID NO: 116022 - DNA, 110 bp, Heterodera glycines
  Promoter: Source sequence=SeqID_44342; Location=922..1031; Strand=+; Gene=SeqID_71842
tcaatacttttttttccacctatatacattaaacaatttaaatacttaaatatttttaattacgggcgccaatccaggaattattttcttagtcgccgtagaaaacaatg

SEQ ID NO: 116023 - DNA, 941 bp, Heterodera glycines
  Promoter: Source sequence=SeqID_17630; Location=1..941; Strand=+; Gene=SeqID_82157
tcaaaaagggcgttatataaaaaaccatcaaatgaaaaatttcaacctaaaactgtccataactcttgtcaaagtcaacagaattaaacattcttggtatcatgcgatatccctaacatttctctattagctcatctaaatttcaaaaaatttggtcaaggttgagcaaagttatggccaaaagtacacaagcaaccaggttttcaaaaatttttggccataacttttttaaacctaacgaaatttttttaaattttgcagggtaatagaggacacatagggttaccgaataatagcaataaaataaaaaatgaaaataatttctaactaaaattttttaataaaaataaaattattttgatcatcaaaaattctgatcaaaactttcttacaacaaacaaaataagatgatcttgatattattcgatagctctctatgtgtcctcaattagcctgcaaaatttcaaaaaattttgttaggtttcaaaaaaggtatggccaaaaatgtctgaaaacctggtaccttgtgtactttttgccataactttgctctaacttgaccaaatttttcgaaatttaggtgagctaataaagaattttagggctatcgaatgatactgagaatgtctaattagattgactttgacaaaagttatgggcagttttttgttgaaaattttcatttggtggtttttttataacgtcctttttgatggcttttttataacggctcagcaccgatacgatttttaggttttagcttattttttcatgagctccccgtggcctgaaacgcacgaaaaataagttttttttggtggttgttaagctacttgtcgagttattcgagcctattttctaggtctttatttttagagcttaaaacctaaaaaatttttgaaaaaagctatttgacctattttggcgtgacggaggggatg

SEQ ID NO: 116024 - DNA, 282 bp, Heterodera glycines
  Promoter: Source sequence=SeqID_7789; Location=1108..1389; Strand=-; Gene=SeqID_65963
aaaaattcttttgtttttttaatttagttgttacagaaaataaaagttgctgaagttataaaaaaaaatcagacaaaacttgtgtttttttcttgaattttctaaaatcttattattttttttgtggtgaatacctatatcccagtattgtctcggcgaccttttttcgacaaattttgatttccaaaaattggcaaaaatggtttaccagtattgtatgaaactaattttggctatttgctagtattgatcatttattctacccccttttcagccgccatg

SEQ ID NO: 116025 - DNA, 556 bp, Heterodera glycines
  Promoter: Source sequence=SeqID_9376; Location=5177..5732; Strand=+; Gene=SeqID_71167
aagagcagtgggtggtcagtgagagagagagagagagaaaaagcaaaaaaaaaaaatgccaaggaaattggagaaaggacagaaacaacaaatggggggatacggtagacagtgttgaaaggatgatacggtaaatggagaggggagaggtactctgtacagatgtattgggatgtggtgtaagggctgtgcgaagctgaaatttaccgagacaagattaacaagaatagagcttaaatattcggaaaatacagtaactggctcggtaattttacggtacagaacaaaaaattacagtatgttttaaaagtttaaattgtaaaacggcggaaatttgatttgactcctgagaaagttgatgtttaagctttcgcatagcccatgaaaattggaaaatatgtaatgacgatggcaattgtttaaaatgggaataaatattattaataaaatttaatgccattggacacgtaatgccaagctttttttatctgtgccaattttgatttcaaatggcacccgttttgattttcccacagctaaatttgacaaaaaaatg

SEQ ID NO: 116026 - DNA, 137 bp, Heterodera glycines
  misc_feature (122)..(122): n is a, c, g, or t
  Promoter: Source sequence=SeqID_33804; Location=839..975; Strand=-; Gene=SeqID_63752
tcagcgtgttgaacggaagcgacaaatcttcaaagctggatttgaaggaggcggatcttcacctaaatgttgacgataaagccaaggaatgcctgaccatttgcacgcataaaggcttatancaatttacgcgtatg

SEQ ID NO: 116027 - DNA, 312 bp, Heterodera glycines
  Promoter: Source sequence=SeqID_12861; Location=1..312; Strand=+; Gene=SeqID_76589
aaaaaacttcacaactcggaaacggtattccgaggctccaaaaaatatcggaagccataggccggaattccgagaccaaatgaagtcggagttttaataataaaagaaattagaattaaaaaaactttaaaatttaaataattttactaaaataaaacaaatgaatgtgtttcattttcacagatttacataggttttatcgcaaaaaataaaaatttccacaaagaccaatgtatagccatcaaaatttttaaccaagacgcaaaatttttttatgatattagcgtacaaattaaattattgaatccaatg

SEQ ID NO: 116028 - DNA, 244 bp, Heterodera glycines
  Promoter: Source sequence=SeqID_28287; Location=1310..1553; Strand=-; Gene=SeqID_58912
aattacatttttaattgaatttagtaagattctaattaactgtaaaagttataattttcgatgggttttatagtaagtttaaggacagtcattatttgtgtattttttgtacaattattatactttttttgatagaccgtgtaaaagaatgattcgaattggatttgagttttcatctgttggttaacccatttatttaaatatcaaatgcttaaaaatatattttcttaatctttaaaagatg

SEQ ID NO: 116029 - DNA, 371 bp, Heterodera glycines
  Promoter: Source sequence=SeqID_45041; Location=1..371; Strand=+; Gene=SeqID_72432
tgatattgtatattacagtacttctatgtttttttatctccgagtaatgttactgtattttacactatgtctatgctttatatgtccgcgtctgggttttacaatacgtctaagttatatatgtccgagtgaagttactgtattttacagtaattcttggtttctatgtgagagtcattttgtctatttatcaaattcatgcagatttaaatgctttttaccttctatgtgacatcagttgttctcataaaaatacacctttaattacagtacagtaatgcccaggttactgtaccgaaattacttgacccaatgattttctcctctaattgatcctccccatcttccttcccctatatcaaggtgccatg

SEQ ID NO: 116030 - DNA, 307 bp, Heterodera glycines
  Promoter: Source sequence=SeqID_16973; Location=1219..1525; Strand=-; Gene=SeqID_81398
atctcacgtccattgtacttttctactgaaagaaagaaaagaaaatattctcaacattaaaaaaatccttgggacgcgtaaaagtcaatgggacgcgtattctcactagaaacccccgagaatttaaaacaaaaaatctaccccctccccctaattttcagtgaatttcctcatcgaacatggagccgaccttcagcatgttgacgtggagggacacaacgctttgatgtgggcagtgatcaaagggaagacggaagtggcgcggcatttggtggccatcggcgcgggcattcaccaacggaacatg

SEQ ID NO: 116031 - DNA, 570 bp, Heterodera glycines
  Promoter: Source sequence=SeqID_4056; Location=2490..3059; Strand=+; Gene=SeqID_45711
tgatgatagtttaaagaacctcacttggtctgtaggccatttttggatgagttttttgtaagttgtaggtcgattgatgaaaaccgaaagagtaatttgggatggatatacagcacaactgaaaaggccaaagaaactaaggaatacagagattatatttttaatttatgttagaaaatgcttaaggtattttatgagaagatgaagcaattccattaagaattttgcaaaatttttcctcgtttaataaagtccacgtgaaacaacaaaacgccatatattttaaaattacaaaaatcttcgacttgaatttctaggtgggatttcggaatttaggtaactctttctcggcatttttcctgaccttaccgggtattacccaaacaataataagatggggttttggcagatttttgaaataaagaaaatctataaaggtgtttttatgaaagtttgagtctgggacctatgattgatatttttacccgacataagttcaaaatcctcgttttattactagttttctgttttcctttcatttaaatttatttagaatttccatttataatg

SEQ ID NO: 116032 - DNA, 1003 bp, Heterodera glycines
  Promoter: Source sequence=SeqID_6496; Location=694..1696; Strand=-; Gene=SeqID_61791
actgtctgtgccgtgccggtttaccggttccctctgccggcacgcatgctctcggacgcctagctggttatgttgaaaaattgttttgaaggtttttgcctatcaattggataatattggtatcattcaaaagctcttgatagaggggccgggccgttttcgtacgagaggatattcaaaaaataaataaaacaattgcatttaaattatacatattactaatgtttaattatgctttttaatgttttgaccaaattaggttttgataattactaaaatgaaccaacagcaagtaattaaaacaaaacgaaacaatgagaagttggagcatgacggtgcacaatctaagtttggtgtcgtattttcaaagagtcttttcagctttatctttttcttttcttttttcgggtttctattagttttttgacaccttttaccttttcataatcataaataaaaaataataaataattttttcatccatcaaattataattcatccgtaattttcatcttttctgctcataattatgtcaacaaattcaacgaatcagcagaaggtaaaaattaaatgaaacaaaacaaaacaattcccccatttcacaaccaaaaaggaggttgcttttgttccaccaattgaagccgttttaattggcctaaatgcgttcatttgctttattggaattgcactaaacgcgtcgcttgtccatgtgactgtgaaaagaaagtgctgatatttcgatatttcataatttaataattcattaacctaaattaataaaattgcaatttcttgggcttttttttaatttgactggatttcctaatataaattatttaattttgttatcaatttgctgatcaggactctccattcccaatgcaacattctgatcgctttgtatgctttcttagccattttcctcctcggcggattgtgtgttaaatttttcatctttcttttcggcatcaattacatcacacttgaacattgctactacatg

SEQ ID NO: 116033 - DNA, 460 bp, Heterodera glycines
  Promoter: Source sequence=SeqID_42069; Location=1..460; Strand=+; Gene=SeqID_70063
ttttgattttaaaaatttttgtttaaccccttactctaaatggccattttttgctggggaaatccccaatttttgctggggtagcgaaaatgccatcggtcacatggaaatgcgatgaaaggggcgaaagaatgagaggaaagagagagagaggaggaggaggggggggggggggtcacaattaaaatacgattaaaaaaagttgggataaatatttattatataagggaaagatgaggaatttaataaattaatttaaaaatgcacatttatttcaatgggataaatttggaagggatatttttgaaatgaaacggagccaatgaatggacagagagagggggggcggggcgggggatttaacggagagcacaaagtccattaaaaagcaaaaaaagagcccgccaattttcgctaattttattttgcacaatttctgttcatttaaattttgcagatg

SEQ ID NO: 116034 - DNA, 397 bp, Heterodera glycines
  Promoter: Source sequence=SeqID_17881; Location=310..706; Strand=+; Gene=SeqID_82427
aataatagtttctttcaaaacacttttcaggcaaagtttactgtcctcaactctcatgggccgacacgttggacgactttgaccaatgtcgtgcaaaaaatttacgtacttttgcaaccattatgtgaatatttcaaggaagatggacctttaattctacgcaattttttttatcacaaacatctgaagttattatcaattttctcaatcacgttttaccaatattttccaaatcaattgatgcacttcaggtggcttttgtgttttgatttaaaattaaacaacaaaaacaacaaaaccaccttgcaacagaaatttattaatgagcatccaattaaaaaacggttgtgtttcattataaaaatatttatggctattttttaagaagaacaaaatg

SEQ ID NO: 116035 - DNA, 81 bp, Heterodera glycines
  Promoter: Source sequence=SeqID_12018; Location=1269..1349; Strand=-; Gene=SeqID_75544
tttcccactcgggttaatgatttgtttcttttagtgaattttttaattttgtaaattaatatatttttattttcagtgatg

SEQ ID NO: 116036 - DNA, 247 bp, Heterodera glycines
  Promoter: Source sequence=SeqID_8990; Location=3002..3248; Strand=-; Gene=SeqID_69928
ttttgggttggtggcattttgggtggtgctgttttgtagtgctgctcgagagtctcggtctcgagtctcgactccagaaaagtctcgggtttttttggtctcggtctcgaatctcggtctcggcttttcagtctcggtctcggtcttcgagaccgagacttttttacacacataatgattggctttttgtaaagttaaaaaataaatatacttttagtaacttttttgctttatttccttagtaatg

SEQ ID NO: 116037 - DNA, 739 bp, Heterodera glycines
  Promoter: Source sequence=SeqID_4259; Location=2033..2771; Strand=-; Gene=SeqID_53790
gttgattttgcctgaaggaaaccgagacgatgttgataatcttacatttgggttggattctttggaaattatttttgttaaggatttgcatgaagcagtttgtaaatgtattaatgtttgaataaaaaatcgtcttccctaaatgtttaattttcatcaaatctgtctaccgtatttcctcgattataagccccggggcttctattgttcaacccccctccaaagggggcttatattcgagggggggcttccaatcgaggggggggggcttttattgttcaacccctttccctatataaattcttaaaattttttgctttctgcataatggtacaatttaaatcttaatctaaatttttgaattgaaaagatttttcattttttggcccttggaaatttaggcgaatgtttgaaaattcataattcacttctaaatgaatcaattaaagtgcaaaaaagcattaaaaatagagaaaaatctggagcattttatacttttttagaattttctatcttcaaaatgaagaagttattacataaattttggaaaaattcgttttttgagaaaaaaaaattaatagcgctgttctgaaaaggttttttgaacaacacgaaattcttcctctataagcttctgtttattctatatttttataagacttttgaaaaaaagtacaaaaataaactgattttggaattcgggatcatagatggaagcaaagcgattttttgggccatg

SEQ ID NO: 116038 - DNA, 317 bp, Heterodera glycines
  misc_feature (25)..(26): n is a, c, g, or t
  misc_feature (56)..(56): n is a, c, g, or t
  Promoter: Source sequence=SeqID_7340; Location=1334..1650; Strand=-; Gene=SeqID_64519
tgactcatttaaataaaaaattcannataataatagtgaatttattagattagcantaaaatataattagtgaaaattattcatttattatataaattgataataattcaaattaaataaaatacaaattcttaagaaaataatagaaaattaaatgttttattttaaaaacaaaaataattagaatgtaatttattaattaatatgtaaaaaatgagaatcgacaagctcatagaaattcaattgaagaaaatttgaattttttagttgtattttaacttaatgagttggcaatgcccgtggacatgtaaccgatg

SEQ ID NO: 116039 - DNA, 93 bp, Heterodera glycines
  Promoter: Source sequence=SeqID_18361; Location=2729..2821; Strand=-; Gene=SeqID_82959
aactattagacaaaaggaaaagatgatgaacgagggtttcctgtacattttcgacaaatctaatgtagacatcagcatgaaattctggcgatg

SEQ ID NO: 116040 - DNA, 216 bp, Heterodera glycines
  Promoter: Source sequence=SeqID_25494; Location=151..366; Strand=+; Gene=SeqID_56232
tttttatgctcacaaattgaaagataaattttatttttcataaactacataatataaaattatgcataatttacagcttcctaataaaaatatttaatgtgatcgatctattgactgctcgattaaaaacaaaattgatgatcaatttaaattaatacaaaaaaataatggacaatatcatttaaaaatattttcatattttatttttaaaaaatg

SEQ ID NO: 116041 - DNA, 257 bp, Heterodera glycines
  Promoter: Source sequence=SeqID_5127; Location=5348..5604; Strand=+; Gene=SeqID_57010
ggtttctgtttgcattaatttggaattgctatgcttgtagttttagtagtagtgagtgaaggttttttcattttgtgttttattttatttatttattttggtccctgaatacaaatgttaattttcatgttggaccgaaatccgcgaaagattagccccctttcttgactattttctgttcacgcatttattccaaatttttcggcgcttcaattagatagttgtaagtgcaataatgccccgtttttagtcggatg

SEQ ID NO: 116042 - DNA, 409 bp, Heterodera glycines
  Promoter: Source sequence=SeqID_8820; Location=1..409; Strand=+; Gene= SeqID_69322
aaggttatcatgacaacttatacacaggcaactcgaacaatggcttatggttagactagtcataagcttaggcttttgtaaatttttttcttatattagttgaatttctgttgacatcattaagtgtgcttagagttgcttttgcacatttcgatgatcaaagtatacaaacaagaacaattagactattcggaaggtataaaattttccgattaacggttcgaaaaacattttttgacgcgtaaaatatgatgggacgcgtaaagtgtgatgggacgcgtaaaatgtgatgggacgcgtaaaatgtcatgggacggcgtaaaaagcgacttagaaaccccaaattttgcttttttaagtgacaaattatcattttaattttaccaaatttaacaatcgaaaagcaatg

SEQ ID NO: 116043 - DNA, 125 bp, Heterodera glycines
  Promoter: Source sequence=SeqID_9740; Location=1512..1636; Strand=-; Gene=SeqID_72546
ggtagagaagaagtacaaaactgaccaaaggaaggccaaaattaagcggaaaggcattgattctggacagactgttggcttatttgcacaaaaagggccatcgtgtccttattttcacgcaaatg

SEQ ID NO: 116044 - DNA, 105 bp, Heterodera glycines
  Promoter: Source sequence=SeqID_19200; Location=1060..1164; Strand=-; Gene=SeqID_83945
tcgctaaacatcaccgcaacacagaataaaactacaaagtgccaagctcagacctgtccattcggtggtgtaccttattttcataatttgtgaatcattaaaatg

SEQ ID NO: 116045 - DNA, 423 bp, Heterodera glycines
  misc_feature (21)..(21): n is a, c, g, or t
  misc_feature (31)..(31): n is a, c, g, or t
  misc_feature (109)..(109): n is a, c, g, or t
  Promoter: Source sequence=SeqID_22351; Location=1024..1446; Strand=-; Gene=SeqID_53025
aattttgacttaaaattgtgnaaataatttncagaaagtgaatcttgcaaaaaataatgaatagcagcttaatcaaaagctaattggaaaataaaaataatacatcttntaatttagaattgtcccataaatttttgttttttaaaataataatatgaaatttgcccatacggtaccaaggggttttgcgaaatttagccatacggtaagaaaaattattatgatttgagtaatagaaaacgccaatagcgaaaaaagtgtaattttgaacttaaaattgatgaaataaatttcagaaagtgaatcctgcaaaaaataatgaatagcagcttaatcaaaagataattggaaaataaaaataatacatcttttaatttataattgtcccataaatttttgtaaaattttttaaataataatatg

SEQ ID NO: 116046 - DNA, 114 bp, Heterodera glycines
  Promoter: Source sequence=SeqID_28668; Location=840..953; Strand=-; Gene=SeqID_59257
catactcatatccacgccacttgcacttaataaatgaattttttgaaaaatattagccgtattctgaaaacgcgcacagggttattggtcatactgcaccaagcactgaatatg

SEQ ID NO: 116047 - DNA, 512 bp, Heterodera glycines
  Promoter: Source sequence=SeqID_11757; Location=2193..2704; Strand=+; Gene=SeqID_75256
ttttgtggcataaattgagtgtaatcaaaaaaaaagtgtcaacaatttgtcaggccaagcggagaaagcgcgattaagattgcccagaatgtccttcttgctgcccgccggggccgaggaaccggcggcggaataagtgtaggacgccatttgttgtaataatttggaatggaatcgaataataatcacacaatgatgtatttctgaatattcggtcaattacactatgtatttaatgtctcatattttcaaatgaacgaaatggggttttttgaaccggctaaaaactacaattttttctcattaacattcaacggacatttggtaggcatgaaaaagatatagcacgggaaaagcgaataaatgagaaaggttaattgtttagattcaaaaacccctattggggcattgtaaaattaaatataaaaataaagatgaaaaaataaatgtgaaatatgttcaagtaatttttataaaaaatagagattatgatgatattttagccaggtatg

SEQ ID NO: 116048 - DNA, 1003 bp, Heterodera glycines
  Promoter: Source sequence=SeqID_7751; Location=216..1218; Strand=-; Gene=SeqID_65825
aaccagaatttcttgaaataattttatatttatgatattaatcatttttcggatcaaaaatatgactatcattgtctttggtccaattatttgctgataaaataatgtatcacttatttacattaaaatgaaaggtcttataaacttataaagaattaaaatttttattattctcaatacataccaaaacttgttggtgcacagctagtaaaataaaaccaattattaattttattaaattcatgcatgcaaaacgcgttaaaacttgacttaaaatgcaatttttatattccgcacacgaaaaaagctaatattcgtatctattcttgcgattttagcagttttaaataatgttacatttataaagtaaaattgcctattacttttatttattttgtttccgaatttagcaaccagaatttcttgaaataattttatatttatgatattaatcatttttcggatcaaaaatatgactatcattgtctttggtccaattatttgcttataaaataatgtatcacttatttacattaaaatgaaaggtcttataaacttataactagcgggtgttgcatgcgagggtggcgctggggaaagcgcttcgcgcttcttgagcttcgctacctagattagctatctggttgtgaagagattttgaatttttaaagaatttcagtgatttttaggccgcttcgcggcctcgaacgggcgcttcgcgcccgttttttaaatttggttgtgaccagacgtgcgcttcgcgcccgttttttcaaattttgttgagctcaaacgggcgcttcgcgcccgtttttaaattttgtttggcattttcggccgcttcgcggcctcgaacgggcgcttcgcgcccgtttttaaattttttttaactcaaacgggagcttcgcgcccgttttttaaattttgttaagcttgtgcgggctcttcacaaccgtttaccacgggtggaagaggtacaacgatgatttgaagaggtacaatg

SEQ ID NO: 116049 - DNA, 859 bp, Heterodera glycines
  misc_feature (96)..(96): n is a, c, g, or t
  Promoter: Source sequence=SeqID_10132; Location=5290..6148; Strand=-; Gene=SeqID_73224
tagtagcgaatatcgttgtgctttttaaattcttaagtaatattcaatttttattattatatttggtatcaataaaagatttctaaaataattatntaaagccgatagagtcagttattctcatcgcgcaatggacaaaatcaagaaaccgtacacgtaataggacaactcttgaaaaacgaattttcaaaatatattaaatttatatctattagcataattcagttagttcatcatttaatttaaattattaacaatagaataattaaaattatgccactaaaaatacattagcttactcaattttaaattatttgattttggtttaagagtttttaatttgaatgtctttccaaatatcccaataattaatttaatttaatgaattaatcaacacggaattttattgaaaatgtaaacaataaattcggataacaaaatcttaaaaaaaacttttcacaaacaatctataaaaagttaaataaattacgaaaattttaaactatttattacataatctcaaaaatgtttgaatattatataatgtaaaaaaaaattcatatttaaagctaaattgatattataaactaaagaattattattatttttctgccaatttaaaaaatctcaacttaatgcaaaaataaaattgactcaattaaaaattaatataataataaaataaatttgcttgaatttgttgtacggcagcgaagagtaatgacttttctcttcagaatttaatttaattcattctccaaataattcattctccaaataattcattctccaaataattcattctccaaataattcattctccaaataattcattctccaaataattcaatccccaatg

SEQ ID NO: 116050 - DNA, 545 bp, Heterodera glycines
  Promoter: Source sequence=SeqID_11695; Location=1728..2272; Strand=-; Gene=SeqID_46975
ttggcaggaattgctcagtttccgacggcgtttgttaccgtacacacaaaggaagtcagcccaacggggggtgtctcagctcgggaaaagccgaaatttgctgccaggtgagcaattaattaagcaattgtggtaaatgggtgccttatcatccaattgttgataacctttttctcaggtggagctaaaggtacgcgcggatgtttgatttctttatgactttttgccagccatacaaaaaatggaccttccaatcggtccaactcaaacaaccgtccatcgtattcattctccgttatcgaatctttgaacggagtgccaatgaagcgaaaggggagggccaatgggagcaaagggtcgacgaacgaattgccattccgctgaacaaagggtcgacaaaattcgaactaaacgcaagggacaaaacggcggacgacagaagcgaacatcgggtggagattagtgcgggtaaggtaattagtggccaaatcggataaaagttccaccaaccattgccagtcggcggcacaccccaacggaagatg

SEQ ID NO: 116051 - DNA, 433 bp, Heterodera glycines
  Promoter: Source sequence=SeqID_15356; Location=1..433; Strand=+; Gene=SeqID_79615
attttacttgtcccaattatgacaatccgcgcggggaccgaatccatcgcattattcatttttgcaaaaattgcgagatctaataaaaaaatgatgtcagattcgatattagctgattagcaaggccagccaaaaacccctcggtaaacatttaaaaaatttttgcaagcaagaaaaggttccccaccactatggttttaataaaatacaaaagggtatttgcaagggagtgccatggttttcacaaattaattttgccggaattgcttattcttaagcagaagcggcaaatgtttgaaaattcataaatagtgccaagaaaatttaaaatgaaaatgcatatataaatttaaaatgttacctatttgtttcagtttttaattagttttcatttttcaaaatcataaacctctcaatctttaggtacaaaatg

SEQ ID NO: 116052 - DNA, 1003 bp, Heterodera glycines
  Promoter: Source sequence=SeqID_7285; Location=371..1373; Strand=+; Gene=SeqID_64350
taacaaatgacaccaaaaggtccataatttttggtgaatttaataaactccccctcgaccacccgccgccccgctcattgtcaactaaaaaattcttgctcacaggcgaataattgcaattttcttgcacgaataaatttgttggcttcagtaagtaaggcttggaatatttgcataaaaaagagtaaaatatgaactaaacaccaaaatatgtgcgaaaaataaattttgccgattaattttttccgtcaaaaaattttttgtttgtttttttcatttttcattataaattattaatccaattttttcatcaaaagactgaaaaatatatgacataaaataaaaataattttaattatttgactttatttaaaacggggtaaagatgagacataattcagtggtgtcatgaacaatcgaaatcggaacttcaggatcaaaaaaatcagatttttgggtcaaaaactgtgttattttacaatttattcagtcaaaaaatcaaatattatttttcagctttttttttttgcttttcgcaacgcttttttgcagcgcattttttcaaaaaaaaacttttgtgcaactgggcggaggggccagcggtgcctcctgcccagaggtgtcaccgggaaaaaatgtgtaattcttaatgcgatttgttaacggattttgtccaaaatctgaacaaattttgcaattttgagccaattttttaaaagaaaaattaggagtttttggaacccggcgtcgccaataggctccgccggggataaattaaaaaaaatttaaattttacttctgaaacgcccaacacattttgtttgttttttatgatgagcgaaaaaagggaaaataaattttatttatataaatattaatattaattgtacgaattatagtaaatttgatgtgataaaattaaattgccaattcattaaagggcattgataaaccataaagatgaatttgggcattttatatttcataaaaatggagtttaatg

SEQ ID NO: 116053 - DNA, 248 bp, Heterodera glycines
  Promoter: Source sequence=SeqID_26661; Location=1..248; Strand=+; Gene=SeqID_57416
agctttacaccttcgataaatcaagtgcggacggaactagttattttggagatgcgaatacaagaactcctgcaaagggagaatttggacggatttggacgatcaattcattcgtttggcaactcctcatacctgtccagtgaacgcagcaaatgttgaggcgcagaaagtgaagacggcaataaaacgacgagcactcaccacgttagaaccgccagcagtgatccgatccgaagcacttcagaatg

SEQ ID NO: 116054 - DNA, 1003 bp, Heterodera glycines
  Promoter: Source sequence=SeqID_19890; Location=621..1623; Strand=+; Gene=SeqID_84647
agtgttgctacaatttcaggctgttcctgtggccaatgcggccatacgggcggttacagcagtggcggatgttacggttgcatgtccggcacgagcggctgttactgtggaaagaaaaaatgaaaaaaaaatttttcaataaattagaggaaaaaaaatcggagaattattttaaagaaaataaataaattgttctaatgcattttattgtaatgttatttttatgaataaaaacaaattgattgtcatttttgggattttaatgatgataattattaattaattgattaatagtgctttttaaataaattaattgccattatgtattaatatatagattctattttaatttaaatacaaattatttttttaaatttttcttttcgaatgatgtcatgtgcttttttaataatatatttgtacaaaaactcgacaacatttttttaaggtgtaatttttttaattcccaaaaagtcgatctttattctcgaaaacccccaaaatatgacttatattcactaaaaattttagaaatgctatttttgagtccctttcttcatagaataagcgccgagattacattagcttagataataaaagaatacattttttaatttttatttaaaaaaaaaatttaaataactatctcttattttaaatattttttacgaatttttctttcgtccccaaaacctaagtcttaatgagatgattaattggttaattaatttgatccatattttggcagttcatgactttgtcatgagacataaattaccccctccccccaatatttggctagatttaattgaaaaagagcggaaaatgtttaaagtctcgacctaaacttgttttaaattgagcccaattcaacgcattcgtctcaaatttttgtgtctatttaatgtttgattttgtgttgaatcccatcatttttatttaaaaaaaataataatttaaattaataattatttttatatttgaagacgatttttttcaaatg

SEQ ID NO: 116055 - DNA, 818 bp, Heterodera glycines
  Promoter: Source sequence=SeqID_44175; Location=1..818; Strand=+; Gene=SeqID_71706
tctgattttttaaacacactcataattttggagttttatggcataatgtcaatattagtcaagaaactttcaagtttacgcaaaatttggtcatttttgggcaaaaaatcttaaaaaattattcaatttaaaaatgcactgcaaaaaatgttaaaaatctgaaaaaaggttaaaaaaccattttgatcacaattacactgttcctccacaacattgttataaatgatggaggtgaaaaatataatatttttatatttttttgattaaataaattgtaaaaaacagctgattaaagcaatttgcaaaatgttcttatttttggctttatgttcttattttgaaatattaatggcaaaataataataaatagggctgggatttttatgtgctaaaaatcctgaaatatgtaataaaatatgtgctaaaaaccaaaaaaaggcctaaatacgtgttaaaaaatgcaaaaatatgtgctaaaaattggaaaaaccaatagtatttttgcataaaaattccaaaaaactcattctttttattttcgcccgcacaattgcaaataaaaaacatttggaggtgtttgggggtaaaattagtccttttttgataaattgtttttaaagataatttttccatcagttgagtaagttccagcaagaaacttcgatatccagtaacgaataaatgaagaattcgattttcggtacacgaaataaataaagaaaattttgaaagagcctataaaaatggcaagaaagttgatttttaggggtgcatttttgaattttttgtgtttttcttagatatttttttcaaaaatg

SEQ ID NO: 116056 - DNA, 190 bp, Heterodera glycines
  misc_feature (47)..(47): n is a, c, g, or t
  misc_feature (62)..(62): n is a, c, g, or t
  Promoter: Source sequence=SeqID_15628; Location=1..190; Strand=+; Gene=SeqID_79919
ccgaaataccagaaatttttaccgtatttttccactattcgtgaatncgggtgtaatattcncgggttgtaaccaatgaattttgaactggactttcgacactgaccactgaccgagtggccttacaattattcgtcaaaattattttatggtcgcttttaatttgcattcaccactcggtaccgaaatg

SEQ ID NO: 116057 - DNA, 74 bp, Heterodera glycines
  Promoter: Source sequence=SeqID_31537; Location=1392..1465; Strand=-; Gene=SeqID_61871
aaattgctgaattccgcgaagaactttacgaaaaaaagttctttggaacaatccttggatcaggagagtccatg

SEQ ID NO: 116058 - DNA, 537 bp, Heterodera glycines
  Promoter: Source sequence=SeqID_521; Location=4836..5372; Strand=-; Gene=SeqID_55201
aatcacaggtgcgtggacccgggcaaaatcttgccttaagaccaacatgccttcgcaaagaaaagtttatgtcttgtgttgtaccagccacgcaccacgacactcccttaacttcagcatgagggtcacgggacatactgtgaaccgtatgtaacaatgtatcatcaccagcgtcagaccacatcgaacgggtctgaccgtctgcaagcgccagacggggcatgtggtggtgcctcgctagttcaacattgagtccatccataacactcaaacatacgctttctcctgctgcagtcagggtactcacgtacgagcgcatggacgcacttttctttcgcaccacgaacgtgtctcctccgccggacagcaaacccaccaaagcaaggcgatccgccaccatcccattaccacacaagcagcctaccagttggctttcactagtgcagcactggacggcataccaaatccaacggaagaagtacacattgctcgcggcactttctaaacagacctgtctatccaattcacattcacatg

SEQ ID NO: 116059 - DNA, 138 bp, Heterodera glycines
  Promoter: Source sequence=SeqID_29492; Location=481..618; Strand=-; Gene=SeqID_59985
ttccctccccccatttctctcttcttcacacattctctctctttctctccctccctttctctcattattttcttattttttgtctccaatttttaataataagcaaacgatcgccacaaaaagtgaccacaacaaatg

SEQ ID NO: 116060 - DNA, 323 bp, Heterodera glycines
  Promoter: Source sequence=SeqID_12363; Location=799..1121; Strand=+; Gene=SeqID_75968
cctttaaggaggaaaattcaaaaattttcttttagttttcattttggggtggcgtgggaaccccccctccctcctgcggttacgggagcgacccaagctgcacaaacatgctaaaaaatcgccatatttttatgtgcattttcaacatggcaggtataaatctcccccaattaatgctcttaatgccatgaaattcctccgatgaatccctcccttacgctctgtgccatcgcgttgacaatgccgtggctgttgttgccgttgttgttgtgttgcagtctgtgcgggtgttgttgctgctcggtcggtgccaccaactgatg

SEQ ID NO: 116061 - DNA, 239 bp, Heterodera glycines
  Promoter: Source sequence=SeqID_6002; Location=1243..1481; Strand=-; Gene=SeqID_59977
tcccccccccctttcctccgtctcttccgatcccttcgcaatgcttcaaaatattttcgctaaaaaatgggcagataattatcgataagccagctgattgttccttattgcttgcttatgttttcacaacaaacttcatttgaaatattctttcctttttcatttgaaatttcataataatttttgtaaattaactaaatttagttattaattaattaactaattaattatccgtaatg

SEQ ID NO: 116062 - DNA, 721 bp, Heterodera glycines
  misc_feature (49)..(49): n is a, c, g, or t
  Promoter: Source sequence=SeqID_20733; Location=1..721; Strand=+; Gene=SeqID_51294
gatgatttcgcaaatcagctcagatggtaaacgttcctttatgggtttntggggaagatgaaatgaatggtttgactgcttgcattggcaacgaagggcccaatatcggaagacccgttgtcttacaataagccccaagggaataaaatcaaaggaaaatttgaaaatgcctccactacagggtattggtgtcgaaaattatcgattactgggcggaacgtgttgaatttaagaaattcaaaaatacattccttgagggatagcgtcgaaaattattgattagtgggaggagcttatcgacatttggacggctttaaaacacacacccgggcatcataatttcatttgctctattttttaaataattattattatttgctgtgctgttaaccagggcgggagcccgacttacagaaccccgtttatcctggcagcaatttctaatttgacttttagtacttgaggtagtgcattagacaattctaatttccaaagctgtttaggtgccctgtcgtcttgtgcttcatgggtggcagtgcgctgctcttcaggtcaatggttggttttgaaattaacacatttaattgaattgatacacaaattttgcacatccatgccaatttgaataccatatataaatatgttgctttttctccatgtttcattttatttattcaaaaaacacaaaaaaataatatttaattaaaatagattaaaaatg

SEQ ID NO: 116063 - DNA, 57 bp, Heterodera glycines
  Promoter: Source sequence=SeqID_23766; Location=1122..1178; Strand=-; Gene=SeqID_54469
ggtcagtcagtcccttttcaatgactaaattctcatctgttgctctatttggccatg

SEQ ID NO: 116064 - DNA, 199 bp, Heterodera glycines
  misc_feature (39)..(39): n is a, c, g, or t
  Promoter: Source sequence=SeqID_30774; Location=1122..1320; Strand=-; Gene=SeqID_61166
ccctttttgatagaaaaagcatcagagtgcctaaactancctgtaaataaagttttgtgtgtttcagagcactttctgaaaaaatacttatgaattattttgcaaaaaataaataattaatgaaaaagtcagaatttcgaaaaattttaaaaacaacaagcgttggcattttttcaggttaagttagtcctttacaatg

SEQ ID NO: 116065 - DNA, 448 bp, Heterodera glycines
  Promoter: Source sequence=SeqID_25921; Location=1..448; Strand=+; Gene=SeqID_56691
gcattatagtgttcattcccaaaaatggaggaccatagtcaacagcagcacacaaaaataggacagctaataaaagacaattcggactagttgtgtgcattggcaaggaccaaatcctctaaaaagtgtataaagatggtgtgtcacgcaaccagtgaacagctgttagcactcgtggaaatttgtctaaatcttgtcgcttcgcgtttccaactgactagccgacagaaaagaagactgatgccctacgtggaaactgtgcgacggatgagcagagcgagaagtgaacgcggtgcgagacgtgtgcttgtgcagaaaggatcaggattcggggggttgtttgccgccctcctaacacccgtgctaattgaagtagcaaaatcatttgtcaccaaaaacgcataaataccccacaatttgttgttcacgctcacatttttgcaaaatg

SEQ ID NO: 116066 - DNA, 182 bp, Heterodera glycines
  Promoter: Source sequence=SeqID_1441; Location=558..739; Strand=+; Gene=SeqID_73553
gctgaacaccgattcgatttggacgtttgcattaaaaaatcattaaaaagttataatgcaccgttttgttcccgaagtgaaaaatcgtgatggggtcgagaaatagaagccgtcatgttccggactgcctacgaaatcaccccatttcacaccgacgacggagtgaaactgttcccgaaatg

SEQ ID NO: 116067 - DNA, 154 bp, Heterodera glycines
  Promoter: Source sequence=SeqID_15861; Location=1538..1691; Strand=-; Gene=SeqID_80192
aaattttgccctcgctacccattgtagtgcaaaattgctgaaaagccaaaaatctatgtacgacgattgcaattttagaatgttttttaacaaaaaatttaaaatcaaaatacccaaaataccgcgtattttggctttgcgtttaaatcaaatg

SEQ ID NO: 116068 - DNA, 313 bp, Heterodera glycines
  Promoter: Source sequence=SeqID_27802; Location=612..924; Strand=-; Gene=SeqID_58468
tggcgctcctggacaagggtgagcagagtttgttcgattaatttctattgatttggtggtgcaacaacaattcggggactattagcaattgtccacaccacaaattcgacagagaaattaaggagtcatcaattgacgcgcctgttactcattcttgtagaagagtaacaaaccatcaaaaaaaaaaaaaactacaaaatcgccatcgtcccatcgcccaacatttgtgcactttcttgtagaagtgtacaagaaaaagcagcagcaagcattcttgtagaaacttgcaaattcttctcttctcttcacaatg

SEQ ID NO: 116069 - DNA, 131 bp, Heterodera glycines
  Promoter: Source sequence=SeqID_31394; Location=669..799; Strand=-; Gene=SeqID_61754
tcgccaggccgctgccacgccgccaccagtgccgatggatcagcagccgcacacgcaacgcagtcacgctcagcagcaggcaattttttaggaaaaatcattaaaattaaaagtgtcaaaatggtcgaatg

SEQ ID NO: 116070 - DNA, 66 bp, Heterodera glycines
  Promoter: Source sequence=SeqID_16833; Location=1..66; Strand=+; Gene= SeqID_81253
ctgtacgtaaaacgtttttttcctaaaatttatgaaaaccaaaattaatgctctaggtcagagatg

SEQ ID NO: 116071 - DNA, 291 bp, Heterodera glycines
  misc_feature (25)..(25): n is a, c, g, or t
  misc_feature (34)..(34): n is a, c, g, or t
  misc_feature (104)..(104): n is a, c, g, or t
  Promoter: Source sequence=SeqID_5693; Location=1..291; Strand=+; Gene= SeqID_58926
tgaaccgctgctgagagagcgcggnaaaagtcancaaaaaatcaatcgaaacgatgtccaaaattattgaccagccaacgtacatacacactgcatcaccagcngaagcggcgctaccgccgattgccaacattggcgcccggcttgcatactgaatggcaggccgatttagctatttttgaccgacttggtaaacaaaatcgtggcttcaagtacttattagtctgtattgatacccttagtcgacaggtgtttgttgagcccgtaaagaccaagacgagcgctaacatg

SEQ ID NO: 116072 - DNA, 124 bp, Heterodera glycines
  Promoter: Source sequence=SeqID_5256; Location=630..753; Strand=+; Gene=SeqID_57472
aattttgacccaatgatatgtgttgcatttgctcaagcttatcttttttataatttgtttaaatggattttaaaaaaatttacgtgttgaaaaattataaatcgttttaccgaagccataaatg

SEQ ID NO: 116073 - DNA, 455 bp, Heterodera glycines
  Promoter: Source sequence=SeqID_13044; Location=2774..3228; Strand=-; Gene=SeqID_76826
tttttgggctttgaatttcttctgtttcgctgggaaaatttcgaagaaattctgttgcactttcacaaaaaggaggccgaactgcctgtttcgttattgttgttgctgattttgtatgcataaaacaaacagcagcagaagacgaacggaaaatgtgggaaaaacggggaccaacccaaactaaaaaatttgaaaaatgaaacaaaaaaaaatattatgtattttgaaagataggaattgaagatttaacgcctgtcaaaacggcaaaagtgtgctaattgcagcaaaaaatgaacagacggtaaaaaaaattttttaaaattacaaatttttcgtttacccaattctagaagctttttctaagctattgcttcgcgattagacacgtagttgtccaattaagtccttaagatttgatcgcaaaaaacaattattcttgctaattatccgacatg

SEQ ID NO: 116074 - DNA, 509 bp, Heterodera glycines
  Promoter: Source sequence=SeqID_26103; Location=1..509; Strand=+; Gene=SeqID_56850
catggcgcataaaataatttaaggccgtacagatcttaatcctttattaaacctttgtgacatttctttttataatttaaaacaaaataattgtgcaaaaatccattcataggcggaatgcaccgctaaaattatatttttattaattaatcgaacaaaccgccagatgctaatgcactctaacagtgacgtaaaaaaggaattaaaaccaagattaatcataaatggtagtcaaaaatcacaaaataagtgccatattaaacacaataaaaataaatcacgcctctcaatagtgaaaatatgcattagtgcttattatttcttttgcaaaagccaaaagaatgttttgtattaggatttttaaaaaccagaaaaagccctgaggggatgcggagaagcctgccaattaacgccggcttaatttggaaatttcttttttttaaatcatcgataaaatataggataaaaattgctgacccccccctccccacctccttccttgtgaaatg

SEQ ID NO: 116075 - DNA, 60 bp, Heterodera glycines
  Promoter: Source sequence=SeqID_5448; Location=4442..4501; Strand=-; Gene=SeqID_58084
ttgcccttccgtcgctttccgttgccgaaaagcgttccgtcgatgtgccatcggcgaatg

SEQ ID NO: 116076 - DNA, 296 bp, Heterodera glycines
  Promoter: Source sequence=SeqID_18813; Location=1227..1522; Strand=+; Gene=SeqID_83497
atgccaaataatcaatcagtcaataaattaattcaatccatttttagtcttagtatcaattttccgttaaaattatcggaaatcggaatcagacggcccaaaaaatttcggcaatcaaaaatcggatttttttttttttgtaaaaacaacaaaatgttaaatacttaattaattgcttcaaaatgatatttttcaaatgcgttttttgttctaaaggaatggaaaattgggagcaattgcgcgcggatgaaaagctttgttttacccaaaaaagcatccaatttccgaacacgatg

SEQ ID NO: 116077 - DNA, 632 bp, Heterodera glycines
  Promoter: Source sequence=SeqID_16118; Location=1879..2510; Strand=-; Gene=SeqID_80475
aggagcaaaaaataaatgatgaaaaaagttattgtatacaaatttcaaatgcaaacagcgataacttctcattattatgttgaactatagaaaaataattcactatttattttcaatatactaaataattctatatgtgtaaaaataaatataaactttaagtaaataccatctaaataaaataaaatgtcatacattttgaaagtaaattaatatttttgcaacaaatgaataatttttttaagcaaaatccatgaaattaaagaaaataataaattaatataatttttattgagtttataattaattcaaattttctttttacagatcgtggagcaaaggacatgagaattaaaaatattgaataaattttatacaacaacttaaatccattaacggaaaatgaattaataattaatatttatacaaaaacaagcaattaaatagttcagaaaagcttaattaaaaatatagcagaaatcaaaaaattaacagaataacaaaaatcattaacttaaaaactttttgcgaaaataaaaatcctaaaaacaaagcttataaattataaaatttttgtgtttgtaattttgaaattaaattatattaatttatcttttccagacgaattaatg

SEQ ID NO: 116078 - DNA, 1003 bp, Heterodera glycines
  Promoter: Source sequence=SeqID_6762; Location=680..1682; Strand=+; Gene=SeqID_62795
ttaaaaaaattatttataatgactagggctaggatttttatgttttaacatattttttttgcggcttagttatggcgagagaagcccaaaaatagcattttctccgaacaaattttggtttagagcgacttataaaaacataaaaacacatattttggcgttttggcacataaaatatgttagcacatattttggggtttggcacatattttgcacatattttggcatttttgagaaaaattgcaataaaaatacaagaaaattgaaaaatacacccctaaaaatcgacttttttcctaattattaacataattttcaaattaaaaaattttttcttcgattgtagaaactaatgaaatctcgaattcattaattcgtcattggatttcgaagttctctgctggaactttcaatttatagaaatgatttatcaaaaaaagacaattttaccccaaacacttcgaaatgtatttgatttgcgttgtatgggctaaaaatgataaagaatgagatttttgggaatttttatgcaaaaacacacttattttttcaatttttaacacatattttagcacatattttggcatttttgggggtttttagcacatatttcagcattttttagcacatattttattacatatttcaggatttttagcacataaaaatcctagccctaataatgacgaaaaatctataaaattaagttttacaaaacgatttaacacggattaaaaattcagtatttaaggacatatttcttttcatgatggtcattttttgaacactttctaagcttgcataaaattgtaatttaaatttgttttccattattttattttcatttggtatgttttcggcaaaaataaaaacctaaattcatctaaaaaaatttcggggcctagaaaaatttccaaaaaattcaaatttaaaaatttcaatgtgatttttttgcatttttttacatttttttgcaagttaagcgacgacgacagaaggaatg

SEQ ID NO: 116079 - DNA, 478 bp, Heterodera glycines
  Promoter: Source sequence=SeqID_21549; Location=1..478; Strand=+; Gene=SeqID_52168
ttagagctgttcaccttcagagaaaaaaggcaaatgtcctccatctctgatctctcttttttcaccgaattttattttttgcttaattaaaaaaaacttttaccgattgagggaatatttagcattttattatgttaaaattaaaaatataaaaaacgcgcagaaaataaaatgccaaacaaatttaagaaaatttaaatttattaaacctgtacatagagttgcctaaattgttattcacttacttatatatcaacacttcctgggtgactaactaatgccagcagaagcacagatttgtgatgttggaaaagaattttccggtgacatcggcaggccaaatttcggaataattcaggcacttaacgcatagacttaatgggttttgtggaattgaactaaaaaagaaaaccaattttaggtgataaagacagccgaccaaatttattacagagacaaaacattgtacagcaaaatg

SEQ ID NO: 116080 - DNA, 863 bp, Heterodera glycines
  Promoter: Source sequence=SeqID_2963; Location=5725..6587; Strand=-; Gene=SeqID_82529
tatgagttcaaaaaatttaaaaaacgggtgtaaaagcgcccatctgaaccaaaaaaaatttaaaaaacgggcgcgaagcgcccatctgaaccaacaaatttaaatttgacatttaaaattgattatttatttctttttaaattaaagaagtcatttgttttttaattagaatttgtcaaaaaattaatttcaatttaaatatatatacaattcatgtacatttcaaattctcattttaattaataaaaggaataatttattttattttttaaatttataattaattgcattcaatttttattcttacttttaataaactatttccttgattatttaattttaaaaccatgagtgtaccctttttaatcactgttttacctttctaatcattgttacacctcttctaatcacttttctacctgttctaatcatctttgtactgattttgtacccttataaaaaagaattgttagaatttgcgaaatttgtatttttttatgtgttagagacatgaagatagtacgccaaaaggagaggaaagaaataatttatgttttgttatgtaacttttgagtttgaccatagacaaaaataattcagcattaatcgatgcaattttttttctatcgatatgcaaaaattggtattgatttaacaaatagaaagaaaatttacacagaacgaagtaaatattgttttacatcataagagtgtttattattggatttccattaaaattttggtcaagctcctttttaattattttatgagtttaaatttttataatttgccataaaatattgcagatttgtttctctttactcaacaatttgcggtttaataattaaagacgctaaaaaatg

SEQ ID NO: 116081 - DNA, 142 bp, Heterodera glycines
  Promoter: Source sequence=SeqID_30054; Location=1..142; Strand=+; Gene=SeqID_60508
atttcaatttgggaagcagtaaattaacaaattcactttttatttcaataacattttatttgttttttcggcactccgttgggccgacgcaaaatgccgtaaaaatggcattgaatgttcagcagagaatcgccgtcaaatg

SEQ ID NO: 116082 - DNA, 325 bp, Heterodera glycines
  Promoter: Source sequence=SeqID_30989; Location=1098..1422; Strand=-; Gene=SeqID_61345
tagtcggcgcggtgctgtcatttctttcctgctctatattccttcctgtactgtatgacgtcgataagaacgacgtcagtatgttgcctcctctctgaaaattgcgccccaaaaaaagcctttgtcctctccgaccttagtgaccaattagcggacgttgcgcgcctcatgaatagcaacgacgcggacgatgagaccagcgactcgccgctcctgcaaacacttttcaaaatttttttgtcgctctctacaacaggtgcaactgcaacaacaaatcatactgccgcagaaccaagacctgctgcagtccaagcagtacaaaatg

SEQ ID NO: 116083 - DNA, 237 bp, Heterodera glycines
  Promoter: Source sequence=SeqID_41518; Location=802..1038; Strand=-; Gene=SeqID_69610
tactttcgttcttatgagcctctctgtttttttcccatatgaattgttcaaaatttaaattatggctttacgccgttgcttatgtaatgctttattcccccaccccaccatccattacatttttacaaattcgcagatattttggtcgctccgctgcgtgtcgctcgccgacttaccgaactgagcgacgcggaaacagccgacttgtttgtggtggccaaaaaagttcagaaaatg

SEQ ID NO: 116084 - DNA, 327 bp, Heterodera glycines
  misc_feature (22)..(22): n is a, c, g, or t
  Promoter: Source sequence=SeqID_22092; Location=1..327; Strand=+; Gene=SeqID_52732
acgcggaattgagaagcatttntggaaagtgatcagaactaaaatgctgcttttatgggttggaaaattagttaaattgaaaaacaatcaatttcattatccaattttcagaataatatttaaattatttaaaattgatgccaaatattattatttttattaaatccgtcttccataaatttatgtaaaattaaaattttatttaaatttaaagttttgtatttcaccgacgaaaagaaaattaccgacgcattgcgccactttctggggaataataactttataataaaaactgatgaaccggaaaatataattaggcattatatg

SEQ ID NO: 116085 - DNA, 255 bp, Heterodera glycines
  Promoter: Source sequence=SeqID_39759; Location=662..916; Strand=-; Gene=SeqID_68256
tccccccccctctcccctccctgcttcttcttctctcacaattggccgtattcattgtggggaagacgagcacatcttgggagtacagcagttgatgaatgaacagatttcatgtgcagcatcagttagtatgccattgtcactttaaaatattttaaacttttcgtttgggagagaattgccccgtcactgattaagagcatttagttgcctatttttaatgatttttgtatttaatccatttttatttagatg

SEQ ID NO: 116086 - DNA, 679 bp, Heterodera glycines
  Promoter: Source sequence=SeqID_20104; Location=1849..2527; Strand=-; Gene=SeqID_84893
tttacaaaaagttgtatgaaaataattactatttctgccacaacttatgttaaatttgataattttatttgaagttttccaggctaatagagaaaaagctgggctatcaaatggtaccaagaatgtataaaatttgattgattttaagcaaagttatgccagtttttgtcgaaaaattcgctaaaatggcgggttttatgaaacgacccagccgtttaaaattcatttaatttttattttttaagagcaaaaaatattaatcgaaatgcaaaacgaattcaaatcacttttttccatcgaatcggaaccaacttttaaaagcaatttcatggactcggacaggatcaagcaattaaatgcaaaagtggcgatttggcacttcattcaattcaatgaagaaacattaaaaatgatgaaaaagctaaaagttaaaattatagaaaataaaaaagatattttaatcgcgaatatccaattaataaaaaataataatcttttgtatgcttaaggcaaatgaatgcaacagcagtacatccgatacgcaaaagaaatttgtgaaggaatgggaaaatttagttcaaaaaattggaaaaaataacgtcaacaaagacgtttgtctgttgcaagggttcgcgcaccgaataattcgaaacgaaaatttaaacaaaaacgaaaaatg

SEQ ID NO: 116087 - DNA, 1003 bp, Heterodera glycines
  Promoter: Source sequence=SeqID_2757; Location=3135..4137; Strand=-; Gene=SeqID_81446
catatttttagcgcgaaaatatttcgatttagctttactattcatcaataaaaaattgggttttatcactttattagtgaccgcccaccattttggcgttttaacttttttgccataattttactttttgaaaataacaatgcaataaagtgaactcctaaaaggactttaatctttgactgtttttagttcattttttgtctcattttattcacttctatagactttgtcattattttatatttattcgcgtttttgcattaatatttagctaactattttaagatttttctccactaaagttgccagcacctattaaataaactaagcataatttttctatattttgcataaaaaataaatatagcgatgctgcattattttatgtaatattaaaataaaaaataaacaaaaaatataattaatatgacgatgaaaggataatgtaaattccaagtaaatcctttaatatttaaaacaagaataaattattaataaaaaatacaagaacaattaaatttgtatttttgttgaagttttttggtttcctttttagcatttcaatacttaactgaaagaaccaattttagctggattatgtatactagtcaattttataaaatttatttgcatttcatatttcctttttttattatttgtttttagttaagtataatttctaattgtttggtgaatcctttatattttttgatattttttagtttatagcatgaaataaaattaatagactttttaaaaattcttaatataaattgcatttttttttctcttttaggttaaggggagggggtcgacggtccctggttttcacaccaaacggaccccgattttttttaccgccaaaattttttcaactttaattttggtaatacaaaaaaaagtctaattttgaattacgcaaaattaataaaatatttatgagcgtctgcagcagaatgccccccccccctccccccaattgaccccaggcaaaatcaatatg

SEQ ID NO: 116088 - DNA, 261 bp, Heterodera glycines
  Promoter: Source sequence=SeqID_34928; Location=1..261; Strand=+; Gene=SeqID_64612
actgtttcccattccgtcaaatcagctgaccaagacacagagaattgaacgattatacatcaaatgtaaccattacgctgatcgtatgggcgttcggggaaatacaattaataccgcaaacggcaacccgttggcgcacagcaatttgcgaatggccatcaagtatataatagacagaagagcgggccgtcccaccattaaaccaccaggagcgaacctattggaagagcggcttaggcaggacccaattttgtattcatg

SEQ ID NO: 116089 - DNA, 199 bp, Heterodera glycines
  Promoter: Source sequence=SeqID_45457; Location=458..656; Strand=-; Gene=SeqID_72755
aaatgaattaattccttaagttgaattttctacaggtgagtttattgactttctttctgccgcttcggcatttttttttcttcgttacctgccggtcggccatccatgtcttacccaatactttggatgaagtgattttagttgaagtttgttttgcttggttttttattcaaaattatgtttataaaatttaggtatg

SEQ ID NO: 116090 - DNA, 428 bp, Heterodera glycines
  Promoter: Source sequence=SeqID_9055; Location=1..428; Strand=+; Gene= SeqID_70120
agaaaaacaccgagcagcgactgggcgtacttgccaatgcgcacataatggaccagcagaggggaggaagtggccagctgatcaaaaggacaaagtgatcatcaattgagaataaattaattgatttggattcatatcattagatagattattggttaattgatcagttagaaaaatctaaatgatcaagatcaattaaaggaatttggcttgatattattggctctgattgatccgttagaaaaatgaagttaaaatttcaaagtgatcaagatcagtaaaaggagttgagcttgatcagcaacagaaggcagagagtgcaaaaaaaaagtgataaaaaaaaagctgatcattaggcagatcagcagacagaaagtgatcagcagagcagaagtgtgcacctcgctgacgtgttggatgcgcggatg

SEQ ID NO: 116091 - DNA, 623 bp, Heterodera glycines
  misc_feature (94)..(94): n is a, c, g, or t
  misc_feature (145)..(145): n is a, c, g, or t
  misc_feature (155)..(155): n is a, c, g, or t
  misc_feature (168)..(169): n is a, c, g, or t
  misc_feature (206)..(206): n is a, c, g, or t
  misc_feature (260)..(260): n is a, c, g, or t
  Promoter: Source sequence=SeqID_26248; Location=1..623; Strand=+; Gene=SeqID_56995
aaatagatgtcagaatcgtgttcaccatccaactgtttctaccactcgtgtgcgttctcgcctcggccgcgtcgctgtcgatttgcagtgtcgntcatgttcgttcacgaagtgtcgtcgtcacagatgagcaaggggaggcgancaccagtcancagaagcagattnngtaagtgaagaaaataatgatggattactgcaaattnttgcctatttatacacttagacagcgttcaaaaaacgagagatgaccaataagnggagatgccagagaaaaaaaataccctctcattttgatgttctctttctttgtctctctgttaatagagaaaaactaaattattgtgggcacattttgacgttaaaaaaatattcgaaattcgtcggttggaccttgaatttcgcgttttggcacaaaaattgggctaataaaacgaattgaccaaaaacgaaacatccttcgtccgcctatataaagggaacggttcgaacaaaatgctctcattttgcgtccgtcagtattttcatcattgttttctatttgccagttgtgtcaaagcatcgttctgctccttcatcgatcacagcaaacggaagaagtcgtcacacgtggtggcatcatg

SEQ ID NO: 116092 - DNA, 72 bp, Heterodera glycines; identical to SEQ ID NO: 112797
  Promoter: Source sequence=SeqID_14677; Location=417..488; Strand=-; Gene=SeqID_78785

SEQ ID NO: 116093 - DNA, 89 bp, Heterodera glycines
  Promoter: Source sequence=SeqID_14263; Location=903..991; Strand=+; Gene=SeqID_78283
ttaaaaaaatatattaaaatgaaataaatttatgtaaaaagtcatataaaaatattaatcaatattaaagggtagtttttcgcactatg

SEQ ID NO: 116094 - DNA, 1003 bp, Heterodera glycines
  Promoter: Source sequence=SeqID_6420; Location=5099..6101; Strand=-; Gene=SeqID_61507
ttaaagaatatattaatatatttttaaaattttttccctttaactccaattttcattactaatttttcacttagacccccattcttaccagtgcttgtttttcccggttcccggttgccctaccgggaccgggacctgagcttttcaaaatacgggaccgggaaccgggacctcggatgaccgggaattcccggcccggtcccggtcccgtggcactctaatttgagttctgaaattttcattgtttaaccaaagaaaaaaaggatttattccctattttgttataggtatattagtccaaaatcggctggaaagaaatcccgacttccttttttcttattttcgaattacttaggtttcataacttcgtttaaaataaatcaaattttaaaacttgatatttttcgttagccctaagtgttttctattatcatgcaaaatttcaaaaaaattcgtcaagttttaaaaagttatgacctgagaaactcaaaaaccaagcttttttaatgaattatatcaagatttttaaaattaggttgctttgagaaaagttataccaaaaaaaaaacaactttcatttgatggttttttgacgaacgcccattttgttggtttttgactaacgtcatagcatctaagagatgagatttcgaaagcatccctatttaataactttttaattttcttgtaagaatttttgcacgatttgtctgcaaattgtcgtgtcaatgtctcatttgtctaaatgtcgtcattggcaagaaggattttgagcttaactgcttaatctatacacaacacttaaagtatgaaacgtcaaattaatcccaaaaatatttttgaagtaaacttataaaacattgcaaattaaaagttcaaaaattcgtcaaatatagctaattaatgaaaaattcgcgcacatcactaattagaaatgccaatttttaaaaatatttaaattaaaaaaataatatatttaagcataaggcgtaagtaaaaaatg

SEQ ID NO: 116095 - DNA, 835 bp, Heterodera glycines
  Promoter: Source sequence=SeqID_39444; Location=541..1375; Strand=-; Gene=SeqID_68008
ttgtttaccaagctgacgcggattatcaagtgaggagaaatctgtagcatacagtagtacatgtgtacatcacaagtaataaaggcatacggtacaatttgtaaagtgaaagacaaattttgttcaagcagcaaaaattggcaaattattttgtacatccataataatattgcacaaatattaaggctcgtcattttgaaaaagcgtgaacagaagaatggacaacgatttgataatggacagacaaaaaggcctttagggactaaaatctcttttcctgggactttctgtttccgggattcccggccatctgattaagtacaaagaataaaaatgcgtaagcagagaaattcccccgccattaaaaagggcaaaacttttttacgagtgtaataaataatacataaacttgtaaatggacagatgattgactctgacaacaaatcggtgttggtctacacaaacatagacgcgccgcagtacaaattgatcagagtcagtctcaagggcggcacgaaacagacgccgcaggtggtcatccccgaggacccaaagcaattgttgcgatttgtctaccccgtggccggagacaagctgttggtctgctacatgaaggatgtgaaggtgctaattaccagtgaaccatcattaattaattagttaattaattgaaatgagtgtccattgttcaagtgatctcccgatccgatttttctgatctaaagccggattgattgattaaatagccaatcaacgctttcatgggtcttattaatttcttaaaaatatccaacaggacgctctctatgtgcacgacctgaacagtggcaaaatg

SEQ ID NO: 116096 - DNA, 167 bp, Heterodera glycines
  Promoter: Source sequence=SeqID_42485; Location=1..167; Strand=+; Gene=SeqID_70363
tttaacttttaattaacatttggtgcgtttcagagctccttgctgaaaaaatacttatgaattaattttgcaaaaaatatataagtaatgaaaaagtcagaattttgaaaaattttaaaaacaacaagcgttggcattttttcaggttaagttagtcctttacaatg

SEQ ID NO: 116097 - DNA, 232 bp, Heterodera glycines
  Promoter: Source sequence=SeqID_18464; Location=1..232; Strand=+; Gene=SeqID_83064
agttggaaagtaaggaacaatcgcgaaattgagtgcgccttgcaaataagagggataacactggataataaaaccatagaaaatatgcagtagggcagtgtacaaggtaaatcataaaaatgatgaaatattgtgggaaaatgctgcagtatcagagaaaaattcggaaccgaattcggaaaggagcgaaaatttagacgcattttttgctttaaatttgacggacgaaatg

SEQ ID NO: 116098 - DNA, 216 bp, Heterodera glycines
  Promoter: Source sequence=SeqID_4779; Location=73..288; Strand=+; Gene=SeqID_45901
agttttcttaataattacatataaaatgtttttttaattaaatttcattagataaacaaaaaatgcaattaaaaagaggatagcatttccgcccttaattcctctccccaaaatttaaaaacattttaaaaatccgattaaaaattgtacattttgccgtgccgttcaggtgaacgctattggctccagttgttccgcgattggctgcgcggtatg

SEQ ID NO: 116099 - DNA, 678 bp, Heterodera glycines
  Promoter: Source sequence=SeqID_14997; Location=1754..2431; Strand=-; Gene=SeqID_79153
ttcccatcattatgttttgttctttattcaaaacccattcacattcattgtgtgtattattgtctggggccttgtactatgtccaacatttcaaatggttgttataacaatgggtaggggattttgttgtcattgagcattttgggtttgaaagttgggcaattccatccgtctgtctatttattccttctattatcaagtgctttttttcaaattttccattccattccaactttttcccctttttttgggcgcgggatggagagagaattaacttttgcattattcaaatcatttttcgcattgcctcatttttaatactgttatcaacaaaaaaaaaatcgcctgtttgttgtaatgaaaatccagggggtgagacgattctgttacagtaatatttaatgttaatcctgattaagcattaatcgcgtcagaaatattcttgaatcttgtgatggatttatataatctcacaccgcaaaataacacttttagtctaatcaaaagacacaaaagcattcattgctaatttcttttaaataatttttaaaaatatatttataaggtttttcaaattatgtaatttttttttaaagcgcattctttaaaaaaatgccaaattataattttttattattatttctgccaatgttttggccactcctcaatttcaaaatg

SEQ ID NO: 116100 - DNA, 709 bp, Heterodera glycines
  misc_feature (52)..(52): n is a, c, g, or t
  misc_feature (56)..(56): n is a, c, g, or t
  misc_feature (61)..(61): n is a, c, g, or t
  misc_feature (64)..(64): n is a, c, g, or t
  misc_feature (67)..(70): n is a, c, g, or t
  misc_feature (103)..(103): n is a, c, g, or t
  Promoter: Source sequence=SeqID_5444; Location=1..709; Strand=+; Gene= SeqID_58064
caaaaaaattttacctaacacactacctctgcaccatctgtagaggttaagngaanaaaanaanggnnnnttttcttttcttagaaaaaataaaaactttggnacgtcataactcggcactcgtgctcatttcgcagaaaataaaaatatttttcttaagaaaccatgggtgctctatccacccaccaaatttcatttggaaatcccacggacacctggggaccttcctttgttagaatttttaattactttttaagaaatttaaccgagaaaagcaaaatcagtgatgactttgatttcgtgctaacacttcaaacagttgccgaagagagcacggaattaaaggcggagaaacggcaaaagtcaattaaggctaaagataatgtgaattgtttcaattgcttttctcattagcaattcgtttgtgcttactaattgacgaaaaagaaaaattggcagaaaaatatttgccaaaattcgtattcgcattgaaaatgtgcacaaaagaaactaggtaaaaataaaattgatttttaattttttatttcgatttttattttattaagcaattaagggttgggaaattttaaatgaaaaagggtgaaaaaatagaaataaaattccacttgtattaagaattttaattatattggtaaattaactttattaattaagctgtaacaatttcgaactctttgaacacaaaatg

SEQ ID NO: 116101 - DNA, 261 bp, Heterodera glycines
  Promoter: Source sequence=SeqID_8907; Location=395..655; Strand=+; Gene=SeqID_69598
atggaaaatatactgtagagaattaaattaaaagtacggaagcaaatgaaggaaaaagatgcgataaccaatagtgaaaaaggtatggcataaaaaaaacacaaaatgaaaaaagtatggaattaatttttaagaaattggaaatgatgaagggaattactgttgggtttgctactgtactttcttgttttactgtgtttgctctgatcagatcagtcggtgcttcgcttgggcgatccgttgttcgcctactccaacatg

SEQ ID NO: 116102 - DNA, 253 bp, Heterodera glycines
  Promoter: Source sequence=SeqID_13105; Location=1702..1954; Strand=+; Gene=SeqID_76899
tttcgatatttattatattttatgtaataaatgttaaataaaaaactaaaaagtgacgacggcaaattttttaaaaataatttatagctaataattatataatattttcaattgatatgcaaataaatcaatagaattggctggatatgaaagcagagtaaattatttttttgaaaaaaaaagaaattttatttaaatttgatagagaaaattatgaatgaagtaaatttaatattttttaagcaaacgtatg

SEQ ID NO: 116103 - DNA, 284 bp, Heterodera glycines
  Promoter: Source sequence=SeqID_1441; Location=4172..4455; Strand=-; Gene=SeqID_73554
ttttgagcttataattagaaataatattgtttaaaaaacaatacgatgcttgacttccctggctcttaaactaaaatgaaaatgggttgaaacatttatagacttttttattctttgctctaaaaattgattcgtcctgaagtcattacacattcattttatttttgccgctgaaatgcgttggattggaccaatcttccgactttcttccgtggtctctccaccgtcgatttatcgtcgtccgatttttagccaaggaattgagacagagccgcgagaacatg

SEQ ID NO: 116104 - DNA, 1003 bp, Heterodera glycines
  Promoter: Source sequence=SeqID_18897; Location=486..1488; Strand=-; Gene=SeqID_83605
gattcgtgaacagttaccccgaaaacccttggaaatgtgttttcatggctttcaaaacaaaagttgaaaacaaaagcttgtttgcgtccacttttcccaattcaaatgtcaaaacggtgattgtcaacagttctctgcgatctgtctttacaaaacaaaacaaaacacaaataaatttataccaaacaaaataaaatagcgacgacaaacaaaataaaataatccagcacaatttctctccaaaattaaatcataaaacaacaaccaaaaacatcacaaaatatattgagtctcttaaaaatatacgaaacgccacagaaattaataatttaaaattgaaatgaagtcaattagcacacaaaaaattttttcgaaaatgttcgaactcgggttcagggttcggaattcgccaaaaagtaggccggattcgtactcagcacctcaaaataccccccaagaaatgtgttattagaattttcagaaaagtttaaaaaacaattttttcgggaccagtaaaagacatgattgccagaaaatggcctgcggccgaaatcaatgctggaaaaattcataaattttgaatgaaattttgttaatttagtaatgtttgaaatttttggcattctgtcttaattttaaaattgcaacgagcccgtttcccgcacaaaaaaaaaaatcaaatttgcgggtccgtccgatgtgggattggaattcaaaaattgcgggacctgatcccgcaggattaatcatgcttttccaaaaaattcgggattgctagctgggatcttgccaaatcccatccctcacctgactagtttttgagtcaattttaggagattaacgaattattggctctgacgccggggaaaaccataaattttcatttttatatctgtcctttgccgaaatgcccagtcatcttttatcatacttccccatccatcgatttattcgatatacctatttacttttcattttcatcttatttaggtgaaatataatg

SEQ ID NO: 116105 - DNA, 323 bp, Heterodera glycines
  Promoter: Source sequence=SeqID_7048; Location=447..769; Strand=-; Gene=SeqID_63668
ttaggtacttaaaaaatgttattatgattacagacccaaagcataataaaacacaaaaaaattcaattaggatagaaactttttttgaataaagtttaattaaattttaaaatcgttttatttcttgtttaaaacagcatgaggttatctgcttgggacctaaacaatcctcatcattattgcttaggtataccgggttgtaaaacgccggcttgggtgtcgcaagttaggcacaaaaactccaaaataggcaaagttaggcattataaaaggatattgttattattacgtacatattcttttttagattatttacaaagatg

SEQ ID NO: 116106 - DNA, 238 bp, Heterodera glycines
  Promoter: Source sequence=SeqID_627; Location=1..238; Strand=+; Gene =SeqID_57748
gtgaggatcgaatgataatatcatttatataccagggatgggccgaggtttcgtttttctcatttcgcctttcgcattattcgcattttttggcgtttcgcatttcgcttttcgcatttcgctttttggcgcgaaatgcgacttttacacccctaagaattggattaaattcccacaaaatttttcaaaattttacctataaataggctaattttcagtgaaaacctgtttataaatg

SEQ ID NO: 116107 - DNA, 167 bp, Heterodera glycines
  Promoter: Source sequence=SeqID_32923; Location=1233..1399; Strand=-; Gene=SeqID_63149
cagaagatatgcattagttatccaatttcaataaataaataaataatgaaaactcgatacattttatagtgtttgcttaacctgcccagggtctgcttgatgcgtcctttttaacgcgtcaaccacagcaacaacatcagcagcaggcagccaatttccaacacatg

SEQ ID NO: 116108 - DNA, 116 bp, Heterodera glycines
  Promoter: Source sequence=SeqID_14477; Location=862..977; Strand=-; Gene=SeqID_78527
ggtggcaaatgacaactctctgatcaaccaatgctttaaatgttttgaccaatttgcaggaactggcggagctgcatcaggaactggtcacgacgggttacaccgcggcaccgatg

SEQ ID NO: 116109 - DNA, 165 bp, Heterodera glycines
  Promoter: Source sequence=SeqID_8356; Location=370..534; Strand=-; Gene=SeqID_67791
atccttttgcttcgttttgttgtttatttgttgaatgttacatttaaattcttctcaatcttacaagggaatttcacatgttcacaatcagtgcactttgtgccttatttctctggttttacccttttgtaaaatcatttcaatttttactgtgacaattcgatg

SEQ ID NO: 116110 - DNA, 928 bp, Heterodera glycines
  Promoter: Source sequence=SeqID_4662; Location=2838..3765; Strand=+; Gene=SeqID_55274
gaactggtcaacaactctgctggattcaaacaacctgcaggacaaaacccattgaaaatttaatcaaaaaacaaattttcgaacgtccatatcttttttctactcatgaatcggttagcatttgcttataaaaagcttctcataagatctttcgatttataccaagattttccaatttggttgtcaaaacctttcagaagctcattttctgaatggtgtgttaagtgaaatttcataccatttagcacaaatttaatgggttttggttaaaaaatttataaagtgtatggcatagtgtttaatttttaaaaatttatttcagtgacgaaacacaaaaaagaattatcactcacttttgccgtttcatttcgtatttaatcaatcctttttcattggcacattcggacttattccttcacttttgtatttaaaatcatttgcatttaaattgagccccgtcactttttgtcaaatattttaaaattttaatgttgacaagtaaacagtttaatcctttcattcatttgctactttcacattacttacaaatttaataaaaggatgtgagaagttcaaaatagcaactctaaaatgcccgagaccttataaaatcctgataagtgtaattaaaaaatggatggctagaatccctaccggaaaccccaatcaaaaatacgttcctaagaatcgaattcaaatatttccagggaatctcggcttgagaattcattgaaatattctaatttttcaaaaattacatatcttaatgttagaaaatgttaggaaaaaatgcaaattcaaattataacaccaaatttacccgaaatgaaacattattaaatcatttgtgaatagcgaataaacaataagtattcaaataaaaaatgatgaaagtaaaacaaaattacaattcgcattgatgaaaatg

SEQ ID NO: 116111 - DNA, 256 bp, Heterodera glycines
  Promoter: Source sequence=SeqID_7867; Location=1781..2036; Strand=+; Gene=SeqID_66225
aagaaacaaagataaaatgagataatcatttaaaagacaaaaaaacgaatgtaaaaattttaatttaaaataattaataaattaatgatattgtggaaaggattcagttacgacgataacgcgtggaagtctgagaacacttggaaagagccaaagtgctttttgaagagttcaaaaaatgaaagttaaaaacagtgaaaaaataaaataatttattagaaaaaaaaatcaaataccttccaatgctacaaaaatg

SEQ ID NO: 116112 - DNA, 346 bp, Heterodera glycines
  misc_feature (128)..(128): n is a, c, g, or t
  Promoter: Source sequence=SeqID_5294; Location=2467..2812; Strand=-; Gene=SeqID_57586
tttagatagggaggggcgcaacaaacttttggaaaaattgttaaaatttttgatttgtttttgttgcgcaaaaataaattggtatggaattggtcgggagttcaactttgagcaaccttggacgtcgntcggcttgtttttgcccattctgtacacttgggtcggcaggcattcgatgtcacaatggtccatcagttctttgacattcgccaagtcatcggttgcacgttgagttggcgtttggctgttgctttcctgcaattgcgcgatgacaacgctgtgcagtcgtcgttcttcgtcaaaaacactgttcgggttgcttcctccgtcctgctcgcgtaccatg

SEQ ID NO: 116113 - DNA, 588 bp, Heterodera glycines
  Promoter: Source sequence=SeqID_2861; Location=6043..6630; Strand=-; Gene=SeqID_47453
tttaacttaggaaaacttttcaagttggttagcacattatgacaatggggacagcaagggagtagggagggctggaggaaaatcagaaagggtaaaacgaggaatagaaagaaatatttgagatggaaaggataggtgttgtgccgtcaagtcccgaaccggcgataagtcccgaaccggcgaattgaataaataacaaatttattcaagttggggaaaacacaatataaataaatgacgagggacagaagggcaaagggcgaatattgattaaacaatataagcaaaataaatgggtacaactgaatgacggagaggtcagagggcgcgcggtatttatgtgggacatgaacgaagagagaaaagagaataaacgggagagaaataaagaaatgaaaataataatgggcggacaaaagagtaccaatcccaacaatagagagaaacatttgagagagagagggaaaggatagagcgaaaatttgagagagagagagagagagataaaagaggaaagagaaatagatatacccaaaagaaaatccaaatctctaatcagttggtcaaagtgtttccatttccgatatg

SEQ ID NO: 116114 - DNA, 411 bp, Heterodera glycines
  misc_feature (17)..(17): n is a, c, g, or t
  Promoter: Source sequence=SeqID_33095; Location=400..810; Strand=-; Gene=SeqID_63259
aatatggcttcattttntaggcaaatgcctaaaattttgcgcacttgatacacaaagataagcatgaaaaacgcgttttccgcttggtttgaggagtctacaatgacttttataatgcctatttttgcctatttcggggtttttgtgctaatgtgcctactttaggtttttgaaaaaaatcattaacaaaaatgcaataaaaaagaaaaaaacaccccctaagaaatgacccaaaaaaaattttacaatttcacaaaatatacccaaaagaattaaaatttttcaaaaaattgacccaaaaatttaatatttttttctttataaaaatttttggtttaaaaatttgttcttattcggaaaaaacttaaaattattttaatacatttataaccgtttgacactgcgccaatg

SEQ ID NO: 116115 - DNA, 273 bp, Heterodera glycines
  Promoter: Source sequence=SeqID_39211; Location=1..273; Strand=+; Gene=SeqID_67829
tacgcatgttataagaggaacaaaagtcgagcaatgcgcatgtttaccgtggggaagagtactgtgcttgtacggtaggcatttgatacggtaaaactgttaagctgtgccatcttttagtacaaaggtcaagtgccgaacgagaaattcggcattgtttttggcacattcaaccgaagtcggccgatttgtctgagggaattgcaaaaatttgcatttgtaaaaaataataaaaataataattgtatttaaattttattttttgtacagatg

SEQ ID NO: 116116 - DNA, 260 bp, Heterodera glycines
  Promoter: Source sequence=SeqID_17926; Location=422..681; Strand=+; Gene=SeqID_47487
aaaaactgaacaaaaaattgttcttaaccgggccggtccgggttccggatcaggcacttttggtgccccgaaagtggtgcgataggcttccggaaaatgaccaatcaatcactgagcttttttgtggaacgactcaccacgtcactggtctattataaatgtcttaaagcaaaatcaatgcgatcagaagcaatcactatcaaacaaaaactatcagatgccattcattagcgttttattggtcattatttgcaaaaatg

SEQ ID NO: 116117 - DNA, 727 bp, Heterodera glycines
  Promoter: Source sequence=SeqID_7192; Location=1402..2128; Strand=+; Gene=SeqID_64101
ttattggcttaaaagttaatattattttttaaaataaccaatcccacattcttttttcccttatttctcaagataacaagctggtgtagctcccgatttttcgacagcaacgggcttttcgatagtgaaggacttttcgacaataaacaaaaaataatggacttttcgacagtaaacataaaaataaattatggtttgtcagttttattaaatttcttttaaattagcattaatttgtatttctaaataaatattaggaatacgtttttttggttttaccttttttcctgagctttaagtggcccgaaagtacgcttgttaagctactcttcgattatagcaactattttctagttttttataaagtttaaaaatacatattttgatcaaatttatttatatattttcttaaaaatttttgtttgaaatatttgtatctcaatactaatttggcttaattttgtttctttttgtataaaactttacattaaccccctaaattgaaacatgattgcttttacttttgaaaaatctattgtcgaaaagtcacctcataaaatttataatatttctggaaaatgtcctttgttgtaaaaattccttctgtcgaaaagtccggcgcccgctggtgttcgaactttttaaataaagtaccggttttaaataaaaatactctaattttataataaatcaataaaattatcggctttaagaaattgcaaatatg

SEQ ID NO: 116118 - DNA, 62 bp, Heterodera glycines
  Promoter: Source sequence=SeqID_2035; Location=10915..10976; Strand= -; Gene=SeqID_77432
cgcacgcccgcctccatctgcacgggcggctggaggaggtgcggttggcgggcggccgcatg

SEQ ID NO: 116119 - DNA, 341 bp, Heterodera glycines
  Promoter: Source sequence=SeqID_23519; Location=1..341; Strand=+; Gene=SeqID_54208
gttggagctcattatttttttcagccatcttgaaattgtttaaatctaagccatcaaattttcaaatatttatagctattagctaaattaaaatcattttaaacttttgaataaagcatatttttatttttttcataattatgtatacaattaaggttgcttcttcatttattctcattaaaatattgttatactctcgtttctgcagcaaaatttactcacataattttattagattctggaatgtttttatcgttatagtttttctttctatgtttatatatttctttctaaataattaaaaatttaatttgaaatgacattaattaagtttaaacatg

SEQ ID NO: 116120 - DNA, 107 bp, Heterodera glycines
  Promoter: Source sequence=SeqID_15915; Location=291..397; Strand=+; Gene=SeqID_80260
ttctctttccttagttccgttcgtccgccgttccatttcgtctgcccctctttctgctgaccgtccccaaagttcgctctctgccgatgatgttaattcgcgccatg

SEQ ID NO: 116121 - DNA, 351 bp, Heterodera glycines
  Promoter: Source sequence=SeqID_3105; Location=2638..2988; Strand=-; Gene=SeqID_83204
attggctttataaattatttttcaagtagttttttttgttaagtttggtgtcccacttttggcgaaattattttgaacggcagaaattgtctttccacacactattttcacaatttgttttctctgttccattgtttgtattggagagaatggagagagacactcaaaatatgcgtctctgcatttcaaaaaggcagacatgggaacagaaaaatttaaattacgagatcattcactgacgactaaatcaccgtcaccgagaaccaacttttaattagatacatacctaattagtagggaccattgacaaaaaaagccaaaatatggattataatatggacgaaaaaaatg

SEQ ID NO: 116122 - DNA, 106 bp, Heterodera glycines
  Promoter: Source sequence=SeqID_34311; Location=934..1039; Strand=-; Gene=SeqID_64134
ttttgaccccaattcaaaaaaggaaaaaaaattggcagtcaaaaaattattcgaatttctccaattttgtttccatattttccgaaagttattcggtatcataatg

SEQ ID NO: 116123 - DNA, 375 bp, Heterodera glycines
  Promoter: Source sequence=SeqID_11662; Location=4374..4748; Strand=+; Gene=SeqID_75126
ggctttttactccttacaattagtcgtctttcatcttatttactgtaaaattccccttcccctccccccgggcatttcagtccctttccttcgcttctttcccagctattttttcactgtcatttccatttttgtgacctatgcatttccttccagtttcatatcttttcattgttctattctttgttatatttacataagaattaaagtatttattgttcgtttttaagtgcaattagctctgaataaataatttttaattacttctacattctaataaaatttgacgtttaaattgaacacattaaaatactcatttttatttgtgaattttgcaaattttagaaaaaaaaattgttttaaaaatatcaaatg

SEQ ID NO: 116124 - DNA, 181 bp, Heterodera glycines
  Promoter: Source sequence=SeqID_21044; Location=580..760; Strand=-; Gene=SeqID_51631
ttttcgtaccgccgttttcgtacctgagacgttttcgtaccgccgttttcgtaccggagacgttttcgtacggccgttttcgtacgagtgagtatcgaaaaaattgcattcaaataatttgctaattttttaaaattacttttaatgttttgacagttaagcttttattaactacaaaatg

SEQ ID NO: 116125 - DNA, 337 bp, Heterodera glycines
  Promoter: Source sequence=SeqID_27540; Location=560..896; Strand=+; Gene=SeqID_58238
tctttgttaattcctgacctcatggaaggttcacaaattcgatgaaaaggtacgtttttctttccttttgcatttccataactttcctatttcagtggtgtcgtctccaaattcgcaaggcaaagatagcggaattgctgacaagagtgcagaattacataacgtcaggtcaggaagaggcacatgcattgcgacgcatcacggaaaaagatttccatgagtaagtgaaaattcgaatatcaaaatggcaactgaattcagtctgacccatgtgcaaactaacgaagagctgatggacattcatgcacatttccagctttattacggtcaccaaatg

SEQ ID NO: 116126 - DNA, 133 bp, Heterodera glycines
  Promoter: Source sequence=SeqID_18175; Location=978..1110; Strand=-; Gene=SeqID_82759
cagatgcgtgtggtcaatttgcattattttcttgacacagcgctgctccggaatcccttattgtgaggtcattgacggtctatataaggttcgcccgagggccgatttttagttaagcaatttgtcagtaatg

SEQ ID NO: 116127 - DNA, 97 bp, Heterodera glycines
  Promoter: Source sequence=SeqID_25358; Location=1..97; Strand=+; Gene= SeqID_56107
ctcatttttcctccgctccttatttttcatttttccattttccattttcttttttcaatttttatttttatttttcagtttttcatttgtttagatg

SEQ ID NO: 116128 - DNA, 678 bp, Heterodera glycines
  Promoter: Source sequence=SeqID_96; Location=2346..3023; Strand=-; Gene=SeqID_66804
tttttttgtaaaaatataatgaattatttttataaaaatatttttcgcaatgaattttgtaattattaattttatagcatggcttaatttttcttcaatcaatattaaccacatttaatcattatttcattaatttgatacaacatttttataataattcaattattaaattttccttttatcagcgaattgggtagtaattaatatgagataactataattatggagatttttaaggtaactatcacaaatatcacattttcgttctcatctgatgtcattaattcactaatttttttagcacatattttggggattttttggaaattttatttttattttttacgaaagtagcttttttgcactcaaattcttggcaagatatccaaaaatgctcaaaaattttccttttttttcttttttttctttttgcaatttttgatatttttttaatgactttttttcatttttaaggcaaaatttgaattttatcgatgaaaaacagaaaaataagtaaatcttggagagcgagaaaaatatttacgtcacaaagaattgaaatgtttttgtgtgttaaatgggaaataatttggcttttgcacggaacgagggctgttaactgaagtgatccgtccacttagcgaatgcgtcttctcaagcaaagtgcgcgccgcaatg

SEQ ID NO: 116129 - DNA, 492 bp, Heterodera glycines
  Promoter: Source sequence=SeqID_4855; Location=1244..1735; Strand=-; Gene=SeqID_55970
tgctgaaagagaaaatacataaataaaaagttagacaaacatttttttttcaaaaacgaaattaattattgaataaaaataacgccctttgcttttgttgcttggaatgtttgttataaagtcccaattaatggcactgcaaaaataaaaatttcttaaatgacataattaagtgacaaaaatgaaataaaaataaaatagttatgtggataaaattcaatttttcagactgccgatgtgtactgaaaatggggagtagaacggggcgcatcagctgaagcgagcagttcatgaagaaatttaaattgcttattttaatgttagagattacaaattttggccattaatttcgaataaaatctttttaaatttcaattacattaaaataccaatgcagttggagtaaagttgatagagaaatgagtgaaaatggatctgacaaaaattaataacttaactaagtaaggtaaatagttttttagaatttaaatg

SEQ ID NO: 116130 - DNA, 138 bp, Heterodera glycines
  misc_feature (69)..(69): n is a, c, g, or t
  Promoter: Source sequence=SeqID_42904; Location=791..928; Strand=-; Gene=SeqID_70702
cattatacctcattccctacttctatctcctttctctcttaccatctctctctttctttctttctctcncaaatctctctttttcctttttcaatttgtttcatttgactttttttaggttttcccgaatttaaaatg

SEQ ID NO: 116131 - DNA, 84 bp, Heterodera glycines
  Promoter: Source sequence=SeqID_1314; Location=1..84; Strand=+; Gene =SeqID_72412
acgaaggagcaacttaagtgcatcatcctcgtgattgcacttcgcgacgagcaccacgatttgcgccaaaagtgcctaaaaatg

SEQ ID NO: 116132 - DNA, 107 bp, Heterodera glycines
  misc_feature (78)..(78): n is a, c, g, or t
  Promoter: Source sequence=SeqID_24520; Location=2086..2192; Strand=-; Gene=SeqID_55248
tggaaaaatcaaccttcttccgagaccaaatcaaatatttgggtcaaataatcgatcgaaatggacgccgaccggacncagcaaaaattcatgcaattgtccaaatg

SEQ ID NO: 116133 - DNA, 56 bp, Heterodera glycines
  Promoter: Source sequence=SeqID_6126; Location=545..600; Strand=-; Gene=SeqID_60446
ggtgccaaaaattgcgcaatttttaaaagaattttaaaaattattttaagcaaatg

SEQ ID NO: 116134 - DNA, 53 bp, Heterodera glycines
  Promoter: Source sequence=SeqID_15276; Location=1467..1519; Strand=-; Gene=SeqID_79492
ggtatggtcaagagtaaatatttttgtacttacaaataagttgttttctaatg

SEQ ID NO: 116135 - DNA, 901 bp, Heterodera glycines
  Promoter: Source sequence=SeqID_12039; Location=1059..1959; Strand=-; Gene=SeqID_75567
tttggtatttcattttttcctcagtgtttgtgaatgttgattgtggcgccgacggactttgattggcattctcaaaattttttctaattgttttatttttttgatttcgcttaaacttcttctctataattctatgaagattaaggcattttttgtacatttgttaccttaatcaacaaatagtcgtctaatttgcggcacttcgttaagaattttaatttggcatgtctttttttttcttagcacgacatatcttttttcccttatctatcatcaaagactgcttgtcctagagggagggctttgcctttggattaaattttttgatattaaaaagacaattacaattagttatcggatgggctcactggtactaaaacggaaaattctcaataaaaagcaaaaattctagcctgtaaaaaagttataaaaaaaccaaaatttttgttttttttttttgttgcaattttcatgttataactcttttggtaattgtctaatcgcgaagtaataagaaatagcttctgaatatgttaagctttagaatgatatcaagattgtacgtttaagttgacaatgaaaaaaattatagtccaaaaacttaggctggcgccgaaacaaccccgaccacccacccacagtggtagtgtcaccttttgtcaaattgtacaaatatcaactgctattttataaaatacaagaacaatattttagaattttcaatagaaataatcatggaaatctttgacgaatttattattgttgacgaaaaagtgatcagcgaattgtttggcccaactgcaggaactttttcatttaatgaaaaaaaccgatttgcaactctgtaatttcattttttaattttcatttataaacacattttagtcaatttacgatcatg

SEQ ID NO: 116136 - DNA, 679 bp, Heterodera glycines
  Promoter: Source sequence=SeqID_21270; Location=431..1109; Strand=-; Gene=SeqID_51863
ttttcagacaggacaatttaaaaaaataacccgtcggttttacacttcgttcatcattttatcattcatattttattctcatctccccctcccaataagccaaataggaaggggaaattcgatgaaatggaatgaataaagtaaagtgaatattttctaatagagagttggtggtctcacaattggtgacaaatggcgggagaggggggggggggggggtacggctttcagtgaaaaatgctaataaaagcaaaaacgccggtgttgggaatcagtagcagtgattgtgaaagtcattggatttttactctcatttgctgtgcaatgtcattataaaaaatgcatctaaaaaaggcattacaaaaaaatgaaaaattttcaacaaaaattacccataactttgcttaaatccaaattaaattttaattcttattagcattcgatagccctaacatttctatattagcctgcaaaatttcaaaaaatttcattaagtttcaaaaaagctatggccataaatttttgaaaacctgatttcatgagaatttttggcctaactttgttcgaactatgcaaaaatttttgaaattttgcaggctaataagaaatgttagggctatcgaatcccgaatgctaataataataattaaaatttaagtcgggtttaagctaagttatg

SEQ ID NO: 116137 - DNA, 504 bp, Heterodera glycines
  Promoter: Source sequence=SeqID_15478; Location=2126..2629; Strand=-; Gene=SeqID_79754
cgggcgcgaagcgcctgtttgaggtaaacaaagtttaaaaaacgggagcgaatcgcccgtccaaggccaataaaaattgaaaaacgggcgcgaagcgcccgactaaggccgcgaagcggctaacaagctaaaaaacgggcgcgaagcgcccgtatgagttcaacggatttaaaaaacgtgcgcgaagcgcccgtccaaggccaacaaaaattgaaaaacgggcgcgaattaaggctattttatgacgctgatcacgaatacctgatcagattttactttggacatcgttaagacctcagaatccctgtgacgattagaggattctgaggcatccttttgtagtgagaagggacgaatgaatccatatatattaccaaactaggtactaaagacctacatatacagaaagtaggacaaaacgccgacataaatcgaaatataacaaaggaccaacaattgagaccagattgatataatggaagccgaaagccaaaaaaaaaaatg

SEQ ID NO: 116138 - DNA, 643 bp, Heterodera glycines
  Promoter: Source sequence=SeqID_7363; Location=1..643; Strand=+; Gene= SeqID_64616
attgattttggctgtctttgtccccccgggcgctttctgttcatcaatacagatgagtattttactttatcataatgtgtacttcgtcgtgtgttaataattaattgacaatttgatgatgacggactagcggtgaagaagaagaagaagtggccaattggagcaattagaacattaaaacaattttattatttgttatttttttatgcaacaaatattaataaaaatatatgtttttatttatttatttttattcatttattttacatatttttggggtctattttttataattgaaaaccagaaatatttccttgaaaaattaaaaaagagccccctcccttgaaatactcccctcctcctttgagtgaggttgaaaaatagaggcctaattcattaagtattcttaatttttaatattctaacaagaaaaaaccaaaaattcaagatttgttttttacatttcattttcaaaaaaaacaatttttttttttttttgagaaattcggtttttttttgtaggcaaaaacgaggaaaatggcgggggggggggaggcaaccagcattcacaacagatccccctgattaaccgaatatattttacataaaaaaatattttatgccaaaaatagtcaaacaaatg

SEQ ID NO: 116139 - DNA, 690 bp, Heterodera glycines
  Promoter: Source sequence=SeqID_18374; Location=644..1333; Strand=-; Gene=SeqID_82976
gactttgggtttttgaaagtaggcgaatattttgaaggcgatgaacaaaagaatggcaatttcaaaatagagctgtgtgccaaatgacaatgacatttcctgtcggattttcccacttcgtttttccaaaagttcaaatgaataaattttaattttccaccatttaaatagggagaaaaaaatattttgttttattttatcagactttttaattagtccggtaaagaattaagcaaataaattcactcgttgcaggcttatgttaaaccgatttttgtttttgttccaattaatccaaaaaattacacaaattaaattaaggaaaatatgcaattttaattaaaaattgataaattttaagaattttaagtggatatcaaatgaaaaaagtaaacttattattattttttgaaaaatttcctacttagtaaaagcaccaaaatttgttaaaaaagcaatgacaatttatgtatgtacttagggtgaaacataagttctgtcggccttcattttttgaagaaaatttatttttcaaatttcaacaaacacaatcattattcctaataattaccattattatcgataattgttgccatttttcaggcaaaagatcaatcccaatggaaaagtcattaaggagttagagttgataaagtaaaattggtcattttttaggtaggtattttgatg

SEQ ID NO: 116140 - DNA, 279 bp, Heterodera glycines
  Promoter: Source sequence=SeqID_25505; Location=1..279; Strand=+; Gene=SeqID_56249
ccataacttttttcttatttggtctatactacattcgttggtatcaaatgaaagcttgaagtcccagtaattcataaatacaagaaaaagcaaatattgacacaagaaaaaaattacaaccaaaaaacaggaaatgcagatttttgtgagtatattcttgaatatttttttgtttatctgttggttttagcacagattttagttctttaaatctatagactttaagttttcgtttgatgccaaaaatgtggatattgaccaagcaagaaaaaagttatg

SEQ ID NO: 116141 - DNA, 186 bp, Heterodera glycines; identical to SEQ ID NO: 105842
  Promoter: Source sequence=SeqID_45492; Location=357..542; Strand=+; Gene=SeqID_72783

SEQ ID NO: 116142 - DNA, 705 bp, Heterodera glycines
  Promoter: Source sequence=SeqID_31233; Location=235..939; Strand=+; Gene=SeqID_61608
tgttggagagggaaaagcacgagtgcgtttttgggggaattgcgaaggcgacggcacaaagaattgttgaaaatgccgaaaatttgatttgggctttaagggctttgttggatcgccaactgaaaatggaggtgatcctcagcaacatcgccaacgacccgacctttgatgacgagtcgcgcactcagcaggtagaaacaaagaccaaaacgaaatgccattcagtgttgggcgctgggcaaagtgaactaattactagtaattgctcgaattcgtgccgttttttgggggggggggggttttagactctgctatggttagttgtaacttgtggtttttgatggtctatcgatgctacacccgaaatttttatggaaaattttgtatttttgctgagattttcgattttccttgttcgtacccacccacgccaagacctcccttgtatacggtagtgatgttttgatgggccgatcgcattactgtattaacatttttccaacacgaatttgtcccctacgattgtctctgacccgttattagagcgagctgttgttcaacaacaatgggatatggtgccattgtttatcaattagaccgtaattagtctacggtgtaatgacgtttgatgagggattgccttactgtacatcatttccatttgtgtcccatcattcgtttgccaaaatcaaaaccccaaagatg

SEQ ID NO: 116143 - DNA, 110 bp, Heterodera glycines; identical to SEQ ID NO: 98226
  Promoter: Source sequence=SeqID_30516; Location=765..874; Strand=+; Gene=SeqID_60927

SEQ ID NO: 116144 - DNA, 507 bp, Heterodera glycines
  Promoter: Source sequence=SeqID_8276; Location=672..1178; Strand=+; Gene=SeqID_67540
aattttcaggggccttccgcaaaattttcaattttttaagagcctttccacccataaaaaataaatcaaacccaggcctaggcctttaaaatacaaatgttttttatgtaacgaaaatgtcgctaaaaatttcaattttcccgagcagcttccgccttttgccgccaggccacaaatgttttaatttaggctaatttctccgtttctctgccgggccactaattatttttaattagacttaattgttttttttgccgttgcttttccgttattccaattaaaaagcaggaaagttttatgtatcatttttgggcaagaattctgtttataaatctgaaaaatgcaatttttcattagacggcgccaaatttttgaaatattaaaaaatatatggatgagttggatcataccgtttttttaataatttaaaatccttttaagtctggcgatgcgtctactctgctgaactcgcaggagcgcaaggcacagcgactgttgtccagcatg

SEQ ID NO: 116145 - DNA, 1003 bp, Heterodera glycines
  Promoter: Source sequence=SeqID_13779; Location=342..1344; Strand=-; Gene=SeqID_77702
tgttcagaattttgcgatgaaattggtgaactaaaaatatgccttttgggcataatggaaccgaggcaaatgagcaaaagcgacaaatcatttgccaatcgtacaaaatttataaatgtgggggggggtagaggggcaaagatactaatttgtaaggacaccctcaagatgacgaaaaattatcaaaaaaaaatgataatatgcatctaatataatgtgggaaacaaatgaatgatatgcctaatgcctgagttcttaatgtgtttatataataatttttattttatataataaacatcataaaactaattaatatttaaaaatatctatatacagtacattatttcgaaaatttaatgccatcaaatttttatttgttgcccaatttttggctattttagaaaatttcttacttgagatttctgatttagacaaaataaaaattaaatttagctgaatagaaataaaaacaaataaaacaaaatcaaatttgtcaagccatttgagtacagaagaatgtaaaagcccattcattttattgggtttattcaatttgtccatttgcttcatcagttcacaaaatgatgatgctaaagggttgactttatttatgccatcgaattcacaaacaaaattttgaaagttttattttgcctttttttgtaatttttagtttattttataattttttagttcatttaagtacatttattttcctgggtgttatattctaaaattaactttattttctggatgtgatttaatttgtgattttttatttcgaataagaagaaaattttagcatttctttccattaattaaaatgtaatttaatattttattttatttttaatttttcacatttaaatatgaatttgattttaaaacattgcgatactttttttgaataagaaaaaaattacctcgccgttagttcattttaaattttttcattttattactaaatttaacaaatttttcaatttcacttttaagcgtaatg

SEQ ID NO: 116146 - DNA, 60 bp, Heterodera glycines
  Promoter: Source sequence=SeqID_28679; Location=1..60; Strand=+; Gene= SeqID_59266
ggtgatgagctgctccttcatcatgttaacgtaattgctgccgttgagcccgagccgatg

SEQ ID NO: 116147 - DNA, 619 bp, Heterodera glycines
  Promoter: Source sequence=SeqID_23777; Location=1674..2292; Strand=-; Gene=SeqID_54478
cggattcttaagtttttacttattttttctgcggctttaactcagcgagaaatgcacgaaaaacacattttttgttcgaaaaaccttcgttttaacgcccctatccgatcctaggaatccctattttggatgttcgcccctaaaaatccctattttgagtgttcgcccctaaaataagtttttatccttattttggcgttttgtccttattttcgcccttatttcgcgatttttcggaaattattaagaagaatgcaataaaaaagaaaaatacacccctaagaatcgacctaaaaattttcaaaaaatgcacccctaagaatcgacctaaaaattttcaaaaaatgcacccctaagaatcgacccttaaaccccgaaaatttcgaaattacttcatttctaactgcaatcagtgaataaaattgtttgccttagcttttaacttatttacatagagaaaacagcaatttaaaaaattgcacccctaaatttgaaactttttcgcccctatttcgcgaattttttgcacctatttaggtccctaaattggaatttttcgcccctaaaaatcccatccctattcataaattttaacgtttatttttaattaataaaaatg

SEQ ID NO: 116148 - DNA, 923 bp, Heterodera glycines
  Promoter: Source sequence=SeqID_8262; Location=322..1244; Strand=-; Gene=SeqID_67484
ttttctccacattgttcttcatttgccttttcagtgaatgttttgtcaaatttaaatcttttcgccaatttccatgaataatttttgttgccgaataataattcacttttgtaacacaacgaaaaacttaattgggttaattaattaaagcaaattaattaattgaaatgcctttaattagtttcaattaattacctttcacaatttccatgaatttcatatttcacttttaatgtgcaaaatggtctaaattccaacggcactttgcttaattgcttcagattagtaaatgatcatttgaatatttgataattttttttttgattacattgtgttattggcattggaaacagcgaaaagatggatagaaaagcaaaaaataacaaaatttaaatttacaaaaaacatcttaaaattaaaattatttaagattcatacatttgtgccaaaaataccgaagccgaaattaatggcactcaattgataattaattaaataatatgacactctaaattattatgtattgtattaattaatatgacaccgaattatttttaattaattaatatggcaccaaatcatttttattgcttttttatttatttaattaaaaaataatttgcacatttaattaacataaatcatttttatttgtccattttcccagtgaataattatcataaaatttttttttttgatcattttcaattagtcatcagaacagtggctgcagaaagaatatttgtgggatggaaagtgaatgattcattaaaaaagccaaatggaaaacgaacaaaaatgtgaaaagcattcattttacaatttattagtccaaataaaaatgaaaataaataagtcaaattaatttaaaaatatttcagataaaatccaattaatttcaacaaatttttttttttcaaatg

SEQ ID NO: 116149 - DNA, 116 bp, Heterodera glycines
  Promoter: Source sequence=SeqID_7774; Location=1..116; Strand=+; Gene= SeqID_65907
atcaaactgattccgaacataagcatatagttcagctgcttagggtaagaagaaatgaacatgtgaagtttgactgcgaatggaaatttcaggatgttcttatcagtaccaagatg

SEQ ID NO: 116150 - DNA, 110 bp, Heterodera glycines
  Promoter: Source sequence=SeqID_43802; Location=646..755; Strand=-; Gene=SeqID_71388
agaaattttctatgcaacaaacgctctcgaacatgaaacgaagtgcggtgcgccgtggccattttatttttcaaataatttttaaatttaattgatattccagaaaaatg

SEQ ID NO: 116151 - DNA, 338 bp, Heterodera glycines
  Promoter: Source sequence=SeqID_12941; Location=2524..2861; Strand=-; Gene=SeqID_76692
ggtaaaatcaaaaaattaaaaatttttataataaaattttagggcgttacgatgcgcactttattttgcgcgcattaaccgaaatgggatatatacctgaaataattatttcagatctaaaaatttatcaaataaagttgggaaatttgttttttagagatttttagctgatgtcacagaataaattatccgatttgccaaaaacatttgggttggactgcactccaaagttatatttcccacacaaatataactcaaaaaaaaattatggtaaaaaataattattaattaattttttatggtttaaaggtaaaataaatccaacactaccccccatg

SEQ ID NO: 116152 - DNA, 74 bp, Heterodera glycines
  Promoter: Source sequence=SeqID_1738; Location=1..74; Strand=+; Gene =SeqID_75604
tgatccacggtcagtcagcctcatctgattctgaataaccaaaaaaaagtgaaaattttagagtccggccaatg

SEQ ID NO: 116153 - DNA, 371 bp, Heterodera glycines
  Promoter: Source sequence=SeqID_20362; Location=1..371; Strand=+; Gene=SeqID_50881
actatattttaaatatttccagtataaaaaattctttaaaattccaaaaaaattttcacccccagaattattaaattttttattagtgcaagagtagtgcaagagtagtgcaggagttgttcatcagtggttcattagttgttcgtgagttgttcaaaagttgattattttacataccaagatgcacatgcagtatcttggcgagagttgaagttatatccaaaatttaaacgtcaaacatctttttacattgttttaagagtttctgatgtattatttttattacttaacctaatttttaaaattgaattttttcggattctggacacaatttcccatgaagtatcttggtcagtattggacatgtaatg

SEQ ID NO: 116154 - DNA, 247 bp, Heterodera glycines
  Promoter: Source sequence=SeqID_23956; Location=329..575; Strand=+; Gene=SeqID_54645
atcatttgaaagctcaacatgtttagaaacttttcccgattgcttcgcgattaaaagattactaaaaaaagttatgcatgaaaatttaaaaaaatcgaaatttttgaagttttttcagaatattttttcataggctatcaatcttttctttctaaggctaatatagcctgtaaagagctttcgaatgtacaaagattgttaagtttgtttgacaaagaaaaaagttataaggccagaagcacaaatg

SEQ ID NO: 116155 - DNA, 264 bp, Heterodera glycines
  Promoter: Source sequence=SeqID_228; Location=3650..3913; Strand=+; Gene=SeqID_78607
taataatcaaattcaaaagctaaaatattgtaaaaattaatgaagaaaagatgtaaatttagggagaaaaagagcagaattaacgaagtgaagaataaaactgaaaaatataagtgtgcatcaactatttataacaatcttggttttgtttttctgggttaaacaaacatcaatctgtataaaaacggagaacaagatcactttattcaatcctttattcaaatatatttaatttattaaaataaataatcctagctaataatg

SEQ ID NO: 116156 - DNA, 194 bp, Heterodera glycines
  Promoter: Source sequence=SeqID_7315; Location=1..194; Strand=+; Gene= SeqID_64434
ttatgggctgatcaaaaaaaaaatacaaaaatttttttgaattagcactttctgtcttttggcgttttaattttgaattcaaaatttgggatccctttcagcgatctcgatcccgaaaaatggataaatcaaacccttcttttttgtagtttttcaatttctgtttattatcaaattttatagcaattacaatg

SEQ ID NO: 116157 - DNA, 279 bp, Heterodera glycines
  Promoter: Source sequence=SeqID_16352; Location=1375..1653; Strand=-; Gene=SeqID_47360
cgttttataaatcgaatgatcgatgaaaagccggggttaatggggacaatagaaacattgacaactgagggtaaacgaggcgcggacaacattttggagaagggtggatttcaacgtcaatttggtacaggacgaagaaagcgtataaaagctaacaaatcacccattctatcgcaccagactttaattggaaaaactattaccaacccactaattaaaagcaaaaagcgactcagatcagacgcatttggactttattaaaaaaaagaagataaaatg

SEQ ID NO: 116158 - DNA, 114 bp, Heterodera glycines
  Promoter: Source sequence=SeqID_39312; Location=1156..1269; Strand=-; Gene=SeqID_67906
ttttcccggcggcgcctatcggatgcgccgaaccccttgcgccccaaaacttattttggaataagcgactccaaacatctgctgctcttgtgatgtacataatcccaaaaaatg

SEQ ID NO: 116159 - DNA, 280 bp, Heterodera glycines
  misc_feature (80)..(80): n is a, c, g, or t
  misc_feature (97)..(98): n is a, c, g, or t
  misc_feature (226)..(226): n is a, c, g, or t
  Promoter: Source sequence=SeqID_9988; Location=1..280; Strand=+; Gene= SeqID_73037
gcagggtgagcagagaatgcaattagggcaattaaaatgccaccgaaatgacatttccaaagaattaattcgattttatnggaataataactcattnnaagagaaacaaaattaattttattgcaaatattacacgtttgcacgtgaaaagtgaaattttctttttcagcatccttctgtcacattgttacaaaagtttgataaagtgaaacatttggaagtgccncaattaacgttcaaatttgcgaatttaaaaattaatttagaaattgtcacaatg

SEQ ID NO: 116160 - DNA, 63 bp, Heterodera glycines
  misc_feature (21)..(21): n is a, c, g, or t
  misc_feature (28)..(28): n is a, c, g, or t
  misc_feature (39)..(40): n is a, c, g, or t
  misc_feature (48)..(48): n is a, c, g, or t
  Promoter: Source sequence=SeqID_26672; Location=1224..1286; Strand=-; Gene=SeqID_57429
aatttcctccatttattcatntatttanaatgttatgtnntagtatcnaaacagcggcagatg

SEQ ID NO: 116161 - DNA, 128 bp, Heterodera glycines; identical to SEQ ID NO: 107395
  Promoter: Source sequence=SeqID_21562; Location=731..858; Strand=+; Gene=SeqID_52175

SEQ ID NO: 116162 - DNA, 61 bp, Heterodera glycines
  Promoter: Source sequence=SeqID_15077; Location=748..808; Strand=+; Gene=SeqID_79247
ggtggaaaaataaaatacattcaaatagcaaataaaattcagaagttttccattccatatg

SEQ ID NO: 116163 - DNA, 139 bp, Heterodera glycines
  Promoter: Source sequence=SeqID_11262; Location=1..139; Strand=+; Gene=SeqID_74631
ctctagagtcttaatttcaaaattaaagtgttcgaaataattatggaattttttttcacgtccaaaatttttaaacaaataaataccaaattcaaatttgaaaatttagccaagtgatgaacaattaattaatgaaatg

SEQ ID NO: 116164 - DNA, 797 bp, Heterodera glycines
  Promoter: Source sequence=SeqID_22715; Location=218..1014; Strand=-; Gene=SeqID_53398
tttttagcggcgggcagagaagagaaaaatagtaaggaaatttgagagaaaaacttctctcaatttaacttgatatttctaaattgtgtttaaaagcggaaattatcgcatcgattttttccataatgttccttttttcacttatttttattctcaatgaagagccaattttttttaatactttattttcattcaaatttagaattttgcctgccattgtttattttacattgacgaaaatgccgacactttgatcaaatcggatggatttttgcaaattgaccaaaaaatgttgtgcgaaattttggaacgcgacgaattgcaaatccgtgaagaaatttcaatgtggaatgcagtaaattttttttaatttaaaaatgttacaaatttatttttaaataagtccgaatctttttttaatcactaaattgttttgaataaaaaaataaaattttctcttcaatttccttactattttctcttctctgactcgtcgctgctaccatttttagcggcgggcagagaagagaaaaatagtaaggaaatttgagagaaaaacttctctcaatttaacttgatatttctaaattgtgtttaaaagcggaaattatcgcatcgattttttccataatgttccttttttcacttatttttattctcaatcaagagccaattttttttaatactttattttcattcaaatttagaattttgcctgccattgtttattttacattgacgaaaatgccgacactttgatcaaatcggatggatttttgcaaattgaccaaaaaatg

SEQ ID NO: 116165 - DNA, 1003 bp, Heterodera glycines
  Promoter: Source sequence=SeqID_9556; Location=179..1181; Strand=+; Gene=SeqID_71879
aatggtaaactctaaactgggaaggagattaaattttatgaaccgagaaattgttcgcatatatttcaaaaacaaatcaaattcaaaacataatttcataaaatattaaattaatatttcattaaaataaaataaaataaatttatgaaaataaagcattaaaaccccataaaacgagcatgcattagattcactttgatcgtataaaaattcataatgtgataattaaataatgacctcatttgacttttaaagttttaattgatttggcatattgttttttttgtgtgtctttcattttcatttgatgttttttttcactcttcgcccggacttaaatttgtgatgcggattgtgtgtggtaattttaatggtgcttttaattgttgtgttgtttaaatttaattgatttggattgctgtggctttaagtgatttaaaaagtcttccttctcattcttctccttcgccccgttttggaattcggcaaagagcaaaaaagaccccgacagtaaagggcaatttatttacgacgataataatttttaagtaaactttgtttttaagacatttttgatcaaatatctgaaaaatgcgaattaattttcaaattttgtacaattgcctaatttaattaatatttttttaaataaaatttaagtaaatacatttggctgatgcgacattgcggcgattaaacttgcggcgttacattttcggcgcagaattaaacggcgtctaaccaaatatatttttattttatccattcctccgtttaattatgtatgaactggacaaaatgttaagccattggtggtaaataaagaaagacaaaacaactttttcttaagaaaaaaattgttttatcggagatcaacatttaaattgttatttatttatttatttagcattttgctaacaacgtataaaacaacttgtttttaaaatttccgtcaatttttgaaaatttattttagcgggtaataattttatggagagagatg

SEQ ID NO: 116166 - DNA, 316 bp, Heterodera glycines
  Promoter: Source sequence=SeqID_565; Location=293..608; Strand=-; Gene=SeqID_56333
agaccatcgaaaggacgtgaccaaaacacacacaccatcccaaacagttctctatataactataagaaaaaagaaaaaccgttttctctgtattatgactctttgattttttcttttgtctgtcgtttattttgttttttctttttcgttcgataaacttggatggatgacttgggtgtaattatcttctaaattgtattgtttttatcatattttacaattttacccctattcaaatccaatttttgtctcctgtttcgggatttatgccattccttttactccaatgaaaaaaattgattgtcatccaccgatg

SEQ ID NO: 116167 - DNA, 403 bp, Heterodera glycines
  Promoter: Source sequence=SeqID_3663; Location=104..506; Strand=-; Gene=SeqID_51338
cctgaaaaaaacacaattatgtaaaataattaatagggctgcaaattataactaaatatttataaatatatttttcaaggggtttccatgcttaaaatagtagtaaaaaaacttttttttatctttttttttgtgtttacgaacaaagttttggacttttatttacatacttttttagctttccctgatttttctataatttaatcatgtaaatatattttacatattttggactgttacgcaatttttttgtatatatttttacaatttttaaggatttttttaaagaatttttctttaatatccaaaaaattcttcaaaattttcataatttcgtacaaactctaaataataaacaaattttttagtaaaataaaatttcaggagggggacctgttggatg

SEQ ID NO: 116168 - DNA, 252 bp, Heterodera glycines
  Promoter: Source sequence=SeqID_2015; Location=1686..1937; Strand=-; Gene=SeqID_77332
agacgcgtacaaatcgtcactggcatcccaggcgcgtttgcctacctagacgacggcataatcgcctcataaaagcttgaagagcacatttctttgctctacaagctcttcaaacaaattcaggaattttgcctcaaaatccaattggaaaggtgcaaattcatccaaccgggttgctttttctcggcccatttcatctccgtgaaaggaactcgccccgaccccggacgatcagaagcaattcgccaaatg

SEQ ID NO: 116169 - DNA, 108 bp, Heterodera glycines
  misc_feature (7)..(8): n is a, c, g, or t
  misc_feature (40)..(40): n is a, c, g, or t
  Promoter: Source sequence=SeqID_23420; Location=1..108; Strand=+; Gene=SeqID_54124
tccgccnncctccgccacttcccttccaccacatttttcncaaaatttgtgggactaccaaacaaatttatgcacattcatacatatgttaagtgctcaaaaagcatg

SEQ ID NO: 116170 - DNA, 1003 bp, Heterodera glycines
  Promoter: Source sequence=SeqID_10221; Location=4662..5664; Strand=-; Gene=SeqID_73365
aaattattaaaaggtaaaaaataagaaatattacataaaagaaatggtgaaggatacggtaaattaatgcgatttgatctttgttttttgataaaagtaaaactatttagaagtacaaacaaaaaataataattaaaaatcgaattttggtttttaaaaaagtattatttctttttgaaaaatggaataaaagggaaaaattactcatcgacttttcgtagggttcaaaattgactataatcctcgaaattgtttttataacaaaatcggcgctacttgtgctcattttcagcacaaaaaatcatcgattaagcaatgtcatattctaggcgttttcaagctcaatgcttcattaatttttctaataaaaatattttaaattttccaaaagcaaataattaattcaatatttttcggtaaatttacatcaattccaaaaatacattttgcagttaaaaggtcaattttcgaaaaaaaataatttattcaatatttttcggtaaatttacatcaattccaaaaatgcattttgcagttaaaaggtcaattttcgaaaaaaaattaaaaatttctttgcatatgtcctttaatttgcgtttaacgaataaaatataaaaacaaaacaaaattatatttgaaccgaatcaagacataaataaatccattgtcacattccattcttttttgacccattatttttgctgatgtcccatcggaatcattccgcaatcagatcaattgcaagggtaacggtgtcattcgcattgaaatccgtgccgtctttgacatcctgtttaattttgtttatttacgagtaacatggctgggaccggacccaaatagtcacttctttttttgacaagaattcgtaatttttttaccaatgaaaaatttagaaaaaaaaaattaaaagcaccaaaagtttaggatttcccataaactacaaacaatggattaaaatcgtattttacaaaaatcacagtgaaagagtaagaggccgatg

SEQ ID NO: 116171 - DNA, 93 bp, Heterodera glycines
  Promoter: Source sequence=SeqID_31720; Location=571..663; Strand=-; Gene=SeqID_46269
ggtggcccatcagacttcgtttttccaaattttaaaacaattctttcccaggcaattccctgctccatcgacgaacgcattgcctggctaatg

SEQ ID NO: 116172 - DNA, 241 bp, Heterodera glycines
  Promoter: Source sequence=SeqID_25932; Location=1384..1624; Strand=-; Gene=SeqID_56696
ggactttttaattcatttatcgcagatcaagtacagtactttcaagcatttaatgagttcggagtgtcagtcatttgtacgccttttaaggctgtgctcgtccttaacccgttaatccacgaagaggaaaagcgtcgttcggaattaaagaaaaggcgtcgtaaagaataccaagtgctgttcctaatgttactttatttttcaatgaaaatagaatgccgaacgtgccgagcgagcaatg

SEQ ID NO: 116173 - DNA, 70 bp, Heterodera glycines
  Promoter: Source sequence=SeqID_11542; Location=612..681; Strand=+; Gene=SeqID_46963
ttgcgctggtggccggagtcaaggttcactcttttcaatggattagtgcaaatccaacctttacacaatg

SEQ ID NO: 116174 - DNA, 235 bp, Heterodera glycines
  Promoter: Source sequence=SeqID_38631; Location=704..938; Strand=-; Gene=SeqID_67383
tcattacaaaatcaaaaaacaacgtggaaggagagaagccaaggctgaagataccaaagactcaaaaattgatgtcgcaaagagggccgcagaacgcgccgggagagacgtagaaagacattttaatcagatcaacaatatctcgaattccatccaaacccaactaaacacactaagagaaacaaatcctcaaattttagaagagcctgatataaaaatttggtttgacaaaatg

SEQ ID NO: 116175 - DNA, 232 bp, Heterodera glycines
  Promoter: Source sequence=SeqID_3661; Location=3343..3574; Strand=+; Gene=SeqID_51317
aaaataactcacaaataaatttaaaatagattgacacaaaattgaaaaatcactaagcacacttggaaatcctgacaacacatacatatgcttatgcatatgtaatttctttccctactcaataaaatatatttcgatttaattaataaattcttttttccaatttgataaaactaattgtaaaaaattattgttttttttctatttttttagattaatcaacatagctatg

SEQ ID NO: 116176 - DNA, 72 bp, Heterodera glycines
  Promoter: Source sequence=SeqID_5178; Location=1459..1530; Strand=-; Gene=SeqID_57170
tttttattgtgtgtgtgtgtgctgtttttgagtttgagtctgttatacgaataggaggcaatcgccgaaatg

SEQ ID NO: 116177 - DNA, 246 bp, Heterodera glycines
  Promoter: Source sequence=SeqID_4588; Location=918..1163; Strand=-; Gene=SeqID_54999
ttttatattgcttttgtagattatttgttctctttgattatcacaaaatgcttttttaaaggatggatgagttttctgttctgaaaaattcatcggttggtgttttatatttgctataaatttgattgttcgtttcgttaagggtgttggtcgtcgactgaacgatctccacgtttccatcttcaatttgttgcagcaatgggacaaagagaaccagaattgttgtgaacttttggaaagcatatg

SEQ ID NO: 116178 - DNA, 53 bp, Heterodera glycines
  Promoter: Source sequence=SeqID_30828; Location=82..134; Strand=+; Gene=SeqID_61226
ggttaaaactaataaaatttaaaccataaaataatattctttttagcggaatg

SEQ ID NO: 116179 - DNA, 299 bp, Heterodera glycines
  Promoter: Source sequence=SeqID_10637; Location=1..299; Strand=+; Gene=SeqID_73873
aaaagtaattaaaggagatactcgagagtctcagtttcgaatcgagaaaaaaaaattggcccaaaagcgctttatttgtatctgttacaaattgtcttaaaaacgatctatcggcactagggatagcattccgaggccccaaacattttcgaaaatcggaattccgagcccaaaaatgtcagaatcggaatttcatgccatccctgatcggcaccgccttccgaataatttggcaaattagtttcattaattatttctgtttgattaaggcactcgtcgctcgtgtgattgacaaaatg

SEQ ID NO: 116180 - DNA, 61 bp, Heterodera glycines
  Promoter: Source sequence=SeqID_15135; Location=832..892; Strand=+; Gene=SeqID_79325
agccacctggagcggccatatttgaagagaggcttaggcaagatccaattttgtattcatg

SEQ ID NO: 116181 - DNA, 126 bp, Heterodera glycines
  Promoter: Source sequence=SeqID_21914; Location=1360..1485; Strand=-; Gene=SeqID_52549
tccaatctctgggactcaacccaccagcaattcaatctctggggctcaattctccggcattccaaacaatgggactcaaatttcccgcattccaaacactgggactcaacccaccaactttcaatg

SEQ ID NO: 116182 - DNA, 214 bp, Heterodera glycines
  Promoter: Source sequence=SeqID_32687; Location=1..214; Strand=+; Gene=SeqID_62963
cgcagctgggaagcggaacaaacgcgcgggtattttattttccaaaattcccaattttcggtatcatataaaatgatttaattaattttaattttttttgtaaaattagagacatttaggcagtgttgaccgctatgggacttcaaccgttggcaatcatggcattattggcaccaaaattgatggcgactgtgccaatggaagcccaaaaatg

SEQ ID NO: 116183 - DNA, 167 bp, Heterodera glycines
  Promoter: Source sequence=SeqID_10498; Location=1612..1778; Strand=+; Gene=SeqID_73714
tttggaaaaggaagtcgaaaatgggcacggtgagaaaatggaaaaggaattaagaggaaatggaaaattaggaaaatttgaaaaaaagaattggcaaattgcataagataagggggattgggcaaaaagggaaaactttgtgaaaaattagtgaaaatgaaaaaatg

SEQ ID NO: 116184 - DNA, 768 bp, Heterodera glycines
  Promoter: Source sequence=SeqID_6182; Location=3953..4720; Strand=+; Gene=SeqID_60629
tgtcgcgacgactctgtgttgaaaacagtgcaaattaggcacggcgatagttacttaacgatactaattgcgtcaattaaatctaattgggggcaaaaggactccttttcctaacattttaaatagaaaagaatttagtaaattttaaagaaattcaaaaaaatttaaggatttaaatccatgtagatcttaaaaccttaactaacaagtttgaaaacaatttaaaatcactcagccgttcccttgtaaaaaaaaaatatttaaaaatttaaatttttcaagaagtagagaaaatcaactcgttttaaagagattaattttaaaaaatcaaaaaatttttaaaaccaaaatttttttaataatttaaaaaacctagaaattttgaagaaaaaaattctaatttttcatttcgaatttttttttgttgaagaacatcaaaatttgcaattcttagaattttactatcgtgggggaacaacaattaatgaatttgaaagcatttggccaaatttgtgggccaaccagggctgcacgcaattacggattacggattgcggattacggaaattacgggttttgggagttacggattacgggttacggatttttgggatttttccgtaattttgatccgtaatttgatttttggattattttttcgagacgatttcttgtaagattatttttataaaacaaatttttctattttttatttaaagaaaatatgttcatttctttaaattcttatttctttagcaatttaaaatg

SEQ ID NO: 116185 - DNA, 131 bp, Heterodera glycines
  Promoter: Source sequence=SeqID_43397; Location=1004..1134; Strand=-; Gene=SeqID_71069
acatttccaaaaaaaaagcagaaaatgatagtacagatgatgataatgctgatgatgataatgatgattatgagtatgatgacaacaaacaaagttatgaagggaattcagaaaattcggattatgaaatg

SEQ ID NO: 116186 - DNA, 413 bp, Heterodera glycines
  Promoter: Source sequence=SeqID_2997; Location=1061..1473; Strand=-; Gene=SeqID_82705
tcgatttggtggtgatttggctaaacacagccactcataaaaatttgtaaaaattaattttttcaataaaatttggtttcaattaattatttacatactttttggggtaataaaaaataatgatcaaatttgaaattgattcacggctcattggaataattatcttataaattcctagcatttttttgcaattttgtgtattaatggtccacaatttttttatattaattgattcaatcaaacaaaaattacgcataattaatttcatattaaaatttcattaaaaatttagatctaaatccttctcgtatcagctgaaaatgtcctaattacccattttgtccatcctcaaaactcccatacaattaacctcattaccgacgtctttcatcacataacgacaaaaaaaaatg

SEQ ID NO: 116187 - DNA, 110 bp, Heterodera glycines
  Promoter: Source sequence=SeqID_31000; Location=278..387; Strand=+; Gene=SeqID_61355
agttgctgaaggcgacatttaatttgtaatgtgaggacaagccctttttcccctactactacaacaagaaagaaaattatggagttcgattacaacatctgccaacaatg

SEQ ID NO: 116188 - DNA, 144 bp, Heterodera glycines
  Promoter: Source sequence=SeqID_12493; Location=1..144; Strand=+; Gene=SeqID_76129
ccacaactcttttttaaagaatttttttatgaatataaatttaaaacagattttcatttattcattttttgaaaataatttttttttattaaaaaaaccttttcaaggagtcgaaaattaaatgcagttggctgtataaaaatg

SEQ ID NO: 116189 - DNA, 86 bp, Heterodera glycines
  Promoter: Source sequence=SeqID_14737; Location=1..86; Strand=+; Gene= SeqID_78867
ccaaaggccaaaactggaagggaattcgtggcaattcattttcccccccccccccccccccgcccatccatttaaaagctctgatg

SEQ ID NO: 116190 - DNA, 209 bp, Heterodera glycines
  Promoter: Source sequence=SeqID_22995; Location=1..209; Strand=+; Gene=SeqID_53697
ggggggggggcataacgaaaaagtttcgaaaattccttaaaaaaaactttaaaaaatgatggaagtaagcaggaaaaattcagtgtcccgagagattccatatgatttttctggaattttattaaaaattttaaatcttttttgagcatgaaaaaaccgaaattttttgaatttccataaaaattcagccctttcaaatcgtccggatg

SEQ ID NO: 116191 - DNA, 1003 bp, Heterodera glycines
  Promoter: Source sequence=SeqID_5985; Location=476..1478; Strand=+; Gene=SeqID_59930
gatttttatttgtttttatttaaaaaaaaataaaaagttaaaagctaaattaaattaatataattttcaaatcaaattttcttcaattagttcaaataatttatcaattttggactaaatcatcgaatattaatagaagttcagatttacttttcatatcacttttttcggcgcgctttttccaaaaaacttttccggagcaagggcggtccggcggtgccgatacccgccgacggggaaaatttgaaagtttgagtgtaatttgttaacagatttccaacaaaaaaggcaggtttttgggggagaggtccggcggagccgataggagccgccggggaaatttttgtaatttttaattcgatttgttaacaattttgtccaaaaatggacaaatttttaaataatttatatttaaaacaatcgcttcaataaaaattttctttttaaaatcttataaaaattgccgcggattcacaaatcccgcggatcgcgcatcgcgtatttaaaatcccgcagtcgcggatcgcggaaaaaaatgccgcgaatcgcggatcgcggtcgcgctccacccctgcttgcatacttttcataatattttttggtttttccttttccttatctttttttcaaatttcgaatttgccttttttcgcaataataccacaaaattataccgactttttccgcttttgtaattttttttggcaatttttatgatttttgaatccactttttgatgattctcgtctgtttttacatttggattttgagttcaactttctcttccactactccgacgagtacttcgaccaccaccaataaattgtcctctacgcctcccgcggaaatcaaaaataaattgcaatgtttggcatggaatatttgcaatttgttagtttatttctaatttgaaagttaaaatttatcattttcaaggagcacgaaattgaagcagtcaaaggtttcgcgacgatttgcaattagtcaaaactgcgaggaaatg

SEQ ID NO: 116192 - DNA, 937 bp, Heterodera glycines
  Promoter: Source sequence=SeqID_15930; Location=721..1657; Strand=+; Gene=SeqID_80282
tatttaaatttacttaaactaaatattaaaaaataaaatttatttttaataaataagaaaagttttcgtcacgtgcattatataagtaatttttgtgatttgcaaaaattgtgttttctaaaaattcgatttggaggcatttcatatttgcattaaatgatcttactttcttaaaattgagttaacaatttttatttatttccaaattattttatttatttattaggaatatgcatcaattatggaaaactaaaataaataatcatatttgtcgtttaatttagcttatattgtttgcatttgttttaattctttttccatttcatgttgaattttttcatttcaatttataaaatagaatatgttttatttatgatctaaaaagtactttttagataagatttttcttagtagaaaaaatgctaaataattgtttaatcaaaaatcattaaatttatatttcctaatattttagttttacgattttaaaatttcatttccataaaacattttctttgtagtttactattcgcttcgttcggaaaattattttaacttaggattttctattatttcttaaaataagttttgcagtttaatcatttaactattttttaataatttaatttttacagtgatttattattataaattaaaaaacattttttttgtctaatatttttattttaaattttctttgttttattttaaattttcatttctttgtttattttcatgagaatacaataaaacatgtagcatgtgtgatttatgaataaaacatttagcaaaaatttgtggtaaataattttatttatttataatttaatttaattaatattgaaaatttataaacatagaattgttttgatttgctgaattggtgctactatattcaaatttctttgttgttacagtataatttttatttaaaatg

SEQ ID NO: 116193 - DNA, 507 bp, Heterodera glycines
  Promoter: Source sequence=SeqID_21337; Location=1..507; Strand=+; Gene=SeqID_51937
ttgctgtgttatttttccattgctaaaacatgtgtcatttcttttcacattctttttgaatttaaaaaaagcattggctaaaaaggaaatgttatttttcatgctttttgaaataaaaaatttgtcattctgatacatttcctcgtgaattatttaatgaattatcgtgttttaaaatttcaattttaattgataaatattattatttaagcggttttaaaaaaagaatttttcattcctttttcggtgaaaaagcccattttacgtaaggctatttttaggagcacaatttcgagaaaccctagctgcttttgttaagttgcttttcgagttcaaatctaccactaaaaatttttatataaaagtttttgttacaaataatttagaatttttcaataaaaacagccaaaaaaatgttcagaatattaaaccaattagttcatccttgtaaatattaataattttcactaaattagttcatatttttgtatttttagactttaaatg

SEQ ID NO: 116194 - DNA, 98 bp, Heterodera glycines
  Promoter: Source sequence=SeqID_17852; Location=1134..1231; Strand=+; Gene=SeqID_82388
ggaggggggcggggggcgaacggaggacgatcattcatcggcatattgcccgacatttttattgttttaattttagaattctcgacgagcgtgagatg

SEQ ID NO: 116195 - DNA, 1003 bp, Heterodera glycines
  Promoter: Source sequence=SeqID_2810; Location=404..1406; Strand=+; Gene=SeqID_81730
ctttcggtcatcgatttgctgataatttgcccaattactttacttcgtccgcctctctctctctctctttttggcatcggacggaacagtcaaagggtctctcagaacgacacttttttatggctacaggacatcagccaatttcttaactttgctcaggtaataatgagcaatgaatgagtgctgtctgatgagatccccaattagcagttaattagtctctttagtcttcctaatttagtaagtactcaatgaatgcgctttctttggttgccattaattacatttattcctgctcatccaaacgccaattattgcaatttgtgtagagcggcaaaaagaaagtgttgtgatcactccactggaattataaccgatgctaatttatcaagcttatcagtggttagagtttaacagaatttgcaaaacaattggcaatttcattgttgtccgtttgcttccacttttcttctcacttttttgtgcttttccatcgatggcattttcaatttgattcattttttgccattttcccttttctcgcactttttcctctcttaagttggtctttgatcgcatctgttggatggcaaatcaatcaccccattgaatgagctttaatgcggcggcgggcggcggaatgatgaattataattatttaccatcggtgggatgggatggttttgctggtcactctccccccccctatcccttcgtctcccgttctttcccccattctccgcctcgtcctcctccgtctgttccttcctttcgctgattgatcattcatttgtcatttgtgtggccaatcaaagaaaaaaaagtcattcaaagcgaaaaacgaaaggattctttttcattttacacattttcatattcgcaagttcaaattccttctttccttctgttgcattttatttattcaccttaaagaaaatccgccaaattaacaaattaatttataatgccaacagaaaatttgccgcccgaaaatgacacaatg

SEQ ID NO: 116196 - DNA, 140 bp, Heterodera glycines
  misc_feature (35)..(36): n is a, c, g, or t
  Promoter: Source sequence=SeqID_15014; Location=731..870; Strand=-; Gene=SeqID_79169
tcatcaatgcgatgtacggatttatgtggatatgnngggaaaagttcaattcgacggagcgaccaaaaaattacaaagtgatcatcggcagcgaaaattgttcaaacaacgacggcactcatttcaaattcattcgtatg

SEQ ID NO: 116197 - DNA, 284 bp, Heterodera glycines
  Promoter: Source sequence=SeqID_5469; Location=1..284; Strand=+; Gene= SeqID_58169
tttttattgaaaatatgtttattattttcgaatgagctctagtagaaagtaataaaattttatttaatcattaatttaccaattggcaattattttgtcattaagataaaattattattattattatttctttgaaattaaacaggatttccttattttattaagtaaaataatgatttattcagttttgtaatcagaaaaaaaatcatttaaatgcctcaaaaaatgaattgccatttaattgaagaaaaataaaataaaatcatttcgagacgacaaaaatg

SEQ ID NO: 116198 - DNA, 1003 bp, Heterodera glycines
  Promoter: Source sequence=SeqID_11135; Location=317..1319; Strand=-; Gene=SeqID_74476
attttttttcaattttcctatattcttttttttatcaatttatatgtacactttcgtgttaccagaggcacaaaaataacggaccagaccgttttcgtacgagcacatgttttttgactataacttttttctttgtcaaccaaatcccaatattgttggtatcattcgaaagctctttagatgctctattagcctgcaaaattccaagaaaattttgttcagtttaaaaaaaagttcgagccaaaaaagttggaaaatctggtttttttgaattcttctgaccataacttttttgaaccttgacaaaattttttgaaattttgcaggctaatagaggatacatagggctatcgaatgacaccaacaatgttggatttggtcgataaataaaaaagttatagccaaaaacttgtgctcgtacgacatcggcccgtacgaaaacgaccctgcccccaaaaacaacgcaaaaatatcaaaaaaatttgccaaaataaaaaaaactcccgtgatcagtaaaatttttttggacataatatatatttacacaaacaatctcatcctcaaaataaaacagcagttgtttctgttcaacatgctaagctttatgaaaacaaaattttttatttttttttgctgaattttctttttgaaatctgttcattatttcgttacattttttttttgttaaacataaacaaaaaaaatttgttattttaggtccacaactgttgttgctgaactgaacgacaacaattagggtatgttgatcgtggccaaattttgttgattgtttatggccacaaaagagcttcgagcaaattctttgatggaaaatgttgtttactcaaatgaactctcgtaaaatttggcctatataaaaatggccaatgaataataaaatagtcaattttatataaataataaaagaatttttattttaaatattttaatttttattttaaataaaatatttaaatttaagaaaaaccaattcttttaaatg

SEQ ID NO: 116199 - DNA, 1003 bp, Heterodera glycines
  Promoter: Source sequence=SeqID_14495; Location=1080..2082; Strand=+; Gene=SeqID_78540
ttggagcggcaacttcaaagggaaacagccccacatggtcgggattttgcgggtgaaaatcccgaggcggtaacttcaaaggaaaacaaccctccaataggttagggattttggaggggtccttccgttacccggacggtttcagggtcatatactattggcgcctcaatcgtcacctaaatcgtgctaaaattaaaatctactaaaattcctaatccaagttttgcacctgtgatgacttttttcaatctgcattagctctgttcgatccgtgtatatggcgaaaatacgagggagagaaagtctgggaaaatggaaaaaaaggcgaagggcaaaaaagcaaaataaaaatgttatcggccgattggcctttgctttaaagaattgtcaatttgctctttcaatttttgagccaattgctgaaatattgggtgactaattttcctatgtcaaaatttgtcccttttattctgctccttttcttcgtgtgctcttacgcatttttttgactattaaaattttctcattttacattttcttcacttcacttcttttcttggactcaatcgaataaagcgcggttacacctaaggatatgcgagaaatgagttttcccgagaatcaagaaacgagagcgagaaatgaccccgagaaacgagactgagaagcgaaaaacccgagagatttctcgagtcgcgaatcgagactctcgcacatccctagttttcccacatttgcgcctcggacatttgcgcctatgtccaaaatcgggttcaaactgaagttttttcaatccatgatagcctaaatagcattaaatgatagaaagtgattgtatccgttaaactgataattttcgaaaaaatcatcaattatccaaacaacagaattactgctcctacataataaactaaaagactgtttttttaaatttcaattctgtttcggctatcagacagggtttgaaaaagtttttttgccacatttaaaaaatttcaagatg

SEQ ID NO: 116200 - DNA, 1003 bp, Heterodera glycines
  Promoter: Source sequence=SeqID_16511; Location=804..1806; Strand=+; Gene=SeqID_80917
ctaccgaattagccaggctctaatgcagtttacgcgtccaatcgacttttaggcgtccaatcaatgaccaacctcggtttcttaatttttacttaaattataaaatttataaaatgtttgtttttttattttatttatgtttattaatttattttagtgtttttttctttggaaaaatggacgaataaaaaaaataaacataacaaaacattaccatcatcatcatgatttgtgcagaatcagccaataatgggaaataatcatatgatagtgcccaaacagtaattaattcataatttattgaattttattggtgttttatgaatttcatcatcattatcttgtaaatcatccttacggaaaataatcttgtgattttttgcattttttatttttatgattaaaaataattaaatgggccggaaattgtttgaaattgcaaaattagttgttaaaatttgcatcatccacacttaatccatgacgaaattagtaagggcaaacaaataaaatggcatatttaagctgagaattttgtaataattttaacttaatgaaattcaaaaaaactaataattatttttttttaattttaaaataaaatttttaaaattcagaccattcatttaattataagaaaatattacagcaaaacattttatgattttgacaatatttatttccataagcataaataatcactatttagcaaaatcaagtttaaaataaataaataattcaattaataatttaattgttcaccttaaatgtcaacattttacattccttcaattctcttttacggatttatttggcattttgccaatattttgctttgttcggcaccaaatccaatgaacaattttgcaattaataaaggttatgaaaatgtgatttttataaattaaatttctaatttaaaggctcaccattttttggccaatcgccaaaatttcactttcaattaaaatcggaggaacaaaaaaatcattcaaaaacgatg

SEQ ID NO: 116201 - DNA, 319 bp, Heterodera glycines
  Promoter: Source sequence=SeqID_20193; Location=243..561; Strand=+; Gene=SeqID_84991
ttgatcgttgttgatgatcaggaaattttgaagaaggaaaaaaaaaattaattgtataaattgcaagtataagaattaaaattaaaaagtcaaattattaatttccttgaatatataaaaattaaataaaagagaaataaaattttttattataattggaaaacaacattatacataaacaagatggataaattttataaaaaaataacaattttaaataggaaaataagaattgataaaaaatcaaaaattaaaatgaattttaatttttcatttatctgagtcagaaaaccctttaaccccgcttatttaaattatg

SEQ ID NO: 116202 - DNA, 475 bp, Heterodera glycines
  Promoter: Source sequence=SeqID_901; Location=10983..11457; Strand=+; Gene=SeqID_63559
cgtggggctgcgctaattggcaagggaagtgccacgaattacaaaaaattcgcgggactcagctctgggaccaaaggaagcgctacggattacagaaaatccgaagggcaaccttccgggttcaaatcctaccgtcccctgtttttcccttttttgccctgcccaaatctcaaaatttcctcttcccccaatttactcactaatcccaaatgctcctgtgcgcaatgtctgttcggccgctttttgtccacgcacggtccgttgaagtgccagggtcgccacttgacgcagatgggggaggggtctgcgccgatttgtccgtttttcgctgccgccaattgcccaaatttgccgcccaagaaattgcaccaaaatattccacaagtttatggctcaaacttgggtaattaaacccatacataagaaatgtgtgagaaatacaatggggggaaattgtgacaatggggacaaaatg

SEQ ID NO: 116203 - DNA, 607 bp, Heterodera glycines
  Promoter: Source sequence=SeqID_14154; Location=1603..2209; Strand=-; Gene=SeqID_78155
tcactacatagggagactacttcaattatcgattgattggcttcgcagctttttttctctagctttttttttctcttgcctatatgtagtctctaaccgcaattaatttttatttatttttgaaatattttttaaatatttaaatattttgattatttttatttattttttaaatttaaattttattaaattaaaagaaaaattcaaaaacggtggaatcgaacctttggttcggccgaagccttaaccactcggccatgtagcactggggaaaaaggaagttaaatttgtttatgtttgttacccgataaacggtgagaattgaatgaaaggaaatagtatgtctttcatagaaaaaaaggatggaaaagcggccattatttttgtaacattctttattttcagcaaataaatttttatttttaaataattttattcgcaactaaaaaaatgttttttgttcgatggaggcggagtgtctccctgtccaaacaattttcttctgctgctaaagcattcgcacatttcacttttaaaattgcaggtgttaacccaataaatttcatttcttattcaatttaagtttttattttttatagaaaaaatg

SEQ ID NO: 116204 - DNA, 144 bp, Heterodera glycines
  Promoter: Source sequence=SeqID_38732; Location=987..1130; Strand=-; Gene=SeqID_67460
aagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 116205 - DNA, 73 bp, Heterodera glycines
  Promoter: Source sequence=SeqID_7738; Location=2552..2624; Strand=-; Gene=SeqID_65788
ggtaaattatccattaactaaaatttggtcgtcaatcatttaatgtttcaacgtttaagccattacatctatg

SEQ ID NO: 116206 - DNA, 91 bp, Heterodera glycines
  Promoter: Source sequence=SeqID_12196; Location=2618..2708; Strand=-; Gene=SeqID_75773
ttgagcgatacagattttcaccaaaaaatgaactattttgtgatttagagcaaattttcttatagaaaattacagaattaaaatcccgatg

SEQ ID NO: 116207 - DNA, 361 bp, Heterodera glycines
  Promoter: Source sequence=SeqID_44920; Location=642..1002; Strand=+; Gene=SeqID_72321
ggttttttggactaaacaccgggactgggatcgctccccggtccattttccaagtcccgccaattaggaccgcgactgagtttacgctattaatctcgggcttgagaatggtgataaaaagaaaatagctcgggtttgattcctcttccggaaattatttcttcttttttttgtatgacaaataaaattctaatctttattaaataaagtgcatgcaaatgctgtctgtgcgtacaattataaagtaaaccgaaattttcaaaaaaaaaaaatcaacagtttaaacaaataataatctcgactgaatgtgtttgttcccctgacattttgattattgaaagactgaaaattttctaacatg

SEQ ID NO: 116208 - DNA, 247 bp, Heterodera glycines
  Promoter: Source sequence=SeqID_17943; Location=1..247; Strand=+; Gene=SeqID_82500
caacagaatcaaagtgcactaggccatcaaatacctcgactggtactcccacatcaacaatgtcaacatccaaactgctcactcccggtacggcgaatatgtgtttaagcgtgaagggcaggtataccaagtggacggctacatcaaaggggaaaatgggaggcgggacaaaataatcgaggtgaatggttgtctgtggcacgggtgcgaggagtgttttgaggacttggacgacgaaacgaaaatg

SEQ ID NO: 116209 - DNA, 173 bp, Heterodera glycines
  Promoter: Source sequence=SeqID_17546; Location=2025..2197; Strand=-; Gene=SeqID_82056
ttttgacaaaaattggtaaaatgattctgggtttttggcaggcaaaatgttttggcttttagtgggcgtgtctaaaaccgtgactcttttcaaatggtgtaggcgtggccacacttttgcgcatataaaagtaaaatttttcaacctcattccaatttcattctcctgccatg

SEQ ID NO: 116210 - DNA, 803 bp, Heterodera glycines
  Promoter: Source sequence=SeqID_10098; Location=263..1065; Strand=-; Gene=SeqID_73177
aattttaaattttcgcataaacaacaaaactttggccatgattaaacccgattaaatgagaaaaaaccggaattttttgggataaatattaatttgtaaaatattgataaaagtcaattttcgaattattctatcctttctctattagtctcctattatattttttaaattattcgacaaaaatattgaatttttttttaaattaattttttcttcctttttttaaaccacactctcttagtaggggaaaacggggagcaaaaattgtttccttctaatggatgatgatgatgatgatgaaagtggcaaatatttaattgatccttttcattaggatttggtgcaaaataaaaattgaaaatattcattatttatttatttttttatttatttatttttgcaatatttaaacagttggaaaatttagcaaaaattttaaccccaaagggacggatctcacaataaagaattcttttaacgaaaatgttcacagttttcctctaccaatataaggaaaaattaaaataaaaatgaaaaataatcgctttttaatagtcccggagccctaggatttatttctaatttttaaaaataaaatcgtcccattcataaaatacaaaagtggaaattctaaaatgggaagggtaatcttggcacaaaattcaatgctttttaatttctcatcgaatttaaataaaatgaactgaagacatgtaaactattagcctccaagataaatttttgagttaattttaatattttaaaataatttttcaattttttcatagtccgcggtgaaaatg

SEQ ID NO: 116211 - DNA, 1003 bp, Heterodera glycines
  Promoter: Source sequence=SeqID_919; Location=4429..5431; Strand=+; Gene=SeqID_63999
taacccaagagaagacacgaccaaaattaagcggaattctgttgtcatagactgacgggatatttattcgaaaacttttcgttgttttttcctaatttttcatcaaattccctcaaattgcaccaaattgacttttctaatcagatgatgcccccaccccctgctggaaattccatctgatcatgccattccattggccattcattcattccttggccaatcacttctcggcttattcccccacccctttcacagatgaccgacgattggtgcgccggagaagcggtgacgattgcctttccgtccgatcagcagctccaaaattgtgtccttcggagggcacggctgagcttcttccagcgccaatggcaacgcatggagcaaaatcatttcgactttttgcgcagttttattcttttggttttccccgagggcgaattgccggcgggcgcaaagcgaaggctgacaaatttagtgggcccaaaattattcgacactttgtgggcccattccgcaaatctgctcagggacaaacaaagtcagtaatttaaagaccaaaaaatataaataaatttaaaaaatcaaatttaaattaaatctttgcctttttacttttaaattatcaccaaactttcaaaataatgagataaaaactccaatatttatttttcagttcattttaaaattgggaagaaaaaccacaaatttaaactgctaattgtttagtcgaatacatttcgaattaaaaaattattttccaaaaattcacacgcagaagaataattaataagtgaaaattttatgtgtgaaataaggttcggctttaacatttgtaagaaataacggaagaattaattttattaaaataaatatttttaatttttgatatttttacattttgtcagtgtttgacaatgacatcagtctgatgagtcattatttggtcgttctgtgcccatcgccgggtgctcacactttcgccgatcaattggcccacaaaatg

SEQ ID NO: 116212 - DNA, 201 bp, Heterodera glycines
  Promoter: Source sequence=SeqID_13234; Location=3478..3678; Strand=-; Gene=SeqID_77066
ccaatttttcaattaattaattagctaattaccatgcaattacggcatagtgaagttaattaaacaataattagacggaaaaacgatagcccaaattagcaaaaaaaaaaaatccaagctttacggtcaacttactgtacctatatgtattctaagttaatttgacgaaaatcccattataaggacaatcggcgatttatg

SEQ ID NO: 116213 - DNA, 1003 bp, Heterodera glycines
  Promoter: Source sequence=SeqID_3141; Location=749..1751; Strand=-; Gene=SeqID_83382
cgtaatgaaaatgtcaaaaaatgatgcggaaggctgtactaattgcttattaagaaaaaggcttttttaaatatgaaaagtcaatcaaccagaatcattagaggcaagaaaagtgtaaaaaagaataacatctgtctttgacaacgcgttagatttgattctaataaatatggatagttgaaaaacaaaatattaaagataaaaataaattttatggctaaatttttgaaaaaatttccatttcaatgggttgtatttttttttaatttttcgaccaactcttctgagttatttaggttatttattagtttttggcgtaaatgaaaaattttcattaaatcaaaaaatataactgctgtcgaagataacaaaaataatggtaattagaaaaagtttatgatgacatttagttctcaattaattaattggagcctttcttagattgttcaaatattggatatccaaaaaggattttttattacttacttctgcaaaagttaatcaaccatattcattagaagcaagcaatttgtaagaataacacctgtcggtgacaagcaaaacaaatattttaatgataaataacaccacccaagcagatggtttgcgtcaaataagtaattagttttctaattagggaaaactcctttaaagttagttccttgtaaaaaatacacgaaaaacaatttaagtaaaattgttttcctcatccaatgttaaaaagtaacggttaaatgtccataatttacaaataaagaggtataaaacacgaacaaaagtaacataaattagataaaataggaaaaaagagataatcgtcgataaatgcaatctatcccgatgactaaaaactgatcactaatataaaacaagaaatatacaatcagcgaaatatccttgtgattgtgccgaccatttacatgatctttttcttgtcgcgcaacgtcactcattttcattcatgattggcattcatgttcccctcgtgtacggtctcagcatg

SEQ ID NO: 116214 - DNA, 55 bp, Heterodera glycines
  Promoter: Source sequence=SeqID_129; Location=2818..2872; Strand=+; Gene=SeqID_46875
tcctgcgccttcgccacggaccgcaacacatcgctggccaacatcaagcgcaatg

SEQ ID NO: 116215 - DNA, 698 bp, Heterodera glycines
  Promoter: Source sequence=SeqID_2106; Location=1556..2253; Strand=-; Gene=SeqID_77880
ttgcctttgaagcaccttttgctgatgaaaatgacaatggtgcaaattatggtgggatgaaactgcagaagaagtgtcacatttttgtgcggggacgggtataaattaataattttaaataatgaatttcattcacattttaaaatatattttataataattttagtccatttattattttgggtgcactaagtcctcccaccacccgtaaaatattaaaaaattttcaacaaataaattttttataagaaaattagaaggaaaaaaaattatgaaaaatttaagcatttttgggaaaattttttgaaaaacattaaattttgaaaaatcactagatttttcaaaaattttcttataaaaattttacctatgtttttttttttgaaaaattttctaacttcgagattaaaaaaattcaggttggtgggggataacaaactgatcccatttattttaattgtatatatattttttatatcaataaaataaatgttgacactttctgatccaaaaagtcaaacaaaaaaagataaaacaaaatttgtttggcattttttggttacaaaatttgtttggcattttttggttacaaaaatttgtttggcattttttggttacaaaaatttgtttggcattttttggttacaaaaatttgtttggcatttttttagcacaagccgaacagcatgctgccgatg

SEQ ID NO: 116216 - DNA, 471 bp, Heterodera glycines
  misc_feature (36)..(36): n is a, c, g, or t
  Promoter: Source sequence=SeqID_33249; Location=1..471; Strand=+; Gene=SeqID_63369
ctgccaaattataaattttaaatcatttcaatattntgctcatacacactaaactacaaaaaatggatttgaaccttataaaatgccaaatttttatcaacttctagcttcagaattgcaaacaaaagacatatcaagattatttagtaataatctcattctttgccagcgaaaatttacgaaagcgaacaaaatacttaaaaaattcccaaattccgaaattcttttaatttaaaaaaaattacataaaattaaatgcatgccaaatatggttgaaatttaatatgaggatttttatgagtataaattttataaaaacttttcaatgaactttttgtttgattccaaaattttgcgggattattttcaaaaataaataatatatatattttatcatttttcaaatctcactttgatttcttcactaccctcatttatgattcaaatttttgtttagacactttccgaatg

SEQ ID NO: 116217 - DNA, 834 bp, Heterodera glycines
  Promoter: Source sequence=SeqID_437; Location=5845..6678; Strand=-; Gene=SeqID_52736
tattgcccaggaagagcaacagtccaaagtgcttggcaaattgatcccgacggcaaccgcttcaaaatggggcgagtgacagcaccccataatcatccacctatttttggccaacacaatgtattaaatatttaatttgtaatcgaaattatcctatagttagccgggatggaatttctatgtcaaacaatacactaaatgatatttaaaagcgaaaagacccaaaactaacaaagtgtttgtcttcagcgtataagccaaaaagtttttgggattgcctaaatagcccatccctgctgatcagataagggaggcgaatgaacgagttcgtgaagaagcgcgcagcgactttcctacgactagccgtaacattgtacgtgatgttcgatcagaaatgcaagtcgatgtccgaataaacgcaccgagtcccagcaacatgcgcagaaactacaacaacgccaagaaaaaacaccaagaagaagtttttgaatcacaaaatcttttcttagtcgatttaggcaggagatgttggtctcgatgcacagcccactgcccaaattgtcatcccggctgcattgcaaaatcgtgttattttaaaccagcccattgaaaataacagaatgattgtgtttgcgtctgcctttggccttgattcgcttaggcagttcaatgctgaagttgcaattgacggcacttttgatgtgagcttaagagattaaaatgtgatatgatttaaggcggggaattgtgttttggtgaatgttttatgagtatattttgtgttaattatttttaaagacagcgccaaggggatttgctcaattgtacacaatg

SEQ ID NO: 116218 - DNA, 1003 bp, Heterodera glycines
  Promoter: Source sequence=SeqID_19611; Location=1615..2617; Strand=-; Gene=SeqID_84352
ttatgtttttagttttaaatttataaattatttatttattttatctatttttattttgatattttgctttatttttaagtcattttatgaagtttttcggatccaagttggaatgaatgaccaatttgtccaaattcgtcttttcaggcatcttggacatgtcgtagtgagtaaggttgttgatcggtctgcagcaacacctttgctttggtgaatgctttttcaatttgtatttaaatattttggcatttttgataaatataacagtcaagacaaggcattcctattcctcccaagggaaatttgagaagaacttattcgtttgccaaattaaggactaaattgcaggctctatacacaaattactgaaaaatttgaatgaaatttttttgtagggaaccgcccactttgacgcaagccattttggctcaaaacgctatattatttttatttatcatccaaattaaataatctttggtatgattttgaatggcttcatggtgcttattagcctggaatgttttaaaaaacttagctgagacataaaaaagttgtggccaaaaaggtgctgcaacatttgcgcccctacatttgagccccgaacatttgcgccccaaacatttgcgccccgaacatttgcgcccctacattaattccttttgttgtcagacgaaatgaaattgcgtggagagtcgtagcccatgctggtgtctcatctgatttcgtttgtactcatcttcatcttcgattcgactaataaacttttaattgtttttctgtttaggttttatcttaaattaccttgccaaaggtggattttgatgaagctggattagaaacataacctacgatggaaagtaatcaaagattgaatgcgcttgtatatgtgcattatttctgagttacgattgaggtcgtgagatgtaaactttaggatcattgttttgatgtctctgccagagactatacaccggatttttttttggaaaaatcacacattatg

SEQ ID NO: 116219 - DNA, 223 bp, Heterodera glycines
  Promoter: Source sequence=SeqID_4886; Location=1..223; Strand=+; Gene= SeqID_56087
ttacttttgtatgttttttaatttactttataaatttaatattttaaaacaatttattgtttttttttttgtaatttatatttcaaatttttatagatatttgaggtgttgtataagttttgttatttaaaaattcttaacaattcaagtaataaagcaaatttacgaataattgcttaggaccaatgtcatggaaattcgtacaataggcagtcgtactatg

SEQ ID NO: 116220 - DNA, 52 bp, Heterodera glycines
  Promoter: Source sequence=SeqID_24531; Location=1..52; Strand=+; Gene= SeqID_55255
ggatgtagtgttggtcgaggagaatgacactcctcgatccgtctggacaatg

SEQ ID NO: 116221 - DNA, 1003 bp, Heterodera glycines
  Promoter: Source sequence=SeqID_1352; Location=5508..6510; Strand=-; Gene=SeqID_72983
aaccgggaaaaacccgggaatttcccggtaccggtcaaaatttgtcaaaaccgggactgggtactcagttgtacccgttttttcagtaccagtcccggtctcgctcaactctaatttacataaagaaatttttaaacaatttaaaatattttcacttgaaaaataggtaattcaaagtaaaaattttttaaaaatcaattttttccttaaaatttttttcccgtttcccggcgggattcccgttaattgacggggtttgggtgccgttgacgtcatacgggaacagttcggcatgggcgaggaatgcgatggcgagcagtgtggtgcctagaaagtcgctcagcgcggtcagcaatggaattgtttcacgttcaggtcccagcgaaggcgccacaagttcggggtagctgatcactccatttcgacctatttcaaatccctgacacgaattcgaacaaaagtcgaaattcttactcttgtccctaaatgaccaaaaaatgggtcattgaaaagatgcatttacatagtcttataaaattagatgcaacaaaaataaatgttttttaacgaacagatttaaagcaacgagaataaataaattaattaatggattttttcaatttgacaaatcggtcatcgcgagaaggaatgggcaacgagctaatggtttaaatttgaatttcacaattattttttgaataatatttttataaatttaagttttttaactaatttttatagaaactcacatcccattttacttaatagttatttgtggaaaatatcagtcctaacctatggctcggtgatttttgttgagctatgggagttaagaattgaattcgataaattcgggttcatataaggtattgtaccggaacaccaacacaattatagggcaaaattgctattgttaatgtaaaatttcttaaagtaaaactccgtatcctttttatactctccatgagaaataacgattaaaaaacgaataggtgaaaaaatg

SEQ ID NO: 116222 - DNA, 325 bp, Heterodera glycines
  Promoter: Source sequence=SeqID_8612; Location=1..325; Strand=+; Gene= SeqID_68677
cggaggaaggaaaagcggaggaaaaaggaagccaaaagcacgccggaggaaggaaaaagcggaggaaaagggaaagccaaagggacgacggaggaaggaaaagcggaggaaaaaggaagggccaaacagcgaagaatcggctgaagaaagtgtgatggaagaaagtacaacaataaggacgacaatggaggaagaaaaactattgggggaggaggaacagagcaattcaaagcggacaacgaccaaaagagcgacagcgaaaggggcaaatttgaaacggaaagtgcccccggggctaaagcataacagacgaagggtcacaatg

SEQ ID NO: 116223 - DNA, 75 bp, Heterodera glycines
  Promoter: Source sequence=SeqID_29342; Location=638..712; Strand=+; Gene=SeqID_59855
tggccaagacgtccagctaaatgcaatgcaaatgtttttgcgtttataccgcaaaaaagtgggataaaggacatg

SEQ ID NO: 116224 - DNA, 478 bp, Heterodera glycines
  Promoter: Source sequence=SeqID_1891; Location=3172..3649; Strand=+; Gene=SeqID_76598
aatggttttgttcgcgcagagaatacgccgaaattccgttggcacaaaaccaagcgaatatttcacgggcaattgacacataaaaagcgattgaagaattaaaaggtgtggccttcgaacggagaacattttgttggaaagggcaaatcttttgcttctctttctgttgccgaaaggcgtcactgatccgaatttgtatttgcccttaaacgggtgattttcccaaattgggcgagtgaatgtgcgcataattatgtctgtcatttcttcgttattcttttttcctcaattataaattttggtgctcgtttcccatttccttttgcctattattaacagtttgatccgttttgcatttgtattttcttctttctcttttttccgtttccccttttacttttaattgctttgccaattagcgcggttaatgaactcaattggttgcccttcctcctccaatggtccttcctccgctatg

SEQ ID NO: 116225 - DNA, 627 bp, Heterodera glycines
  Promoter: Source sequence=SeqID_15294; Location=1314..1940; Strand=+; Gene=SeqID_79519
atatttgatttttggcgtttaaatttattttaattatattgtcccttcataattttgtctctttgtctgtgattgtactctctcgcctatcgatatttgccactcccttcccagcagaatatgttcccccatcttgccttcagttcattctgttggcagtgcactttcatatttgtattttgttcttattttcctccgactcttctcccattttattgttgcggttttaaataaagtgatttgtctccgtcttggaaatatttgtggaggagaagcagtgtattagcccgacccgaaaagcattatttagcacgtggcgctcctggcgaagagttagctgtgccggcattgtgggatttttgactgctgagtagaagccgattcgagaagcgtccagaacaaacgcattgttgcggttctgcaattttcttcgttgcggacagaacatacgcattgctgcggttctgatatttaacgcattgttgcgattcgtcaattttggtaccactgttaacgcattgctgcgataagtgaggattggcgccgacgtatttaacgcattgttgcgaatttgtggactggaacgccgaattttgtgagtcttggattgccactgcggaagaaatg

SEQ ID NO: 116226 - DNA, 166 bp, Heterodera glycines
  Promoter: Source sequence=SeqID_6551; Location=2898..3063; Strand=-; Gene=SeqID_61984
ctgactgtgacgaaatcacattgggatgacaataaattgattttatacttttaaaaatctaataattcatttcgagcgattttattagtgaataagcaaaattaaacacatcattttgaaaaagcaaaattaaacatacaatttagaaaaattcctaatagttatg

SEQ ID NO: 116227 - DNA, 152 bp, Heterodera glycines
  Promoter: Source sequence=SeqID_6157; Location=590..741; Strand=-; Gene=SeqID_60534
cattttttaggctgcccaagagttgcgttccatcaaagacccattgaagacgaagacacgcactcgcgacttgctgttttctatgggcgttagcaaagcgagggtactttttctttttaaagttctttaatttactattgttcagatcgatg

SEQ ID NO: 116228 - DNA, 408 bp, Heterodera glycines
  Promoter: Source sequence=SeqID_3215; Location=3886..4293; Strand=-; Gene=SeqID_47557
aattttgtttttcttaattgattgaattttcaaaaaattttctcaagctctgctttttctgttgtttttgttcattctccattcttttttttaaatttccgccaaatccgcatttattcttactgtaatagaaaaagaaagaaggacaaaacagccaattgggaattgacagcagactctgtgacgcggcggtctacgctcgcttctttctccaaaaagcattcattttatttttgttgaaaggaaagccgttaacacgagatgatgagaagagaagggggtctccataatttttttttattgcaaatggcaatcgattcacttaaaagtttatcgaaaaagaaacccaaactgtttttcttattcattttagaagaatttctcaaccatcataggaccgaatagatg

SEQ ID NO: 116229 - DNA, 75 bp, Heterodera glycines
  Promoter: Source sequence=SeqID_12059; Location=1280..1354; Strand=-; Gene=SeqID_75588
aataattacatttagactaatttacataattttcttttgattgaagccgcatttgtcgcaacaaatattaatatg

SEQ ID NO: 116230 - DNA, 136 bp, Heterodera glycines
  Promoter: Source sequence=SeqID_36078; Location=804..939; Strand=-; Gene=SeqID_65503
ttcttaaatatatataattaatttatttatagaaatcggctgttattcgatgagtgtggaaatgggcaatttttctcatttttgggcacctctaggcaattttgcagaaattgattgtgtgcaaggcgcaaaaatg

SEQ ID NO: 116231 - DNA, 328 bp, Heterodera glycines
  Promoter: Source sequence=SeqID_607; Location=2396..2723; Strand=-; Gene=SeqID_57483
attggcccggaaacgcaacggtgcactcgccaatttggtggagagggcgcagaaagcgcgggacgcggatttgccctccttttttgacgacctttacgacctcggggcggcgggggacactccgtcacagaggtcgttggccttagattgaactcttattttgtccatttgatttcttaatgccaatgaatgctttttacctttagttcgtccggctcagacgaccaatttaaccaaattgtcggttcatcggacagttgcgaaaatcagacgaaaatcgctgaaggcggagggaagaaaaaaccgcgcagagtccgcacttaccatg

SEQ ID NO: 116232 - DNA, 204 bp, Heterodera glycines
  misc_feature (7)..(7): n is a, c, g, or t
  Promoter: Source sequence=SeqID_4642; Location=2638..2841; Strand=-; Gene=SeqID_55207
ccaaacntcatcggagcaacttcagccagtcggcatttaactcaaccaattgtttgtcatccctactgattagcttttagctttcagtagaagttatagcgctgctaataatttgtctaggcgacatttattagctcatccacgcgcacccactcaatttgtatctaggcgctgcaaataaaagagtggagaacgacaaaaatg

SEQ ID NO: 116233 - DNA, 85 bp, Heterodera glycines
  Promoter: Source sequence=SeqID_43882; Location=640..724; Strand=-; Gene=SeqID_71458
agtagacaaaagaaagcccaatgttacgtaaatcattctctttttttttgcttctcagctccaaaaccatttcgccaagcatatg

SEQ ID NO: 116234 - DNA, 433 bp, Heterodera glycines
  Promoter: Source sequence=SeqID_25517; Location=1..433; Strand=+; Gene=SeqID_56262
tcaaccgccggtggtcgtcgctgtttttcgtcgccgtccttgtcctcatcataccacgctagggcgaactttacgacttgtaagcattttggagaattggcgtattttttggtcactattctttccttcctacccttatcgtttccaccgaaatttttcatgaaaaaatttcaaattgaaattttatagaaaacatgaaaaaaaattttttttttttttttgcgattttttggaaattttttttttttttgtaaaactaaataattttcatcacaaacactatttttttcttaaaaatttcgagtatggaggaggggctcttctgggtgggagcggtgactatgcaaaaaacaaaacaaaaaaaacggtcaaaaggaaaaaaaatttttttaaattttatttgtcccattttcagcctcaacctttgcaaatg

SEQ ID NO: 116235 - DNA, 571 bp, Heterodera glycines
  Promoter: Source sequence=SeqID_29514; Location=402..972; Strand=-; Gene=SeqID_60007
ggtaaaagtcaaagcaattaaaaaataattttttaggaaaagagttctcccggaagcatacaaactcgtcaaggcaaaaatactcaaggatttagatgattgcgaattttcaaaatttgattttattgacgcgattacatttttgattttcaactcaataaatttgcttaaaaattatcccccccccccccagtagtattgggataaaaatctggccccccctgggcagagagatgcgcattcactataggagagtggagagaattagagaaaaagagtaaaaaaatatgcgcgagaaaacagagataagtgattaaattgtaaagggacccccggtcactactttgaatgctaaaatcctcgtccacagcgcagtgcgctaccgttttgtgttcccccaaattaagcgatcgatatcaacggaaattatcgatttgttaaaaatttgaatgcacacataattatgaatagggctccaatttttaggctctaaaaaccccaaaaataggctctaaaaatggaaaataggcactaaaaaccctcatttttaggggtgtaaaatgacaaaatg

SEQ ID NO: 116236 - DNA, 532 bp, Heterodera glycines
  Promoter: Source sequence=SeqID_8877; Location=1..532; Strand=+; Gene= SeqID_69495
attctcactgatcttgaccaattgaatttaatctgttcctatggactgttccccgatgcaattggcgatgatgggccaaatgcaactgctggccaaattctctccaaatggttacacacgccgagcaaaaatggccaaccgaagcgattggtttgtgcgaattttgacgaagaagtcaacttagattgggtcaacagttttaaggaggtgcgtttgttcacattctcataaaattttggtatactaccgctgaccattcaattttttgaaaaaattttgaaaatttttaatcggatgggtcaacaatttgaaggagttgacctgctggttgctgccatattttcgttaaatgaccgactgatgattgattgcatttgattttcgcttcctttttatttagacatttctcggtgccaccaccacttcggtcagctacaaaattccaatttatttgcattcggaaacatcgccaattgagccatttgaatcggtgaacgagcgaaccaaagaaaagctgacattagaggaaatg

SEQ ID NO: 116237 - DNA, 456 bp, Heterodera glycines
  Promoter: Source sequence=SeqID_43058; Location=1..456; Strand=+; Gene=SeqID_70826
aatattaaacaattaatataatttattttgaaaatgtcatttctaaatttaatctgaatttacgaagaatttatttataattataattttaattataatttaaatcaattttaatgtaaggaaacgacatcatttcccgtaagtccaataattatttatttttaattaccctttaattacatataaattatttttatatagcaaattatacggtgccaagaagtcgtcgacttcaaccaaatcaattttttgctgaaaattgaagaaaatttttcaagaattcggagctcacccacccaattgtcaaatgcttacatcaaccaattcacttcactggaacacttaatcaattgcagtgaaaatttgttggcaaaggcacacaaattttcggtgaataaaaattaaaattttcaaaaaataaattattaaatttaagacacttccaccgttgccatg

SEQ ID NO: 116238 - DNA, 207 bp, Heterodera glycines
  Promoter: Source sequence=SeqID_11959; Location=2427..2633; Strand=-; Gene=SeqID_75479
ttttcagccaaaaaaaaactcaatacaatgatattctgaatttgttttttgatatttgtccttttttgttaaaaatagcaaaaattaaatttttttaatgaattgttttacaatttgcgctttattagtatctaattaaccactaattaggtgccatttcctcctaaaacattgttcccattctctaatttgcgaccatttaaaatg

SEQ ID NO: 116239 - DNA, 344 bp, Heterodera glycines
  Promoter: Source sequence=SeqID_6910; Location=1665..2008; Strand=-; Gene=SeqID_63263
atgcttctcgggttggtcgagaatccgtccatttttgctattgaagcgatttcattagtttggcatttattccccacaaatcaatcatttgctttcggtccgattcggcatttttgtcccaaaaagatttgggatttggtcaaatccaatatttgtttcaatttcaaataccttttccgaccaatcaaattggcaatattaaatcgggtcatttttcatcaatttgaattggcatttggcatttagttcatggctattgcggaggcaacacgccggattggatgtgggccaacagcacggagcatccgttgaaaaactaccagaaaaataacaaccagaaaatg

SEQ ID NO: 116240 - DNA, 1003 bp, Heterodera glycines
  Promoter: Source sequence=SeqID_4162; Location=963..1965; Strand=-; Gene=SeqID_53415
tttgaaagtccaattctgggtttatgtttatgtataaaaatccatccctaataattattaacttttaattttcaatttaggtgcttgcttcggagcgtctacgagaagtactcgtcgatgaggcatccaatcaatcggcttgccgaaattatttccattgacaccatgaaaatcgtaaagatttttttacattatcaattgaaaaatgctactttgaattatccacatgggttcagggggcttcggtatgaaatttatgagtggttgaatatccaacaagggaacatttcaaactgtaaccacctagatcacttagaaaaatcgataaaaataacaaatttttaaaaattcataaaaacttctaaaataatgatagagcaattaaattaatttaaaatgataagcaaacaattctctatgaaatagcatcataaaataaatttaaataactgcataaaaatatgctagttggaataacactttttaaaaaatttaaaataattcagcatctgtcgagcggatccgaacccacgactgtgggcaataacatgaagagaaaaaaaaatccattttttgctgtaattttcatttaatgaattttttctgatcatttttggcgccggcgccaaaaaagccgaaaaaatcttaagaaaaatagtttcaatttttgccaaatgagcatgtttgcattggcaaaaaattcctaatttgtaaggttttaatcggtaaaaaaaaagaaaaacaaattgacttgggttacttttttctgctcggttcgagtccgtttttatgcaattttattttctatttaaaattgtgtcttttattatcttcccattaaaatctttgacattttttatctcggtacacatgcttatttggcaaatattttaagtccttttcttaagaatccttggtgctctacccacccataaaatttcataccgaaacccaacgggcacctgaggatcctcctttataagctattccttacttttgcatg

SEQ ID NO: 116241 - DNA, 161 bp, Heterodera glycines
  Promoter: Source sequence=SeqID_7797; Location=673..833; Strand=+; Gene=SeqID_66002
ttttttactttgaaaatcaaattttaaatttggaaggtatgaagcaaaagtttattttatttcaatttattgcttttgattgagcttgcctacaattggactcgccacaaaataaatgatgcctttgtacggaatggtcgaccattttcccaacacttatg

SEQ ID NO: 116242 - DNA, 1003 bp, Heterodera glycines
  Promoter: Source sequence=SeqID_3837; Location=4586..5588; Strand=+; Gene=SeqID_52072
aagtcatacaaaatttatcaccacgtttatagctgttcttttgaattcaaaaagagattttcttgaccctttggataaaacaaattttatttaacaaaattttttgttcacttttcattttttgttgaacaaattttacctttctctcaaattattttttctcacattctgagacaacaaataaatgttaaaaaatgaagaaaaatagattttacacagaataaaaaattataaaaacatataatgttgagaagataaactctttttctttacaatatgaaaattaaaaaagaaaaaagcttacaacaccttcgattcccaggacgtctccgttccaagtactaagaaggcccaacgttgcttaacttgccagatcggacgggatggcgtgttttcaacgtggtatggtcgtaagcgaaagcgctccatttgaaagcaactaaatagtcaattttataatgcattttttctcttttaacttaatcattaatcaaaacaaggatatttaaagaatttggaatacacttaaataaggtaaaataaaagaaaaattcaatagtttttatcaaaattaaagtgcaaaaattcggaatttgaattctttttttaactaatttcccaactgcaaatcggctgaaattgaaaatgagttatataaatttgcatttcatcaaaaattctctttaaaaagcacttataaatccttttcctaggaataatttaattttttaattagaaaaaacattgaaaatcaaaatttcttatgaaaattggttaggtggtgattttaagaaagtaatacacccatcatttatagtggttaaagtcatcttttaaaaaatctaaaaaaccatttcggcacaaaatgccaaaaaaggcaaaatggggatacaaaagtcatacaaaatttatcaccacgtttatagctgttcttttgaattcaaaaagagattttcttgaccttttggatctaattcatcagattgtggtcttttttcagatg

SEQ ID NO: 116243 - DNA, 292 bp, Heterodera glycines
  Promoter: Source sequence=SeqID_14872; Location=1454..1745; Strand=-; Gene=SeqID_79020
ggtctcgataaatttaaaaattctgaaatattaaaaattaaatttgtgaaattatgatgtttttctctaggcgcaagagtcaacattaagccaaatgtgggccttctcacttgttcatccggtgcttcaaaacggaagtggccgcccgaaatttgtttaccaactcgatactttttacccaaaacggtaatttttaaattgttttatcattcctttttataattaccataaattaattaaaatgttttcaaaaaatgataaatttaaaaaaaggaatgaggcggtcaaaatg

SEQ ID NO: 116244 - DNA, 190 bp, Heterodera glycines
  Promoter: Source sequence=SeqID_21461; Location=1..190; Strand=+; Gene=SeqID_52067
ccatatggggaaaacagcccattccacgttccgtctaggcagagaagtctcgctagacaagcttccaagcattccgcttgaaagcttctttgcccgacggatacgtgaggcccaactcatcatcattgatgagatcaccatgctgcacaacacggtgatagaggtcatcgaccgagtgtgcaaagaaatg

SEQ ID NO: 116245 - DNA, 68 bp, Heterodera glycines
  Promoter: Source sequence=SeqID_31416; Location=385..452; Strand=+; Gene=SeqID_61768
tgtgggaaagcgagcttaatttaaaaaaatgatgatgctaattgattccttttttccagcaatgtatg

SEQ ID NO: 116246 - DNA, 512 bp, Heterodera glycines
  Promoter: Source sequence=SeqID_39; Location=11965..12476; Strand=+; Gene=SeqID_54451
taatatagatagaaatctattaattaataaggggttttattttctataattaaatttacatattcattcaacaactgtttggcatataccccacccccgcatatgccaaacagttgtttgtcatacgtcaaagcccccatttatgaataaaattatagaaaagatattatgtggtgccaacaaaatgtatggcatttgacacatatcattttcccctttttctctgccataatcttcatttaacatactgtctattctacattgtcttcgtatcttttccgctatcctttatacaaatactattttcatacctaccccatattctcatatgactttccatattagaacagattgtgaatatgaaaaaattattattatttattgttaggggaatagtgactgagaacccattactaatgaaattttcatttttccattatttatcaaaaagtagcctcgggttcccagtcaatttttttgtataaagattaaaaaattttttatagaaaatg

SEQ ID NO: 116247 - DNA, 1003 bp, Heterodera glycines
  Promoter: Source sequence=SeqID_15388; Location=1123..2125; Strand=-; Gene=SeqID_79650
tggctaaaaaattgtaaatttaattttacctttaatttatattataataaataatttaataatttcaccaaataaatctcgagtagtttagtaaattagcgtatgctaataaaggcttatcaaaatatagccatacgaaagaatacgaccaaattttcataaatacattttatacaaatccagattttctcaaaatttttttacagaatatcgaaaaaccgattctctgatgccaatttaaaccgttcaatgcatcaatttattaaaaaaaaaatttcattcacctatttcttaatatttttaagaatttttgtttattacaaattaattttcatttttttttatttttttctaattttattaatggatggctaatgtaaaaaatggtaatttattcatttttttctcttttcacaacggtccgtccgatcgaaaatttaaaaataatgatgaataagcagcagagcagtgaaaaaatttacccacttctgtgaccactgaacagcagcaggcaaactgctgatggtgctgctaatgatgatgatgatgattatgataatgagctaataggcattaaattgtaaacacaccaccaaacactctattcaatggggcaatagaaaaaataaaataaaaactattttctgaacatgacagtcattataaaattgaaattttttcgatttttagagttgattgggattagagacaaactgtaaaattaaatttctgatggctattttaaaggattaacgtacaaacttttctggacagaattttgagtacattccactaaaattagtatttgaaaaatgagaaaaatggatctgcttctcctgtaagatgctcctctccgttaattaattttcaattaatataatcactctgtgatcctaaaactctaggaattcctcaatcactcctatttttatttaatttattttttgtttcaaaaactattcgattttagaccaaaatttaatacaacaagtgacagacaatg

SEQ ID NO: 116248 - DNA, 995 bp, Heterodera glycines
  Promoter: Source sequence=SeqID_2475; Location=343..1337; Strand=-; Gene=SeqID_79912
atcaaatttttaaaattgtgataataattgttaattccataatcaataaattgtgattagcatttaacctgtgataaaacaattctgttaattccttttttgagtaataaaaggttcatttcatttattattttaaattacggtatttaacaaaatttcaaactgtgtcctaaaaatataatcgatttaaattcaattgacttgtcaaatcaacccgatcagttaaatcagatcgagaatattgaaatattaccggaatttgaggaaccaataattatagagaacgaaaatcagaatatcgaaatatttgaacctaacgaaattgaacaaataacaaatcaagacgatttaatttttggaaatttctacggggctttaatcactgaaccattgtcaaattattttaccattaatcaagactatattaccaaagtcaaaaaatttaaatttaatccttctaaatatatatttaaaattactattgctctcactgtgcatgtacacaaaaatttgtcacaccgtaatatagaaattttctgtcaaacaatttctgaagaagtaacaaatagtatactatcagactttttacacacaacagaacaaaccataattgactcaatcaaaacggaccaaagaaaaatcaaattaacaaaatttctcaagagaatagaaaatcgaatatctaagcagattaaaaaacagtggggtccatattgctatcatccaattcttgtactttcaactcataagtatattttttaaatatgtcgggtcaactcagagcaaaaataccgttacttaaccgagtgttaataaaagaaatacagaaaattaagtcaaaaatagaagatgggaatttcgagtatgataaaaataattttgatgactgttctcgaatttttaataaaactaaagaaatcattcaaagaattgaaccaaattttgaaaaattaaaaattttgcaccaaaaatggcaaaatttaataaggcaaatg

SEQ ID NO: 116249 - DNA, 388 bp, Heterodera glycines
  Promoter: Source sequence=SeqID_11438; Location=2981..3368; Strand=-; Gene=SeqID_46956
tttttgcttggtagttggatggatgagcaaattcaaatgagcaaaagaagaaaagtgaggaatagaatgaccgtgggcgctatttatgctaagaaaaaatggcggctaaaatgtgcaggcacgcggagactcctttcgtgttgaaaaaaatccatttcaaaaagtgacgccgtcttactttctctctcacacactctctctcgtccatttttctctgctcccaccggggatttgcattgtctgtcaatgggatgggcgttccctccactttagcgacataaaagggctcactgtgccccattccccactttcattagaaagcaaacgaatcgattcaccagctctcttcaacaaaaccttcgcctctccacatttcgacgacaaaatg

SEQ ID NO: 116250 - DNA, 812 bp, Heterodera glycines
  misc_feature (81)..(81): n is a, c, g, or t
  Promoter: Source sequence=SeqID_6110; Location=4024..4835; Strand=-; Gene=SeqID_60396
tcccgttttcgggtttgattctctaacgacgaatattggctaattaaaaagaccctctttaattccctccctcttttgctntttgccattccctcccttggtcagttgcacatcccaatttggatgcgtgtcttcggcagattgctctctctgttcaaccctttggccactttgcgtgcggctgggccttttggttaatttccacgtgaaaattagaaacaatcaaaaaactttaaaggcgctcggctggtgaaaaaattgcgttccgaccttgggattcgctatgctcaccaggacccggacgccatttacgaatacatttaccaatgcaatgcgatggaacccacgggtcagtgtgggcacaaacaaataggcttatatgtgacaaaatttaggcgaaattgcatttggaacaatgtccaagaattttgggtgggctaagcgaccgatgattaatcggtcggtttttgggttcactcaaacatttcccaattcaaaatgtttttagtttcggtgggataagtccatctgtgccggtcactttcatttggggtggaaaatcgtggatggtaaaccaatcgcgaataataaaatagttttgtcatcattgacatttgtttaggacccgggcccggcctatgaaattcaatacaggagacaagaggcctatgtggatgttcaggtgatttggacaatgccgatttgtaggttttattttatattttgccaagattgtcacccgtgccggccatcacgtctacgccgatgcgccagcggacttttgccgactgttggcccacgtttcggacatg

SEQ ID NO: 116251 - DNA, 228 bp, Heterodera glycines
  misc_feature (50)..(50): n is a, c, g, or t
  Promoter: Source sequence=SeqID_1077; Location=400..627; Strand=+; Gene=SeqID_67306
tttgtcacttttatgagtcaacgttttcgctcgccgtttgcccaaatgtnccgttttcgttggccaaaaaaaaggcgcccttttccaatcgatcgaaggaacgcttttgaagcgctttaaaaatatacggagaggaaacgaaaggggcgtcgagctgaaaagtcggctaattcagtcaattagttgattaatgaggggcattggtcgttcatttcactcaccgaaatg

SEQ ID NO: 116252 - DNA, 198 bp, Heterodera glycines
  Promoter: Source sequence=SeqID_26683; Location=1722..1919; Strand=-; Gene=SeqID_57442
tttttttttttttgtaaaactaaataaattttcatcacaaacactatttttccttaaaaatttcgagtatggaggaggggctcttctgggtgggagcggtgactatgcaaaaaacaaaacaaaaaaatcggtcaaaaggaaaaaaaaaattttttttaattttatttgtcccattttcagcctcaacctttgcaaatg

SEQ ID NO: 116253 - DNA, 1003 bp, Heterodera glycines
  Promoter: Source sequence=SeqID_12071; Location=1754..2756; Strand=-; Gene=SeqID_75618
tttaaatgttattcttttactaataagattaaattttctcataaaagaataaaaaggaaaaatttatttttattttttaaagaaaaaagcattttcattatggataatttaaatagaataaaaaaaattaatttaataactgtaaaatgatgatctttaatgcaaaaaggcaatatgttaaatagctgaaaaaatctgtcacctatttttttcaattgcctaaaggctcgaatttttaaatttaaatttttgttaatttgtgcatactgcagctcagacagttataaatgaataataggcatattttgatattcattttggtgtcttcaaataaaaatttaaaaaatattccatttttaccaaatattttcttaaaagaggtttttgcagctttttcttttatgatccgatataattaattaggacgatcaaaaatataaatttcatccaaaagcagaaatattttacattaatttacaacaaaaaaacgcatatagaattcatatacattggataaatgtaaaaaatgcacagattaagtgaaaaactccatatttctctgcatacaaaataaaaagcgtctttttttggatttcaaagattgctgttgatcaaaatcacaacacctgctgttgtgttgttattttatcgaacatttaaaatgttacagtttaccgttgttgctatgcccatgacatgtgctacataaataagggacaaaaacgctatgattgtgataaaaaatttgcaattgcttatatgaaaacgttgattgtttgctaacaaaagtttgttttgtttatttttaatgagattcttatgtttagaatttgttatgctggtcagtccatatttttggagaacgttttaaagaacagtgaaaaataacggattttatttgattacagttttcaatattcatagtttactaattatataatatgtataacacaaacataaatttttgaattcataactctatactaaacatatttttataatg

SEQ ID NO: 116254 - DNA, 160 bp, Heterodera glycines
  Promoter: Source sequence=SeqID_27970; Location=1242..1401; Strand=-; Gene=SeqID_58628
aagcatttagcttctacgttttcattttgcgtttttcgtccttctaaggatgtttgttttttcgattggtttctcattgtactttaaatatttctaacataattattattgtgccccctttgtgacgtccttcgtaattgtgctaatttccaacaaaatg

SEQ ID NO: 116255 - DNA, 230 bp, Heterodera glycines
  Promoter: Source sequence=SeqID_20548; Location=1..230; Strand=+; Gene=SeqID_51086
cttatcacaccacttttttcggcgcgctttttccagaacttttggggaaaaaggtggtccggcggtgccgataggcgccgccgggggaaattttgaaaatttgagtgagatttgttaacagatttcaacaaaaatggcttctttttgggattattaggctcaatttgtacggattttcatttaaaaaatgataaaatatataccaattaaaaatatgaggcaccaccatg

SEQ ID NO: 116256 - DNA, 1003 bp, Heterodera glycines
  Promoter: Source sequence=SeqID_2288; Location=801..1803; Strand=+; Gene=SeqID_78910
ggttttgcttctgtgttagaattctcgggttcttttaatgtctatccgttttttttgaattattttctttccatttaaaaaaattgcattatccaattaattttcggtgttcaacagttgctgttcttttctcacacaatttgcccctttcccgaactaattaataagtaaatgagattgaaaaagtatttgtgattgattgggtgaatgagaccaattttcatcatttattgctgataaaatggttcgattactgcacaaacatttttttaaattgatttatttaaatatttttttggtcatttttatacatataaattatcaatagggtttgtaattatatggatataaaaacgcgaaatatggccataaaatatggacaaaaatcgcgaaatatggacataaatggcaaaaatatggacataaatttttccaattgagggtataatttcacaaaatttatttaattcaccaaatgtaaagtgaaactttcataaatgattaaatatggcattaataaatcattttagaaaaaaacacacgataaagctaaaatttactcattttaacgaaaaccatcccgaataacgaatttttcgcttttttgcttaaatttttgacataaattaaccattttttgagaaatttaaattttcaatattttcgtgaaaatcttactaaaaaattattttttggaaaattttctggtctttagggcgtcaaaaggctaatttagctgctggggccgttctaatagaggttttttggaaaattgccaaaatatggacaaatatggaaatatggacataaatcgcgaaatatggaaaaaatggataagaaatccaccctagaagcttctaatcaagctaaaaacatgtttttcgtgcgtttcagacctcccaaagtccagaaaaaaaggatttccatacaattctattccctaatttacaaataaaattttgtcaaaaatatatatttttttatatgtcagcgaaaaataatg

SEQ ID NO: 116257 - DNA, 255 bp, Heterodera glycines
  Promoter: Source sequence=SeqID_17259; Location=2864..3118; Strand=-; Gene=SeqID_81727
tttgagttaatctttctctcagatttctccatgatggattaatacgcatgcgtattggttttgacatttattttttttttagttggtcgtggcaccaatttgttaattccccttattaacaagtacagatttagtaattaattagtgattaatttgtggttgacagctattagttggtgcagatttatcggtgattaaatgaaatgtgaatggatttgtgttggttatgtgtgaatagtgactggagtagaaatg

SEQ ID NO: 116258 - DNA, 751 bp, Heterodera glycines
  Promoter: Source sequence=SeqID_9585; Location=456..1206; Strand=+; Gene=SeqID_71973
gggagtaattgtaaatttttcaacctgttcgacttttctgatccttaaacttgcaaataacatttgaaaaatggatgaaaaaagagatttgtgggatttagtgttgctgatttatggaaaaaaacattggatctatttgttgttgtatgctattaaaatcatacgatatttttatttatgttgataaaaaattgaatgtaaatgttgacaaaatcattaaaatttttgtttttacgtcatttatctttaaaagtccatcttttaagagatatattttccaaaaaaatgtttttacggacatattcatgccaaatgttgacagttattgatcgctacattgaatattttatgaattagtcataatttaatgaaaatttatgcatttattttctccgcaaatatgtaatgtaatttccgtttttttgattaataaattttcgaaattaagaattgcccatccccccgaatgccgagtctgatttttaattataagtataaattttaaatataattttttccctatataaaaaaaattataaatttagaatattattattggttatttattctgatgaatttaatcattttgttatgttttttttcgctttataccgacggcattctcaactaaattatggacaaataatgaaaatgattcgctaattgactcctctaatcgttctgctgctgatgctaatttggacaatgttttgccaccggaaaaaggaaatcattttgtgccattccaatg

SEQ ID NO: 116259 - DNA, 325 bp, Heterodera glycines
  Promoter: Source sequence=SeqID_36322; Location=624..948; Strand=-; Gene=SeqID_65668
ttagtattttaaatatttcgctttacttcattcactttaatttttattcaaattaaactctgacacagtaacttttattgtcataagaattgtgtacttctaaataaaaagatgatgaaatctgttacattatgaaaatataaaataaagttaataaaaaaaatattattaacaataattaattttaaaaatttatttttcgtaaaatatgattcttaaaaaaataaagataaaaaaatcataaatttttttgattttcgatgtattttaaggataattatttataagtatttaaaaattttagattactttatttaaaaaaatg

SEQ ID NO: 116260 - DNA, 559 bp, Heterodera glycines
  Promoter: Source sequence=SeqID_14583; Location=367..925; Strand=-; Gene=SeqID_47216
tttttttgtttcatccaattttttggacaaaaagcctttcgcaggatttctagggtttttattgcatcaaaaaatagtgacaacgagtcggcccgaaaagcccccctgatactacgtagaaatgaaaaaaaaattggttctagtcggttttatgcgtcccatgtcatataccaagcgaaagacaaaagtctcgagattttataaatgcaagaaaagagcaaatactggcattaaaaaagaaattacaatgaaaaaaacgaaattcagcttttccgagcataatttttttgtctattgcatttagctaaaaataaagttatacaaaagcttctatagaccttaagcttttgtttaataccaagaatataggtattgaccaagtaagaaaaaagttatgcctaagaaactgggtatggtcattcatgggacgcataatctgtcatgtgacgcataaaaccgactagaaccttccattcatcggctttaataacttctgattgatcacataggttatgaattacggcccaaggaggtgcaccattggctgcgaaaaaacatg

SEQ ID NO: 116261 - DNA, 1003 bp, Heterodera glycines
  Promoter: Source sequence=SeqID_7394; Location=281..1283; Strand=+; Gene=SeqID_64692
ggaaggaagaaaacggcactttcttgcagccaaaaattagaaataattttttcggtacaattaccgaaaaaatatttatctaataaaataggaaaatgactaaatcaaattaataaattcaattcaacttttaaaaatttttcgccttcggcatcgccggactaaatattgaaattcttttgtttttcatcataatctcaaaatcaaaatttaaagggaagtcaatttcgagtcattattatgtgaaagttcaacgaataaatgagaatttgaaaaagatgttttttacatttttattatttattgcaataaaataatgctctgctttataaaattggtaatttgccaattaatatttaatacatttaattaatcaaataaataaaagaacacccaaatatagattaaaaatggtcgataacttagcatttaataaatgaatttaaattatatttttattttcataatattgatttaaaaatgattttaaaagtttaaatatttgtcgatttaaaaacaatttttatacttataaaatggaatatcgatggcttttcgtcgtcccccccccccccgaaatattgttgtacttttttttaatcataaaatgctggcctgtcatttttatgttatttttgactaatatacaattttattatttgtttgccaatcagtcatatcggagaaaaacatttatttcaccaatttttccactttttaagtatttttcttccatccagaatttttgttactaatgccattttctaaacttttatttgtcaatcagtcacattcgtcgaaacatttacgttgccattttcacgcatattaattatttcacaaattaatgtgttactaatggcatgggtgtgagagcaaaagccaaaacaggcctttaaaaggcgcacaaattgaagcgccaaatcattcattcattccgctcaaaagtgccatcgatttcctccccacaaaaagcatcaaattctcgattctcggaaaaatg

SEQ ID NO: 116262 - DNA, 1003 bp, Heterodera glycines
  Promoter: Source sequence=SeqID_4726; Location=598..1600; Strand=+; Gene=SeqID_45882
gcttaattaaataaggaaaaaagcaaaaaatgttataaaaacctccaaagattgttttttaaaattttttatatgttttaatcgatttttaagtgaaccagaaaaattttttggaaaaagtctcgagtctcgactcgagaaaagtctcgggttttttgggtctcggcctcggtatcgagtctcggggtctagtctcggaatcggtctcgagtctcggggtcaagtctcggtctcgagtctcgggaaatttttggtctcgagcatcactacaaaatcggtcatttttatcctccaaggcttattggtcacttcgccaatatggtaatgaaggtttgaatgcaattcacaatttttaaaaacaatcccaaagtcctaaattcagaaaatggccaaattccaaatcgcaactccattttgcttcttttctcacattttttcctcctttctttttttaaattgttatgaagtgtaattaatattttttaataggaaatgtaatgcctcggaataaaccaaaagggaaaagcacaaagaaagaaatttccttctttttaaattaattttgactctattattcttttgtttcgtattgcaatatgtaaatgctctttttatctgacattttgcgacgatctctcctaataggcatttgtaaaattggagtttatttgggtttagcttagcaattattttgttattaatttttcttaagaattagctaatgagttagttgtaattatagtacaaaaataataattcataattacattgtccgttttaaatgaaaaacattgtttgtgattaagtgtatactatttaagtgtaattgcttacatattcataaaatggctcagctcagtttcctttatcaaaaatataaataattctttttttctgttttttaatccatttttgtccgtttctccatcatttattaaagaacccaaacctcattaagccctaatttctgtctttttttttctttttttggattgagaaaatg

SEQ ID NO: 116263 - DNA, 73 bp, Heterodera glycines
  Promoter: Source sequence=SeqID_2843; Location=1957..2029; Strand=-; Gene=SeqID_81892
ggtaaaaaaaaggaagaaagaaggcgaagtaaccgaaaaacgggttttgcaggagaaggagaagaagtacatg

SEQ ID NO: 116264 - DNA, 94 bp, Heterodera glycines; identical to SEQ ID NO: 97954
  Promoter: Source sequence=SeqID_27586; Location=480..573; Strand=+; Gene=SeqID_58274

SEQ ID NO: 116265 - DNA, 563 bp, Heterodera glycines
  Promoter: Source sequence=SeqID_15898; Location=1..563; Strand=+; Gene=SeqID_80238
caacacacacacaaaaaagaaagaaaaactaactaatttctaaaattcaacaagatgccaaaatatgaagtgtaaaattggcgcgacaatcatgttttatggaaaagagtatttattgttggcaccccctccaagatctacccacccaaaattaatttttccgaaagtttttcttatctattgtatttatttagcgacttccctggtgttgaaccctttggtcatatcatcaaattgctttttgaatttaaattaagctgctgtgacgaatttgtatgacaaaaaatttttgataattttttccccaaaattttgcgcaagtctccgtccccgaatataccataaagaattacaactatctctttggaaagacctaaccatgctattaaaatcaattaaggtcaatacccggttgttttacaaaaaaaatcttttaatttacaaagaaatcagtttaaataagattaatacgtgtccgttcctttcagttaaaggctaaaatcaaaaaaacgcacaatgcggctttggccaaagtgacgcgggcgcagcagcgacgagcgatg

SEQ ID NO: 116266 - DNA, 70 bp, Heterodera glycines
  Promoter: Source sequence=SeqID_22841; Location=483..552; Strand=+; Gene=SeqID_53551
tgtaagaattaaacaatatcagtcattatacactagtattaatcgttgcgatgcttcaccccttacaatg

SEQ ID NO: 116267 - DNA, 968 bp, Heterodera glycines
  Promoter: Source sequence=SeqID_4620; Location=1..968; Strand=+; Gene= SeqID_55121
accccttctttcccaaaagttttttgaaaaagcgctccgaaaaaaagtgatgtgaaaatcaaatctgaatttctattaatattcgatgatttagtccaaaaaatgatttttgaaataattgaagaaaatttgtttgaaaattttcattaatttaatttgctttattttgggttttattaaataaaaaaccaaataattttgtattattttcacttgaaataaattaaaatttgaattttttttaaaatttttaaaatttttttgaatttttaaaatttcccggttggtcccggttcccggtttttcttgcggtcccggtcccgaagaaaaatcgaggtcccggtcccggtcccggcttctcaggtcccggcaagtcccggtcccggttttggcaaaaattcccggtcccgtggcactctagtttcaagcgccatttgtacatttaatttgcttttcttacgtctgttactacaatttttgagaatattttatagtaatttttgttaattgttaattcttaattatgctaaattttgaatgaataaataattatgccgaattaactaacattgtcaaacaattaccaaaataatgtcacttttgcgcaaattattgccttttgacatttattaatgccgtttttacattaattagtgacattgagtgagttaattaattcgttttgtgccattggtaacatttttttttgccgcttttagagtccttattttaaggacgcccttatgcaaatcggatcagcaaaacaagggcttcggttttttgagtatttttatcaagagtggatttaacattagggcttggataaaaattttctttgtctttcttctaaaacttgaacatgacttttctttatataaggacgtccttgaaacaagaatttgtcatattgaacattgaatttaaaataattaattaattaaattatttttgactgcttcttgacaatg

SEQ ID NO: 116268 - DNA, 241 bp, Heterodera glycines
  Promoter: Source sequence=SeqID_1011; Location=3137..3377; Strand=-; Gene=SeqID_66045
tttccctgtccttcagatggaatacggaactgatcgcttcgatgtatttggttttaagtcggaaacacgggacgagcgcatccaactaagggaaaagccaattttagtgacatgacagaaagcggatctcacgagaagagtcttatcaatgtgaaggtcaaaagggatttgttggccttgcgcgattccgagtttctgaaattcgtaaaatgcgagcagagcgagtttgacgagcgaaatg

SEQ ID NO: 116269 - DNA, 152 bp, Heterodera glycines
  Promoter: Source sequence=SeqID_21925; Location=1860..2011; Strand=-; Gene=SeqID_52561
cattaattaaagtaattaattataccaatttaatttataaattgatgaacaaacaaatggcaaattaattaataattttaattttgggccaattttaaattttcttccaaaagaaaaacccacggcattcggcggccgtgggcccagcgatg

SEQ ID NO: 116270 - DNA, 357 bp, Heterodera glycines
  misc_feature (19)..(19): n is a, c, g, or t
  Promoter: Source sequence=SeqID_11028; Location=3875..4231; Strand=-; Gene=SeqID_74357
aaactgatcttctgtaccnttttttgatcaaaaatttccttctattgaaagaattaatagaaaatttttgaaaaaaaatagaaaaaagtgtcttcttgcaataagccaacttttgggttttatttttcacaaagctttgggtaattatcaaagaccaaaaatacggagttttgaagccgaagttttgcctgtctctgaaaccaaaattaattattaaattaaaacaacaaaaaatgaaaattcataattcaagacaattaaatttgaaaaagaacctttttaattaaaaaagaatttttaaaacaaaaaaataaaaataaggaaaaaatattcagtaaaaaactcaaaaatcaaatg

SEQ ID NO: 116271 - DNA, 1003 bp, Heterodera glycines
  Promoter: Source sequence=SeqID_6816; Location=1644..2646; Strand=+; Gene=SeqID_62981
tgataaatatgagctcaattacgaaattctatattcatgcattaaaatgattttttcgacttgacaaattttatgggtttacgaaatttttttaaaatccaaaccaattcccagaaatttattgtccgtattttcgtatttaaagtggttggcggtctcctttgagtctcaccgtcaaacgacccggtccgtgaaagttgtgacaaatttgggatttatcacaggggtggtaattagctaattaggtttatccaccagaaatgtaacgaaatccaactttcccatttttgagtttttaagttaaattaacgaaaacgaaaaaaattattaacttggaaatacttttatttttcaattatgcgcatcttttgcgattttatgttcaaatatgattctagtacagtatactcgtcccataaatttttacgcgttctataaaatttttctgaaacctcagcgtgtcgaatgagaccgtggtgagtcgttccacaaaaaagctcagtgtgggcgttccacaaaaaaagctcagtgtgggcgttccacaaaaaagctcagtgtgggcgttccacaaaaagctcagtgtgggcgttccacaaaaaaagctcagtgtgggcgttccacaaaaaaagctcagtgtgggcgttccacaaaaagctcagtgtgggcgttccacaaaaaatgctcagtgattgataaaataaaataataaggttaaataataattttgaactgtaaatgtaattttgatttaattttattgcatgcttttaaattataatttttattacaaaactaaaaaaggaaaaacaaattaattgaagacaattgataaggtgctaattttctttgcatttcatgtaaagaatttataattttgattcccgaaatagcgaattaattgataacataagaatgtcatagtaaaatctgagtatttaagctaattttattaatctataattcaaaaaatttaattaaataatccctcccaatcgcaacaatg

SEQ ID NO: 116272 - DNA, 55 bp, Heterodera glycines
  Promoter: Source sequence=SeqID_10016; Location=1651..1705; Strand=-; Gene=SeqID_73068
gtcaacatttagatgatttatcatcagtcacggaagagtcgtcaacatttagatg

SEQ ID NO: 116273 - DNA, 134 bp, Heterodera glycines
  Promoter: Source sequence=SeqID_4051; Location=534..667; Strand=+; Gene=SeqID_52963
aatatatggccatggaaaaaatgatttaatttattgacattttttaacgattgaaataattttttatttttaaaaacctatttttaggtgtgtaaacaagtcgcggtctcgagtctaaaaaatcgaaactaatg

SEQ ID NO: 116274 - DNA, 910 bp, Heterodera glycines
  Promoter: Source sequence=SeqID_17349; Location=1574..2483; Strand=-; Gene=SeqID_81828
aataaaaaataaaatttaattaaaaaagtaactattatttaaacaattttgttcttgaatgtttaaataaataataaaaaatgtatacaaattaaattcactcaattaagcaaagtttaattaaacatacaaataataatatttttaattttttggagtgaatgaataaataaattttgttaacatttttaaaatgaaaagattaatggacagcataaaaactctctaaatttcgtagcaaacaatcaaagatcaaacagtgttgagctcaacttcaattagaaaaatttatttgcacagtctgctgaagcaaaaaaagaggccgcatttttgtacgtaagaattttttggtgcacatttttcaaaatgattaagaggggataaagcgctatttttagtgcaactttgaagaaattttattataaaatttaattatttatttattcgtaaaaataaaaaagtcatcagaagggcgaaaaccacttactctgacgactgttcagataatgtgtcgtagagtaagtgataaaataaagtgatgatcacaggaattaaaaagacaaaatatgtgaaaataaataactaaataattgaggtcaaagtcaaaattagggccacgcgtaaaaatgccaaatcacttatgagtttatttttgttctagcttttccggttttattaccctagtgaacttctaagtttggttttaaattgatttaaagaatttgttttgattagttctttatcgagttgattccacaattttgttaccctcccagcaaagggaatgaattttttgcccagtttatattttgagttaaatctgtaaaaggggatgttaaagcgcgttgagggattaaaaatagaaaatagtttcagatctgttcggccataaacaattttatgcgccatg

SEQ ID NO: 116275 - DNA, 964 bp, Heterodera glycines
  Promoter: Source sequence=SeqID_15671; Location=1948..2911; Strand=-; Gene=SeqID_79978
ttttttcctttgactctaatctctatctctaatttttcactcatacccccattcttaccagtgcttgtttttcccggttgccctaccgggaccgggaccgggacctgagcttttcaaaatccgggaaccgggacctcggatgaccgggaattcccggccggtcccggtcccgtggcactctagttaaaatgaaaaattttagtcaaaaggcaacaaattaagccaaaccagattgagcactacataatttttaaaatcaaaaattcttgtcaaaaaaataatagatttttgagaaagtttttcatttcttatgggtatatttttgaaaattttcggtcgatttatatgggtgtattcttcgatttattgcatttttgttaatacattttgagcaaaacgccaagtcaaaatactctttttcaaaagctctatctacccaaaaaatctcattccgagatcccacggacacttggccacctccctttgttagcgaatttaaagcaatttttttaaatgatttttggcggaaaataaaatggagagagagataacacaaaagtgagagggtgttaaagatgaagaataaagaaaaatcaactaaagaaagagtgttataggaagagatttaagacagagaaagaatagagaatatagtgaggaatcggcactatgggttcgccccactgtgcagagaaaagcctagtactatctcgtcgtttctctttttctttataatttctctcactttggcgtactatctctttattttaatgtgtgtaaaaacaacactcacttcatcctgtttaactttttttctgtttgttaaatccacaccaaattttgcaaatcgatagagaaaaaattctgcatcggttaataggtcaagttaatattaaaataggtcgaattagaaagtttttttttgtgctaataaataaaaatatagattctttaagtatttatg

SEQ ID NO: 116276 - DNA, 85 bp, Heterodera glycines
  Promoter: Source sequence=SeqID_38499; Location=584..668; Strand=-; Gene=SeqID_67287
ttttgccaacaaattcgatcattttgtgttccgccccgctgtccttaagccgctcaaaagagacgaatttattcagcaaataatg

SEQ ID NO: 116277 - DNA, 402 bp, Heterodera glycines
  Promoter: Source sequence=SeqID_40605; Location=1..402; Strand=+; Gene=SeqID_68880
cgcctcgtgttcctcccgctgtgtctgttgcaggcgccctttatccgacaaattccgtttactccgtcgctttttccgtcgcaaattcacaagcgggcggcagcagggaacgttcgccctacgcggcccaatttgggtaaaaatttcaacaaaagggaaatttttctgaataattgtatttctgtttcgacattggtgaccgagtaattgtcgacgatggaagggcgggaaaaatcaaattcctcaactatgtcgctgaccaaatttttgccggcattgtgttggaccgaccattgggcgactcggacggaaaatttcaggcacaaatggcatattgaggcatttatataaattcagtgctttttaagggcattcagtacttcaaatgctatcccaaatatg

SEQ ID NO: 116278 - DNA, 513 bp, Heterodera glycines
  misc_feature (29)..(29): n is a, c, g, or t
  misc_feature (38)..(38): n is a, c, g, or t
  Promoter: Source sequence=SeqID_42335; Location=472..984; Strand=-; Gene=SeqID_70259
tttaaaatattcctttctggactgacttnggtttctgnatatcgaagctgttttctacgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatctgaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaaggaaaaaaatttgcagtcaaaaaattattcgaatttctccaattttgtttccataatttccgaaagttattcggtatcataatg

SEQ ID NO: 116279 - DNA, 717 bp, Heterodera glycines
  Promoter: Source sequence=SeqID_5386; Location=693..1409; Strand=-; Gene=SeqID_57852
tgtttaacacttaatattatatattaatcactaaataatccaaaacaataatctttattaattgtgcaattcccggatttattttttctttatattatgtaaagaagtttcgtttttatgcatttttcgtaacaaattttggcaaaacgccaaaatagttgaaaatagtttttttcaaaaatttactattttttagttgctaaaaataaaaaactagaaaatagttgctaataactcgaaaagtagcttaacaacccccctaaaaaacatgtttttcgtgcttttcaggctatagggagctcaggaaaaaaatagtgaaaactataaattgcatccctatttattatataataattttatttttatcttttaaagaccaaaaactaatctttgtgtgaatgtgaaaagcattaatttgaatggctttacgtcttttgctgcttaaaaatcttcaataaaaaaattttaaatgcctttttcgaggttttcgtgccttttcatgcctttttttcaattttttgtgccttttatagtgcctttttcgcgatttttgtaattttaattttattaaaaatgccaaattttagcccaatttgtgccgacgattggctggcggtgttttctttgctgccgccgcgtaaattttagaaatgcattgcgtcatttcatggaagagcaaaaatggttttggcggacgtttaaagtttccaagaaatg

SEQ ID NO: 116280 - DNA, 122 bp, Heterodera glycines
  Promoter: Source sequence=SeqID_13627; Location=2200..2321; Strand=-; Gene=SeqID_77534
aacaaattcgcctaaattgctcaaatttctcgcaattccccactaaatattcgttcaaggcaaattctatgcaaatgcttactttgtaattcaatttaataaacaacacatattttgtaatg

SEQ ID NO: 116281 - DNA, 141 bp, Heterodera glycines
  Promoter: Source sequence=SeqID_6013; Location=1438..1578; Strand=-; Gene=SeqID_60021
ggtgaaaaagaacgacaaaaaggcacaactccaacaggaagtgaatttctcgtggaattccgctacaaaccaattctgcttccgatttctgtaatttgcccattcgttccgttttacctctttttcagggccaatcacatg

SEQ ID NO: 116282 - DNA, 200 bp, Heterodera glycines
  Promoter: Source sequence=SeqID_28148; Location=745..944; Strand=+; Gene=SeqID_58796
tagataaaaaaattactctaaaaatgtaattttaaaaattaagactgttgttgtgatcatggtcatgtgttcaatttctaatgatagaaaaaaaaaatttccttttttgctttttcatagaaaataaacaaacttcaaatttatatgctttctttatcgttatattttcagttttcaaattgcattattgtttttaaatg

SEQ ID NO: 116283 - DNA, 145 bp, Heterodera glycines
  Promoter: Source sequence=SeqID_38918; Location=1..145; Strand=+; Gene=SeqID_67610
tgccctcaggcgagaatacaaaatatttttagtcaattatttaattaattaattgaatttttgcaagtgacgcgatggcatttcaattgtatgtatggcatttggtcacgacataaatcgctacattttttttgcgcagaaaatg

SEQ ID NO: 116284 - DNA, 686 bp, Heterodera glycines
  Promoter: Source sequence=SeqID_36809; Location=446..1131; Strand=-; Gene=SeqID_66028
agatgtttttattgttatttttataaaaattcatgcttcgcttatcatgcaagaagccaagcataattaaaaaatatttattgaatatttatgaaaaaatcataaaattttaaaaattatagagataacacccaaatggactaaaataaaaaaatatgtataagagggatgagatttttaggctctaaaaccgccaaaataggtaggctttaggtcctaaaaaccccaaaaatagggactaaaatggaaaatttaggggtgtaaaatgacaaaatctattcaaaaaagtaacaaaattcgaccaatcagtatgagataaacaattctttttaaaattgttgtcaacaaataaataaataaattttggagatcaatttttgagaaatttttagccaattcttaggagaatattttgaaaaaatttttaggtcgcttcatatttgttttggtttttattgcatttaaataattttaggcaaaacgccaaaaaggttaaaataggtttttcaaaatttttaaaggtttttaggctttaaaaataaaaatctagaaaataggcactatgcgatcagtataactttatgctttctattttttattaaatattattttatatttttatttattggcacaaatttttccataaaaatctttttataggtattacaaatttcacgcgaaaaatg

SEQ ID NO: 116285 - DNA, 163 bp, Heterodera glycines
  Promoter: Source sequence=SeqID_35; Location=1..163; Strand=+; Gene =SeqID_52147
catcagaatttgggtgcatgttaatcatgagatagctaaattgattattggtcgcatcatgatatgcatccatgaaataattcagtctttttgggaacagttgtgaccctagagtcctcacttgtaattgtcctgaagggttgcgcattaaaaccagataatg

SEQ ID NO: 116286 - DNA, 110 bp, Heterodera glycines; identical to SEQ ID NO: 98226
  Promoter: Source sequence=SeqID_5871; Location=696..805; Strand=-; Gene=SeqID_59503

SEQ ID NO: 116287 - DNA, 148 bp, Heterodera glycines
  Promoter: Source sequence=SeqID_31978; Location=1003..1150; Strand=-; Gene=SeqID_62291
tatcgatagagaaaaaatctgcatcgatttctatgtttattatccgcgttgttttaaaaagttataagataaaaaagttaaattattattctttttaaagatttaatggctaaaagaactttattacggaagcgacagaccaaaaatg

SEQ ID NO: 116288 - DNA, 59 bp, Heterodera glycines
  Promoter: Source sequence=SeqID_17154; Location=2285..2343; Strand=-; Gene=SeqID_81593
ttaagatatattctctcaatcgtcagaatgtgacgttgcgaaatgccagttctgtgatg

SEQ ID NO: 116289 - DNA, 428 bp, Heterodera glycines
  Promoter: Source sequence=SeqID_1300; Location=461..888; Strand=+; Gene=SeqID_72005
gaaaaaacattttaaatgaataatgggagaaaatttttaggtatttatactaaaataaattgaatttatttatattttaactttaactttattataattcatttttaattttaaattctttatttaatcattgactcacagctgaaactcaacaggcaattgagcagctgtctcaagcacagaatatctgatgttgggttttgcataggcacaactgtcacaattaatcattgactcacagcttgacctctatttccagtggtatattaccgacacttccgtgggcattatacagtcaaaatgcatccaagggattattaatgaccattccattggctttggctcggtcagaaatgcaccaaaagaattcccaagggataattaatgaccactagcttcggttggacagacatgttcacaaaagaatg

SEQ ID NO: 116290 - DNA, 52 bp, Heterodera glycines
  Promoter: Source sequence=SeqID_23195; Location=1..52; Strand=+; Gene= SeqID_53904
aaaatttttagccaattattcccatccattttcagttacatcgaccaaaatg

SEQ ID NO: 116291 - DNA, 70 bp, Heterodera glycines
  Promoter: Source sequence=SeqID_34632; Location=1..70; Strand=+; Gene= SeqID_64376
caacaataaattagataaattttcggaaaatcccacttaaaattattatgtcagattcataaaggcaatg

SEQ ID NO: 116292 - DNA, 340 bp, Heterodera glycines
  Promoter: Source sequence=SeqID_2149; Location=1..340; Strand=+; Gene= SeqID_78092
tagagaccggcgcgggacgggatcccgcgcgggattttgcgggatcccagtccgcaatcccgcattttttggaaaatgcgggatttgcgggattgcgggatttgtgggattaatcccgcgggatcccgtcccgcaaagaattttgagttccaatcccgcagcgggatccgcaaatttgactttttgtgcgggattctgcgggatttcattgattttttgaaaattttaaagaatagaatgccaaataaagtgtttaatttgctttataaaatataattaaatattccagtaaaaaaataaagatatatattttttaaatgccataatttaagcaaatatg

SEQ ID NO: 116293 - DNA, 1003 bp, Heterodera glycines
  Promoter: Source sequence=SeqID_484; Location=1414..2416; Strand=+; Gene=SeqID_54028
cgtttttggcagagcgagaacaacgtgtgcgggcgagacgacgaagcatctgtgcgtgagctttcagcttctttaaatgacgtggacgcaatggaactcggcccttttagaatgttgagacaaatttctaccaggcataatagttgttcatcggatgcgtctcgaataacaattttcgcctttttggaattagacagtgtctccaaaaaggattcatttcttgcaatcaattgcgaccctttcattttggcatataaacgatttgtttttgttcatatatatttgttctaaggcgaatctcttccgaactctcggggtgcatgtcaaccaaaaggtagccaaaatttttagcgcatgcgtcccggtaggcttccataaagtgggcggtcattgacgggaagaggtgggtggctattgtacggatctgaagagcacccgctgggtttcgcattaataccaaataatgtgaatttgtgcgagcgacgcgcaactctttgttgaacaggtgttgggtcaccaaaattacgctcacgccccaattgtgtgagccgcgtgtgaaaagcgagtccaaatactgttgactcatccccactaccaaatcatccaatattagcaagagtttttcttttttggcgcaatcgcgtacctgttccgcagatgggaccccgctgtgcacagttactggcaatttgccaatttttccagtgcgttgcaaattcaaaacattagtgttcaactctccgtagccataaataacgcgctcaatgggggtagagatcattttctctaaattgcgtagaagactcattacccactctgacttcccactgcatgtactcccagatacaatcattgtgaatggatgacgaaattgcaagtccacgtgttcaaagcttggaaacgaatccatttttttttattgcgcgttgatatttaatatatatatatatatatatatatatatatataaattgatttcattacagattaattttttttaatg

SEQ ID NO: 116294 - DNA, 140 bp, Heterodera glycines
  Promoter: Source sequence=SeqID_11096; Location=2441..2580; Strand=+; Gene=SeqID_74427
gctgcaattctctcgggttctgttcttgatttttttcaaaattggctctaactttttgcatgggttaggttgaagtgaacaccggcgcactcggtggcgttggagcatgttcacgcgtgtccgagcatcataaacggatg

SEQ ID NO: 116295 - DNA, 98 bp, Heterodera glycines
  Promoter: Source sequence=SeqID_8978; Location=1..98; Strand=+; Gene =SeqID_69897
atgtttcaagccaaccgcataaatatgcagttgattccatacaattgcaaccaaaagcgagatattatcaaatttacgataattttggcgatgaaatg

SEQ ID NO: 116296 - DNA, 125 bp, Heterodera glycines
  Promoter: Source sequence=SeqID_13887; Location=1..125; Strand=+; Gene=SeqID_77833
tattgataattgcaaaaaaaaattcccggcggtgccttcagcaccgcaacggtttgccaagaattgcagaaattttttttttttcgttttctgtctgacatcataaggccaaggagcaaacaatg

SEQ ID NO: 116297 - DNA, 80 bp, Heterodera glycines
  Promoter: Source sequence=SeqID_37776; Location=1157..1236; Strand=-; Gene=SeqID_66768
gaaaaaaatttgcagtcaaaaattattcgatttctccaattttgtttccatatttccgaaagttattcggtatcataatg

SEQ ID NO: 116298 - DNA, 698 bp, Heterodera glycines
  Promoter: Source sequence=SeqID_3998; Location=1..698; Strand=+; Gene= SeqID_45693
atgcgaaggcgccaaattcgccaaccaatgggccaatgggaaatgaatgtataaaaagggaaacgttggattaaacagaccttagaaaagatttgatttaccagacaaacttcagaactgatctcaccaattttatgctattatttaaatcttcggattccatttttgacatcattttgaatattgtcagtcgcgctcaattcctgtcagttcgcccaccacatcccatcatacaatatcatatttttttattatatcttttattttttgatcgtacaaatttgtgaaagagagtccattgattagatttaaaaagcgactttttgaattgtgaattcttagttcgaaatagttttttttatcgcagtcgtggaatgtacctaattgtgcctttccttgtattcgctagtgtttgtttttctcaattggccgtcaaaataacagaaataaaagatgattttttctactgttattcaattcattcatcaattttgccattgtatttgtcaaaatgacagaaatttaatttacctctcctttaaatgatattttgattaactgataaattgtttagttattttactgccatgcacaacatactcaaaaggttctttgcgaatgtttcgccttcgcttttaaagaagcccctcaacgacccatttccgattgctgcgtggcgctcgcacccggccaacatg

SEQ ID NO: 116299 - DNA, 628 bp, Heterodera glycines
  Promoter: Source sequence=SeqID_3249; Location=1152..1779; Strand=-; Gene=SeqID_83907
tttttaatctaatgctttattaaaatgataaatcaacaataggaagggcatatttatatgagccgagctcgtaacaaatacaaaatggggaaggaaaagtgatgaaattgagtgaaatttaacacttaaataaaccaatcttggcctgatgagccgcgcactgccatccatgaagcacaagacgacagggcacctaaacagctctgggaattagacaagtcaaaagcattacctcaagatctaaaaaacaaattaacaaaattgctgccaggataaacggtactctgtaggtcgagctaccgccctggttaacagcaaaattggaaatggaaaatttttattaagaatataattaagggtaaggaacaaatgaaaaattctctgtacagtctcgcttttaaagctggtgtctccgcccattaatcgataacttttcggcgaatcaatttgcatttccctctgggaaatgccatatggtaacagatgtttgcaaacaatcgataattttcaaagccaattcaaattttcactgattcccgagggaacggcatcgccttctggtatcatgcatcctaaagccaacctatgcatgcatttattcattcatttcttttttttcactacaatg

SEQ ID NO: 116300 - DNA, 1003 bp, Heterodera glycines
  Promoter: Source sequence=SeqID_14511; Location=614..1616; Strand=-; Gene=SeqID_78562
ctctggggtttttgagatcgctgctaatctctaccgaattgccttttgaatgatgggtctacgacttaaacacgcagaacaagagaggttaaaagtctttttcgagaaaatttgaattttgctgttgcactgccttcgtcccaaaacttttgcaatgactgtataaaacagggttcctgtcggccaaactcggtttcaatggacaggtcggggttttgcccgtcccttttgcataggtgtattagccaaaaagcgatgtttgaaaactcagtttaaaaattcgagtttataattccctaaatttagaaaattattccaaattcattataaaaggcattcctaaactaagttaaaatggttaaaacgctgtttaaaaatttagccacaattctctttttttgagtagcgatgtttcggtgccaaaatttaatttaccgtccttcgtttgataaggtattcccccccccccccttacagttgtaacttacatcgctggtcagcaacaatatttccataatgtatccattttttgaattttcgcaatttacttgattcaaatgcccgttttaccgggcctcattctcgagatttttcgcatgattaggaagtcgggattcatgaaaatcctgtagtcaaaatattcatattcgaaattttactttgtcctttttcgtactataatttctctccattaaccgataaaaataaataaatttattttttaacaaaaaactaaatgatgagtcatctcatcacttcattttcatttccatccccaatcccaacccattcgcatcattatgaatgggatagtgtggtggttggtgatcggagcattttatcccattcatttggactgggcgttgggctttcattccatcgtttagcgattcatttacataaatttattagcggaatttgtaaaaatatattttaaaacaaaaataaatggttaacagaaaaacattttgtaattatttctcgccattttgaagccaaaatg

SEQ ID NO: 116301 - DNA, 167 bp, Heterodera glycines
  Promoter: Source sequence=SeqID_15152; Location=644..810; Strand=+; Gene=SeqID_79344
agggggacatcgaacggcgttggggggacagagcgggaggacgcgcaatcggaatactttgccaacagtcaagtagaggcaattaacaaattaatactaattgccgaaacaattagcaaatgtttagagaaatacgaaccgtttcagcagtaataacaacggaaatg

SEQ ID NO: 116302 - DNA, 356 bp, Heterodera glycines
  Promoter: Source sequence=SeqID_24217; Location=1324..1679; Strand=-; Gene=SeqID_54933
ttttttattattttattgttatttgactcttcgtaaataaattattttatttgttggtctttctcactcggacaaaagacacaacaaatttggcgcagtcagcagtcgtcttcaaccaacaagaagacacccggactgcacaccaacaaaaccaatagtccctagacgggtgaggtctgcaaattctgcagtttttcgccatcgacaaaaccaatagtccctaggcgggtgaggtctgcatatattgcagttaattcgccgaaaaaccaaaagacctgagaaaggttgcggttccgcaatacgcggtttttcaactttggactctcaaattcggcaccggcaaacacttcggcatg

SEQ ID NO: 116303 - DNA, 132 bp, Heterodera glycines
  Promoter: Source sequence=SeqID_7916; Location=1..132; Strand=+; Gene= SeqID_66366
aacaggtgatcaagaaatgattgaatagagaatattttccatataaaagaccctcaaatttgtctgtaatcagtttcaaatcgtattttaattccaaaaatcaacaaattcacctcccatttttacaaaatg

SEQ ID NO: 116304 - DNA, 916 bp, Heterodera glycines
  Promoter: Source sequence=SeqID_1951; Location=1207..2122; Strand=-; Gene=SeqID_76978
tttggagaccaaaattgtaatttttttatattaataattaattccttaccgtcgtccaagggcgtagccagacccttggctttgggggggggggctgaagtctaaaattcgatttttaggtgtgtatttttcttttttaagtcgatttttaggggtgtatttttggttttttgaaatcctgaattatggggtgtattttacaaaatttttcgccgtttttcgccaaaaaattaatttttttttgccattttggcctccatttttcaaaaattttttattaaaaacaaaaaatcagtgagagaagaaaaaattaagatcgagataaatttctgtaattagcatttgctttcctttcgtcggcttttcctacgtctcgttaaaaagtggtcggctggcatggcaaaaaagcttatataaagatacaattgtgaataaaaataaaagtgcaatccacttaatgggcaaaaaatatattgatggattttattgcctcgaaccaatatggaaaatatttaaaaatacatttaaaataattaaatttatttattaatataattttctgtactgaaatgaccccatccctctaaaagtctctgattttttgtttttaataaaaaatgagaaaactataaatgttagttttattgagatttaaaaatattataaaataaacgcattaattaagtagattattattattatttaaaataattattttgcttttaatttattaataattattttgctttaatttgttcactttgcactttttcgtgcttcgactcagcacgttttagcgcaataagctaaattcactgactactggtttaaaaatagttttaacgattttgaggtcccacaacttttttcaatttaatttttgtcaaaaaattctttcagattcgtgggttacatg

SEQ ID NO: 116305 - DNA, 747 bp, Heterodera glycines
  Promoter: Source sequence=SeqID_2627; Location=1319..2065; Strand=+; Gene=SeqID_80789
ttgaggatgtgaaggtggcaaaattttggccaatttgagccctttaaagggggggggggataaatttaaaatatatatcccttttttaaatttaaatatattcatttaaatttgtacaaaattccactaaatatatcacattaatatgcactattattattatttttttcttcgattaatagataattaattatagaacaatttagacatatctttatgttcatcattatgcgactggaaaactaatttacaggtactgaaaacaaaaaagccgtacatttcaaattggttagtcatcgttaggatttcgggattaaaattattattattttttttacttggatactgatcatgaattaaaaaggtcttcttttattatcacgagggtgcggattttttgtaaatgaattaaatttaatattaaaaaaaagatttttcataatttttgatgaatttaaatttaattttaagaattccattgggcattggcactgtcagccaatgctatggcgatcgagatgatgtggaggcatttttcagcttcaactcatttttggagccacccacttttttccgtgctgatttttcactcgtcgagaaaacatcaatgcttcaattggaacaggcaaaaccaaaaaaaacagctatttaaattaatttaaatattttatttttggttcaaattcggttacatgttactctgtgcaaaaacagaatgaaatggcttttatataaaatttcaaaatg

SEQ ID NO: 116306 - DNA, 75 bp, Heterodera glycines
  Promoter: Source sequence=SeqID_17958; Location=1..75; Strand=+; Gene= SeqID_82523
ccacatcttttcacacgcttccgtgaaaatgaagacactttagtggctctgcgatctgtccaagcattcgcaatg

SEQ ID NO: 116307 - DNA, 1003 bp, Heterodera glycines
  Promoter: Source sequence=SeqID_7254; Location=1993..2995; Strand=-; Gene=SeqID_64266
gcttctctcgacataattaaatcgcagaaaaatatgttaaaacataaaaatcccagccctaatagtaatttagcactcttatttaatttatcaaattcactttaaatatagaatttattaaacatgcgaaagtgtgattttttaattcccgttttaaaactgaaaagcggtgtgttttttgggctgtgaaaatggaaaaaaattggccattttgagggcaattttgaagataaatcagaacatttaattaagtaaaatttgggagcgccggatttttcacagcaaagaatattcgagagaaatatttaaaattttaagaggacttttcgatagaggaattttcgacagtatagagtaaatattcacaaatttgggcaaaaggtcaaaataaagtttttaaaaaattctcactagtaataatgattagcaatacagcaatgcacatttatatgtaaatttataagaaatttagaaactggaaaaaatttaatttattttaatataagatttattttcatgtttactgtcgaaattccatcatattttattttctgtaaaaatcctttattgtcgaaatatcctttgaaatccgctgtcgataagtccttatgccgaaaagtccgctgaccaaaagtcgggagccaaattaggagccttaaaatcagaaaatttttgtaaaatcagaatacccgagccctagaaaaaaatgagtgatcatcagatcaagttggggtaaagacttgttgatcagacattttacaccgaaattaggccaatttgtggggacgcacaaagataattcctctttgccatctactttggccatgcctttatacttttccgataatcgacattcctttactaatcatttcatttttcccattatgctttcattataaacgcatttatcttttaacttatcttttaattttagccaagtactataatttttatttaaatatggatcccggattttttctagatgaggccgccaaaaaaaatg

SEQ ID NO: 116308 - DNA, 156 bp, Heterodera glycines
  Promoter: Source sequence=SeqID_5025; Location=681..836; Strand=-; Gene=SeqID_56614
agagaattggcccgagtccatggcattacaattgggaccagacatgtatataataattgtcagtgaaaagattaaggaaagaaatttaagggcgtaattgatgatttactcgcaaaattatcaaacacagtgctgccccaatgttttatgaatatg

SEQ ID NO: 116309 - DNA, 138 bp, Heterodera glycines
  Promoter: Source sequence=SeqID_25206; Location=1760..1897; Strand=-; Gene=SeqID_55948
tttttgcgtatgaagtaaaaatgtagattttatgaaaaaaaaaattaaattttttggccttttgtcagagcaattattaatttttagaaaatttatcctagaaatagtcaattttcagtaagactaatagagcatatg

SEQ ID NO: 116310 - DNA, 115 bp, Heterodera glycines
  Promoter: Source sequence=SeqID_35; Location=7347..7461; Strand=-; Gene=SeqID_52148
acgaatttcagaaattacaattgaaattcacacaccgtttggtgaattcgttaaatttcactggggaagttgtattcttacattacattttaagaaaagtatattttaaaaaatg

SEQ ID NO: 116311 - DNA, 319 bp, Heterodera glycines
  Promoter: Source sequence=SeqID_28386; Location=1..319; Strand=+; Gene=SeqID_59013
ttgttatcgttctaaaattgataaaatcaagcaaaattctttaaaactcattgaaacacgaaagaaaattacattacataaaagtgaattttaacaattttgtttttgactttttgttcgagtccgggattcgaaacaggccaagttgaatgccagatttacgacacgacctcgaaacccccctacaaacatatttcacgattttttaaaacgaaaattttctgccaaaaaagggggagggtatcatcaatcatcaccaactcaacgtttatcctgtcctttttccagcttgctcggctttgtgttcatcgccacgatg

SEQ ID NO: 116312 - DNA, 613 bp, Heterodera glycines
  Promoter: Source sequence=SeqID_15038; Location=1766..2378; Strand=+; Gene=SeqID_79212
accaattgcctccacctaccaccctacagtatcctgcggcactcattgtgaaccgtgacccccatcacaaagggggctcccattggtgtgccatttatgcccgggacttggacgcgccagtgatttactttgatagccttgcccttcccataccaccaagtattttatcatcctttttaaataaatttcccaaaggtttacacaaaaacattgaagcctaccaatctccattgacatcaacatgtgccccccattgtattgtgtttgtttaccacatgtcccatggaaaatcattcgataaatttatacatattctcaaaacttgttcaaaccctgacatgtattcattaataatattaaataaaatgttgaacagttaaattatattttcaatttcttaattttttcaaaattgtgtcttccacctactaattatgcattattctacctaaaagttacattttccaacgcttaattattttcgtactttatttcccattcattaattatgcatgcaataaaataaaaaggggcggagcttaaccatttgagttggaacaccggtataaaagccgctcgaatttcttcattcagacataaaaaatctgaaatg

SEQ ID NO: 116313 - DNA, 815 bp, Heterodera glycines
  Promoter: Source sequence=SeqID_11755; Location=3585..4399; Strand=-; Gene=SeqID_75250
cgggtcaatggcaactggtacaaaaaaaaaatttctaagattttcaactaaaacttagaatttttcgataaaaaaaaatctaaatgaattttttatcctagaaaaacttttaaaaaaattctttaaaattttttttactaatttttcagctgattttttttattttcttaaattttttgaaaatttaagtcctttaaaaagtttttctaggctaaaaatccatttagatttttttcatctaaaaattctaagttttagttgaaaattcttagaaatttttttttgtacgagttgccatgacaccaaaaaaccaaaaaaaataaatgtttttaaatgcccagctagctgcataacgttccgtgaaaaactgcgtttcactctcctgtatgaaaacaggcatcgtgaaacagaaaatcgtgtcctacatttaaagcctaggataaacaatccataaaactggaaacccttgaaaaagtgttgttgtaatccccaggatcagagctgagagatttaatttttttaaatttttaatcactttgtttgaaaatgctcattttttttcttcagctcgtagttgtcagaatgactaggattttgcaggaaaacaccttagcattaggggaggcctatctgcctgcaaaattcaaaaaaatttcagacattcaaaacttttgtacagacattaaagttgaaaatttttcacggttttagtataaaaatgcccttgtttctttccctcctcctcattccattcattctctcattcattcattctccctaatatttccgccgatcattttgttgctgcaaaaatg

SEQ ID NO: 116314 - DNA, 157 bp, Heterodera glycines
  Promoter: Source sequence=SeqID_21070; Location=374..530; Strand=+; Gene=SeqID_51661
tcgggcgtttatccaaaaatatttttaaatttaaatccaaaaaaaaattaaaaaattattttacaccaaaaaaggtttgcgtgatcagatgaagaattccatgcaatcagtgccttgtgatgtcaaacaacaggtggtgaatgcttgcaccaacatg

SEQ ID NO: 116315 - DNA, 567 bp, Heterodera glycines
  Promoter: Source sequence=SeqID_822; Location=626..1192; Strand=+; Gene=SeqID_62032
agtgcgtcgtttgcattgcgattttttggaaattttaatttttttttattctgatggagggttataattttaaaaattttaattttatttttcatttcatttttatataaataattgaaattcttacggacaacaaattggtttctttttgacaaattagagttgcaagaataaatttttgcagcaacaagtggaaaattaaattttcattctccaataaatataattatattgaaaattattttttttacatattttggcagtaatatttaatatatatttttttttaaatatttttaatgtaatttaataaattgaagaaagttttctaaattttacactcaatttaatataagaattgctgtaatgttcatatttttgcattatgactttatttcgcgatttaataaccaaaaaattagatgctattttttgcactttttattttccaatttttaattacgttttgtaatattttccaataaatttgaaattttttaaattttacaaaattcacagtttttttttcttggcagaagccatgttgaagccgaactgtggaacatg

SEQ ID NO: 116316 - DNA, 911 bp, Heterodera glycines
  Promoter: Source sequence=SeqID_9510; Location=2305..3215; Strand=-; Gene=SeqID_71690
aagaattgaataaatttaaaaaatatttttgagaaattttaaatattctataaaaatatttttttgaaatattcaaaaaatctttaataaaaatatgtatatttttgaaatgaatgtaagcatttcgcactcttcgtgactttaatccacataattggcattcttaattaatcatcaacaaagcttattcgaacgttttccatgagatgaaagtgaatattatgcaagaatatggagctcttcttggccttgtgtatttgatgaaaattaaatggaattgtgaatggtttaaattaaaatgtattttcaaagttcgtaattttttttgtttggctttttgagtttatgaaattttgaaatatatttttttctatagcctggcgcaaacgggatcccgcattttttggagatttcaggattaatcccgcggggtcccgtcccgcaaaattttttagtaccaatcccgaagcgggacccgcaaatgtaattttttgtgcgctattcctcgggaatgaattggattttttgaaaattcaaaagacagaatgtcaagtattgtttaaataaaattaataattttaatcaataaaatctaaaatctaaaaatgtaaaaaaagttaaatggttaaatttttatggattgattccattaacaaagttaactttgaagtttttcgagatttcaaagatgatgcaatcctgcgcgggatcccgcaaattttcaatgcggagttttcgggattaatccgcgggatcccatagtgcaaaaatttgtactgaagttatttttatttataaatttaaatggttttagcatcctaaaaatttttttaaataaaactaattaaagctcaaatattgtgctttattgaaatcaaataaatttttaaaatactttagataagaagatg

SEQ ID NO: 116317 - DNA, 516 bp, Heterodera glycines
  Promoter: Source sequence=SeqID_12918; Location=1..516; Strand=+; Gene=SeqID_76661
aactagcgggtgcgtgaaccgtcggctatttagctgggaaaaagcgcttcgcgctttgggagcttcgctacctagataagcattgagtttttttagagatttggaatttattttaaaatcttaaggggttttaaggccgcttcgcggcctcagacgggcgcttcgcgcccgttttttaaattgttgagctcatacgggcgcttcacgcccgttttttaaattgttgagctcatacgggcgcttcgcgcccgtttttaaattttgatgtgcattttcggccgcttcgcggcctcagacgggcgcttcgcgcccgtttttaaaattttgttggaccttttcggccgcttggcgcccttttccaaagtttgttgagcttggacgggcgctacgcgcccgtttttaaatatggtttggaatggacgggtgcttcgggcccgtttttgaaattttgttggactcatacgggcgcttcgcgcccgtttttaaattttggttatcagaagaggtacaaaaatg

SEQ ID NO: 116318 - DNA, 540 bp, Heterodera glycines
  Promoter: Source sequence=SeqID_1401; Location=1748..2287; Strand=-; Gene=SeqID_73288
gctaaaaaggaaaaagggaggaaacaatgaaaaattgtcaaaatattcattttattgccttccatcgtcgtcatgattatttctcctcccataattttagccgtcggagtgcacgcggtaacaaaatgaatgatacagaaataattaatcgacaatttcatggcaattttatcaaaaaattatccaaatgattttgaatattcagaaatgaccataataccaaagcaattaatgtaaattgatcatcactaattgcaacaaaatgtgtgggatttcctgtctgcaatgagaacagaataatgatggtgtccacttcaaagtgacgactgttcactaatgacccgactaattgtaaacaatacaaacaaaagaaacggtcggagtctcaaaacaagaaaagaagccgcccattctttaattatttaattgtgggcttttgaaagctttcaatttaaaaagcaccttttaaaaagtaatagattaatagaaataattgacatattatgataaaatgaaaatattttaataaaaagaaaaatg

SEQ ID NO: 116319 - DNA, 564 bp, Heterodera glycines
  Promoter: Source sequence=SeqID_29353; Location=816..1379; Strand=-; Gene=SeqID_59860
tttttgcaccacaatctcaaaatttacgattttcattatgaataatttttagaaaaaaatttcgcgtttcgtgttcgtatatttgtattttcgtgtttttaggacgtttcgtgttcgtgtttcgtattttattttagtttcgtattattcgtattttatttttcgattcgcaacatccctggtgcgcaggtagtggtcgacgaatcgttcgatataaatgcaaattaatttcgcaaaatttagttaaaaaactgcaaacagaccataaaaataaaaattgtttttaaattttctagggggttttcgggtagatatggcgaaacgggtcagttgcgtctggccaattgcgtctggccagttgcgtcttgaccagttgcgtctggccaattgcgtctggccggttgcgtcttagtacttatggggccggttgcgtctcaatacggggttaactaattcggactgaaattgtgcggggtggaaacatagtgcacccatatcagaaaattgtttttgcatttttatacatttcatttgttttaaatcttttaatatagcccgaaaatg

SEQ ID NO: 116320 - DNA, 70 bp, Heterodera glycines
  Promoter: Source sequence=SeqID_13508; Location=1..70; Strand=+; Gene= SeqID_77403
ttttctaattgttcgccatccaaccacttttttaaggcgcaaaatcagcggttccaagacattgatcatg

SEQ ID NO: 116321 - DNA, 229 bp, Heterodera glycines
  misc_feature (82)..(82): n is a, c, g, or t
  misc_feature (103)..(103): n is a, c, g, or t
  misc_feature (108)..(108): n is a, c, g, or t
  Promoter: Source sequence=SeqID_19519; Location=2598..2826; Strand=-; Gene=SeqID_84250
ataaatttggagtttaagcaacaaaacaaaattcaaaaaaattcaattacgacactaaaaaaactatgaattcaatcttttntgaacagtgccaagaatgttntaatntagttcaaaggaacaaaaattatggtccaaaaactcttcggcaacattttgtcccgcctccgattaaattattatttatttattatcaatttaaattaattaattaaggtaattgtgaatg

SEQ ID NO: 116322 - DNA, 196 bp, Heterodera glycines
  Promoter: Source sequence=SeqID_28529; Location=1306..1501; Strand=-; Gene=SeqID_59137
ttttggggctgatgctatacacggctgaacatcatttctgaatacgaatgtcacccgtaagcaattaaaattaaatgctgcttttgatgaaaaatttattttggaaattatgatcataactttaactttttcaaatgcacaaatctaaacttatttgtgttattagtagggatgaatttttaattgataaaaaatg

SEQ ID NO: 116323 - DNA, 1003 bp, Heterodera glycines
  Promoter: Source sequence=SeqID_34227; Location=775..1777; Strand=-; Gene=SeqID_64069
cccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttcttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagattaatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggagtagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagtctgtactttaattctgcgttggatttttgctccccataaatgtttgagtaccccaaacggacacttgaaaaaatagatttttttgttttcggggcagtccccccgaaccgatgcgcccagatttatggggagaccgaatcttcgggagtagcttccctatagcctgtactttaattctgcgttggatttttgctccccataaatgtttgagtaccccaaacggacacttgaaaaaatcgatttttttgtttcataaatatttttttcagaaagtcatg

SEQ ID NO: 116324 - DNA, 127 bp, Heterodera glycines
  Promoter: Source sequence=SeqID_38195; Location=550..676; Strand=-; Gene=SeqID_67088
gggggggcaccacaatttttagagagtaaaaaacgaaattgtttccaaaaatgtttttggcatttcaattttcctctacttttaggtggtcaaacaaattgaattaggcaagcacccgttcatcatg

SEQ ID NO: 116325 - DNA, 381 bp, Heterodera glycines
  Promoter: Source sequence=SeqID_20887; Location=1..381; Strand=+; Gene=SeqID_51470
aatgtaggagattcaaatgtcttgcaccctttgcccaattaattaattaccccttttctacagcagatgatgatgttgctgacttgcagcagccggtcagccttttctcctttacaatcctttcgcttttcacatggaattgttggcgaaatgcacgcgcagctgaaaaaatgtccaaaaaggcggcataatgtgccaaaaaattcattaattggataaaaaaaaataaatatgtatttattaatatttggatttgcaatttgtttcatggcaattttggatacaatcagccgatgatttattttgttttttgatcccattttatttgtcttttttcgtaatttttaattttgtttgccctccccccaccccaattaaatg

SEQ ID NO: 116326 - DNA, 300 bp, Heterodera glycines
  Promoter: Source sequence=SeqID_18407; Location=420..719; Strand=+; Gene=SeqID_83003
ttattttctcccgctgttctgtctcattcattattattttattatcattttcagttctaaattatttctgttttgctccttccatttttgccttcctctgactccgtcgtcatcattattttatttgttttgttttattatttatttgtttgttatcatttgtcttttctaaaataaatttaattctgttgttccttgcggacacaacattggcgacgcccgtaagtgaaatgccttattttcatcacaggtttgagcgacgcgcacaaagaacttcgacaagagtgtctccgccaaatg

SEQ ID NO: 116327 - DNA, 461 bp, Heterodera glycines
  Promoter: Source sequence=SeqID_20013; Location=1331..1791; Strand=-; Gene=SeqID_84789
ttattatgaactgaaattgctaattatttaataaattcttacttaattaaattattttttaaaactaaaaatgatatcatttttagttttaaaaaataatttatcattttttaactaaatacatatttaatattactcaaaagttttgccacatatttaatttgcttctccacttcaattattacccatttgatattgtaatccatcaaaatttataacacattactctcattgcgacacccaattaaataattggcttttagttcggcatttttatttttggtgtcaaaaaataataatgaatttgacttttcgcaaataaatttgtttgcaaaatataaaaaaaaagtaatacttaaaaataaatttaattttaattttaattcccttctttaaattaatccttacaaaaagtgaaattttctatttatcctctaaaaattttaattttttaaaagatg

SEQ ID NO: 116328 - DNA, 176 bp, Heterodera glycines
  misc_feature (39)..(39): n is a, c, g, or t
  misc_feature (70)..(70): n is a, c, g, or t
  misc_feature (147)..(148): n is a, c, g, or t
  Promoter: Source sequence=SeqID_1203; Location=1..176; Strand=+; Gene= SeqID_69860
aaaactggcatgacaaaaagacaccatataatttttcanccttgtatttctataaaaatgcttttatttnttattcatgaaaattaataattgtttcgatttatcgataaaccccatgttttttttaaattaatttcccaattggtnnttatttctttacaattagtccatcaatg

SEQ ID NO: 116329 - DNA, 346 bp, Heterodera glycines
  Promoter: Source sequence=SeqID_197; Location=275..620; Strand=-; Gene=SeqID_77174
gccctaataattatcattttagttgcttcttttttaagaaaaggaccctacaaattgctccttaaaaaagaattcgtaaaataggttaacattgactattagttcttacagaatgccaaatttttggggccaagtgccgccgttttcatttgaaatataaagtaacttgaaatttttcaaagcaaaaaaaaaagaaagaaaataaagtacgcacttggaaacaagtaaagtacgagtccggagtaacggtaatttccgattttactgttcttactccttgaacttctccctccccccccgcccctgttccttttagtccgtcgttgattttgggtcggggaaaatg

SEQ ID NO: 116330 - DNA, 436 bp, Heterodera glycines
  misc_feature (74)..(74): n is a, c, g, or t
  Promoter: Source sequence=SeqID_14173; Location=1..436; Strand=+; Gene=SeqID_78179
attaaaaaatgtcagaatgaatgaatcataagctgaagctggattctctgttattgaagcaaacaaaaaggagnaagaatgctaaaatcattttttgtgacattttccactggaacatttaaaaaaaaaagattttaattatgcgttaatttttattccgttttcagtgtctgctaattttcgaatttgccgctccaattcgcttctgtttacccttttctgctggtcaatgactaaattttcatggggtttcctgcgccgtggcgacaatgttcgagtaattattgaatatttttaccattttcaattcattttattacatattaagcatttctccaccaatccgttctctgtcctgattttgttcgtccttttcgccgtcttttccaactttgtcaattgctctgatcctccagtcggtctttccgcaaaaatg

SEQ ID NO: 116331 - DNA, 71 bp, Heterodera glycines
  Promoter: Source sequence=SeqID_31255; Location=468..538; Strand=-; Gene=SeqID_61628
ggtaaaagtttcgaaaaatcaaataaataaaatataaaagaactcagacaaaaaataaatataataaaatg

SEQ ID NO: 116332 - DNA, 93 bp, Heterodera glycines
  Promoter: Source sequence=SeqID_37371; Location=1..93; Strand=+; Gene= SeqID_66460
ggtaccggtaccgctcaaccctacttttttcaaataattaaatttaatatatttataaattatgtacaaaaagacacttaaggcgtcgaaatg

SEQ ID NO: 116333 - DNA, 333 bp, Heterodera glycines
  Promoter: Source sequence=SeqID_5314; Location=1..333; Strand=+; Gene= SeqID_57649
ggcagggtctttaattcctttttaaacagtccaaaatgtttaggcttaactttttttttcagaaacttatcagaagcgccccaaacttcgcagggataccgaaaggaaaagaattaacctgttttatcacattagcttgtcatcagtttttataaaaaattttcaaaattctcgagtctcctattattttatttttttttcaaaattttgaagggcgggggggggggcgggtgatctgaatttatgagtgagcgtatacagaagatgttgatgacatactttaaatggcattttacgcggaagtgaaaaggtaaaaatgatcgggctataatg

SEQ ID NO: 116334 - DNA, 430 bp, Heterodera glycines
  Promoter: Source sequence=SeqID_20814; Location=1198..1627; Strand=+; Gene=SeqID_51395
tgagtccagtggttttgttttttgcaaatgtcacaaaacatttaaaaatttggagaacagagaaatttctattttgaccgcttcgtgtcttagacgagcgctcgcgccagtttctttgggtcggtggtcagtttggcgctgccaacttttaatgttctattcaaactaacgcgaaaaaaaccataatgccaaatatatttttttgtcaatgaaggaagccgctgcccgtcaaaatcccgctgcgtcaaaagtatttgtatgtatattttatattatacatatataaaaatatcagaatagattattctaagcaaaatgggtcgaaaaaattgaaattcttcataaatgttgtaaacacagatttctgaacaacaatgacggcgaaaatgcaaaaaattctgatcattgtgagcaaacgacaacaacaatg

SEQ ID NO: 116335 - DNA, 258 bp, Heterodera glycines
  Promoter: Source sequence=SeqID_13819; Location=1..258; Strand=+; Gene=SeqID_77754
atgcgattttttgtttaatttgcggttcagaaattaatattcatttttgaacaaaagaaaaaaaagaaaaaattgaaccaatgcaacgaaagaaattagtgaattgtcatagaaacaaagaagaatgtttcttacatatcagaatctgtgtataaaaatgaaagctttgaaaaggaattttatttttcaaccgaaacttttaaaatttgccattttaattctttggataaatcttcccatttattcgcttttgaaatg

SEQ ID NO: 116336 - DNA, 1003 bp, Heterodera glycines
  Promoter: Source sequence=SeqID_1900; Location=3423..4425; Strand=-; Gene=SeqID_76664
aggcttcagcttaggcctaggcttaggcttcagcttaggcctagacttcagcttaggcttagcattcagcttaggcttcagcttaggcttaccttaggcttcagcttaggcttaggcttaggcttcagattaggcttatctttcagcttaggcgtaggcttcagccctaggctttagcttaggcctatatccgtgttcagcaaactcgaaatccctaaaaatatgtcttccttttatttatcaattttgtcattgcttgaatctgcattcggggtttggaatcttgcaaaataaactcatactcgtgatcagctccacgaattatcctagacaacttatccacaatctattgagagaagttagtatagcacggtcgctcgagtcccagacgagttcggctcttcaattacggctctttttcatcctgaaaaagggctagcgcgcccttatttctattattcctatccatttccaccctttttacatcgattctgaccgtttttaagcatttttgagtttgtggcctatgatcaatattttccttattttcatttaaataaataaataattaattgttttctattttaagctgctgaggaacggttcttacaatcgcaaaatgatcagaagaaaattttggaaagaatcttcagtgaaatggagaaagaacagaaacagctgcagacaaaaggcgaggagaaattaaaatgaaaaaatatttaatcgaattaaatgtttccattttaaatttaaaaattaatccgatttttaagctactgcggggcaattgtcaaagattttggaaaaaattggtgaaatggaaaaacagaacgaaaacacggacaaaggcgagggaattttagcgaagaataatttatcacttattaaaaattctttttttttgaataagtttcttatgaattaagaatttcatttaaataaattataaaattttaatttttgaaaattaattttaggaattttggagcaattttcaaagatg

SEQ ID NO: 116337 - DNA, 183 bp, Heterodera glycines
  Promoter: Source sequence=SeqID_17728; Location=1234..1416; Strand=+; Gene=SeqID_82265
agctatatgtagtattataataaaaagaaaatttaatttgttgactttgctgagggataagattttttatattgtcattttcttacccccgggcggaatttataaaatgtcccaccaatacgtaaaattttttaatttactaattatatacaatttcttattttcctaacttttagaaaaatg

SEQ ID NO: 116338 - DNA, 243 bp, Heterodera glycines
  Promoter: Source sequence=SeqID_6936; Location=965..1207; Strand=+; Gene=SeqID_63343
aggagaaatttacttaaaccaatcacacaattaaaccctaaaaaagtacgggcaggaagaatgaataaacaaacgaagcactgcaaaaaatcacacaaaaatcaaaatcatcttttatttaaaaatctttaatatggcgttatgttgtttttccgctctaaagaaagaaaagcgtctctttttgccaaaagcctttaatcttaaattcaaatcccattttaattattcttttagcgatccatg

SEQ ID NO: 116339 - DNA, 55 bp, Heterodera glycines
  Promoter: Source sequence=SeqID_39162; Location=204..258; Strand=+; Gene=SeqID_67800
ggttttaatttgagcttatttttttcagttataaaatttttttagttgtctgatg

SEQ ID NO: 116340 - DNA, 1003 bp, Heterodera glycines
  Promoter: Source sequence=SeqID_5243; Location=571..1573; Strand=+; Gene=SeqID_57414
ttagttagtttttgtacagtcttatctcttatctgtttttcagcatgtaaatgattggaaagtagacttcacctgtcttagtgaaaatatggggtttcttacgatgagaaagtttcaacgagcattatcccattacggtaataaaatgtgtaggcttatgttgttgcgctctttaggatataattttacaacaccgtttctgcgaattcttttgcaccatttcgatcgaacacagacaggtaaaggtttaaaattatggtggttaccaatgcttaatcaatcaatatgtaccggaaggttttctatatttcgacgacttcatgcatatgtgcatttttttgcaacgactgacttcacctttccgtcatgtagacttagaccgggacggacgcgttgacattcgtgaacttagcctaacatttataatcgtttcttgggtggtgtttagatttcgaagaatttcttttaatgattatggcaacaaacatctaagtgttattccgctacttatcagctttgaccttatcaagtcattttatctttaggaccgcctccttgctgcccgaaaattcgacataaatagcgagagatgattagctttatttcacaattttcaccgtgcataaacgcgattaatctttaaccgagagcgaaccgctgttgattatttctttctacctttgctaacattacaatcaatcctcgcaccttctcttttctcaacagaaactcaatcaaaatgagcggactgaagcgcttccaaatcatctcatctcctaaaaaaaggacggccgacgactttccagccaaccctaaacagcttcaggatatagttaaatttaattcacctggtctattttatgttcgtgccaaagttgctgaccttcaattttccttatacaaggtattggttttccggtttatattaatagttgaatgagtttaggcgtgccctttaaaaaactttggcaaattatgtaagaaaaagcttgacagtgaaatg

SEQ ID NO: 116341 - DNA, 870 bp, Heterodera glycines
  Promoter: Source sequence=SeqID_21473; Location=236..1105; Strand=-; Gene=SeqID_52083
tgtcgtctgaaacaatacctaacctaatgttgtttatttatgattataataccgttattttcaaatttttcgactagcatctcgattaagtcctcgattaattgtgcagttattgctccaccgagggcaccgattgtcgcgcttgttaaaatatgcgcactctttagagtttttagtgttttggcggcttggtaaagggtagcaattgggtggcaattgctcacaacaacaataatgaataataaaaataaaaataataataataaaaataataataataaaaataataataacaataatgaataaaatcaaaaaaataaaatcaaaaaaataaaatcaaaaaaataataaaaataataataacaataatgaataataatacaaaattctgctttagttgtaccgaatcagctattgcaactttataccataaatgttttaattgaaacagctagttttgcaagcgcttacattttaatgcaaaataaggcccaaaatacttacttcagagcttttcaggttttggtgtagaacaaattttgcaaaaaaaactcataaataggctttaaacaatcacattcaaattgcaccacaaaccctcatgttggatttcgaaattggtaatgtaatcaaatgtatttgttttatgcaataataggtgccagaaacgcgtttttgcaagcagttcgcagtcttactgcactctcatttttaagggttgaacaggttcaacctgctttcaaccttttgagagcaagaatgaacctgttacaattccaaaacaacgcggattcaatctttgactattttggcaggtccactgatattaggaaattaaataaaatctaggttaggttggaaaaatgaatg

SEQ ID NO: 116342 - DNA, 65 bp, Heterodera glycines
  Promoter: Source sequence=SeqID_9660; Location=1..65; Strand=+; Gene =SeqID_72242
tgcttcctaattagtggtagtaataaatcctccttttcccccattctcacttttaggatgggatg

SEQ ID NO: 116343 - DNA, 599 bp, Heterodera glycines
  Promoter: Source sequence=SeqID_38338; Location=534..1132; Strand=-; Gene=SeqID_67183
cccagcatgttttccactataacattctataactttttctttgtcatccaagtccaataaacttggtatcatttgaaagcttaacatgtttagaaactttttctaagctattgcacaatgaaatattaattagcaaactttatgaaaattataaaattttaacatttttcttaataaaacttttggatgggttttttgcaacaaaattacaaaaatctgtaagacattttgctcaggaataacttgtcaattttccttagaaaactattttagaaaggaacaattcacaaccaacttttcatactttaaaactgaacattaattacaattttaattatttattttttgttgtccttccattttctttcataattagcaatttttaagtttttttttggttgtccttcaattttcttttattaattttaaagagtaaatccgggctgaatcccccacaaaaatccttgttttacaggcttcgggatcatatttagttttgaatattaaatcgtgaatgcttattttgtattttttttaatttttcaaaatcaaattaaattgcatttatatatttagtcaagctaaaatttctaaaaatg

SEQ ID NO: 116344 - DNA, 171 bp, Heterodera glycines
  Promoter: Source sequence=SeqID_10979; Location=1..171; Strand=+; Gene=SeqID_74288
attggacttgcttgaatgatttattttttttttcattcagttgagcattttgaacaatcattcagttatgaagggttagtgcaaccagcgaatttcgatgacatatgttcaacttcaaaaaatcaccatggaagctttggctctgccggatgcactccggtgaagaaaatg

SEQ ID NO: 116345 - DNA, 1003 bp, Heterodera glycines
  Promoter: Source sequence=SeqID_2506; Location=264..1266; Strand=+; Gene=SeqID_80120
tcagcatgagagaacaaaattactttatttgacttggacggtcccaggatttcggcgtgaagggcgtaccgcctccgggcgaaaatttatttttcttcatttccatcccttttatgcaatgcacatttctcaaaaaccttttgggaaaggaggagtcagacggaaaatttaaaaaaaaaaaatggaattttgagtgctatttgttaatggaatttattcaaaaagaccaaattttgggattttgagacaattgtgtaagaaaacagaggagttttagggatccgatggtggcgccaccggggaaacattttggcgattttgttaataaatttgcaccaaagattaatactaatttttgaaaaaaacggaaaaattcaaaattcgctatggtcaatttatatggtagggtgaactttattatagaatgcgttaacataaaaataaatgaataattcatgatcagcgcctaaatcacctttcaaaaaaacaattaaaatttcatgggagtcaaaaaacccataaatgaccatttatttttaaaaatttcattctaagaatgaaaaatttaaaccattatattcgaaaagggatgagatttatctttttccatctaaaagtcctatccatgcatatgtacaaatcaacaaattcaaatgaatttgctttgttctcctcatcgtttttcgggtcataattttgccgcaattattttgttattttgtgccctcccgcataaaaaaagtgaagctcatcagcagcagaaaatcctttacattacaaatctttttttacaattatacaatgagtaatgttcatttttaaataatacataaataacttaagctaataataaaatgtaaattatcgtttaaaaattaaaatgttaaacatattttttttctttaaattgacttacgctctgaaaataaaattttctttttaccgattttggcatttgaattgataaaattactagtttggcaattgctttatcattacaatg

SEQ ID NO: 116346 - DNA, 1003 bp, Heterodera glycines
  Promoter: Source sequence=SeqID_15407; Location=1372..2374; Strand=+; Gene=SeqID_79671
aaaatggagcaaatgaataattttgaaaatttataacatgtttaataaaaaaaaaataataattagatataaaattggataaatcatcccggaacatgatgaacgaacttaaactacaaccggcttcaacgtttgcacgcataattgtcaagtgaaagtatttatattaaatggtgatatgttaaaaaattaaacttgctcatataaataaaaatcaaacattttgattttacaccaagaatgcagtaattatagtaacatagaaataatgatatttgaaccataactatctttaacaatttactcaatttaaaattaatttattttatttgaatcaaaggctgcactttatcttaaaaatatattttattaaaaattttaaaattagtaaaacatattcaaaaaataattgtaaaagaattaaattatttcattataatttcaaaatatttattttactaaaaaagcagttaaagtgataaagaagctactagttataacatatttaacataacaaatttttaaaaatcgactattgcaataacaaaaatttaatttgaatatgcaaataaaagatgcaattgtataaatttgaagtttataacaataatataatatatatttaaaaaatattatttatcgcgaaaagaacattgttttgaaaaaatgagaaagggctcaaaaaccaatagagctctaaatttaaacccaattgttgtagaacaaaaatgcatctgcattaaataaacatctaaacgcataacaaaatcatgtaattgaattaaattcaaagcagtaagaaataaaatttttagtatttattaacaattatcatatatccgtggcccattatttatctaattatgaaaatttagggaatgtgaattaaagaaaggtaaggaaaaatgggaaagttgagtcgatgaaacaatacacgttaattatccctatttttgtggggaaaaaacaacaacacgtaatttaataattatgttttgttatg

SEQ ID NO: 116347 - DNA, 220 bp, Heterodera glycines
  Promoter: Source sequence=SeqID_9228; Location=2648..2867; Strand=-; Gene=SeqID_70687
aaggattctcacaattgcaaaatgaacagaagaaatttttggaaaaaatcagtgaattggaaaagcagcaaaaagagcagcacgaagaaatcacgaccaaaggcgagtgaattttaagctaagaacaaatttattatatgaattaagaatgttttatttagttaaatcgtccattttttaattttaaaaattaattttagttgaacaatttttaaaaatg

SEQ ID NO: 116348 - DNA, 262 bp, Heterodera glycines
  Promoter: Source sequence=SeqID_35366; Location=471..732; Strand=-; Gene=SeqID_64934
ttttgccgctctggtgacggccggcgggggtgacgcttcgtgtgcagctcgccccggtgttgggacgccttcgatgcgcggtactgttggaggcggaattggcggacttgaggtggcatttttttaaacatttttttcaatgtggaggaaaagaaggtggcaataccaaattttaaaattaaacatttttcgtttaaaggcgctcccgcccagtgtgcgtgaggcggttgcacttgtgcatgcgcggcagatgcagaagatg

SEQ ID NO: 116349 - DNA, 132 bp, Heterodera glycines
  Promoter: Source sequence=SeqID_4915; Location=1678..1809; Strand=-; Gene=SeqID_56183
aagtcctatttcattttcaactgattgattgcattgtgcctgtgaaaccttaaggtacaaacactaataatgctcgtctcgttcatttgttacatttgttttagagtgagcatacaagttggtgcaaggatg

SEQ ID NO: 116350 - DNA, 261 bp, Heterodera glycines
  Promoter: Source sequence=SeqID_10039; Location=862..1122; Strand=-; Gene=SeqID_73098
gctagaaatgaagttgtattacgccaacaaaaaagataagtaagtaagtatccatatggatgtgcaattctcgaaaaatacgtggaagaattttcatggcgtaagcgatttcaaggacgtggtgtttttttaatttttggtctcaagtggctgctatttatgaaatttcgtgaataaatatcagatttatgttttatttatgttaaaaagtgtttaagcaaatgtaaaatgagtgcatttataggcatttaaaaaactatg

SEQ ID NO: 116351 - DNA, 788 bp, Heterodera glycines
  Promoter: Source sequence=SeqID_22545; Location=260..1047; Strand=+; Gene=SeqID_53214
tcttaaatgggaagtagttacaagggggccagggtcccacttttggcgctaaatttgaattcaaaaatttgaattcaaatttgggcttgctttttttctctgcctatagggctatttcgtttattggctcgtgcctattgagcggttttgggaggtcagaaggtgtgggacgtgtttggcgccaagtttagaatttaaaattttctttttttctctgtcagaaagactgtttcgtttttcgtcatacacctattgaatggttttgggtgatgtcagtggaaatgaggcgctttggcgccaaatttaaattcaaaattcctgaaagtgttgaaaattgaataatttatgttttaaaccaggccagcgaccgagttgcggcgccggtcgtggcgctaaatttgaattcaaaaattcgaatcaaatttgggcttgctttttctctgcctatagggctatttcgtttattggctcgtgcctattgagcggttttgggaggtcagaaggtgtgggacgtgtttggcgccaagtttagaatttaaaattttctttttttctctgtcagaaagactgtttcgtttttcgtcgtacacctattgaatggttttgggtgatgtcagtggaaatgaggcgctttggcgccaaatttaaattcaaaattcctgaaagtgttgaaaattgaataatttatgttttaaaatattgtactattatttttgtaaataacaaaattttttattctcctagaaacaggaaattttttaattgttttcagcttttgtatcggaatg

SEQ ID NO: 116352 - DNA, 628 bp, Heterodera glycines
  Promoter: Source sequence=SeqID_14656; Location=1735..2362; Strand=-; Gene=SeqID_78762
gctaaaattgcaatggaattgaaaagcgaatgaattctctcgcctaaattgcatttactgtttttattttaattaacaaaaacccttcattttaagaaaaatttactgttttcctgaaaaattgtttgtaatttatttacataacaatgcaaacctttttacctattttatcgatataatgtttaaaagtaattttttaatgatttttttttggaatcaaaatgtttgggtcgaattcttttcgttattttgataaaaacttacgagctctgataagaaatatgtgctttataggtttttacaagtatgctttttttaaaaaaggacaaaagctgtaattgaagatttcataatttctccagctaaattagttttttcgcagttcattaattactttactgttcgctgttttgaaccagggatggacgaaatttcgtttcgttttcgtttcgtcctacattttcggcactttttgagtttcgttttcgtgtttcgttttcgtctaccaaagttttttcgtttcgtgtttcgttttcggtttttaaattttggattttcgtttcgtgtttcgttttcgtcagagcaaaattggacgaaaaagacgaaaatatttacacccttaagaatg

SEQ ID NO: 116353 - DNA, 147 bp, Heterodera glycines
  Promoter: Source sequence=SeqID_12088; Location=1944..2090; Strand=-; Gene=SeqID_75642
tattttctcatttcttattcatttcaacattttctgtatccctttccccacattttttttctccttttccatttcacaaatccatttcaattaatttccgtacattttagctataacaaatccaaatttccttttcccaaaaatatg

SEQ ID NO: 116354 - DNA, 358 bp, Heterodera glycines
  Promoter: Source sequence=SeqID_23394; Location=859..1216; Strand=-; Gene=SeqID_54098
agtccatgctttggcattttgggggggggggaatttcggaaagaatgtacgtccatacgaaaccttggaaattgttaaaattttgtcatgattttttttttaattttgaattatgaatttttcatatttcgggtatgaattagtattagagaccggacaagtgattcactcgacattttttaaataaaaaaaaattcttaaaatcgattttcggtaaaaatccaaaaattttgtgttaaatttagcatttcccccccccccccccccctcagctgccacccattgtcatgacgcgcgctatttgctgggcaagggtttgtacgccaaatttcgaccgaattgggatgacaagcaaatg

SEQ ID NO: 116355 - DNA, 322 bp, Heterodera glycines
  Promoter: Source sequence=SeqID_20559; Location=1253..1574; Strand=+; Gene=SeqID_51105
tttaattaataaaaagtgaaattgcaaaatcaaaaattatgtgaatttttagacaaaaaatttttaatttggaatttaacaaaatggaataaacaaaatgaaaattttcttcacaaccttcgtagagtgtgctggctgctctcaaaaattaagtaaatacaagaaaaagtcaaataatcaggtcaattagtgtgccattaattccttattgcaaaataaggacaccaagccaaaagcaaggacttttcaagggctgtcgttcatcaaaaaatgccaatttttgaaatttctaaaacaatttttccgaataattcacgagatg

SEQ ID NO: 116356 - DNA, 119 bp, Heterodera glycines
  Promoter: Source sequence=SeqID_24967; Location=1192..1310; Strand=-; Gene=SeqID_55702
acaactgtgtttgattagaagaggcacaacagtgatgagaagaggtacaaaagtgattaaaagaggaagaacagtgattaaaagaggaagaacagtgattagaagaggtacaaaaaatg

SEQ ID NO: 116357 - DNA, 214 bp, Heterodera glycines
  Promoter: Source sequence=SeqID_24725; Location=868..1081; Strand=+; Gene=SeqID_55473
ttccaccacggtgcccccaacatcaccgctgttatttgagcaaataaagaaagaaaaaaaatatgtgatttattcttcatcattgctgatttcgttgtcaaggacaagcaaaagtgcattattttcggggtcaataacaaatgaacgcatccaaacagcacatctatttcgacgcatcaaccattcccgagcgcgatgttaaatgataaaaatg

SEQ ID NO: 116358 - DNA, 197 bp, Heterodera glycines
  Promoter: Source sequence=SeqID_36333; Location=1..197; Strand=+; Gene=SeqID_65673
atttatttaattgttgataaaatttatttgaaggattgtgtgccgtttttatacaagctttgagagcattggccggaaacgaaaacactgtgacaatttattcgcttattatggaattgctaaaaaagggtgccaaaaaagacgacgaaaaaatcaggaacaaatttaaaaacttggcaaaaacattacgccaaatg

SEQ ID NO: 116359 - DNA, 96 bp, Heterodera glycines
  Promoter: Source sequence=SeqID_9608; Location=374..469; Strand=-; Gene=SeqID_72072
ttgtttgtcggctgttgcaccattctttggatgttttgggaccgattcaaaaaaacaccaaaacctccagcagaccaaatttgcctcgacaaaatg

SEQ ID NO: 116360 - DNA, 116 bp, Heterodera glycines
  Promoter: Source sequence=SeqID_24; Location=3871..3986; Strand=+; Gene=SeqID_80480
tttgtttaatagttaagagattattattatttctgtaaagctttattgtgtatatataatattttttaaacatggataatataagataaaccgttttgcaaaaaaaaaaaaaaatg

SEQ ID NO: 116361 - DNA, 247 bp, Heterodera glycines
  Promoter: Source sequence=SeqID_7424; Location=721..967; Strand=-; Gene=SeqID_46417
atcggcaaagtctctccaccacgtcatctaactaaatctaaagccatttatttttgccttaatttctaccctcaaattgcccaattgctatataattataaaatgtaattttaaattatgtataaatttcaatttttcacccataatttgtttttttaatgctttttctatgcagattaattacctttatgtttccattaaattttgattctttatcccccatccaagggataattaattaattatg

SEQ ID NO: 116362 - DNA, 174 bp, Heterodera glycines
  Promoter: Source sequence=SeqID_15584; Location=2110..2283; Strand=+; Gene=SeqID_79874
taaatgcaaccgctttttttgattttatatttaaaaaattattatttattccttaacacaaaaacccaattatttccaatatttttaaaattaaatatttacattaaactattaattaattaagccgaaataatttcaattgaatttgctactaaatatttcgcagcagagatg

SEQ ID NO: 116363 - DNA, 484 bp, Heterodera glycines
  misc_feature (63)..(63): n is a, c, g, or t
  Promoter: Source sequence=SeqID_9475; Location=2967..3450; Strand=-; Gene=SeqID_71558
agatagctaccaataaaaatggcactaattaaaaagtggcatttttgaatttattaaaaacanggggaaagggacccttttggtttgcaaattatttttgtcataataaatcgtgaaaactttgtttacaggggtttttggtgtcattgataatggatttgacagcaattttgaacaatatctaatccctaacccgaacttaacaaaaaagtcgaaaatttaatttctcgaatttcatttttttttaaattttagttagagattcgggattggatgaaatgtttgtcagattcgtgatcaacaacccggaaaattctcggaaacaattttaacgagtagacatcatcttaaaaaatgaataatattgcaaaccaaaaggttccttccacctttggtttttaataaaatttaaaaaactgacaatttttagaagcgcctataaaaactaaaaattttttttattgttgcagcatcccaaacgatg

SEQ ID NO: 116364 - DNA, 173 bp, Heterodera glycines
  Promoter: Source sequence=SeqID_21512; Location=1732..1904; Strand=-; Gene=SeqID_52123
atttaatgtttctttttttgaatcacgctgacacctttaaatttaatcatttgtttttgtaattgatgctttattaaaaccaataaaattttaacaaatatcctttaattgactctaataaatttcaataatttttttagtcttactaacataataattttcaggtataaatg

SEQ ID NO: 116365 - DNA, 414 bp, Heterodera glycines
  Promoter: Source sequence=SeqID_4141; Location=1..414; Strand=+; Gene= SeqID_53347
ataataaaattattatttaaactatgcgcataaaaaactaacaataaaaaaaagtgaaatgcatcaaaactttagcatctgtttttgtttttattctttagcatgctctgcaaatttcttgcaaaaaggcgaggagcaaaagcaccaaaatgaccatgccgaaaatgaccaatggggcgaaacgccttctgcgccgctgttgctttttcagcttctcttaacaaatgataataataataataatatattgtaatggcatttttttaattaaatttttaaatagtaatctaacggcacatattctacaatacttacacataatgatgatagtacaaaaaaataaaataaataaatattctttaaactttccccataaataacacaattcgggaacccgtaaatctcttagagatg

SEQ ID NO: 116366 - DNA, 374 bp, Heterodera glycines
  Promoter: Source sequence=SeqID_11865; Location=1..374; Strand=+; Gene=SeqID_75361
aggagtgatctgatcacttggtgttgctaccttttttgatcagcatccaaagttatgcttacctgaatttttttagatttttttaatgctgtgaaaaaaaatatgggtagtgttgttaaacatatgaccaccccaaaaagggagtgcagttggtaaaatggtttgtaactaataaggatagtgaatggtatcattataaagcccacaaaaaatgctacaagaaatataaaacatatatacacaatatagtcatattgagattttataatcaatttaaatcaaatttggtagaaaattttgagtgttgttaaacatatgaccatgactgtatgtcattttaatttacttcttcttctgtttacttcccgcagatg

SEQ ID NO: 116367 - DNA, 617 bp, Heterodera glycines
  Promoter: Source sequence=SeqID_30807; Location=1104..1720; Strand=-; Gene=SeqID_61188
tttttgatattttaccccctaataaatttttaattttgttttttttcaatgcacagatccgaactcattgagcgtcgcgttggcattcgcttcttcggcgatcggtcgctgttgcccgacaaaatttgcaaattggtggaggaaattgaggagatcagtgggacgacgagcacagagggcgaaagtgctacgaaaatgaggtgacaacaacggcccacagaacaatttgcaaaattacgctcaataaaattatttgcaaaaaatgaacattttttgaaagttaatatttttaaataatttctccattaaagttaaattatgttttcacttaaaaatatttttaaaaatttatttacatattttacaatttttcatattcattgatatttaatagtacgcattttctgagtcacagttctttcgcgaaactcttccaggcaaaccaaaattaactcttaacttaattcaaaaaatttttttctcaccaaaatgctattcgtctggtgtatgatttaccccaacttggggtatgaaagcgttcgaaaaatggcctagaaatcccttttttgtttgcaggactttcctgaacatttgcctctcttacacctcacaaaatg

SEQ ID NO: 116368 - DNA, 1003 bp, Heterodera glycines
  Promoter: Source sequence=SeqID_25957; Location=621..1623; Strand=+; Gene=SeqID_56709
tgctgaaaatgtgggagagagtggcggtcgccttaatcgatttccaccgccgacgtccgcgtggcccgtcgaataataaataaataaatgggtggtcatttgaccgtggtcatttatttgtttgaccctggtcagtcgggaaaggaccgtttgggcgccgccgtttcgacgcgatcccaagtctttgactatattttttttaagtttcaacaaaatctaactatcttagtatcatttgaaagcccttcatctgatctattagccttacaaaaagcaaaaaagcttttctaacctataaaaagttaaactaatcgcaaaacaataacttattgttagaaacagcttccaaacattataagcgctcgaatgataccaattttgttagatttggttgacaatgaaaaaaaattataggccaaaaacttgggctgtcgacgaaacgagcctactctggtcaattgaacggtcagcagaaatttcaacccatgaaaaattttattagttttttgaaaaaaatattttttggaattctttccttatattttcacctttaatttaacaaaaattttaacaaaattggttatatttatttctttgaataatttaattttcaaaatttcgaaacttctcgcaatcccgcgcggaattccgcaaaccaaatttttatgaataaattacaacatgtacacatttatacatttttggtgcttacctataacaccgttaaaaagtgttgagaatagacaaatataaaagtccttggagaaataaaaatgatatgtgtagcaaaaattgttatttaattaccgtaaatccgttatttgaaggcccgggccttctattgttcaacccctctataagtcaaatgtgaattgcctattttttgtacgtctacctatttattcattataaccatttttacattcaaatttcatggtaaatttgtaattttgaataaatttagtttaacaaattttgcttatatcaatttctcaataagatg

SEQ ID NO: 116369 - DNA, 371 bp, Heterodera glycines
  Promoter: Source sequence=SeqID_11577; Location=1..371; Strand=+; Gene=SeqID_75015
acaagcggggagatttctctcccgagggatgcacgacggagtggcgggcgcgcactccggaggaagtgcggcaatgccgtcccgggcccagcggcacgagcgggagccggtccgggacggtcggagcgggtccgagccgacccagccgaggagaagggaacgggcgaaaagtggaagccgagggtacgaggggagcagccgagagcaagcggcgggtgtggacacccgagccggtgcgcgatgaggtcgctgaactgctcgagcagacccgggcactgaaggaggcagaagcaaaagcaaaggaggacgtccttcgctgggagcggcgagccaaggaagcgaaagagaaggcagaagaggcagaagcgatg

SEQ ID NO: 116370 - DNA, 283 bp, Heterodera glycines
  Promoter: Source sequence=SeqID_42203; Location=1..283; Strand=+; Gene=SeqID_70154
tgactttaattttcatcactaatttttcactcagactcccattcttaccagtgcttgtttttcccggttccggttgccctaccgggaccgggacctgagcttttcaaaatccggggccgggaattcccggcccggtcccgcttcactctattaaaaagttaaatctgattttaagataggtaccatccaaaaataaaataccttcatacataaatcattcttttattcttttttgttatctgtttttcctttgcatttattaactctttttcagccagccatg

SEQ ID NO: 116371 - DNA, 389 bp, Heterodera glycines
  Promoter: Source sequence=SeqID_44351; Location=535..923; Strand=+; Gene=SeqID_71849
tttcctgctgctgcggttccgtcctccgattactccgtccctccgtggtccattcaaattattcgcctctgtttggcatttcgaagtgccccttggcaattattcgctcattcttccgacagcccccgcggcgtttcttcccttccccggcactgtttggctgagtttcgtctttggcccccgcttcttccgcgcatccgtccaccctttgcgcatgcctctgccccgtgcggccccgtccccgtcgttctcatccgctgaatctgtcaactctggccccacagcgcctccgtccgtccgcttcccccgcttttcgggcgttcgtccttctccttccgcttctcctccgcagttttgtccctatctcagcgcatccttcgggccaaatg

SEQ ID NO: 116372 - DNA, 262 bp, Heterodera glycines
  Promoter: Source sequence=SeqID_15912; Location=120..381; Strand=+; Gene=SeqID_47327
tgactctgatcgtattacactaaccattcacattgaccaactgtctgtcaatgggtggcgggtgtaatttacgttccattccctcgctaattatttaatggtctcttttcgttgtgtttgtccgtttttccacttttttttattttttgtataagtaaaatgttttcattaatattattttttatgtcgattatcaattttcatacctttgtcaatttttgttaattctaaaaccttcaaaaagatttaaacagcaaaaatg

SEQ ID NO: 116373 - DNA, 329 bp, Heterodera glycines
  Promoter: Source sequence=SeqID_35681; Location=700..1028; Strand=-; Gene=SeqID_65173
agaagaagatgaggaggagggaggaagaagaggaagaagtaaaaggaggggaaaataggatatatggaaaaataaagaggcaaaaatgaaaaaccaaaaaaataatttttttaaatttgtgaggatgaacagatgaagaatggcaaagataatgatgccgatgatgaagaagagcggatgttagcaaagctgaaggaggcggcggaaatggcacggcggcgccaaaaagaggcaaaaaatgaaaattagaagcaattaaaaatagaaaaaattgttaccaggaagccaaattgaaggcacgaaaagaagcaaaaaagcgccaaagaatg

SEQ ID NO: 116374 - DNA, 125 bp, Heterodera glycines
  Promoter: Source sequence=SeqID_1048; Location=1..125; Strand=+; Gene= SeqID_66888
aagggtgcacaatttcggtgcacaaagtgcgcaaatttagcaagagatcatcgggggacgaggcggaggaactgatgttgcgcactttgaccagcccggactcggccgcctgaggggacaaaatg

SEQ ID NO: 116375 - DNA, 422 bp, Heterodera glycines
  Promoter: Source sequence=SeqID_23467; Location=351..772; Strand=-; Gene=SeqID_54170
tgtagcttttccggatccaggcccagaattttttgaaatccctttttcttattatgatttcatgtgcatttagataaccgcgctgaaagtgtccgccactgtgctcgtgttcgtcatgcctttcctggtccgaaaatgctattcaatcatcgccaaacagttcaatttcaaacgtaatacgcagtccaacaaaaaccgcatttactgaatttgagccccctctcccccctaaaataaaactctcattttgaggggagaagggttgaaaaataaaagcccccggggggctctgatccaacaaatgtcaaaattacatatttctattaaaaaaattcacattttttttgttgttgtcagtgttccaaaatggctccaaaaaagtgtgggcccttctcttcgcctatttcttcgcttctctgatg

SEQ ID NO: 116376 - DNA, 64 bp, Heterodera glycines
  Promoter: Source sequence=SeqID_24795; Location=604..667; Strand=-; Gene=SeqID_55542
tctaaaaattggacaattaaagcaattagaaagaaaataaacgaatgaaaatgaaaaataaatg

SEQ ID NO: 116377 - DNA, 166 bp, Heterodera glycines
  misc_feature (19)..(19): n is a, c, g, or t
  Promoter: Source sequence=SeqID_26943; Location=93..258; Strand=+; Gene=SeqID_57686
actcaatgaccaaccaacntgttggagaagcagcaggagttgtccctgctccgtgtgcagaaccactcgttgggcgaacagttggcgctgtcccaaagccgtgaacagcaggcgaggaaggaactggaaattttgcgcgccgcgcgctacaacaacgaacgccatg

SEQ ID NO: 116378 - DNA, 81 bp, Heterodera glycines
  Promoter: Source sequence=SeqID_13340; Location=1823..1903; Strand=-; Gene=SeqID_77209
aattgaaaggaaaaggaaaaagaaaatgaataggaaaacgatttgaaattgaaattgatattgtaaaggaaaaggaaaatg

SEQ ID NO: 116379 - DNA, 101 bp, Heterodera glycines
  Promoter: Source sequence=SeqID_5592; Location=1..101; Strand=+; Gene= SeqID_58584
ttgttataggccattcatccaatctccatacttaaaagggggaattaatttgagggttctcgccaaaaaacctttttaagaaagaggaagtgcagccgatg

SEQ ID NO: 116380 - DNA, 270 bp, Heterodera glycines
  Promoter: Source sequence=SeqID_17364; Location=1..270; Strand=+; Gene=SeqID_81850
agaaaacgaaaaggggaactcatcccccaactgtacacaatgtacggtagaaaaacgaaaggggaactcatcccccaactgtacacaatgtacggtagaaaaacgaaaggggaactcatcccccaactgtacacaatgtacggtagaaaaacgaaaggggaactcatcccccaactgtacacaatgtacagtagaaaaacgcatcccccaactgtacccaatgtacggtagaaaacgaaaggggaactcatcccccaactgtacacaatg

SEQ ID NO: 116381 - DNA, 1003 bp, Heterodera glycines
  Promoter: Source sequence=SeqID_3844; Location=5954..6956; Strand=+; Gene=SeqID_52108
ccaaaattttccctctttgtttgcttttttccactaaaaaatcgttaataaaaatttttatttacctattttggtacctattttggaatttttgtacctatttaatacctattttgagattttttttttaactttttaagtacctattctgcgattttttttacctaaaaatcgaagccctataaattaattgttagaataaattatttctttaataaatgaacaaatatttattgggctcaataattcattattttcccgttttcaatggatggtgatgattcattttgcttcagaacattaatcaaaaatttaatgtttaaaaaagaaaagaaaattaattgactattcataattgatatgatcgtatgaatggatgggtggtctaaatgaaattatcggataaattaaaaagacatttttcgaatggtttttcagtccaatgctttattagtttattgttgcgaattgctcatttcaagcattagtcactgttgttgagataatataataaatttaaaattcgaatttattatttctattttttagttcgatggatatatcaaattaattgataatctgcataaaatgggtcactggtcacccatttggcctataaattagtttgccaggaatgttcgcatgggtctccgttttgttcaacagttcgttaattttggtcacttttacgaaaatgtaagattttttaaaattcaaatttaatttattttcggtttaatgaaaggatcacaaggtgtggtattggctttcaattcgttttgccaactgtttttcgcttgtcctttccttgccaattttttggccctcattttacagtataatacagtccattaccgtatctgtactggtactcttatggcatcaactttgacatcgtatgcctcatttttgacactttttttgatatctgccgaacgattattgattgttctgtttccaattaagaaaataaattttaattatttaatcattttttagaatg

SEQ ID NO: 116382 - DNA, 548 bp, Heterodera glycines
  Promoter: Source sequence=SeqID_27981; Location=743..1290; Strand=-; Gene=SeqID_58638
tacactttttgtatcagttgaaggtttaaagtctcagcaatttatgcgtaaaagaaaaaagcaaatattgaaaagatttacaatagaaaatccgaaatttagctgttttttcgagtatattcaagataaatgtttgatttgtttttgtaagcgcaggttttggttgcaaactttcgattgataccaaaaatgtacgatttggcaaagtaagaaaaagtctgaactcgtagaattcgattggacattaaactgcaatacaaggcagtttcttcataaagttcattttgtttttaaccctatttaggtaagtatttggaatgctttatctgtgcctgtgatactttcccgataaaccgtcattttgtggccagttgctatcagctttaacctttcatttaaaacatgttctctttgttttgtcttgcataattgccaaagtataaatggtggaaagaaacattttaattttattcaaaagtttgtcctgacgctgcttttgtatttcgtgatttggtgattgcaaatgtttttttcttttttaatggatg

SEQ ID NO: 116383 - DNA, 639 bp, Heterodera glycines
  Promoter: Source sequence=SeqID_38510; Location=1..639; Strand=+; Gene=SeqID_67295
tgctttaaggttttgtctttgactttgcttttttgtcctcacccatggatcgaccacgttaattcattctctatacatttcttttcttatttcatgaaattatatataatttaattttaaataaagaggcaaatttttacagaaaataaatagacgctgactaattagctaacatttataaagaaagtagaaatttgattaaatgcatatacaaaatattacttttttaaaatttgtataaagttcctagtcgtatgtgctttgcgttggttggttggcgtgggtgactgtggtggttgggccgtttttgcgatattatggctggaaaaaagatgcgatttcgctatggggagcgcggccgtctgggttcaagtgcttgcttgcgcttgtgctcggcattgaacggtgatggctgctgctggggtgccacctttgtcgtggcctcagtttctccagcgattggcagctgtcgaaatgaataaacatgcagctcgtctgtgtgttaaagaaatttggcgagttaattgacttgtgtaaatgtggcctaaggcacaaatgctgtggggaactcagcactggggatgctgaacctaaagttggtggtggtgttggtatacgagtgagtggcgtattgccatg

SEQ ID NO: 116384 - DNA, 1003 bp, Heterodera glycines
  Promoter: Source sequence=SeqID_260; Location=7061..8063; Strand=+; Gene=SeqID_80144
ttcagtttggccggattttggtccatctttttcttcaaattattattgaaacaattattttcttattattttttttttgtgcttatgtgaggatagttaataatgtatataattaatttaagtttttactttctaaattatatttgtaaataataatgaatgcacctttttaattcttatttttatattgctcatacattattaatagggttgtaaattatatagattaacatattttttctgcgcatatgctatgaagaaaggggcttaaaaatagcatttctgcgttaaaattttttgatttggtgaaggtttttagtccatataaatccatattttgggggttttcgggaataaatccatatttcgccatttttgcctttttagtccatattttggccattttttggaaattttcacaagaaaaatgaaaaaaaaacgaaaaatacacccctaaagattgattttttggaaatttttaaaaattacaccccacaaaacacgaaaaatttgagttttcatcgtcattttggcattttcaataaatattttcgtcatttttttgcgaacatttcttttttttaatgagaattttttcgaaatttggcaaacttggaggtgtttttgatacaacgaacaataataaaaaatatgcatttttaagttttaaaccccattttttggttgtttattgtactttttaggtttatttaagcaaatattaaatatgcacaccttttttgggatttttgggggtttacaacatatattttggcattttttatccatattttggtccatatttggccatttttggcctggagaaacaattcagtgaggaggtccttccgttgtcaaattctcctatttctaaaaagccgaagggattgcttgatttttttgatcatacgctgtcagcatcgtcagtagtcgagacaaactcacgtaaaaaaaccaatttttttcatttaaattttgagttatagaagagcgaaatgcaatg

SEQ ID NO: 116385 - DNA, 57 bp, Heterodera glycines
  misc_feature (38)..(38): n is a, c, g, or t
  Promoter: Source sequence=SeqID_12534; Location=1223..1279; Strand=-; Gene=SeqID_76181
cgatgctctaaaattgcataattttaaaattattattntagttccctaattagcatg

SEQ ID NO: 116386 - DNA, 322 bp, Heterodera glycines
  Promoter: Source sequence=SeqID_20559; Location=1251..1572; Strand=-; Gene=SeqID_51106
tctcgtgaattattcggaaaaattgttttagaaatttcaaaaattggcattttttgatgaacgacagcccttgaaaagtccttgcttttggcttggtgtccttattttgcaataaggaattaatggcacactaattgacctgattatttgactttttcttgtatttacttaatttttgagagcagccagcacactctacgaaggttgtgaagaaaattttcattttgtttattccattttgttaaattccaaattaaaaattttttgtctaaaaattcacataatttttgattttgcaatttcactttttattaattaaatg

SEQ ID NO: 116387 - DNA, 830 bp, Heterodera glycines
  Promoter: Source sequence=SeqID_5050; Location=688..1517; Strand=-; Gene=SeqID_56720
ttttggggggggggggggggagtttttttacttggggccattaatagaatgaatgaatgaacgaacaaacgaatgagtgagtttgaaatctgaattattatattatatttttctattaaaaaaaatttttttttacaagccctcctacaaaaatgtcctaacagtaatactcataattagtcagcggggtgcaaattaatgcacctactgcctcgaatcctgtgccagcacaggatcgggattatgccattttttttattgatgaaatttataaatttctataaaatttgccaaatccgctttttgtaagaaattggagtaaattatgatgtaattaaaagattaaagaaagaatttggcatttcgtggtaatgaaatagccgaaaatggaaaaaatgtaaaaataatggcaaataaaaagagaaaatccaaaaaaagaatcaaaggggaattgcaaaatgatgaaaattgatagaaagagcatttcaaaatggaaaaaacaatttggaaaagagattttggagggtttaatgagggattttaagaaaaattgaagaaattttccttaaaaaatatctgaaaaactatgaataataattttgaaaataatttgcattagataatctgaattagccgaataatttcctgacttttaaattaatccatatttataatcaatacaaagcaataaattctcatttgtaacgtttaaatacattcataaataattcataaagcagcataattacctaaattcaatcattaaattgaataaattaatttacaaaattgctaatttaaaagtttttaccaaagaattataaagaatg

SEQ ID NO: 116388 - DNA, 299 bp, Heterodera glycines
  Promoter: Source sequence=SeqID_1574; Location=1294..1592; Strand=-; Gene=SeqID_74537
ataatcccgacaaatttaaaaaataaataaataacattatttccggtgaattaaatcgagaaaggatataattttctaatttccaatatttagcaagcttaatgaaccgaaagaaaatagaaattattcaaaagtcgcgtaaacgcgggtttatgtgcaacaacaacagtgaaaacgaagcaaattctgaacaccgtgaacaaaactactacaagagtggactttgtctcatttcaccgacaattctactgatctcaatcagttgagttcaatcgattcatttggtctgttgccctatg

SEQ ID NO: 116389 - DNA, 80 bp, Heterodera glycines
  Promoter: Source sequence=SeqID_2824; Location=1269..1348; Strand=-; Gene=SeqID_81807
aggggaattttcagccattttttaattttagaattctcatttttggccgactttctttcggaaattgggcttccgaaatg

SEQ ID NO: 116390 - DNA, 103 bp, Heterodera glycines
  Promoter: Source sequence=SeqID_75; Location=830..932; Strand=+; Gene= SeqID_63056
aggaagaaacgccatagaagtgatcattttgcttttttcagcaaagacggcatcgttgttgtatgtcttaaaatgaaaaattctattggaaaatacaaaaatg

SEQ ID NO: 116391 - DNA, 1003 bp, Heterodera glycines
  Promoter: Source sequence=SeqID_2888; Location=2883..3885; Strand=-; Gene=SeqID_47468
cataaataaaaaataatattatttcaaggattattaacataagttttaataaaaatattttttaaacaggaaataaaatagttaaataaattctgaaaattttgatcttattttcacaatatcaaaaatttttagaaaaaattaacaatgttttaaaatatacagataaatttggtcgaacagaaaatatgatgatagcataaaagaaaataattaaaataaaaacaataaaatataattaatggattgattaaagtgaaattatttttaaaatatttatagcaaaaaaactcatttatttttttaaaaaaatcatcttctttcattgttaaatgaatgctaatcatttcataatttcccagtaaaagtttaaatttttaaattatttaacaaataaacaaataaaatggagggaataaatttcaagcggactaaaaattgaaaaagcaattgataatttatcagaaaatgaatataaagataaattaaaacttttaaaacgcattaattctttagaacaagggaatttcaaataatgttatattttctgtgatcggacattaatttggacattaagaaagtgagtgaattatttcaatattataaatggatttaacaatgaataaatattttcttaggatatttggcaatttcttcgctcaaaattttaaagcatcatcttacagctaatgattgagaactatgagagcggcatgagttgaagaaaaagtacaatttaattatacaggacaaatacgtcattaacattaattacacaaataacaatattcaatccataaaataattaataaattaaattaatccaaattttatctttaaatatataattactctcttttataatattttaatttattaaaatttggatgaaaaggtaaagataaaaaagagttgattgttgaattatgaaaaaaaaaaaattcaaagagatttattggcgggtcctgtttttcattttaagggcctttgtgctccaataatg

SEQ ID NO: 116392 - DNA, 455 bp, Heterodera glycines
  Promoter: Source sequence=SeqID_4986; Location=2603..3057; Strand=-; Gene=SeqID_56450
ttttgaaaacataaaaaatttttcgaaaaagctttgggggggacaaactgcactattaccaaattttcagttaggacccatggttctatatatttttcgcgctagtaaagcgcagagcttaatttttttaattacccaaaagggtggggagataaatttagattagcgcttcgtaattggtttaaatggattgtctgattccgatcaccgacacaatatcaacgggaacaagttaacaattaataatcatcgtacaacaaaaagcataccaaaatgattctccctgtattttaataaaattcgaacccttttcaaatagcgccgcttttcctaatttccctgaagatatttaaaaaaggattatgcgcataaataaaaattcatagtcaaatttaagggcggatgaggaaattttattcgattccgacgacgagccggaatatctctccaaaatg

SEQ ID NO: 116393 - DNA, 280 bp, Heterodera glycines
  Promoter: Source sequence=SeqID_31989; Location=1..280; Strand=+; Gene=SeqID_62303
ggatgcaattcccgcccaaatgttgtacagtatgccaccagtcgatgaaatgtcattctgttggagttctgtatgaatacgcggacaaatttgttccaaatttcaacaaatacaagcaaatatttttgcttgttttctttttctgtactcgttgtaataaaattgaaaattttcgtaaaaattgccataattttggcaaaatacaaacgaattgacagccgattctcagcatcggacgaaacggttggatttgtgcaaaacaatatggcgtaatccaatg

SEQ ID NO: 116394 - DNA, 433 bp, Heterodera glycines
  misc_feature (181)..(181): n is a, c, g, or t
  misc_feature (190)..(190): n is a, c, g, or t
  Promoter: Source sequence=SeqID_5535; Location=1..433; Strand=+; Gene= SeqID_58372
ccacgcgaaaacgaccccgaccgctactcatgagttgaaatagcgaggactgagttggcgacatttggcgttttgttttttctgtctaattctttgctggcttgtgtattcttttgttcactatttctctcgcatttaagctctgtgcttaagcttttctgtttgttgctgcttttccatntcatttatntagtagtcaatcaaaaaaaaaaatcactaaattacgcgtgtcccttttttaatgatccattattttttattttttggtttgcttcattgattttgcataaaatttattaatttttttttgatttttaaaggatgtgccgtaactcttctccgcttgtaaattccgaattgtttcggacaattttttcgctcagccttctcacttttgtcaattttttggggctttcatcggcccaacaagatg

SEQ ID NO: 116395 - DNA, 1003 bp, Heterodera glycines
  Promoter: Source sequence=SeqID_2181; Location=4194..5196; Strand=+; Gene=SeqID_78318
attttttcgaattttccaaaatcccgcaatcccgcacgggatcccgcaaattttaaatgcgggatttgcgggattaatcccgcgggatcccgtcccgcaaaaaattttgagttccagtcccgcagcgggatccgcaaatttgaaatttccggtctctagtaaaaacaattaaaatcaaaaattaattgatatataatattgatttgtaagcatattttctgtttccgatagatagcaccccccccccccccatgggtcggggagcaaccctagtttataagaagaatcaggaagctaacaaacgttttttggctacctttttcaattattttcccaacttttacaccattgatagagcttcaatagctctacaattttactcagaggtgatctttcgctttttctattgataaaaatggtttaggtattgtttttttttgggaaaagataaaaaaattcaaaaaaaccgaaacggtataccgaaaatttttcttcggttttttcggtttcggtttttttcggtttttataccgaaaccgaccgaccgaaaatgaaaaatttgtcgccgctgggacaaattcaatgagatttgttaatagatttttaactcaaagtttctttgaaacaaagcgtggaatggggggggcgagaagccctgcattaattaaatggagtccctaataagtatttgtccaaattttcacgattaaaaaattctcataaaatgccatatttaagaactttttatccaaactggcaaatttcaataaatacttttaatgatggcttcgcctccatgttgcttaaaaatatgtttgaaaaaaagaagatatttttactcactgcttgtcatcttttgttttttaagcaatggattcaaatggacaaaaaagcaccgataaattccgtcgaaaaggccaatttttcgaacgcacttcgaacccacaaatttgaggctgttcaggcataaaatgttaatgtttggttatcatcccataaaatg

SEQ ID NO: 116396 - DNA, 435 bp, Heterodera glycines
  Promoter: Source sequence=SeqID_18939; Location=738..1172; Strand=+; Gene=SeqID_83664
aaaacagacctaaaaaacgaaaaaagaatattatttttctaatatgtgtaatatagaagttagtgaaaaacagtttaaaaacctttcatttaaaaaaaatatattaaaattattataaaatttcttttcccaaaatttttagaattaggaaaatattttagaacatatgcaattaaaatgaatattttgggcatgaacagcaattatttttattattatcttttttggaatctcattaaattattttaggaaactatgctaataaaatgattatttttggtcaagaacattaaatatttttagtttttatagatttttttttcatttgagtattccaacagccaatttttgccgtttgaagcgtaaaatctattgattgcaaataaaagtatttgccaattttaatttgggcaaacattctcaaagatttttatg

SEQ ID NO: 116397 - DNA, 87 bp, Heterodera glycines
  misc_feature (41)..(41): n is a, c, g, or t
  misc_feature (61)..(62): n is a, c, g, or t
  misc_feature (78)..(78): n is a, c, g, or t
  Promoter: Source sequence=SeqID_27258; Location=1509..1595; Strand=-; Gene=SeqID_57947
tttgtgaatatttgaaggaaaaagaagcgaaactgaataanctgattgcaacaacaaaatnntatggcggagcaattngaaaaaatg

SEQ ID NO: 116398 - DNA, 633 bp, Heterodera glycines
  Promoter: Source sequence=SeqID_43485; Location=444..1076; Strand=-; Gene=SeqID_71133
atttaatcgccactcatagagtatcatgcgaaattgacgttatgtaaatttacttttggcgcaagcatgttgactcggtttaaatttaagattccgccatttttggctttccataaaaatggcgttctgtaaatttatttgtttaactttttgtaccagttagaatttaatcgccactcatggaatatcattgcgaaactaattttatatgagtttttgactttaaaatttagcgcaaaattcgaattgaattttagcgccaaaaaccctgttattgaaacgaatttggcgttgtgtatggcgtattgttagacaatttgagtaatttgattgaattttagtaccaaaaactatgttattgaaacgaaattggcgttgtgtatagcgtattgtaagacaatttatagtaatttgaatttaattttggcaccaaaataagctggcgttgcgtgttaaacaaattattgttcggctatggtcttaatttgaatttaatttttagcgccaaaagtatgtattgaaacgaaagtttgtcacaattaatataaatagccgtcatttcttcacctagtaaaattagccattcatttgataaattttacaaaaaaaaaaaaaaatcaattattcgtaatg

SEQ ID NO: 116399 - DNA, 164 bp, Heterodera glycines
  Promoter: Source sequence=SeqID_3283; Location=1744..1907; Strand=-; Gene=SeqID_84052
tctgaaggccgattgttttggcaaaatgtaaatgtgaccgtactgtttcggatagtattcaacatctacaaatcctaacgaactgaaatttttaagatttaaaatatttcaattaagaaaagtcgagtggatcgagttttttcccatcaaccgacaaaaaaatg

SEQ ID NO: 116400 - DNA, 161 bp, Heterodera glycines
  Promoter: Source sequence=SeqID_6855; Location=4681..4841; Strand=-; Gene=SeqID_63115
cctcccccaatatttcaattacccctccccccccccccccggcattcttttgcacattgaattgcccacaaatggtttattatgaaatttgcaaaaaagccaagtgcaaaagtgctaaggttcgaacgatccgttaaatgccaacacaaaattccaaaatg

SEQ ID NO: 116401 - DNA, 497 bp, Heterodera glycines
  Promoter: Source sequence=SeqID_18856; Location=1461..1957; Strand=-; Gene=SeqID_83548
ttttgactgaaaattaaagaaaaatatgaaaaaaataatacataattctgatggacagagagagacattaatagaatacttttttatcatccgttcacaaactctttagtagcagcattttaaataattttaacttatctacttctctacatcaggatttttaccgcttccctcacaaaatttcggaaatcggctaacacctatccctaagctaagaatcaaactaaattaaaacctatatttttttaattttcaaattttaatctcttgtttagaaattaattttgtttttgtcaaatttctgataagcataaaaccatgagaccaatttgtaattctgcatataggtaatacaaatgtatgaatatctttttgagatgctttcatcacttatatttatttatttagaattgctaattaggtacctaattacaatttgttatgacctattttaatttacatattaagcataataagccgacctaattaaaccgatg

SEQ ID NO: 116402 - DNA, 59 bp, Heterodera glycines
  Promoter: Source sequence=SeqID_7946; Location=261..319; Strand=-; Gene=SeqID_66464
agtaatcattttttgggttttttataataattttaaatttttttaaatttaaagaaatg

SEQ ID NO: 116403 - DNA, 81 bp, Heterodera glycines
  Promoter: Source sequence=SeqID_2447; Location=1483..1563; Strand=+; Gene=SeqID_79777
actgatcagagggacaaaaagcaataaaccaaaaaaggaaatggacgtcaaatagaagagacggaaaacgagcggaaaatg

SEQ ID NO: 116404 - DNA, 186 bp, Heterodera glycines
  Promoter: Source sequence=SeqID_37472; Location=1334..1519; Strand=-; Gene=SeqID_66539
tgcccgtcactgtgacagtcactggtgacctacacagaccaagtcgttcacccgaggaacacgcgcattcaaattcaactcgattcgcttgctaacggcccgcgcgctttgtgtaataagcgagtagcactgaaggtcaacggactctcaagcgaagtgtgtttgtctcgaatcagctcccaaatg

SEQ ID NO: 116405 - DNA, 123 bp, Heterodera glycines
  Promoter: Source sequence=SeqID_14828; Location=2711..2833; Strand=-; Gene=SeqID_78981
gggccatttgatgagggttttggcttgaaatttactaacccgacatacgccattcaaaggatgctgcttccgccgattttaccagttattacgcggcgcatatgcaagcgatgggcgccaatg

SEQ ID NO: 116406 - DNA, 298 bp, Heterodera glycines
  Promoter: Source sequence=SeqID_5145; Location=3453..3750; Strand=+; Gene=SeqID_57073
aaatttatttccaaagctcttccattcacttgttatgaacattgataaagctaatgacatcatttgtggtaataaattatttcaaaataattttgattttttcgacaaaaataaaggtaattagaggcatatgattttttgccaaattttataaaaaaaagtcattgttgacctaattgctaaatttttattggttgatcatttgaatttcatttctaaaatataataattcaaattaaaataattttaaggatttatttatttcaaaattaaaatattttgttggcggcactgaatg

SEQ ID NO: 116407 - DNA, 271 bp, Heterodera glycines
  Promoter: Source sequence=SeqID_3856; Location=8720..8990; Strand=-; Gene=SeqID_52173
aaaaaattatgaagatttttcaattatacgtgccatatgttaattttttaaaaattcaaaatcggaatcgtaatcgtaatcagaatcgctattaatcggattttgggccataatcggaatcggataatcgtaatcggattttgccttgaaattcgattattacacccctaagaattgaccttttgaaggaatttttttagcgagaataccaatgaattttgaaaaaaaatgttttctgaaacgaatgttttaatctaattttaacataatg

SEQ ID NO: 116408 - DNA, 563 bp, Heterodera glycines
  Promoter: Source sequence=SeqID_32890; Location=243..805; Strand=+; Gene=SeqID_63121
ttaatctcggaagttgtaacgaagaatgtgcagaggttggcaaaccgttaattaaattagaaaatgcttaaatctaaataaatatttgcaattgaattttttaataaattgatagaaattttcaaaatggacccaatcctaacccacccgccctttcattcaccactaactacgggcttggatgtatgtatgtaaatgaccacattaaacgaaatcaaaagttatttgattgatgaatcgatctttagttcttgttggttaggttgatctaaatgccaattatccaaaaacataatgccacgaaaaataattcaaatctttttaattacctaactttaatctgtacgtgtttgggctaacaataagctgacacttatgtacagcgagtaaagaaaggattaacagaaataattaatttatatacaaaataaaatttaggtgaaaacttaatgtattctccatttgatttgtttttggtttcttcgggtcgtcaattatcttcattcgctcatctctttgtgccaattaattgccggatttttgcgccgaatattcgaaccatg

SEQ ID NO: 116409 - DNA, 334 bp, Heterodera glycines
  Promoter: Source sequence=SeqID_22637; Location=1191..1524; Strand=-; Gene=SeqID_53309
tacaaaaacaccaaatttctaaaatgcaaaaatacactcaattaaataatattaaataaaaatatcgcgtaaacatatatatatatgcccatgtattacagttaaaatttaagatttattaatttcaggaaacgaattttcacatttttttttggcattttataaaatttgggtaggatttaatgttttatttacatttttgctatgaaattcttttaatatagaaaagatgatcaaaaatgcagaataacgatcagacaaaaattataaaattaatcccattaataaattgatgaattcattaaatttttcttttcaagaattaaattaaatg

SEQ ID NO: 116410 - DNA, 578 bp, Heterodera glycines
  Promoter: Source sequence=SeqID_33923; Location=179..756; Strand=+; Gene=SeqID_63849
ggtgggaacgggattcctcgggaaaacctggtcatcttttttcagtgaccggatttttcggcaacgggaaaaaaggatgggaatcctctcccgcttttttcctttttaatttctctcaaaaatgactataaaaatacaaattttccccggcaaacgcctaccggcaccgctggacacccccctggtcccgaaaagattttggtagagacacgccgcaaaaaagcgattaaacccaaaaaaaggattttggcaattaattgaaaacgtagaaattctctaagttttttcggcattgaatctttttggattttaaatagataataaacaattttaacgaaaattatttaattattaaaaaaaaatctagaaacttcaaattcagaaaattaccagtttttgccagtactgtggaaatgttcgtacttgtttatttataataattaattccgaaaattcaatttttattaaaaaaattttgtcattaataaatagtaatcttttaaattattaaattatattttgtcatttgaaaaaagcaaaaacattctgaagaatcataatttttcagaaaaaaaatg

SEQ ID NO: 116411 - DNA, 1003 bp, Heterodera glycines
  Promoter: Source sequence=SeqID_16067; Location=826..1828; Strand=+; Gene=SeqID_80426
atggttactaaaattacctgggtctttaaaggatctgccctttgatttttcaggtttttttgttttctccaattgtccacttttctttattattttctccgatcttttgagcacttcttaaattatatgtgatatgtatttttatggttttaacgccgcaaagttttttaattagcagttaataaattcccaaaaaatacaaattatgagaattttttcaaaattcatatttcctcaaataaataaaagtaataaaataaagaattctcgaatgaaaattaaaagatttgattcgaaagtatttttattagtcggtcgaaatctctgggtctaaaacattttcgttttaagaatttttatgggaaatttaagagtttttgcctcaaatcttccatgtccccaagaatccggcaacattccattccgttatcaaaaagcaataaaatttacgtgataaagtaatgccggccaattgcgtcaaatccatctcttcagctgattcattctcacatttttccttggagcttaaacagcctccgaatatttcataattgaacaaagcaaaaataagaagcaatacaatttttatattcatttaattttattcagcgcaatttgtaattggattaaaatgaaaaataataaaaaatgtttccccaactgaattttatgctaaaaagcgtcaatattaatcaatatcaaaaaccacttacgtataagcatttaatgtttagctcatccctatgggctgatactcgaatatattcgagacctaaataaaccccaaaagttaaatttttctcgagtcgttagttgggctgagattatcgcagtgttaaataggcacaaaacgccataaaaatcaactaaataggcttagaatcacttttaaatatttaaaaaataatttttaatatctattttttttgcaaaaaaaattattttttagagtacatttcagaaaattttttttaatttttcagaagaaattttataaaaaatg

SEQ ID NO: 116412 - DNA, 361 bp, Heterodera glycines
  Promoter: Source sequence=SeqID_17038; Location=636..996; Strand=-; Gene=SeqID_81470
gcctggcagggtcaatggattttctgatcaaaaaataataaatcgatcatcaaagcgaaacaaaatattcaaaaagaattttttaaatttttagaaaaaaatttaaaaattttacaattaaaaaagcataacaaaatccgttcgaaattaaaaaaactttataaaacaaattttaattaaataataaaattatatttgaaatttttttttagttaaccgtcaattttttcttgaatcgacaatatggagtctacatatttcaaatcgtatttccccgtccaaaccgtaaatttaaaataaaatatttaaatttaaaagtatcataatttttaaatcatttttattacaggccgtggcgatg

SEQ ID NO: 116413 - DNA, 54 bp, Heterodera glycines
  Promoter: Source sequence=SeqID_45490; Location=1330..1383; Strand=-; Gene=SeqID_72779
aaatggttgacagccgaaaaggacaaatgggtgacactcgcaaaaggacaaatg

SEQ ID NO: 116414 - DNA, 206 bp, Heterodera glycines
  Promoter: Source sequence=SeqID_19987; Location=1..206; Strand=+; Gene=SeqID_84754
caacgaccctcccgtgccgattaaaaacggcatttccaagtgtcagacggactgcgacggcaacaacagcccccggtaaaaggcgaaggtcttcctcggagagcttacttcgaccgtgccgttccgtgcacgctccgtccgccgtcgttctgttagcttttgttttgttactaataattggcacaaaggacgggaccaacgcaatg

SEQ ID NO: 116415 - DNA, 201 bp, Heterodera glycines
  Promoter: Source sequence=SeqID_17616; Location=1126..1326; Strand=-; Gene=SeqID_82127
ggtgagtatttattatttattaataaaaattaaaataaattaatttttaatgctttttaaggaaatgttagcgaagaaaaacattttgtaaaggataatttaagagtaaaattttttcacaatttgggagattattggatattttatgcaagcaatttttggaaaagagaaaaaattgtacgcaaagtaacgcatcaaatg

SEQ ID NO: 116416 - DNA, 154 bp, Heterodera glycines
  Promoter: Source sequence=SeqID_11653; Location=1659..1812; Strand=-; Gene=SeqID_46971
ttcgttattcaattcgtttactaaagaaactgaaaacttagttaaaatagcgcgcccagaaacgaattcaaaatagcatcgcttttaggaaaaaagaataaccagcaaaacattatcacagattgtcactgcccaattccaattgaaaagaatg

SEQ ID NO: 116417 - DNA, 1003 bp, Heterodera glycines
  Promoter: Source sequence=SeqID_24378; Location=638..1640; Strand=+; Gene=SeqID_55108
aaaatgagtgacaaaatcatggacatgagaacagtgacttttgtaaaaagtgccaattgcaactttgacgggcgcaaagaaaaattgtgatttcttaattgggctttgattttaggcaacagcaaatatttgagttcatatttagtcgaaataatcaaaaaatggcattttagatcaatttaattatgtcctattttttctatttcgcatttttggtacttttttttgatattttaacaaattcatttcttaaagaagtaataaaaagaaaaccggccgtcggaaaatttttagaagaacaaatccataaaatgtgaaatctcttcaaaaacttttaatgtaaaaagcgttaatttaaaaaaaaattttttgcctttttgtgtatatttcgggttttgcagcttatgaatttactgcttaaaatcgaagcccaatttaattctgtgcggtcccaacgaataataaacataaaaatttattttgtttttcctgcggtgaaaaatgtgctgattacgaatctgagcttagaaaatgtctatttttgagtcggtttaaaatggttcgattaaaaagatacatattatgatttataaaaatagttcaattattatcaattattattctaattcacaatcagcatatacagtggtggaaagaagtcttgactcaaagtgataaaattagtaaaaattaaaattttcctcgtttaagttggcctattatctttctttttgtataattattagtgatgctcgagaccaaaaatttcccgagactcgagaccgagaccgagaccagaccgaggctcttatgcaattttggccttattgtactacaatgcttaaaatgctacaaaccttattttagaaatgctgtattattgacgcttttttccactgacgaatttttcatcaaaaggcaaccctatatatcccctattaattttaagtgatcgaattattaatttagaaaaattaaataaaaaattaatatttaaaaaatg

SEQ ID NO: 116418 - DNA, 84 bp, Heterodera glycines
  Promoter: Source sequence=SeqID_11402; Location=537..620; Strand=-; Gene=SeqID_74795
aatttttatttaataaatttaatttaataataaaatcaattcatttttaataaattattcttttaagttgatcatccgaatatg

SEQ ID NO: 116419 - DNA, 61 bp, Heterodera glycines
  Promoter: Source sequence=SeqID_14232; Location=2003..2063; Strand=-; Gene=SeqID_78250
cgtgagaagaaaaagttgctgggatttctcaattatcgtggcgtcttctcctcctggaatg

SEQ ID NO: 116420 - DNA, 52 bp, Heterodera glycines
  Promoter: Source sequence=SeqID_9721; Location=755..806; Strand=-; Gene=SeqID_72472
taaacaaaaaaaaaattttgaccaaaaaaaagtgcaaaaaaaattcaaaatg

SEQ ID NO: 116421 - DNA, 583 bp, Heterodera glycines
  Promoter: Source sequence=SeqID_16282; Location=3089..3671; Strand=-; Gene=SeqID_47354
ggttggccgacgctttgaccgttttgcaccgtaaggcgggacggacgcgaagtgcaacagtgacaatttgttatttgatgcacaaatttgactattcggttgacgaggcttttgatgctctgtccaaggtgtttacgaccagcactgttccaacatttgtattggcaaatccattttcagaaacgtccccaaattttgctccacgatgcccatttacagtccgtgggcaacttcagaaaagcgcttgacgaccgaaaagagaagcgaagagagggagaaacaaagaattgaaaattttaacaatcagaaattatattttaatcaactgatatgtaattgtaataaaatgattttatggttccttttatttttccattgttcatggtcatacagttattgccgtgccgttgctatttcatcatttattttccgattatcatttgttttccgttttgctacggatggagtgagttccgctgctcattttttgtttatgctcgagtcggctgttctgttccttttgaatttgttctacgcttttgctaatttctgcttggatttgttgcccaattcgtcccccatg

SEQ ID NO: 116422 - DNA, 61 bp, Heterodera glycines
  Promoter: Source sequence=SeqID_10488; Location=275..335; Strand=+; Gene=SeqID_46874
ttggcttggcattatcaccatcggaagagatcgaccaattttgaacaaagacttggacatg

SEQ ID NO: 116423 - DNA, 959 bp, Heterodera glycines
  misc_feature (10)..(10): n is a, c, g, or t
  Promoter: Source sequence=SeqID_26465; Location=1513..2471; Strand=-; Gene=SeqID_57198
aaattaattntttagtagaaaaagaaataaaaaaatcgaaatttatttattatttaatttaaaatatttcaatttaatatatatactaaaattcaaattgggcactgaatttttgtcataagaaatttcatacgaagtaaaaattttgattataaaatagttttttctgatacctaaaaattatttaaaattcaataaggtcaattatttttttttataaattaatttctaataaaaaagaaatataaaaatcgaattgaaattatatatataacatgtattatatattttttaaatttattatttaattaaaaatactctattttaatatatttactaaatacgcccaaattaacactgaatttttgccaaaagaaatttcataaaagtaaaatttagattataaaatatgtaaaagctaagcaaatattttaattgaaggaaacgcaaaagagaaattattttgtcgttttgtgcttagtctgcttcacctttcttttttgtgttgtgtgttaatccttctgtttttgttttgctattcgaaaaatgcgaatgaatgagcgaatggatggaaatgccaaggacaaatttgcccaatttgtacaatggcaccgcgttaagcgcagcacacaaagaaatggataaaataatgggctcttgaggtggggggggggggggacaatggcacagcaaaatcggacgggggcacacgcacggcacggcacagaacggcggtggtggcaaatttgccgcgatgaagcggcctaagcgtgggacaattcagtgccgccagcagacggacgggtgggaaaaactcaggcgaatgacgggagacagaaaaagtgttaattgaagaaaagaatagaatttttcaaagcattgatggtcccagccaacaatgaaataatattaattaatttatttttttaatatttaagcctttttgcaacccaaaaatg

SEQ ID NO: 116424 - DNA, 131 bp, Heterodera glycines
  Promoter: Source sequence=SeqID_11176; Location=4162..4292; Strand=-; Gene=SeqID_46933
aattagcatttattgattgccaattatgtatatctttgtcccctttaaagttcactctgtttcgtgacggtgcagcggtggaggaacgcgtttttgaagcagtacaggcgccagctgctgatgaaccgatg

SEQ ID NO: 116425 - DNA, 104 bp, Heterodera glycines
  Promoter: Source sequence=SeqID_24553; Location=846..949; Strand=-; Gene=SeqID_45874
tctggaaggaatcaatagtttttcctcttttcaaaaaaggggacaaatttaatcctgaaaattataggcctatttctataacctgctcactttgcagggttatg

SEQ ID NO: 116426 - DNA, 1003 bp, Heterodera glycines
  Promoter: Source sequence=SeqID_15325; Location=2087..3089; Strand=+; Gene=SeqID_79563
ttttttttgcatttttcttatgaaaatttgctaaaaatgaccaaaatatgctttaaaaacgcaaaaatgtcgaaatatgcacttattctcgaaatccccaaaaatgcttttatatgcattatacgcactaaaaactttcaccaaaacaaaaaattttaacgcagaaatgctatttttgagcccctttcttcatagcatatgcttagaaaaaatatgcaaaatcatacaaattataaccctactgattagagaggggatttttatatgctaaaaatcctaaaaaaatgtgccaaaatatgctcgaaataggtattaaaattgaaaaaattcggtgtctttatgcataaaaatctagaaaaatttctttcattatcattttctccccattattgtaaatcaatatatttatcgatttcattaccatttgctggattcaaattcgggattcgaatcgctttaaatatgtgttttatgctaagcgcatgaaaggctatggaatggttttcgaaataatttttggataagttgacaaatcatcgcttttttgctgagatgtcggatcattgcgcgccaaaatgccagttttttaatgctgaaatattattatattctgctagatcccggtgggaaaaattaataaagtgattcgaaaatataaagttaataaattttgttcgaataaattaaaaaaataatttatttgaagtaatttgaaaaaattttctgtttttcgaccctaaatctgttttttattccaacttttctgcttgctaaatttttcaacatttaataaaaggattgcccttcaaatttgtaattaaaaatatttttgttgagtttttaattgaattttcgaattccctctcccgcagggattcccgtaaaatttctgcgggatttttacggaagcggtatttttacgggattccctttcgcgactcccgtccaggaaaatgtgaactctcgctctcgaaagtttttcccaaaaacgggagtaaaaatg

SEQ ID NO: 116427 - DNA, 68 bp, Heterodera glycines
  Promoter: Source sequence=SeqID_41623; Location=1..68; Strand=+; Gene= SeqID_69709
atttttagaaattctatccgtcaaatcggcttttggacttttaatgagtaaatcagtaaccgtaaatg

SEQ ID NO: 116428 - DNA, 60 bp, Heterodera glycines
  Promoter: Source sequence=SeqID_3817; Location=635..694; Strand=+; Gene=SeqID_51992
ggtcaattatgagtgtaaaaataatatataaatgtttcataaaattgatttaagcaaatg

SEQ ID NO: 116429 - DNA, 230 bp, Heterodera glycines
  Promoter: Source sequence=SeqID_28690; Location=164..393; Strand=+; Gene=SeqID_46125
ttatttccacaactttggatggcgtttaatttgaaaaaattattcatttgttttatgcgattaaagattttacaaatttaatatttaattctttaattttttacttatattcaaataaaaattaaatcccgaatcccgtaataaaaattaggaattattttctctcatgtgaggctttttttcattttattctaaaattatttaattttttaattaagcattcacaaatg

SEQ ID NO: 116430 - DNA, 552 bp, Heterodera glycines
  Promoter: Source sequence=SeqID_16546; Location=3033..3584; Strand=-; Gene=SeqID_80949
tttttaattgaaacagaaaacggtcagcagaaatgaaagtgaattccgagtgggtgattgaagaatgaaaaaaacaaaaaaagaggagatcaggagcaaagaggacaaagttttaattgtcacccacccattaatttacactaattgatgtccataaataatgtgattaaaagcaatttaatttgttgaattaaactaaatttttatgggaatgcagacaattgagaatagtcaaagttcaatttttgggtgtggggaaccacccgaattatatatattcccatccgatttttttttctgtttatggcttgtcagtgcaaacccctgctgcatgtcgaaatgcaaagttcgttcatttctaagtattttgataataataataataattgttattattattttcgtttcaccatttcctggccaattttcttactttagaaatttatattttatttttgtttcttcgtcattgaataaactgtgtcctcctcctcctccccaacagcaggatgtgacgcttgaacagaaataatgttcctaataaacagaatg

SEQ ID NO: 116431 - DNA, 60 bp, Heterodera glycines
  Promoter: Source sequence=SeqID_14620; Location=1501..1560; Strand=-; Gene=SeqID_78701
aaatttaaaccgtatagtgtacgaaattcattaaaaagagccttgacaaccacagccatg

SEQ ID NO: 116432 - DNA, 131 bp, Heterodera glycines
  Promoter: Source sequence=SeqID_7448; Location=1..131; Strand=+; Gene= SeqID_64852
tagaaaaaattaagaaatttagaaaatcgaaaaatttgcgtggacgaagcgtagagtttgcccactaaggtccccaattcccccattcattcatttttgcaatgccttttctctgccctaaaccaaatatg

SEQ ID NO: 116433 - DNA, 559 bp, Heterodera glycines
  Promoter: Source sequence=SeqID_22400; Location=196..754; Strand=+; Gene=SeqID_53066
ttcttatcaatgcacatcagttccccaatataattcaagacagtgtttggccttacgcatatttcaatgggacaaattaggcggaattaaaaaacaaatgatagtggtgactctaatgatgagaagcatgctctagaagatttctataaaattattatttttttaataagtgaaatgggtaatcactgagtaaaccgtgagtaaaaaagaaactatagatttattattctctaaaagaatgaaactaaaaattttcataaagcaattttcgaaaatatttaaaaaaattttttgaagtttatctttcttaggttttcgaaaaaacattcaaagatgtttgattgcatggagcattcttttggaattgtttaatataaacacaaattttagacattttaatttccaattggtaaatttcttgcgaaatgccccccctcccctctcgcacttcgcccaacacccaagccaacaccaccaccacgcacacacacacctacagcaacagtcatgtcatgaatgagcatggggacgaaagtgaaacgaactgcctgacggtatg

SEQ ID NO: 116434 - DNA, 560 bp, Heterodera glycines
  Promoter: Source sequence=SeqID_1937; Location=1921..2480; Strand=-; Gene=SeqID_76909
attattgagaacattttgactggcagcagaattaatacaatcagaaaaatcttaaaactcgaccgattctgcgaaaaaatgccaaaaccataggaataattattaaatttattttattttcatttaaataaataaataattaattgttttctattttaagcattcttacaatcgcaaaatgatcagaagaaaattttggaaaaaatcagtgaattggagaagcagcaacaacagcagacaaaaggcgaggagaaattaaaatgaaaaaatatttaatcgaattaaatgtttccattttaaatttaaaaattaatccgatttttaagctactgcggggcaattgtcaaagattttggaaaaaattggtgaaatggaaaaacagaacgaaaacacggacaaaggcgagggaattttagcgaagaataaattatcacttattaaaaattcttttttttttgaataagtttcttatatgaattaagaatttcatttaaataaattataacatttttaatttttgaaaattaattttaggaacttcggagcaattttcaaagatg

SEQ ID NO: 116435 - DNA, 617 bp, Heterodera glycines
  Promoter: Source sequence=SeqID_21133; Location=1174..1790; Strand=+; Gene=SeqID_51721
tatttttatctaaagagaaaaatgcataaaaagccatatgacaattaagtgtaaaaacgtcaaaattgaatagattatgcgaagtgacgaacaacattttgattaattaatgttttatcaaggtcaagtattaattaaacaagtcaaaacacaaataaaagtgaaagggacgtgaaaagcgacgcgtgaacgtttgttctttttcttcaacgattgctcattcccagaccaaacactacgattgcgtaaatgtaaacccaagccaaaagtacagtaatagcgcgtaaataatttatggcattttatttatttaaaatttaaaattcttcgctttaataaaacagaaaagaaacggaaaagtagtaaattgtccttccacgcttttccttgttttgtttgccctttccctttgcttttggccagtggccattgcctttagctttggcccattagcttccgcttcttctgctcccattgaaccgcttctcctttcttctctttttgttttcaatccattgtcattcattcttcattcgtccttctttgccctttctcttccatttgttttgcctttcattagcataattttactcgcggctaagaatggctatttaatg

SEQ ID NO: 116436 - DNA, 823 bp, Heterodera glycines
  Promoter: Source sequence=SeqID_43628; Location=453..1275; Strand=-; Gene=SeqID_46747
ttctcttccccctgggttagctcgggagattatggagaaaaggcgaggcgagcggttgtttctctatgtcagctgagcgacggtcgaaaggggagggatggcacgggggggggggggggggggaaaatcaagcccagaaaaacataaatcaactctcaaacacaacaaatatgtatgtagcaatatttgatgattattttattgtttgattttaattttaacaaaattaaaatgggtccaaagacattgtaaacgcttcaaattttgcttaaaattattttttcggcttttgcccgcactgacaaagaatttgaaaatcagctcaaaaacgtaggggaaaacgggggtaaatttatattcaaagaaaggtttttcgataaaaagtaaactttttttttttggctgctggtggttcagtggtgagtgtcgcagtttgattcaacctaattatctctaattattattggttcgcttcctttctcttcaccagttttttcatttatttcctcttctaatctatttttaacaataaaattaaatatttttattaatagtttcggcacttgattgagcccggtaatttcagttcattatttgactcgatttatatttaaatttaaatgaattttcagaattaaattgttttccaaaaaagaaaatagcaattaaaaattttatttttattaattaaaatctaagaatacaaaaattactattattaccagcaaaaactacgtaaaagactaggctttgtactataaaactaacaataagctaagttagcgaaatagctaaaagaaagatcgatagaaaagggaatatg

SEQ ID NO: 116437 - DNA, 70 bp, Heterodera glycines
  Promoter: Source sequence=SeqID_6284; Location=5092..5161; Strand=-; Gene=SeqID_61004
tgttaatttaaattgaatttcaattacctatttataatccactcacattttcagagaacatcgcaaaatg

SEQ ID NO: 116438 - DNA, 685 bp, Heterodera glycines
  Promoter: Source sequence=SeqID_4452; Location=1..685; Strand=+; Gene= SeqID_54502
gatcccgtccggtctctaatgaacacccaccctaacagtgtaaacaatttttcggtttcttggactaaaaacgcgagaccgacgagaaatttcaatgaatcgagaacagaggctctcgcatatctctagtaacgatccagcctcggctgatattatggaaaataaaatatcataattttagcaatgatgccaaaatctcccaaatttcgccggcggtgctctgttaataccttttcctaaacattctttttaatttgttaaagatcaaatattattaaaacatttacaattaataaagataaatattattaatgaataatctagacaattgttctcttcaattattaaatatataaaattgccttatttaaatttaaatttaattattatttttaatttttatacattaacttattaaacaatattaacaaaaaacaaatttttttttatcatttggttattttatgtgcataaatatattatgctttcccactgattcatctcacatcacccaaatcacaatttacatattcaattggtaattacccaaatggacaaaattatataataaaaattccaaaccaggaaagtggttaaaataaacaaaaactaaaaataatattattaaaattcaaagttttttactattttagcaagcttaaagattaagaaatattccaaaatg

SEQ ID NO: 116439 - DNA, 258 bp, Heterodera glycines
  Promoter: Source sequence=SeqID_3983; Location=1858..2115; Strand=+; Gene=SeqID_52688
acttcagatttttgttgtttttttaatatgggttcaatcccatatgcccacactttattttaccgtttttttcatttaatttactattttaattactaaatctgttaacaaattacactaaaattttcaaaattttccccagcggcgcctatcggcaccgccgggcccacccaagttccccaagttttctgaaaaaatgcgccgcaaaaaaattgtttaaaatctgatttatttaaccctataaatgatgggagaatg

SEQ ID NO: 116440 - DNA, 78 bp, Heterodera glycines
  Promoter: Source sequence=SeqID_5277; Location=2214..2291; Strand=-; Gene=SeqID_57533
ttttttttttgtaatatgctcataaacggatttaaataagtcaaaaaataaatttggtctctttttagaggacagatg

SEQ ID NO: 116441 - DNA, 258 bp, Heterodera glycines
  Promoter: Source sequence=SeqID_20402; Location=1469..1726; Strand=+; Gene=SeqID_45577
aattgttaagtgccaaattccctaaattaatatttttaattaaaattgtgcagaaaatgagtttccgtgttttcatccgtgccttaatcatgtgcaatttgcaatggatgaataaaattttatctgcaatgattcatttattaacataacaatgtttgagcgggagcgagcctaagaaatcctggccaagcaattatttctaaacaatttttgccaattataaataaaaaaaattttaaaggaaaattttaaaaaatg

SEQ ID NO: 116442 - DNA, 434 bp, Heterodera glycines
  Promoter: Source sequence=SeqID_12626; Location=1003..1436; Strand=+; Gene=SeqID_76294
cctgaaacaaagagagggcaaattggacgcaggagtcgagagcgaaattaaagaccaaaagccgagactgagaatggccccaaatgagagagaactgaccacacagactcaaggtcgagaatgaacttagagagtcaagaaaacccaaaattggacaagaaattccggatcaaacttaaccccgtattgggaaacaaaatgtgagatcaattaaagcaactgacgaatccacgagcagcctcttcagcagtcgtcccccgttgaacacggtttggtagagggccgagaagcgacacggtcccaccggtgggtactcaaatgggcggtgttgtcgttgttccccggcttgtcatcgttgagtttgttgttgagttcgctgttgctactggccgttgttgttgctgttgtcgtcgttgttcttgtcgtatccgatg

SEQ ID NO: 116443 - DNA, 131 bp, Heterodera glycines
  Promoter: Source sequence=SeqID_8793; Location=709..839; Strand=-; Gene=SeqID_69235
aatggtaccactactaaaaaaaaaaattttttttatgaattatttgggattttttcagttacactgaggtggacccggtgatcatcgcagcgaatggggtggacaaattcaaaaatgacggcttcgaaatg

SEQ ID NO: 116444 - DNA, 123 bp, Heterodera glycines
  Promoter: Source sequence=SeqID_24806; Location=900..1022; Strand=-; Gene=SeqID_55553
ccaaataaattgggtgccccccccccggcaaaataacccctttaacaccattgcaatgcggctggcagtaatgataacccccgacggaatggagaaaaaacggtggtggaccatctgaggatg

SEQ ID NO: 116445 - DNA, 252 bp, Heterodera glycines
  Promoter: Source sequence=SeqID_2984; Location=728..979; Strand=-; Gene=SeqID_82640
atcagttgatcaaatgggtgaatattccaatcagaatgttatcaaaagtgatcaaaacacgagaggagaaccaaatgatcaacagaaaagagaaataattcggaaatttgacgcaattaaatataaactgaagcaaaaaggaaaatatgaacaaaaaaaattgtcaaaattgagaggaaaattggaaaattattaggcgcaaatcgcgaaaaaatatacaaatggaaaaaacaattaaatttaaataaaatg

SEQ ID NO: 116446 - DNA, 415 bp, Heterodera glycines
  Promoter: Source sequence=SeqID_38034; Location=1..415; Strand=+; Gene=SeqID_66974
aacgaaaaaaacttgccgaaaaaatggctttctttttttctcctggggatttgcccgcaaacttgttcccacattttcccttctttagtcgggctcttccaaacactcacacgatatttgaaatgctaacgaaaaaaattctgcccgaaaaattgcctatctcttttttctcctggggatttgcccgcaaacttggtaccaacattttccttctctagtctggctctaccaaacactcacacgatatttgaaatgctaacgaaaaaaattcttgcccaaaaaatggctatctcttttttctcctggggatttgaccgcaaacttggtaccaacattttccttctctagtctggctctaccaaacactcacacgatatttgaaatgctaacgaaaaaaattcttgcccaaaaaatg

SEQ ID NO: 116447 - DNA, 117 bp, Heterodera glycines
  Promoter: Source sequence=SeqID_1158; Location=1608..1724; Strand=-; Gene=SeqID_68984
ccccccccccccccccctctaattgcaactgaagttgtcaacagcagcagacaacaagcaggagcaggaaggagttcctcatttgaacttgaaatatgtggataatttgcagaaatg

SEQ ID NO: 116448 - DNA, 388 bp, Heterodera glycines
  Promoter: Source sequence=SeqID_10062; Location=1..388; Strand=+; Gene=SeqID_73128
ccttttgttttgcaaaattttttttgtgatagtcataaaaatttattctctggggtttttggggtccccgatcacgaatccttcaattattttgatcaattccgatttcctaatctaaatttgaacaaaaaatcataattttaaaaattcaaaatttcgatttttattcgagttcgggttagggattagaaattagtcaaaatacatgtcagattcgtgattagcgaccttttaaaccccggataaaaaattatcatggttttttatcttaaaaaaattttgcaaaacaaaagggtccccccttttgtttcaaaaaggccaacttttacagtagcgccgttttatttgttgcttataaaattaggcttatttaatggtcatgcatatg

SEQ ID NO: 116449 - DNA, 410 bp, Heterodera glycines
  Promoter: Source sequence=SeqID_26706; Location=924..1333; Strand=-; Gene=SeqID_57467
ttttttttatcagtttttgggatgggctgacaaatgagcaattaattagcgaattaattatgtgagggaatttggctcttcctccaattatatagcagcaacacatcactcgccaatttggcctgtgtttcacattttttatcgaacaaatttgatagggaatggagcggacgaaaagtcaaaaaatttgttgatttgtgcaaaagccaattttatttgttttataaattagatgagtaatttaattttctttttaatcgcattcaatacacaatgaattttaagcgtcccatctttgccataattctgcacagagagaaatttcttctgcaaattattaacaaaaagataataaaatataacgggaatgctaattcagttttaaaataattaatttataattaaagatg

SEQ ID NO: 116450 - DNA, 335 bp, Heterodera glycines
  Promoter: Source sequence=SeqID_21600; Location=1..335; Strand=+; Gene=SeqID_52199
aatttgttaaaaggaatgcttaaagttttcagcgatgcttcattcgttgctgattatgaaaacgcgtcagaaaatagcattagagggaaagtcgtagcgcaattccctctatgttgatcaagacaataatttgcgtcacatttttgctggaatttatacagaaagcagcagcagaaaatccccatcgaaaggataacactcaatttcatgatctgcgatatctcagtgacgaaacgatcagtgacgaaatgataggtaaccaaaagaaatgccactttatgacgcgttaatttatttactttagggacttaaaaataacaattcaaaaatatatg

SEQ ID NO: 116451 - DNA, 427 bp, Heterodera glycines
  Promoter: Source sequence=SeqID_13526; Location=193..619; Strand=-; Gene=SeqID_77425
atgatggtcgaaaaggatgaattttggcttggaaatcttataaagccgccccctccccctccaattttcctaaaatatgttatttatttttgttgaatcctctctttacccctatttttctctctctttttttgacggctcatcattatcatttattttgtcaaataatcaatcaatcaatcgcacgtcacactatttccattttttggtttgacaaaatttccaaaatttcatttgatttgtttttaccatcataaaaatcaatgataaaaaatatttggcgccgtttgttttgttccgttgcttgcttaattctgtttcattaaacaacatttacttcatttgtttgtttctttgtttacttgttttgttttttcatttttgttgttgtttaaaacaattgtctgcaatttttgtgcgtaaaatg

SEQ ID NO: 116452 - DNA, 504 bp, Heterodera glycines
  Promoter: Source sequence=SeqID_2359; Location=343..846; Strand=-; Gene=SeqID_79314
cctataaacgggaaaggggggattatagagtgcatcccatataagttactctctggatcgttccccctcccggaaaacttcataaaagttgaaaaatcactgaaaaatttttcaaaatttattttcttggaattttcttataaaaaaactcttttaatttatcggcggggggggggggggcacgacctgctccgaagattataacatgacaaaaataaaaatgcaaacaacaataggcgggaggggcaaactaacttcaaaatgagaggaatttcactggcacaatttttacaaaacggcgcagcctcctccgccgtcccctgctcatccgtatccatgtcgtcctcctctgctccctgctgttggtcaccactactgtcatcctccaagaccaccacgtccccatcgtcctgctgtcgtcccacggttgtcacggtggttggaccagcagcaatttgctgcagttgatttgctccattttttgttgttgaacaaccaacaatg

SEQ ID NO: 116453 - DNA, 136 bp, Heterodera glycines
  Promoter: Source sequence=SeqID_31581; Location=1402..1537; Strand=-; Gene=SeqID_61907
atctgcaccaaattttgcgtatcgattgagaaaaaaatctgcatcgatttctatctttattatcatcgcttaaatgttgttttaaaaagttataagataaaaaagttaaattattattctttttaaagatttaatg

SEQ ID NO: 116454 - DNA, 437 bp, Heterodera glycines
  Promoter: Source sequence=SeqID_30646; Location=1556..1992; Strand=-; Gene=SeqID_61055
tccactatttagtgagataaataaataaaccaattattctcccacaggcactgtgatcactggtctatcggtagtgccttcattaatgtttatagattagaggttcaagtcattcgcatgccaactgatttctacttttttaaaatttatgtttcttataaaattaagtcagaaatataaaaatattttttacaagtataaaaatataaccattttaaaatgataatttacttaaattagtgtttgaccacaaggagagcttgacaataataattatcatctcaaaaattaaatgggctaattataagaaacttgatcatattattaaaaaatattttttatgggtaaaaattttggcagtaaatattttaacaattggtactctataaatttaaaactagtccagggtaaatttcccaacaagaaaaaaaagtatg

SEQ ID NO: 116455 - DNA, 129 bp, Heterodera glycines
  Promoter: Source sequence=SeqID_1724; Location=1..129; Strand=+; Gene= SeqID_75506
taatattttattcatattctacaataaaatctcatagaatatatatcttttattaaataaaataaagttttagcaaaaataaattgattaaaaattggtaacaatttttttagataatttacaaaaatg

SEQ ID NO: 116456 - DNA, 192 bp, Heterodera glycines
  Promoter: Source sequence=SeqID_11213; Location=2322..2513; Strand=-; Gene=SeqID_74573
aaatacagtaaaacacattttttcctgtttttccaggctctgaatagttggaaaaacattttattttttggtttgctacgggttttttgtccaattctttttttcttacatataatttgaatccctaataatatttgatgtgaatttttttattattattttaatagaccacaaaagcgtacaatcaaaatg

SEQ ID NO: 116457 - DNA, 687 bp, Heterodera glycines
  Promoter: Source sequence=SeqID_17846; Location=1..687; Strand=+; Gene=SeqID_82379
atgatcagtagggatgggaatttaagtcaaatgactttttttttttgctgactctaaatgaccttaaaattacttcaaaaatgttctaaactttgttcgaagcttctaacatgcattttttggtgactttttttgctttttacactttttgggatttttatgacttttttgcgtttttgtgacttttttcatgactttttacactttttaaagcaaaatttgactttttgtgatgaaaatgccgaaaaatacaaagaaaattcagaaaaataagtcaatattcgaggcggaactgaaatttcttataccataaggactcaaatgacgggaactgaaaaaataaaaaataaaataaaaatttggcggtgtaacacttttgaatattttttccgctaaaattagtcgttttaaattactttcttcgaagaatgtttaaaacgcttttgggtttaattacatttgtcttattttcacgacttttttggatttatttagtgcttttttggcatttttctgtgactttttggttatttttcatgactttacattttttatgactttttcgtgactttttggcgatttttaatgactttttaagtcgccttttttgagaattttcgtgacttaaattcccatccctaatgatcagcaacaattaagaaaaaatgaaaaacttcctgaaaaatg

SEQ ID NO: 116458 - DNA, 94 bp, Heterodera glycines
  Promoter: Source sequence=SeqID_1440; Location=1305..1398; Strand=+; Gene=SeqID_73551
aaaaaccacaaatgggtataaaagcaatttaaaagcaacagaaatttggtttcctcggcacgtctctgagctggacaaaagcacgcatgtaatg

SEQ ID NO: 116459 - DNA, 1003 bp, Heterodera glycines
  Promoter: Source sequence=SeqID_12440; Location=1640..2642; Strand=+; Gene=SeqID_76055
aattttacaacaattatatgcgtggtgagaccaagcaaattatttaaaatttatttatttaaataacaaataatagaataattttgcgctaaaataaatattcattgctcatcgttttgcaaaacaaacattagttttctttgaattttaaaataattaatcttgctttaattggatctcttgagcttttcttagtcatagcatcgaatgaatgatgaatctggtttggaattttattgcactttaataatattattagggatgcaaaaaatatgcacgaaaagtagccaaaatatgcgcataaatatgcaaataaagtcgtgaaatatgcaccaaatatgcacaaaaatcgcaaaatatgcacaaaaaaacttaaaaattaggggtgcaaattcaataaaaaaattttttttttttactagtgacttgccaatgagctgctacatttcttttataaaattctctttagcaaatattgacattttttaaatcaaaaattttctcatgaaaaaaaatttgggggaagaatttttgagaaaatttccaattcttagtggtgtgtttttaaaaattttcggtcgattcctaggggtgtattttccgtttttattgcatttttgttaacaaattttccaaaaatggcgaaatatgcataaatatgcacaaaaagccaaaatatgcaaatatgcacaaaaaatctcgaaatatgcaaaaatatgcaaataaaagtcccgacttttatacgcaaacacaaaaaagaaagtgtttttcctattatttagagcatggagaaaccaggaaaaaaaatgcatttgcataaaatttgcaccctaattattatttttactaatattaacaaaaaaaatattttaaataaataaattaattattcgaataatttttctgggactgaaacggcccttcccccaaaactcaaacacacatacttttgtcactccggctcaccacggttttattactttttcgtctccatcagcagatg

SEQ ID NO: 116460 - DNA, 93 bp, Heterodera glycines
  Promoter: Source sequence=SeqID_21523; Location=1573..1665; Strand=-; Gene=SeqID_52135
tctgacacgagcaaaatttggataaatttgggaatacggatcccgacaaacggcaaatatccctttgaagcccaattgaaaatctccaaaatg

SEQ ID NO: 116461 - DNA, 703 bp, Heterodera glycines
  Promoter: Source sequence=SeqID_33372; Location=1..703; Strand=+; Gene=SeqID_63454
tagagctcgcaaaaaaaaaggcaccaaaaatcgcgaaaaaggcattataataggcacaaaaaattaaaaaaaggcttgaaaaggcacgaaaaaaggtatttaaattttttattaaagatttttagggagaaaacacgtaaaacttgaccaaaaaatacttaattcaggtcatttcttagaggtgtattttcccgattttaatggattttttcggaaaaaaagccaaaaaggcaccaaaatgccaaaaaaggcatttaaggcacgaaaatcccaaaaaaggcataataaaagtcaacgtagaagcctcgaaccaagtgaaaattgcgttttttatgcttaatatatcgaaactaatacgcagaaaaaaaggcatatgcctcaaaatgcgcgctctagttattaaaaataaaaaatcgacacaaaatgcaaaattttgcataaatttcaaaatttcccccagcggtgcttagacttaccatactttaattttaccaaaaaaacaacaacaacatagagaatttttaaagcagaagagcaaaaaattcattttaattcattctaaattcaaaaagagaaaaaaagtgattccctaaaattgaaaaaatttttattttatctaaaaataaaataccatttgcttttaaatattatttaataaaactttaaaataaaactcatttagaaacctgataatgataaaatg

SEQ ID NO: 116462 - DNA, 176 bp, Heterodera glycines
  Promoter: Source sequence=SeqID_39488; Location=1..176; Strand=+; Gene=SeqID_68053
ctctagagtctaattaggctatggagaatccatgaaaaaatatgtatttacataaaattagcatccctagaaatgaatattaaatgaaaaaaatcaaaattaaaaagaaaatttcattttaaattgaaaagtatatgattttatttatttatccacttttagcatttgagaaaatg

SEQ ID NO: 116463 - DNA, 193 bp, Heterodera glycines
  Promoter: Source sequence=SeqID_18600; Location=1..193; Strand=+; Gene=SeqID_83250
aaaaaaaaaattgaaaaatttgccataaatagtaaaataaacataaaaaattatctaaaaaatacttactcacaaataaaagttgaatttttttgaccaaatttaagattgtaaaaacggaatttcttgctatttactaatcatttgatttttaatttacaattaagatgaacaatttgcacgagctctaatg

SEQ ID NO: 116464 - DNA, 586 bp, Heterodera glycines
  Promoter: Source sequence=SeqID_17183; Location=1..586; Strand=+; Gene=SeqID_81632
tcaaacgcttttttcgtaatgtttgcatttgttaatagttttttataataattttttttaattttttgaaatctccttatccccccccccatgtgagcttagattagcaggtcacgcaaaaacatttaccaatctccaaaggaaatttggtttttccgtctttagctcagaatctcatcctctttactaattttttagtgattgtccattcaacgaaaactcatataattctacgaattttatggttaataggcaaacaatggagaaattcaatccgataaaagcaaaaaacatttataaatgggaaataaatgggtttttggtcaaattttatgccatggaaatgtaaatttgtccgacattcttttggtaacaaatgagggttatataccataaaaatttgctccctttcttcttctcttttcaatcgttcctctcataattctgccattttcggcttccgttttgtttgctcaatttgtcctaccgtactctcttgctaatgagtcatcagtgtcgccattactgtcttctgtcccttctgcttcccaattgatcggactttctgtcgtagtggtcacaaatg

SEQ ID NO: 116465 - DNA, 57 bp, Heterodera glycines
  Promoter: Source sequence=SeqID_7866; Location=1547..1603; Strand=+; Gene=SeqID_66224
aattcgtttcgacaaaactgtgttttctggccaaggagagcgaatgcagaccagatg

SEQ ID NO: 116466 - DNA, 209 bp, Heterodera glycines
  Promoter: Source sequence=SeqID_3238; Location=378..586; Strand=+; Gene=SeqID_83834
atgacaatttcattaaatacatcgcatttttattaaacccaaatgcacaacaacagtgggccatttgttttttgtttgcttgatacaaaagtctagcctaatccctggcgagatattcaaaaaatatatatacctaggtagttaagataatactaaaatggtgcttgaactcaattttatataaaaatagagccctaattatcaccatg

SEQ ID NO: 116467 - DNA, 948 bp, Heterodera glycines
  Promoter: Source sequence=SeqID_22868; Location=646..1593; Strand=-; Gene=SeqID_53574
tagggcagcaacttttagtgacgaaaaatcccaaaatagttaactaaaatagtgagtaaaaatgccaaaatagtgaagaaatagtgacaaaaagtctgaaatagtgacgaatagtgacataattttcagccaaaaattgagcaaaactaatttttattcactatttgcagttgcaaatgagtgggactgggatttttaagaccaaaaaacccaaaatagttacctaaaaaaatttttaaaataaaaatttttgccaagaatgtaaatttttgagaaattttttttttcatttcataggagtatattttgaagctttattcttaggggtgtatttttttgaaatttttttaggtcgattcttaggggtgtatttttttgaaatttttttaggtcgattcttaggggtgtattttttggttttattacatttttgttaaggaattttccaaaaaatgtcgaaatagtgaaaaaatagtgacaaaacgccaaaatagtgatttttaactattttagtgacaaaaccccaaaatagtgatttctagtgacgaaaagtgacgtccaaatgaaaaaattttaatgcagaaatgcgttttttgagctcctttcttcaaaacaattgagcaaaaaaaaagtttttttcactaaaagttgctgccctattaattaaatatcaacgtcaatgttgatatttattaaaacaatgttcgctaagagaaaaatgttgatttgcctttctctaatcaggtgccaaaaatgcgttcattaacacaccgagtcaattttaggctccaagttcaaaaaggaaatgaatgtgtggcgaagtggtttttgtaaaatagtaaagggaaagagggcggaggttcgagtcccttgtgcaacatgaacatttttacttatttttttgaacaaaatttttaacccttattttccaaagcacaatcacaaatg

SEQ ID NO: 116468 - DNA, 183 bp, Heterodera glycines
  Promoter: Source sequence=SeqID_7907; Location=419..601; Strand=+; Gene=SeqID_66337
tcactgaattataggccaaatatcagtttgaaatcgaatttattaatgaaagaatgtgtatatatgtacataaatttatctatttataatccaatgtttctcaattagtgaaaaacgcagaatttccggtgcggaaaaaccatttcattttttctataaaaggcgctgaatgacgccgaaatg

SEQ ID NO: 116469 - DNA, 66 bp, Heterodera glycines
  Promoter: Source sequence=SeqID_30861; Location=1..66; Strand=+; Gene= SeqID_61251
tttttcagctaacatccccccccccgcagcggaaaatcaaaaattctttccttttttgtaacaatg

SEQ ID NO: 116470 - DNA, 599 bp, Heterodera glycines
  Promoter: Source sequence=SeqID_1092; Location=401..999; Strand=-; Gene=SeqID_67691
tttgttttatgaaaaacttgtattgcgataaattaatttagaagagcacataaataattataatgaattaaacagttaaaaataaaattaaataaaaatcaaaatttataaaaaaaaaattcacaaaggctccaatgaaattaaatttttgctttgttcaactatttctgcaaggtgtactcgcccccgttggttgatgaacttcgcaacttaaaatgaatttttttctattaaaaataacttaatttcttttcacccggcggtgccatatcgacaccgtactagccaaatcaccatttttaaaattcatataaacccgtaaattggttatttttaaataaaattcattaacgaatttcaattctaaattttcaaattaggcggaaccgcaattgtcctttaatttaaaaatggattcaaaaaagtttctaaatttgacataaaataggattttttggtgaatatctgctaaaaaatattcaaaatttcatagttcccctcactcgaaacttagttctctcaactgaaatcacaaaattttgtcgtatgttaggcaaaatctgttagtaattgcatccaaattgtaaaaattttcaatg

SEQ ID NO: 116471 - DNA, 727 bp, Heterodera glycines
  Promoter: Source sequence=SeqID_1186; Location=464..1190; Strand=+; Gene=SeqID_69480
tatttaattgctttaaaattttatttttctatttatttaaaaatataaattttatatttttatttatttagcgtcaaaattaggaccgcccaatatttttattattttcagaatttttttttaattgagaacgaaatttttttccaagtaaatgctaagtaatttgattaaagatttgggcgttcgaaattccatgccatccctgctggtgtgtaatatgaatggttttccttaaaaaccagatcagggtcattttggcacggcattttacacgtccaatgagtttatacgggttccgtttttttggcgaaaatatttacaaaaatcgccattttattgggtttttgaaaattagggtttgacctcctcccctgaattagaaccccccccccccccctctcagaattctttcaaaaaaattttgctaaatgattggatatagggcgacaaattggattgaataattaatttaatttgaataatagactgatcggaattgggggaaaatggtttaactgatcgacggggattcgaatttccattatttcacttcttcttctcccattctttcgacatcccacttaaataatgctcttccttccttaaaactcgttcacttcaatcacggtttaagccgatccaaaatggcgccacggaaaagcggcaaaatgccttaaaaatgcaaattaaaaattttttttttgtttccaaaaaatgatcaccgatg

SEQ ID NO: 116472 - DNA, 499 bp, Heterodera glycines
  Promoter: Source sequence=SeqID_8261; Location=1940..2438; Strand=-; Gene=SeqID_67482
atccctatttgtatttattattctaatattaataaaataataagaagcaactgattaattgaactaccgtattttctaagccaaattccaatgagaggaaaaatttggaattgtttagctaggtctaggtctaagggcttaggcttaggcctagcttttggcttaagcctatgttttaagcaaagcctagggcttaatcttaggctttgttttgtcaaacatacgagttgccaatgaccccaaaaattgctcacggaaatacggtagcaataaaacaatgaatttaataattaaaaaattcccaaaatttatcgtatcattcaaccaaaaatttgttttaatttattttttggctgtttgaattttccataatttcacagccacggaaagtttcaccttttgggggtgtgccttggacaaagattgcgagacgctcaacaaatacctggcatttggccacaaatgccagtgccgaattgcgcgcaaggggcgcgacatg

SEQ ID NO: 116473 - DNA, 345 bp, Heterodera glycines
  Promoter: Source sequence=SeqID_20617; Location=1346..1690; Strand=+; Gene=SeqID_51174
atttgagttttacaatttctcattcatagtgacttttgatttttcagtgtatgtgcctttatttttatttaattcgcaaaaagtggcggcatttgattttgtttcatattcaattattaatgttttgatatatataactgtccgtctctttttaagtgcagttatttcacgttttactttgtttatttcattaattggtactatataaacagtaaattggcaattttttctcatttatttgccacaagttttcattaggcatttttcaattgacgatgtagagtgccttgattttatccattaattaatgtttgagattaaccgataacagaagaagtcaatatg

SEQ ID NO: 116474 - DNA, 262 bp, Heterodera glycines
  Promoter: Source sequence=SeqID_39631; Location=172..433; Strand=-; Gene=SeqID_68151
ttttataaaataatagtccaaaagggtgtaaatgatgtcaatcagtgtcgaatcctctgaccccaaaaccttaactgttttagctcaaaaaattgaaaattatttttttttgcttaagagtgttcaccatcgacagtcttaccaaatttttcaacaatttttacttaattctgctcccaatgaattgtaaaaaaaagattagatataaaaagaccaattatttttccccatcttttaaagttgactaaaattcaacaaaatg

SEQ ID NO: 116475 - DNA, 52 bp, Heterodera glycines
  Promoter: Source sequence=SeqID_11067; Location=3988..4039; Strand=-; Gene=SeqID_74402
gtcattttgttacaaataatttttttaaaatcaatttagcaaattacatatg

SEQ ID NO: 116476 - DNA, 169 bp, Heterodera glycines
  misc_feature (27)..(27): n is a, c, g, or t
  Promoter: Source sequence=SeqID_8753; Location=771..939; Strand=-; Gene=SeqID_69112
aaaatattttaaaatttttctgaattnatcggaattgggtggatgcatttttctaaaagcgcaaccacattttgcaaattttaaggaacgtgccaaaacacgtccgaaattgactattttcaaactgtttttcaaaaaaaagatcttgtattattctagcatttaaatg

SEQ ID NO: 116477 - DNA, 140 bp, Heterodera glycines
  Promoter: Source sequence=SeqID_17378; Location=579..718; Strand=-; Gene=SeqID_81861
cctgcaaaattaaaaaaaattccgttgggtttcaaaaaattaatggccaaaaatgtttagaaaaccaactttttgaaattttctggtcataaatttttaaaaacaaacggaattttttgaaatttttaggcgggcctatg

SEQ ID NO: 116478 - DNA, 650 bp, Heterodera glycines
  Promoter: Source sequence=SeqID_26118; Location=489..1138; Strand=-; Gene=SeqID_56868
ccccccccccccatgttcccaaaaagttttttagaaaaagcgcgcgcaaacaaaaaaaaaacatttttaaaagcaaaacaattcgtcgtttgccttaaaatcgcaaaaatttggcaatttttggttgaattctgaattatttagaaaaaaatttaagccttgaagattttttcatgggttgcatgctaaattctccttttaccaaaaatctaattttagaataacgatgcttttcaaaatgttctgtaatatgttcaatttttcgtagtcttcgcttatttgttagccaatttttttgaaatcttcaaaaaaatttcccggcggcgcctatcggtacagccggaccccttttttaccttagtttttgaaattttaggtcgaaaattgcaaaaattgacattttttggcgtaaaattgccacaaattcctgttcttttgctctccggcgctgaaatttttaaaataatattaggagaaaaaaaattttgatccgaaaagcaaaaaaaggccttcggattctctcatccgaactttttttctggttgcatcaaccaactccttaagcggcaccaaaaatttattttttgcataatttcgtgacattcaattccttttgttcgtttgttattacaaattgcagttcaaagatg

SEQ ID NO: 116479 - DNA, 207 bp, Heterodera glycines
  Promoter: Source sequence=SeqID_7210; Location=1464..1670; Strand=+; Gene=SeqID_64162
ggtgcgctacgctcgatccgcttcttcccttggcattccgccgtcaatgtgagttttttcgccgcgccgccctcccattgcattggcacttatcgcgtccaactttggctaatgaacgcacttcacaacgaaacgagcgtaacatcggtgaagcatttgcattaagcggtaaatgatttccttttgcagcaacagttgagccgaatg

SEQ ID NO: 116480 - DNA, 59 bp, Heterodera glycines
  Promoter: Source sequence=SeqID_31828; Location=724..782; Strand=-; Gene=SeqID_62134
attgttgcgttaggaattagtcggttgtccgctgttaaggaatggtccatcctggcatg

SEQ ID NO: 116481 - DNA, 266 bp, Heterodera glycines
  Promoter: Source sequence=SeqID_42357; Location=379..644; Strand=+; Gene=SeqID_70269
actttaaatatttaaatcaaattttaataattgtttctttttcggtaaaatttggaattattatgaatgttttttaactcaaattatttgcattattatcatttaagtagcgaattagtcattaaaataaatgctaatgtttttcttaattccgccaatgaaacgaaaatgaaaaatttcgttggaaatacaaacccttatagcagctatagaagtgattgatttataatcataaaaaacaactcattttcaggaaatttataatg

SEQ ID NO: 116482 - DNA, 555 bp, Heterodera glycines
  Promoter: Source sequence=SeqID_12879; Location=707..1261; Strand=+; Gene=SeqID_76613
aataattaagaattgttaataatttacattttctggttttgtaaatgaatttttattaggaaatgaataaatcggtggcggcagccgatcagcaggaagtaattaaattaaacaatatgacaaagaccgaattttttttcttttttgccttaacttgtgtcccatacaaaattgtaaaatatttgacctcataaatttaacaaaaatacaaattatttttattgtatttcaaactttctatatttgataaaaaatcaaaaaagtttaatcatctgtagtatcttcacaattataaatttggcaaaaatgtgatgtaaatcactataaaacaaaaaaatcgggtcagttcaaaaattttaaaaatttctacggattttcaaatcttgaataattcttgaaaatgtgttaaattttgatccttgatataatgaaattttttcctcggcggcgcttattgtttattgtttattcataaaaaataaaaaagtcatcagaagggcgagaaccacttactctgacgactaaattcatttttctgttcatgtgccgtcaatg

SEQ ID NO: 116483 - DNA, 734 bp, Heterodera glycines
  misc_feature (48)..(48): n is a, c, g, or t
  Promoter: Source sequence=SeqID_13666; Location=1..734; Strand=+; Gene=SeqID_77574
cataaagtatatgaatttcaccaagaaaaactttttcgagtttcgggnccgctgatcacgaatatgccatcaaattcgacatctgccataatctaatctatgattttccataaaaaataaaagaaattagtaaaaaatatagaccagatgtagaagtcaaatttgatgccatattagtgatcagtgaacccaaaaccccgaaaacttatttttaagctatataaaaaaaatttcaaaatacttttttttaattgcaccctcaagtgtgtaattttgagacccatttttaggggcctatttttttgtatttttctaaggaattccgaagtcccgaaaagtggaccaaaaaaggcgaaatgcacaaacataagcatttagccattaagcctaaaaaattcaaaataggcaaaaataacattagaaggcagttataaattatatttcacattaaatagtgacctctctgacatatttctaaaattttgatcaaattgatctgatcgattttgcaaatttttgcccttaatccacttttatgttaattttgacggattgccttcactgacggattgaccgctgacggattttctactgacagattgtccactgacgaattttccggacctcaatctttaacgtttttattgttttttagtctgaattatatgtgtatttaatccatattagtttttcataatttatgataatttgtgtttttagatcaatatattatg

SEQ ID NO: 116484 - DNA, 151 bp, Heterodera glycines
  Promoter: Source sequence=SeqID_21798; Location=370..520; Strand=+; Gene=SeqID_52420
tttgcgcttcttccgccccttccggcactccgttcgttcctccgccaccgtccccttccgtccccagaagcaaagagtcgaaatgttcggccgaatctgcgtaattatcacgggcgaactgttcagcagaagacaaaaacttggacgaatg

SEQ ID NO: 116485 - DNA, 155 bp, Heterodera glycines
  Promoter: Source sequence=SeqID_6071; Location=1..155; Strand=+; Gene= SeqID_60214
tgtacacgttctcgcacttttgcccaatcgcaaaacgccgtgaaaactttgctgtcccaggcctacaaggcgcaggagcccttgagaaaaacaaaagttcaaatttagtgggtgtaaatttttggcgttatgtatagcataaaaaattaaaaatg

SEQ ID NO: 116486 - DNA, 1003 bp, Heterodera glycines
  Promoter: Source sequence=SeqID_2858; Location=1366..2368; Strand=-; Gene=SeqID_81989
acccagcggaacttacaccacccaggtgatcagtttttgtcgatgagaaaccgcacccagcggaacttacaccacccaggtgatcagtttttgtcgctgtccgttgaaagccacccaggcttttgaagtgccaaaattaggcttgcagaattatgccttgatttggcttgaagattgtgcaaatatgccttaaattggctagattttgcagaattagccttgatttggcttaatgatgtgcagaatttatctgctgctgctgactgcgccaaaattgttgtgtaccaacaatttattaataatcaaataaaaataaatgcacaaaaatggtgaggtcggaggagtgcagcggcggaggagaacaaaataataagtgtccaatgcgaatgaatagagcggagagccatgagtgagggaatgggcacccttataaagacgcggggtcagagaaatgtggaggagatggcagagagggagacaatggaaataatgtaagacagagaaagggggaggggaaaagtcaataacagtgatgaggtgtaagtgatctttgatcctatccaacaaaattcatgtttttttcattggttaaagttttgaaaatagtgcaccaaaaggagaaaaaaggaatatgaaaattttaaattagtttactaaaaaacaggacagaaagttattaattccttatagaatattcggtgcaaaatttttttctctagcgagtgagtgctttttagaaaaaaaaatgacaagatagtatgccgaagtgatgagagaaattagaaagaaaaagagaaacaacgaaatagtattgtaaatttttcgtggatgaaaataaaaattttatgacatcattatagtgttggatgccaacacttcatttttataggtatgcatacactaagacatttaatttttcttttacatagctaaatccaaacaaaaaattttatcttttatatagctttatccaaaattttttttttaattttacattaaaatg

SEQ ID NO: 116487 - DNA, 1003 bp, Heterodera glycines
  Promoter: Source sequence=SeqID_18728; Location=875..1877; Strand=+; Gene=SeqID_83400
taatataaaacaaacttctaaatataatgtaaaacaaattatgttaaaaatccaattaaatcagtaactaaagtatttttatttctcaatgaataaaagtaattcttttaaatagaaatatttcgaaaattcctttataaaaacccgaaattaaaaaataaaattacctgatttaattaaaacttgtttttaaacagatttgaattaaattatttaaatatgttttttgagtgggttagcaagtgaatgatttttgatgatggatacattaaattccgaaatgacgatgatgattcatcgacacagcttttatttaaatattttactttttattagtaatgagcaaaaaattttaaaaataaaacttgaaaattttaagcatataatattgactaaagaaaaaatcaatgatttattatttgtggtttccagcagaaagtgacaatcaaaaatattgaaactgtcaactaaattaaagttaatgaaaataacataacacttctaattaattatatacattataaaaaatattcaaaatataaaatcaattctttattagtaaatttaatatattgttttacaaaatagatgaggttgtcaattaagcaactactatcgttttcaagaaattggctaaataacgacacaatttttatagaagactaatacaattgtaaaacttatttttcctatttgttcttgtaaaaaaaggaataaaaatattaattaaaaaaatatcaagtaagaataagattaaaaacaaaaataaatgtagatgatagtcacgaatattttctgattaatagtagtatttatttattacatgtttttcatattgttctttctcaatgaaatatttccaaatatatgaaaaaaggctaacacatgccctgttccaaaaattccgaatccaataaatccaattgactctcggtttccagaattttagaagaaataacaacaaatctaagaaacttagttggaaaattttttttaccaaatg

SEQ ID NO: 116488 - DNA, 398 bp, Heterodera glycines
  Promoter: Source sequence=SeqID_3958; Location=632..1029; Strand=-; Gene=SeqID_52579
tgcttaaaattcttttttgacatgtattagcattctgtttttatatattaaaaagtagtttttgacgaactctatcagttgggccccagcacgtttttggccataactttctttcattcttaaccaaatacaatcttgttggtatcattcgattgcactaagtgtcctctattagactgcaaagtttcaaaaatttttgtcaatttctaacaaatttatggccaaaagaacatcagaaatcaggatttcacttatttttggctataagtttgttcaaaattgacaattttttttggaattttgcagactaatagaggacacttagggcgatcgaatgatacaaccgatttttatattcattcttctgtttttaagtgcataaacgaaaccgcaaaatg

SEQ ID NO: 116489 - DNA, 960 bp, Heterodera glycines
  Promoter: Source sequence=SeqID_32000; Location=221..1180; Strand=-; Gene=SeqID_62310
agtgcctattcgatgggtgggttttttttgtggcctttttaggtgcctatttcgctatttttgaaattattcctttttcttgcattgattttgaatattaatattttccatattaagaaatcagatgctgagaatgtttccgggaatgaaaaagaaatgagttattttgaccgagatcttatgcggggaatggagaaccaatctttgttccgaccattttttgaccgaaaacccaccagacaaatgattgccgagtcaagttacagtaatcctgttcagaaccaggtacagtacggagatgtaattaatttttgcacctgtttaagttaattttagtgcataatttaatgattttattattacatttttttaacaataatttcccaacagttcaattgagatcacaaaagaatgccaataaaagtcgtcaaaaatataattaaaatatttttcagattaagaaatcgaaaaaaaattgcgaatttttttagtatattttttttacaaaaataccttccaagaaagagtgatatttttagaaaaacgaatttttcaaaatttaaggaataactatcgttttgaagatagatatttcatataaagtacatcccacatatttttttcaatttttaattttaaacactaaaaataacacgctttatagtgaattatgaattttcaacttaaatttatgagccaaaaaatggaaaaacaatttttaattccagaagtacaggttaaaatttaatattgtaaataccttaatttacatacatagagaggcaaatttgtacctttatcaaatatggagaaaaatttgaatttttttttttggggggggggggggggtgattaaaattgaggaaatacggtataattaaaataattttcattttaagaaatcagattctgacaatgattcggggaatgaaaacgatttaaatggttttgaaaaggatg

SEQ ID NO: 116490 - DNA, 1003 bp, Heterodera glycines
  Promoter: Source sequence=SeqID_10363; Location=1352..2354; Strand=-; Gene=SeqID_73539
cggctcatatgtcgattttgctgtgcggtgcaaaagtcgaaacacggcgcttaaaacgcactaaaaatccctcaaatatgtcctaaatccaaaaaatgcccaaataccgtatgcactaaagtatatcttaaaaacggccaaaatggcttttaacatttgaaaaaataccaaaaattgtgtaaaataattcaaaattgattgaaataatgtcagactcgtaatcatcgacccggaccccctccctgggaataatttttggttctagtcggttttacgcgttccatggcattttacgcgtcccaacaacagtttacgcgtcccatggcattttacgcgtcccaaaaacagtttacgcgtcccatggcatttgtgtccatggcagggatgtcattccgaggctcaaaatttttcggaaaccagaattaagtgctatccctggtctatggtacatattttagccgtcctaataactatgatgaaacctatttttttgtccggtattcagtaattttttaactaaaacttcgttgttaaacataaagtataataactcatacacaggcaactcgaacaatggcttagactaggcctaagcttttggcttaaacctaggcttaggcttttttgtaaaaattttttatattagtaactttctgttgacatcattaacacaccgtttcaaaaaacgagacatgaaccaaagagagtgcagagaaaaaaacatctctctttttggcgtactatttctttatctctgttaatagagaaaaaccgaatttactttgccacatataactttttttctactcatacaatttacaccaaattttgcatgtcgatagagaaaaaaattctgcatcgaacgtatcaaatgttttccaataatggcgaagatactatgtatgtatgtatgtatgtatggtcattgaaaatggataagtaattcaatttttggcattactgatttttaggttttttccaatttttccccatttcaaaaatg

SEQ ID NO: 116491 - DNA, 92 bp, Heterodera glycines
  Promoter: Source sequence=SeqID_34654; Location=1..92; Strand=+; Gene= SeqID_64385
cgcgttcaagcagtacaacaacggaaacaattaattcaagtagtacaagaagcggaaaactgccaggaacaccgcaacgaaattggaaaatg

SEQ ID NO: 116492 - DNA, 152 bp, Heterodera glycines
  Promoter: Source sequence=SeqID_11598; Location=805..956; Strand=-; Gene=SeqID_75049
tgtcagtggccatttacttattgatcgtctttctatgcctctctcaaatactatttcactcctttctttctcggtcctctctcctttctttgctctctctctaccattaacgtcattatctcttctaattaaactccccgccctaggcaatg

SEQ ID NO: 116493 - DNA, 120 bp, Heterodera glycines
  Promoter: Source sequence=SeqID_18954; Location=1..120; Strand=+; Gene=SeqID_83684
tggagatgcataaaaatcagacaaacacaaaaatacaggactgatttatttgggtacaaaattgaagaaactcctgatcaaattcttttaccaaccactttgaaagactgtcatcaaatg

SEQ ID NO: 116494 - DNA, 408 bp, Heterodera glycines
  Promoter: Source sequence=SeqID_20695; Location=491..898; Strand=+; Gene=SeqID_51255
gtagtccagttggccaagtggactatttcccaataacaaaaggaatttcaagtcgattcctcctggcggtgtgattaattattcagaattctacaatgccgccacggaaacagttaatgccgataaacaccagagtagtgtgtaaaggggggcaagtagatgcgtaacctcataggcactaaaagtcgaacctactacgtaggtaacctatcctgaagacacatcaaaatatggataaatccgatttatttaagggttatcttttttgattagccaattgtttgaaaatgtctgcctttttgattagttttcccggtttgttctgataaaggcgatcgtttgtcaagtcgccgtcggcgcaaaaaacgccaatttcccttgacgattgtcggagtgctcgtcgcaatg

SEQ ID NO: 116495 - DNA, 426 bp, Heterodera glycines
  Promoter: Source sequence=SeqID_3318; Location=1..426; Strand=+; Gene= SeqID_84191
tgtccgtggaggctggccgtggcgaagaaggaagaaacgatcagttgaatcatatcttaaagaaaatgttttaatttgtcattttattttatgtattaaagttctacacaatgtttcatctcctaactctgctgacatcattttgagtggtcaatgatgtttgtttttttgagattctgatttttgagaaaaatctctcaaaatggccattttatgtaaaaattctacaaaaactcccaaattttcaattttatgggtgataacattaatttttctgtgtgtgactttttattcctttgaaattttatgcttatcttgtttattaactatgtgattaggtttctgtgcccgcccctaaatttcacctaaaattaacaaaattagaactataaattgccaattttcagtgaaaatcggtttaaaatg

SEQ ID NO: 116496 - DNA, 88 bp, Heterodera glycines
  Promoter: Source sequence=SeqID_5625; Location=1608..1695; Strand=-; Gene=SeqID_46081
aggacagaaaaggggacaaatgcaaatcagtgaaaattaccaaatcctttaattggaaaggacggcactttgtgtgttgggagaaatg

SEQ ID NO: 116497 - DNA, 397 bp, Heterodera glycines
  Promoter: Source sequence=SeqID_17162; Location=1087..1483; Strand=+; Gene=SeqID_81602
ggccaaaaacccaaaaaataaaatttaaatttcaaaattttaaatttcatttgtaattttttcttctaaattgttttttttaatataattcacccatcctttcgtgatttttaacgtaacttttttcagtcattttgtcttattttgaagaaaaaaaaatgcgaactctggtttaaaagagtttgagaagacttaatcatttgttcatatataatgttctcttttttacattttttaaaaatggaaagtccattttatggaaaattttaattattttattgaatttttgctaaaattttgagagaaaaatatctttaaaaaacatttttgtttactaatccgctccctagtgataagcgtagctttttgctgattcgttgtccaatttcgcgagatg

SEQ ID NO: 116498 - DNA, 139 bp, Heterodera glycines
  Promoter: Source sequence=SeqID_15703; Location=412..550; Strand=+; Gene=SeqID_80017
taatgaaatatagtggggtcgaccccttatttctctgcttttattgagcctttatgggggatttgtccaacacttttccttttttggcattacttcccttccccttcttctgatgtgattttttgttcccttagaaatg

SEQ ID NO: 116499 - DNA, 367 bp, Heterodera glycines
  Promoter: Source sequence=SeqID_28236; Location=254..620; Strand=+; Gene=SeqID_58877
ggtgaaaaaattgttttgcttattgtctatatgcccccacggaggagatgattagaaaattgaagctaattagtatgatcagtcgagaatagaacttttccgaggctcgaaaaccgagaccgttagtcaagagcagccccaacccgcctaattagttctcgggattctgttcgttcgttttttttggcattaccacagtactgacaataattaaaatcgccgcccatttaaggacgcgttcgacgtcattctcgacgagaatcagctggaggacgcgtgcgaacacctcgcggactatttggagtcctattggcgtgccactcatccgcccgtccgctcgccgccgcgcataaaacgcggcccaatg

SEQ ID NO: 116500 - DNA, 937 bp, Heterodera glycines
  Promoter: Source sequence=SeqID_6702; Location=1511..2447; Strand=-; Gene=SeqID_62548
atatttggaggaaaagtgcaaaggaccggaaaaggtgaggaaaagccaaaaggcgaaccctccagggcaaaagtggcttcatttattctttgtcaacagccgaagcggcggggtgggaaatgttggccaattttgagggtcgatgcgtaacggcagcgggaaaggaaaagataaaagggagcgattaggtaaattaggggattagagagggagggggacgaagaaaaagcaccaaacgaaacaaaatggacgaatattttattttttgaatcgacaaaaactaacaaaggtatacggtagtggggggagtggggtacggtaaacaaataaatgggctgtgtgtggctcgacactttacacttgcgaatgaatgtggtcaaaaatgaacaaacaaagcccgctgccccccttttatctccctagtgaaagtttcgtccgcagtttggcaatttgatccgaaatttgtgccatttcttccctcattttcgcgttgtccgtctccaaatgccaaatttcatccctttcctgctccaaaacgttcgactttcgacttcggtagcgttgtgctgctgctctgttctgttcctttttgcgctcggccaattcctcgtgagaaagcgaaaggagcgaattctttttggcacgttttgcctgaggcagagtgttttgggaaaagcaaagaaacggacggggggatcccgaagaattggaggaggacgaagaagaattggaggggaagtcaatctgaagaagggggaggggaggtgagaaaaaaagcgatgggaagggaaagcaccgcggaggaagcggaggaggagaagccgggcgaaccggacggaacgaacgcttccgaggcatttggaagttgggacagtcgaagcgaagtgcctgaacagagaaaagggaattggcaaatccaaccacactcggcggaatg

SEQ ID NO: 116501 - DNA, 54 bp, Heterodera glycines
  Promoter: Source sequence=SeqID_2900; Location=4243..4296; Strand=-; Gene=SeqID_82270
ttgcgccaatgccgcggggcggagagtagtgcggacgaaacaacggacaacatg

SEQ ID NO: 116502 - DNA, 1003 bp, Heterodera glycines
  misc_feature (50)..(50): n is a, c, g, or t
  misc_feature (146)..(146): n is a, c, g, or t
  Promoter: Source sequence=SeqID_17988; Location=803..1805; Strand=-; Gene=SeqID_82554
gctgacgcttaaccgtcatcacctccccgccccctcctcatctgctgctntccgtacccgccgatttggcacccgttttttggcacaaattggcccaactcatcctctcctctctgccatcatcatcattggcacacacatactcnagagtggcggtgtggtgtttttgtttggcccatgggagccaaggctgccttcccatttagttggttcaattcttttgtgtagctctttaaaaatagggaaaatctggcaatttttaaatgctatactccgagacttagttgagtgtcgagactgggctgtaactctcggttttgactgttttgtaattagttgattagcaataataatcgcaagaatcgaaaaccataattagatgattaggcttagattaaacttataaatttcatacacccgaatattttttctaaagattatacaatttaatttatctttgaacttcttctttcttatcgtatatttcttcttttaatatcgtattttctaaattacagtctccatccccctaaattaaagcccttaaagcccactatcgcccaatataaaatttgaatcctttctccatgagatttccatcctattccctctggcatcattaattatgccacaaatttcggcacaatgagcatttttcaaacaaaaaaaaaatgtatccaataatgtttttttacggacaaaattcggatgaacaccccacccccgtgccataccaaaaaatgacgacgacgatggattttcccatccccggaaatcgatcctccacccgccccgaggggacaaacttccgtaaaacttgacgttgttccttctccccatgctgctcatttttggcattgtcttgttccctggggaacatcatgtgaaaagggaaaattggcccccaatagtcaaatttttgtgccattttaacccgtgaaaatcgttttaaaatcgtttttttttggatttaaaatagaaattctactgtacttaaaatatg

SEQ ID NO: 116503 - DNA, 707 bp, Heterodera glycines
  Promoter: Source sequence=SeqID_10170; Location=933..1639; Strand=-; Gene=SeqID_73274
tatagccaaataaactaataaaatataatatttacttaaagaagaattttaaaatattaattcaaaagttaatttatttacgtgaaatcgcaataaaaataagcagtgcgacgacgagagtcagcaaaatgacaatgaatggcgcatggcttttgtccaccataaaaataaatgtaaaataaaaaaaactaaaaatataaaataaaataaaagcacagtgaataaaatgatggctttcttctcaatttttggctatcatcatcagctgatggatgtttcactgaatatttcgcccgggccgcggctttttgtgctttggacaaagagactaaaaatagctaaagcattcatttcacagaagagggattgttgttgacttatttttagaggcagggaaagaaaggatttaaatattttattgtttcgactaatatttttttcgtttcgtaaaataaatgaaaattaaaatttcattaaaaataaaattaattcggacgattgatttttttacaccttgccttaaccatatcagatcagaccaatcagagaaaatcaaatcaccgataagtttcggagggggggggggggggggcagaaccgaaaggcaccaaaagaatgaatataatttgctgaccacttataaaattctatcatttacctattgtctttattgtcactgttttaggtttattaaaaacaaaaaaatg

SEQ ID NO: 116504 - DNA, 326 bp, Heterodera glycines
  misc_feature (18)..(18): n is a, c, g, or t
  Promoter: Source sequence=SeqID_35793; Location=1..326; Strand=+; Gene=SeqID_46445
ttacgcatcggcaacacncaacggcccttaatggcgcgagtcgatgtcacgaggggaatcacttacgaccttttgaaggccatttcctcttcatgcaacaacaacaaacggggcgatagtaataaataattgtttttgctcaatttccatttgcctttttgtgttttaaaattttacttaatatcgttttgccaattttctcattcatttttcggttgtttttgtttcaatgccattgttctccaatggttacctgcatagttttgatttgagcatttccatatttccattcaattttttgctttttacgaatttattgaaaaatg

SEQ ID NO: 116505 - DNA, 587 bp, Heterodera glycines
  Promoter: Source sequence=SeqID_7845; Location=708..1294; Strand=-; Gene=SeqID_66138
tttatcctctatgctcgttaaccaaaattttcagatttttccggtcaaaaaatcttcatttttagattttttttaaaatgagcgtgaggagccaacgacttaattttctaccccccccccttccagatttttcacctttctctctctttttacataaattttccacaaaaattacccgatttttttcaaattttcctccccccgccctcttgccctttgctagcgttttcattttttccaaatttccatttttttaatttttccttatttagattccattcattttgtcgtatttttcatttcccccagactcccatcacttttccattttttaaaattttcccttttaggctcccttcactttgccatagtttttccaaaatttctattttttccaatattttttccccttaaactcatttcgcttttaccatagttttccaaattttctcaaattttccattttttttttatttccccctttggctcccttcactttggcattgttttttccataattttcatattttttttcattgtttttccattttagactctctccgttcccttcacttcttctcccaatg

SEQ ID NO: 116506 - DNA, 495 bp, Heterodera glycines
  Promoter: Source sequence=SeqID_30962; Location=1..495; Strand=+; Gene=SeqID_61323
tgccggtcaacagcgggtccaagtcgccctgaacgccgatgtaacgggcgacacggccaggcaccaggaaaccaaagtcgctgaatgatggatgtagtatgtacctgaaaagcaaaaaaataaccgatttttttttgtttctaaacaagaaaatatgtataccgtatttcctcgattataagccccggggcttctattgttcaacccccctccaaagggggcttatattcgagggggggcttttattgttcaacccctttccctatataaattcttaaaattttttgctttctgcataatggtacaatttaaatcttaatctgaaatttttgaattgaaaagatttttcattttttggcccttggaaatttaggcgaatgtttgaaaattcataattcacttctaaatgaatcaattaaagtgcaaaaaagcattaaaaatagagaaaaatctggagcattttatacttttttagaattttctatcttcaaaatg

SEQ ID NO: 116507 - DNA, 155 bp, Heterodera glycines
  Promoter: Source sequence=SeqID_43639; Location=484..638; Strand=+; Gene=SeqID_71269
tgttagggatgaagcgattttttttttctgaacatggcacgggtatgggataggccgatgtatccccggccgaaacgtcgccggatgttttcggaccattactttttttttgttgttaatcaaattacgctttgttgatgctttcgatagctatg

SEQ ID NO: 116508 - DNA, 445 bp, Heterodera glycines
  Promoter: Source sequence=SeqID_1032; Location=6317..6761; Strand=-; Gene=SeqID_66500
aatattagctaattcaatttgaaatatgtattattatcgtgctatttcattgattgttttaatatttcatttaacgtcaaagactcgttttacacaacaattagaataaaaaataaacaaattcataaataaaagaaaatttataatcattaaaacgcatagaaacagatttgttaaacagaaaaataaagataaaaaaattatttagataaaataaaaggcaaaaactacactaactaaaaaaaataattaatgaattattcattgtagtaaattaatcaaatttttaattaaaagaaaagataaagtttgaaaaaatgcatacaaatgcatattatgaacaattctctgcattctattataaattattagcaaaataaattaaagtttaacaatttccattggcatttgtccacaaaataatttttttaaataaatgaaaatg

SEQ ID NO: 116509 - DNA, 224 bp, Heterodera glycines
  Promoter: Source sequence=SeqID_715; Location=1902..2125; Strand=+; Gene=SeqID_59670
tttcgaggaatatttttgtgtgttaagatgaaaatgagaagggaaaagtgtgggggtactgtatgtgacgtagcggagaggggggtgtcacgtgggaataggccacgcccactcaagtgagagcacgcagggacctccagacgggaggatttcgaaatccatccacagtatgccctcctatgccacgccccttatcattcacttccctgtcagtcatttagatg

SEQ ID NO: 116510 - DNA, 907 bp, Heterodera glycines
  Promoter: Source sequence=SeqID_28408; Location=1..907; Strand=+; Gene=SeqID_59029
caaatttaagcaacgacatttgaccctcgccggggggccaaaatgtgtaaagttagaggggtggagggaggttggctgtgtttatgttgttttatgcttttggacggattaagaagcgggcaaaatcctcgtcttaaattccaaaagctttgagcagcggatatgcccgggccaaagtttaaaaacggagacaattcttatttaaattttgggaatttagttaataaaaattttacaaattaaaactcaaaaaataaagtaaaaaaagaatatttaaaattaaccaaatttttaattattaacccgaaaattttcttaaatttaattgcatcttatagataatccagcagtgtttttgcggataaagaaattttaaacatttttctttgattgttttgcggcataatggactgttataataattaattcgaaattaaaataggtatattaaataaaaaagcatcggtgatttttttttaatatattttcccacctgggactggaaattttacgatgctcattacatctggcagcgacaggagcagcacggaattgcgctaaaacaaattcaaaaataattatttaaataaaaaggtgcttttaaaaatatttattttaattttaattaaccttttttgaactaaaaaatttaaaaaaaaaagatcaaagattcttaaaataaaattcattaacaatcaatttcaacactaatttggatattattctcaaattaaaggaaatttaaaatagaatttatttagaaaaaaatgcttttcaaaaatgtttatttttatttaattttacttattttaaattaaacaatgaaaaacatatttaattatttaggcgaaaataaatgcattaacaatcaatttcatactttaatttggatattattaaccaaatg

SEQ ID NO: 116511 - DNA, 470 bp, Heterodera glycines
  Promoter: Source sequence=SeqID_34106; Location=205..674; Strand=-; Gene=SeqID_63984
agtaaagtgccaattgtcggtattgctttcacaaaaagggcattttgaggggcgagtgaatcaattgggcggagtgtttatcaatggacggccattgccacacgaaaagcgcgttcaaattgtggagatggcacgcaggggcataaagttggccaattgacggaatccattcttaattttgtgccttacagaccctgcaaaatcagtcgcgaactcaaagtttcccatggagcagtgtcgaaaattctcaatcggtgccaaaaaaacaacaattagtgattgtgaatgaatttctttttttaggtttcatgagacgggctcaatttctccaggacaggtaaaaggggagacaaagctatgagaacgagagattaagattttgctattatttggaaaaagtgacagttattttttgaatatatacagtattcctttttgacacacacttacagtagtaccacaatgcgatg

SEQ ID NO: 116512 - DNA, 55 bp, Heterodera glycines
  Promoter: Source sequence=SeqID_3546; Location=3275..3329; Strand=-; Gene=SeqID_50818
gcagcagttccatcgccgcgacaacacctcgcgatcgcagtggttccgctacatg

SEQ ID NO: 116513 - DNA, 181 bp, Heterodera glycines; identical to SEQ ID NO: 104902
  Promoter: Source sequence=SeqID_2242; Location=5522..5702; Strand=-; Gene=SeqID_78666

SEQ ID NO: 116514 - DNA, 1003 bp, Heterodera glycines
  Promoter: Source sequence=SeqID_14563; Location=1258..2260; Strand=+; Gene=SeqID_78635
aaaaaatttcaggatgaaatacaattaaaataattaaaaagaaaaaaaataaatttatttttctaaataaataaaaaacattgtcagaggcagtgcctgcctaaaaaatagacaaaattttttcaaaaaagccaaaaaaaattgaaaatttaaataaatttaaaagtgaaaaaagtaaaaaagcttagaacaccttcgattcccaggacgtctccgttccaagtactaagaaggcccaacgttgcttaacttgccagatcggacgggatggcgtgctttcaacgtggtatggtcgtaagcgaaaggacagcaattaaagtcatttaaataggcatatttaaaagagcctatttttttgccttttcacaatagaatttattaaaaaaggcaaaattcgccttaaattaataaggtgaaagtttgaaaatgtttattaaaaaatttcaggatgaaatacaattaaaataatcaaaaagaaaaaaaataaatttatttttctaaataaataaaaaacattgtcagaggcagtgcctgccgaaaaaatacacaaaattttttcaaaaaagccaaaaaaaattgaaaatttaaataaatttaaaagtgaaaaaaattaaagtaatttaaataggcatattttaaaaaagcctatttttttgccttttcacaagagaatttattaaaaaaggcaaaattcgccttaaattaatgaggtgaaagtttgaaaatgtttattaaaaaatttcaggatgaaatacaattaaaataatcaaaaagaaaaaaaataaattaatttttctaaataaataaaaaacattgtcagaggcagtgcctgccgaaaaaaaagacaaaaattttttgaaaaaagccaaaaaaattgaaaatttaaataaatttaaaagtgaaaaaaggaaaaaagcttacaacaccttcgattcccaggacgtctccgttccaagtactaagaaggcccaacgttgcttaacttgccagatcggacgggatg

SEQ ID NO: 116515 - DNA, 617 bp, Heterodera glycines
  misc_feature (67)..(67): n is a, c, g, or t
  misc_feature (106)..(106): n is a, c, g, or t
  Promoter: Source sequence=SeqID_43811; Location=384..1000; Strand=-; Gene=SeqID_71392
cgaagcgcatgtctggtaaagaagagcaaatttggccaaatattagccaattagtgtccaaattatntaatcaattggatgtagcataattcggtggacagagatntaaaaagtctcgactagccgaatataattcccggtcagttatcgattgactgatcatttgccacacctgagtcagttcgactttgaattcccacacggcttgcgcacattgtgcctccaaactctcagtttcactaaagccggcatcttgcagacagtccaatgcgtccttaatggccacaaattatgggctaattacctatataaacttccgattttgcatataattaatgcaattaattaattaaagaacacgaaaaattggaattaggagaactaatatcaattattctatccttcttaattatcggataggtaggtgtatacacaaaaacataatcatttcaaattagtccattatttagcttaattagcctaattttggtgtgcaattttcacaaataaattgctgaagagaccgttaatttaattgactactgtgacattttaattccaaaacagtacattatttcaaaaatagtttgcacataatttgtttaacgaataatatg

SEQ ID NO: 116516 - DNA, 357 bp, Heterodera glycines
  Promoter: Source sequence=SeqID_29375; Location=1..357; Strand=+; Gene=SeqID_59879
tctttatttatttatttatttttataaatgaataattaattttccaaggccggaaatgcgttgggattaatttccggcccgtcagtatccagcagatatcatttaaaagaggaggaaaatcgtcgtaaaaacagttaaattgttggggcgaatattttttctgcataaatcattaccaaataaaaattttacaaatttttaaagagttcaaaaaatgtttaaattgccatgcattttacttccattttttgcactttttctcagtgattttattgtgggacaaccgatgaagagtaaacaatttgattttttaataaattaaagcgaaatttattattatttttaaatttgcagatg

SEQ ID NO: 116517 - DNA, 686 bp, Heterodera glycines
  Promoter: Source sequence=SeqID_26153; Location=951..1636; Strand=+; Gene=SeqID_56904
tagcaattggctaaattaaaatgaaatcttagctaagtacgagaaagaaaaactaagtatttaaagtgagaaaaatttcaatttttgaaaaacagtgcaaattatacacagatgaatgacttatgcacttaagcgaccgattttatatatcaactttaatttgcctttggacgaaaatcgattagaaaaaggaaaaggcaatcgaaagtgaaaaaggcaaaatgatttaaggcaaattttttatttaataattggcttttgagtacggaggtgaaaagtcgtaaattttaagttttctaaaaaccattcaaattcggccccttttctaagcaattggtggttcgctgggggatatcctcccattaattaatcaatgtttgtgttagtgtggtgtctcccgccgcgcaactcaaatctgccaaaggaattgtttgggactgagaagactgcacgaaataaaacattttgccacaaataaatttttaacattttttaaatttttcaatttattgcgtcttttacgaccgatgagtcacgctaaaattagaaatgttcagcgggtttactattgttagttccttatcaaacctattttaattataaaaacaccggagaattttttcaacaaggcatatcttcacttttattttaattttgtttttatttgctgtatattttacaaaatg

SEQ ID NO: 116518 - DNA, 63 bp, Heterodera glycines
  Promoter: Source sequence=SeqID_41634; Location=1..63; Strand=+; Gene= SeqID_69719
aaaagctacaaatcaaaaactgatgaacaaaaatttgatattgttcaacgctttattgaaatg

SEQ ID NO: 116519 - DNA, 1003 bp, Heterodera glycines
  Promoter: Source sequence=SeqID_19553; Location=271..1273; Strand=+; Gene=SeqID_84284
caaatgtcaaaatcgaggcacaatcgatgaaattagccttttttgaatttggtttaacttaggaagcaatgcttttgaagttggttagcacatttttgttgtattttgtctgtttcaattaatttcgaaaattttttttttcgtatttttaattgttttcttttgttttcgtaaaattggagtcataattcgcgaaacatagtgttcatgtcatattaaaataaaaaatttcatcaaaaaagaggttgagagaaactcagaaatttcaatacataaatttgtcaattaaaactataaaaccacaaaaaccaaataaaaagcattcctaagttatagcttataggtcaaagaatatttaatttggtcgattcgactcaaaaagcgagtttgcccaaggcaagttggttttgccatttattcttctgatcattagatcccgcgttttgaggcaaatgctttttttttttttgctaacttgatatggccaaatacgcacgaaaaactagtttttagcgtgtttgaagcctttaacttgaaattggtgccatttttgctttttttgcaattttggtgtcgaattccggacacgtaatttttctgccttttttgacttttcatgccttttttaaatacggatctattcagtaaaccccccaagatattgatttatatagatagactaagaaccttcaccaaatcaaaaaagattaacgcacaaatgctaagtttaagcagccctttcttcatagcataagcacagaaatatgcaaatccacataaatttataactctattcctaaatgaatgttttttgcggttaaaagagcgtaaaaaccgagaagacccattctcgcttctataaaaaatttcttctttatttatcaattccatctcacagcaatttttattttaaaatacgcattttaatgtataaatctgtgccttccgcttcatttttgattaatgagttcaatttttattaagattttgccgataatcaatg

SEQ ID NO: 116520 - DNA, 486 bp, Heterodera glycines
  Promoter: Source sequence=SeqID_34249; Location=855..1340; Strand=-; Gene=SeqID_64083
atttattttccatttaattatcttaaattttggttaccatatattttatcaaaaattcctttttgtttttcacttttacaaaatcataccatttaatttggccatcttttgatggacccaattaatattaaattacattttctttctcctaaaatttttgtttaatcaattcaatttactaacgcatttattcaaaaataaatgcgtaaaaatgataaatgtaaaaactttaaatcagtattttaatgtattttaaaaattaattttaaaagttaaatttttattttctcttaaatcctactcataaatttaaatatatttttccaattcaaactatttattttattaaattttgaacatttaatcttcaaaatgtataaattcttaatgaataaaatctattttttctccattaaaaaaaattattaaatcttttactcaaaataaataatttccaatttaggcgcactttcaaaagtttaaatg

SEQ ID NO: 116521 - DNA, 999 bp, Heterodera glycines
  Promoter: Source sequence=SeqID_31039; Location=338..1336; Strand=+; Gene=SeqID_61406
ttgttttgttttggtcacagcgccaataaatgaattcccttcgtgcttcttttttttggtacatatggccttcgaaaacgagtttgtagccgcccatttgtgaaggaaaaaacgtagccattatatttaatgaattttgtaaatttagttcagcttttatagcacctattcaggttattcgggcaaatccattggcaaaatttaattctaatcagttcagattagtggtttttggtcatatagaattttctcattaataggaataatgatttttggtcatatagcatttggtcatgtaacatttttctcattaagattagtgatttttggtcatatagcatttttctcagtccaatttgaataaatttagtaactggcatttctctcacagcttattttaaatcttttaatatatttgaattaattattattttgtgggtcctctgtctgtgggtcctttgagaggacaccgtgcacgtcacatagtccatttatcgattcccttttgacccgggcattcttctgtcttaagcagagcccattctctcatcagtcgttcttctcttcatttcgctttgtttgtcttcgtttaaatttcttattgataatatttatttcggcttttagttattttcttgtttagatttattcgtttcgtttttgacctgtatttccatcacaatcaactgaaaaacggcaatggatgattcggttggttttcttagcataataaatcttgcatttgggtggtcttccaccccttacgacagtaaaattagtctgttccgttcgtttacagttatcctctcgacggctcccttccgacttctccttctaaaaatttcatccaatcttctgtataatttttctatttccgtatgcttaacagctgtaaattcccaaaaatcatcctccaagtttgtgggaggggaattcaaaaattgatatggatgttgaaactgaaacacagggtagaacattttggccgacgacccaatg

SEQ ID NO: 116522 - DNA, 952 bp, Heterodera glycines
  Promoter: Source sequence=SeqID_25551; Location=1..952; Strand=+; Gene=SeqID_56291
aagtcgttatgccgtctctttctttctttaaattttcttcattgtaattaaacaaatgtttgatcttttgattagttttaaattgatttatttgaaatattttccaaaatttaatagaattaatcacaaaacgaaaaatttgataatttacaaataaaaaatatatttagtaatatgtattttaattttataatttttaattttaattataatataaattataattatgctctcataaatttgatatttgagtttttattttatagaaatattatattgatcgattagtaatatataatattctcttatgcgatatttattcaaaaatctggttaataaaacattttatctatatatatttttcataaaattttttttactaataaaagacttttaatcagaattaaatatatatggcccgatattatagtatttttatttttgataaatcttcgtcccataacataaaaaccatattaaattccaatcccaaagtggataaaaatacataaataccataatgttaaatattttggttttctttaaatctttaatcaataaattttgtatcgaatgtatatttttataaattgtttagcctttattaataaaaatcaataaattaacttatatctaaaaattaattattccgaatattatttatttttattaaaatttttttatttatatttatttaatctttaatttcctatcagaaaataataagaacttctcggacatgatttatttactcgcaaaatatatttataaaatcaaaaaggaaaataaaaaataatgatatatttacttgatcttcaaataaattaatagtccttattctattaaattcatgaattaagaactttgtgcaaaaattttgaagcagccaaagcccaaaataaacgcaattcaacatggcaaatcatcgccaaatcacaaaatcgcggaaatg

SEQ ID NO: 116523 - DNA, 283 bp, Heterodera glycines
  Promoter: Source sequence=SeqID_18614; Location=1..283; Strand=+; Gene=SeqID_83269
attagctaattaaattaccataccccattactcattaaggaattgtttgaagactgtcgccgaggtcaaacacattcagtgcaactttggattgcgcagaaaagcaagaagcatcggtctccattaaagtgagaggaaaacttagttaccgtaaccttatttatatgtatgtaacaaaaacagtaatgccatgaatgggaaagagttaccgtaacagtatttgtatgtcttaccttaatcaatcttaccgtcttacgcctttaacaaaaacattccagggatg

SEQ ID NO: 116524 - DNA, 103 bp, Heterodera glycines
  Promoter: Source sequence=SeqID_16849; Location=1547..1649; Strand=+; Gene=SeqID_81273
tgtttaatcaatcaaaatcaatattcactacctaattaagaaacaattaaaattattacaaaatgccaaaaaaacgaaatgcgctaaaaatcataaaaaaatg

SEQ ID NO: 116525 - DNA, 426 bp, Heterodera glycines
  Promoter: Source sequence=SeqID_34421; Location=633..1058; Strand=-; Gene=SeqID_64218
cgaaagatttttaaacgaaatttcttttaaaaaaatgaaaaattttcctaattgaacttccgcaactttttagtcaaaatagttgtaaaactttgtgattcgtcaaaaaatttaaaacatcgctcaaaaattaaaaaattttttttttaattttacaaaaacggggcgcggggaacacctcttgacattagcactctctgaatgtgatttctatctttctgtacggacttacaacttcatgttttaaatttttttcttttgtaaattgtgaaccaaccacaaaaaggtgccgtcacaaaaaaaattttgtgccgtaaaataccaaggggtctatgcccaattttcattagtcgtttatttcgcccaattttcacatattttttacactcactaactctgccatttgacaggaatggacaattcatg

SEQ ID NO: 116526 - DNA, 952 bp, Heterodera glycines
  Promoter: Source sequence=SeqID_9824; Location=1675..2626; Strand=+; Gene=SeqID_72834
ggtgaggacgattttggcgttatatttgaacatacacaaaaaagcgaataaatgactaagaatgttttttgcaaaacaaactgaaaaatcaaaatcaaacatttccatttttcaaatcattttttaacgcaaaaaaaacaaacattttcatttttcaaatgcttttttaacgcaaaacaaaaccaaacattttcatttttcaaactcatttttaacgcaaaaacaaaacataacgccacacaaattcaaacaatggcagaaacatacagacactcaactttattatataggattcggatccgggattcgaatttgttcaaagtcgatttttaacgaaacgtccctcagcgagcaaattttgtgctctttgcatccgtcatacttgttttacatgaaaaatttggctctagtgcactttataagtccaatcagagtatatgagtacaataaaatatttatagtcatatgaccatttatgagtccactcattttttttatgagtccaatgatttttaataagttttgagtccaatttttattttccaaactgtcagccaaaattgcaaatacacaaagtaaagtcacggggaaaaaatagatttaagaaaatttttcgcttcatttttaacatgcccataaatttttgtgaagaaacgaaagtgccaagttgtaactagtctattgagtagaaaagtcggacaaccctaaagaatgggggtccctaaattggctttttcaatttttgttcgaattcggtctggggttcggaattgggtaaatccgagttcagattcgtaccctcgaaaagcacttaaaacttgttttgagcccaaaattaaaaaagaagttaaattagggaccacaattctttaccattgccatcaattcgacttctgttataatttggtgctataagctttttttggccagtaccaaaagataaacaaaaatg

SEQ ID NO: 116527 - DNA, 627 bp, Heterodera glycines
  misc_feature (13)..(13): n is a, c, g, or t
  misc_feature (126)..(126): n is a, c, g, or t
  misc_feature (128)..(128): n is a, c, g, or t
  Promoter: Source sequence=SeqID_16157; Location=1438..2064; Strand=-; Gene=SeqID_80519
aattctaattacncaactttaatattatttgtcaatttaaggccgaacttgccaaatatggccatggtccgatgggaaaacgtgcggctatccgacttttgaaccgaatttatgaggcaacacacncnaggtttagcaaaatttaaaaaatgtgctacaatttttttagaattcctaagagccattggcatttatacaatttttttttataaaaaagtataaattccataaaaatcgaaaattttttgaaatatttggaaaattttgtaatttttcgaaaatcactttaaatttctatcagaaattgggatatacttcatttcttcgttttctccaccgaaattttttaaaaactttaaaattttcaaagatttttttaaacaattatctaaaaaattgttagaaaattgggagaaattggattttccaattatttttttagttttcgtttgtaggcctaccctctccctaaaaaaaatttttaattggtttccagtgatttcaagcgacacgccaatcccgcggaaagtgcggcgcgcattggcaacggacgacggcggcggcgacaaaaatggggcggctgaacggcaacgggaacggaggaccaagcagaaaattggccaaatg

SEQ ID NO: 116528 - DNA, 1003 bp, Heterodera glycines
  Promoter: Source sequence=SeqID_4481; Location=1916..2918; Strand=+; Gene=SeqID_54607
tggctctgttgaaaatgcttcgtcgtgccgatggagaaaactggagggaaattaattataaaacgaagaatgggatgccattgttcgcatttggcctacttgaactgacaaaacatgtccgtgtactccttgggaacgttgagcaattcgacgacagtcaaacggaaaatgaattcactgcctttggcaatgtgtggggggaactgaacgtcaaggtcagtgccggaagaatgatctgcaaagtcaaagctcaaaaaaagaaggaaaagtatgggaatggaaattaagcattgaaagccctcttctcaataaaaattggttctattttcgttttgatgctctattaaaaacccaaattattaaataattgtcaaacattatgccaatttatcaaaatttaaaaagattctgaggattttcctcaaaagcctcaaaaatcctcaaatcctcatattccaaaaaaatcctcattgacctatcaaaaagccacaaaatgaggataaatcctcagatctgggagccctggatatcatagtgattcaaatatgtttcacattgcaaaactttatcttctcaatattttactcagatccccattcttaccggtgcatatttttttgcctatgcctcgggttgagaaaaatttcgggttgagaaaaacctcgggtttcgggttggcatcactgccgcctacctacttgcaaaattaaagaaacttttagagtgccacgggaccgggaattttgggcaaacccgggaccgggacctttttgggttgaaaacccgggaatttttggctgggaaaaccgggaccttggtactcagttgtccgctaccaggtcccggtcccgtggcactctagaaaaaatacatacataggtatgtaaaatgaatgtagaaaaactttgttaactgataatatttgtttttacagttttttccactgataatatttgtttttacagttttttccacttttctgcaatacaataaacaacaaatg

SEQ ID NO: 116529 - DNA, 886 bp, Heterodera glycines
  Promoter: Source sequence=SeqID_526; Location=1793..2678; Strand=-; Gene=SeqID_55301
tccctcccggagaatgagatggagatacgcgtggagaaaaagagaatggaatgaggtgcgcaccgctccttcgggagtcttgtcaaggaccggtccatatttgaatggccaaaacatttttgaaaagccaaattgcagcccaaattattatttttttttttatcaaatgccgccactcgctcatattgccaaattaatgacgaacatttaagggcgggccattcgagccatcaactgaaggccattgttgattttcgcagacctattagttttgtttggcagatatttgagggccaagatttttaaactctttctgtataaaagtcttagccctaattacacaaattatttttgtttttggcgaaatttgccccggcgaaagaattttttttttctctctctctccactttctcagcgctctcgccgattcaccggaagcgcattactgctggccgcttgagaataagagaccatcggccgagaattgtgattaatacgagtcatgagacactgcgccgctgtcaacaattttcacaatcgctccgactgatcgggaattaaatattgtagaagtactgtaatttataaggagatgatcatcaataaacataaccattcattctccccttttcgataagagcactcattctcggaaaacatttatccaaacatttctttctacgaaatagctcacttattgcctaatccaaattattttaattgccaactaacttaacggtcactattcaattaaattttatttagctcataaaaacctgaaccaaatttcaatattccttgacatatttcacgctttcgctcctttacattactgaatattcgggtttgaattgcgtcggctcttgggccttctgtcaagatatg

SEQ ID NO: 116530 - DNA, 344 bp, Heterodera glycines
  Promoter: Source sequence=SeqID_9706; Location=676..1019; Strand=-; Gene=SeqID_72433
aatagtgataaaagccaaaaaagtgaattttcactattttaagtgacgaaacgctaaaatagtgatttctagtgacgaaaagtgacgtccaaatgaaaaaattttaacgcagaaatgcgtttttgagctcctttcttcaaaacaattgagcaaaaaaaaaagttttttcactaaaagttgcttccctagttattatgtttttgtgttattttgctctcttatttttcctaattgttgttctctctgttttaagttaacacaattttttttttttttgctttttgtgacgcaccaattaatcaattggaaaaagggaaaattgtgctaattgaactacaaaaatg

SEQ ID NO: 116531 - DNA, 96 bp, Heterodera glycines
  Promoter: Source sequence=SeqID_44882; Location=712..807; Strand=-; Gene=SeqID_72292
ttaattagataaataataaattaattatctcgcgttttcgtaggcgtccagcagaatgtcgcgcacattgcactgcgggtcaatgtgtccaacatg

SEQ ID NO: 116532 - DNA, 54 bp, Heterodera glycines
  Promoter: Source sequence=SeqID_30514; Location=220..273; Strand=+; Gene=SeqID_60921
ggtaatcgcgctcaatgatgaacatcatgatttgcgacaaaaagcattgaaatg

SEQ ID NO: 116533 - DNA, 168 bp, Heterodera glycines
  Promoter: Source sequence=SeqID_27831; Location=1017..1184; Strand=-; Gene=SeqID_58508
gctgatgatgatgaggaaaagcctcctgttcctcctcccgcccctccggcgctgccgcccattcgcttcggtggccctcctccctccaccatcatcaccacctccatagccgttgataattgaaggctgatgataatgttgttgctgctgattttggtggtggtgatg

SEQ ID NO: 116534 - DNA, 635 bp, Heterodera glycines
  Promoter: Source sequence=SeqID_15439; Location=1952..2586; Strand=-; Gene=SeqID_79702
ctgattcttttattcttcaatttgcaacatccctggcctcctttgggccccagcatatttttccactataacttttttctgtcacccaaatccaataaacttggtattcgaaagcttaacatgtttagaagctttttctaaggtattgcttcgcgattagacaattaccaaaaaagttatacatgaaaattgcaaaaagttgaaatttttgaagtttttttaataaaattttttccaggcttgaaaatcttttcgcttttggtaaggctaatagagcatgttaagagctttcgaatgataccaagaatgttcgatttggatgccaaagaaaacagctatcgtggaaaaacatgctggggcccaaacgtgtgggcccaatcgtgagggcccaactgacgggttccgacatctttgtaccctgaaaccccaattcttacaaatgccaaaactgttcatcttcaagttacgtgccgatcaaaatacctaacaaaaaagtagagttggtcgggaccgggacgggaattcccggttttttcaggtcccgtcccgatcccggtttttcgaaaaacagaaatcccggtcccggttttgccagtcccggtcccggcgggactaaataagcactggtaagaatg

SEQ ID NO: 116535 - DNA, 81 bp, Heterodera glycines
  Promoter: Source sequence=SeqID_3020; Location=570..650; Strand=+; Gene=SeqID_82810
tacttttttcaccaaaacaagaaggttttgaacagaacaatgataataaatacaatcgtttttaagacgatcaattaaatg

SEQ ID NO: 116536 - DNA, 418 bp, Heterodera glycines
  Promoter: Source sequence=SeqID_3795; Location=279..696; Strand=+; Gene=SeqID_51905
atattagactttttcaagacatggaaccgggactcggacggacccgacttttaagaatcaaaacctgaaagcgaatcgccagggtttagcctcgtccccgccctccccggccgcccctccgaccatcgggggatagaaatactggagatcagggatattccttttagcacgattttacgatttgaagagaatcagacaaaaaatttacaatgaaaaagtcacccaaaaattcccaacaaaaatatagcaaaatcagttcaactcagtctataaaattcggaagatttttgatagagttgtacggaaccgggaattttgagaaaaaccgggacagggacttttcgggttgaaaaaccgggactttttggctgggaaaaccgggaaaaaaccgggacttttcccggtcccggtcaaaatg

SEQ ID NO: 116537 - DNA, 815 bp, Heterodera glycines
  Promoter: Source sequence=SeqID_16420; Location=276..1090; Strand=-; Gene=SeqID_80824
agagaagctcgacttttgaccgctttctcggaaaaaccgattaaaaaacgcgataaatggacttaactaattaaactaattaatgatattgatactgaaaaatcacattttccgaacattacacataattatttctttccttttcattgcttttcttcactatatccatccatatctgtaaatttgttttgattatttatttatttttttaaataataaaataatttattcatttccaatcagttgggtaaatgtgcataatcggacattacaaaaaatgattacaccaatttgcttaatcaccgttcattgcctacccaatgatcggagagagagagagagagagctgtcagaatattcaattgagagaaaagaatcaatcattcaacaaatgattatttaacaccattttattattattaggattagggcttccaattatatgttcaccaagtttaaaaaaaactgatgtaaaattcgtataatcaaaacattattacaaaccctcaattttttaaaaacttgaaaattttgcgttaaaaatttacgtaaaattttcacttttaacaaaaaaatggggatttaaaaaaattctttgttttaatattagactttttaatttatatgggtgtatgcaattagaagccctaattgttattattatcaaaaatcatttatgtaccagaaattattttataaatatattttataaaatttttaaaaaataatttgatcatttcttcatctcattttatgttgttctgatttcagtctgtattttttccacaaattttaaacattttctaatcaaaatg

SEQ ID NO: 116538 - DNA, 173 bp, Heterodera glycines
  misc_feature (94)..(94): n is a, c, g, or t
  misc_feature (142)..(142): n is a, c, g, or t
  Promoter: Source sequence=SeqID_22572; Location=1..173; Strand=+; Gene=SeqID_53237
aaattattttgaaatttatggcaaaaattttctcaaaagaaaaagtaggaaaaaaccagtgattatctgattaaaataaatcggtttttctcanataattcatttcttttctgctgaccaattggctgcccgtgttcattantagcaatcaattaagtgcaatttgacgaatg

SEQ ID NO: 116539 - DNA, 1003 bp, Heterodera glycines
  Promoter: Source sequence=SeqID_21613; Location=472..1474; Strand=-; Gene=SeqID_52212
gatagctaacaaataagagcattttttaatcatgaacaaatttatgagcaaataaacattcgaatttattaatttatttgtattttcagccgaaaaatgttttattattatgtgccataattaaatttgcgagaacaaagttttggcacaaaaggattcatcgctttgttttgttcttttcgccccggcgccttcaaaaacaatgggcgtaaaggaaaaagaaaataaaagaaagtcaataatttaaaacaaaaaactaaaatatttttgcttatgccaacacaaaatcattaaaaaaatttcgatttcaattttatttttaaaataaaacaaaacaaaattgctttgtcaattttccgtgacaattccttctcaatttaatctctatttgacttttttttgttcgatttaatttattttaaaagtaaatgtttttttctcaaattttactcgactaaataaattttcttttcaaatggcaagtgcatttcgtctgtttttttttctctgaaagatccaacaaaaaaaatcccatgggacggacatcccacagaattacgagcacacaacaaaaataaaagcaatgtttttcaaagtttgggctttcaaatgccatcaaaatttctctccggggagaaattcaaaaaattcgggcaaaaatgcaaaaatggaataaataaactgaagcattcggacgaaacggcacgaataaaaaaaagtttttttaaaaactttaaaaaattattatttttttagcaaaaaatattttatttaattaaataatattttgtattatttgttcacatttgtttttcttcattctctcatgcaattgcctccttatgcttttctgttcattttattcgaacatttggctttatggtacctttttaatagattaattaattcgttttaaatttttaatttagcactttttctttgggccgttcattgcgcgaaagactgcagcgaaatccgaaattgccgccttcgttgggaaatg

SEQ ID NO: 116540 - DNA, 497 bp, Heterodera glycines
  Promoter: Source sequence=SeqID_12125; Location=1353..1849; Strand=+; Gene=SeqID_75695
aactcacatgatgtcctgcgggtctcacttctctccttttcttcaatcagcacggtatgtctttcggtcatattttttttattattaattagttaggtaattttcatttttggcccctatcacttaagcactttatttcctttcatttttctgcactcacaagtttttttttcatttcatccctccctagcttccggtgttcgcaccgtttacgctgtgatataatcagtggggacactttcccaccgcattacggttttaatagatttccgctatttttttttctcaaagcgattttcttttacactagttccgataacaaaattattgtaacactggaacgctagccacgcccattatcaagggcctttaatctaagcatttcacattcattcattcattcttccattctttcgttttactatcctctattttagatactcttgcacaattccactgctaattctcatctcacattcccattccctctcattatg

SEQ ID NO: 116541 - DNA, 517 bp, Heterodera glycines
  Promoter: Source sequence=SeqID_5696; Location=112..628; Strand=-; Gene=SeqID_58938
tggttacatggttaggtaaccataaaccatgttcttttactgtgcgttcacaaaccaccaacatcatggtcaaatgaccaggttaaatgaccatgaacccgtggttgctcatttgctacgggtaaaccatgatggttgtggttatttaaccataacctccttcttttactcggccccagggctctaataatgcgtagctccaatcatgatttaaaatttgtacttgtgtttgtaaataaattataaaaaaattgaaaaatatattttaaaaaatatgtacaaaagcaaagaaacaattatcgtaaagaaaaaagcggtcaaaaaaacaaattttatctcattaattcagttctccttaattacttctccaaattgtttcttccatctgcaaatggtcccttgattaattttcaatatttttctgtccatattattctttttaattgttcaaattgaaattggagcagaaaagaaaaatttgaccaaaaagcatttgaagaaatatttggagaaaatg

SEQ ID NO: 116542 - DNA, 361 bp, Heterodera glycines
  Promoter: Source sequence=SeqID_8522; Location=1..361; Strand=+; Gene= SeqID_68381
cccccccccccctcgggggaaaggttcaccccccccccccattttcccagcccccagcagcagcagcaattcttgtcacccaacaacaaatgcacacacacacacaaaaatatattaaattgtgatacatatgtaatcacttatgattagtttctgatgaattattaatgatgatgatgaggttgggaattgcattttttgttgtttttgtgcggcggtgtgttgttaagtttgtgaaacggtgaaggaatggattaaagtgtgaaactgacttgactgatgtatttgtatagatagagagaagagagagagagtttcggtggatcaaagaacaacaacaaattgtgattggttgataatg

SEQ ID NO: 116543 - DNA, 140 bp, Heterodera glycines
  Promoter: Source sequence=SeqID_36355; Location=791..930; Strand=-; Gene=SeqID_65692
ggtaagcgcaaacaaatggggagcaaaatccacccataattttaggctcacgttacgaccacatcctaatcttcggtgaaatgttgcgcatgggtgttcggccaaaattggttcgacagggaaaccatctgctagagatg

SEQ ID NO: 116544 - DNA, 231 bp, Heterodera glycines
  Promoter: Source sequence=SeqID_17861; Location=1890..2120; Strand=-; Gene=SeqID_82405
aagcgggagacatgagggtaagtgggagaagaaagaaaagaaaaggaagaagagggaaaagaagggaaggaaagtggaaaaagaagagagaaagaggaaaaagaaaggaggaggaaagagtaaaagatgagagaaagaggaaaaaggaagaagagtggaaagaggagaagatgaggcaaagaggagaagagagaaagatgaaaaaagaggaggaggaaagagtaaaagatg

SEQ ID NO: 116545 - DNA, 62 bp, Heterodera glycines
  Promoter: Source sequence=SeqID_11986; Location=189..250; Strand=+; Gene=SeqID_75510
ttaatagtgtctcgcctgcgggccagaaacaaataaaagtggcagtggtcaacccaaccatg

SEQ ID NO: 116546 - DNA, 841 bp, Heterodera glycines
  Promoter: Source sequence=SeqID_15668; Location=1678..2518; Strand=-; Gene=SeqID_79969
catgattccggattcattatacatacattttcagatattcttttaaaaatgtcatagggaaagattgcgacgacaaaaaaaggatcaccgggaacaccaattctttcactcaaaaattcaaaatataataaacgttttgaaaattttgttttgctcccatggtagaccaagtaagcataatttacagctttataaaaaaaaattcggtgccaacacattcccagtttttcggtggggagggacaaatgggcgacagcccagcggttttttgggggaataattcctttgatagttatccaattttgaatagaaaattaaaaaaaaaaattaccaagagtctgagttttttccaaaaaactgttccgacgcgttcatccgccggaaggattgtcaacgaggcggaacaggtcgacgaagaagttggtcaacagtggacagtctcgatcagcaaatagcgattcttaatggttgacaaagttttggtcggacaaattggcactggaaaattgtgagagattttagaaaaaaaaaaccggtggcaaaatttaaaaaaaatgaaaatcaaaaaaaaaacaacaaatattcgaaagtctaatgaatcaggaagatttactatattagtttttttaaaccaaaaacaaaatattaggaaaccggaggtactattcccgaatttccagtcagaattttgccagaaatttcaaaatcaatgattatgtcaaatctttcttctttttcttacccataaatttttttaacctttaactatttaaatttaaaaggatttggtcggtcctacaatatttatgacatacggacccattaaatcggggaaaaaatg

SEQ ID NO: 116547 - DNA, 385 bp, Heterodera glycines
  Promoter: Source sequence=SeqID_1286; Location=1148..1532; Strand=-; Gene=SeqID_46763
tttgtgatggggcatcctgcggaaagaaagtgcgcgagaattggatgatttacagagggcgcgggggcggcggaaacgattcaaagagtgggcccaattaggtaaagctcattaattaacgtttaaatgataggtctaattaagtaaaacactcattaatgaactataagtgatcattttttccgtggcaatctcccaatttgcgttgtgatttctcgcctgcttcgccaccccttttgggctggtcgttgagcttctgggggttgacggttttttgtgccgagtgccgaatgctgctgaagaggcggcacccattgatgagggaactgtcgcggtggataaaccggcgaccattgccgaggatttgcgacggtgggccaacatg

SEQ ID NO: 116548 - DNA, 327 bp, Heterodera glycines
  Promoter: Source sequence=SeqID_28970; Location=1..327; Strand=+; Gene=SeqID_59543
acaaaatactggcgaaaattttacattttctctctcaacacaaatgcgatttttcactgatttttgcagaaatttttttaatttaataaaaacataattaatacgttttgttaattgagtcgaaaaacaaaaaagaaatttttaagtatttttttcgaaaattaagttaagttgaaaaataaatgtaaaaaaatccgacaatattttagcaaatgcaaaagaactagaaaaaacatctttaaattctaataaaataattaattttaatttgataaaaaaaatattctaaaaatattttaaaggaaaatttttttttctaaatatatg

SEQ ID NO: 116549 - DNA, 59 bp, Heterodera glycines
  Promoter: Source sequence=SeqID_4212; Location=1..59; Strand=+; Gene =SeqID_53611
ctcttcgatgccgaatttgtgctcacacccgaaatccgaggtctaacgagccaccaatg

SEQ ID NO: 116550 - DNA, 895 bp, Heterodera glycines
  Promoter: Source sequence=SeqID_41229; Location=593..1487; Strand=-; Gene=SeqID_69414
tctcggttctcgtatcgtttctcggggtcatttcccggttctcgtatcgtttcccggggtcatttctcggttctcgtatcgtttcccgggtcatttctcggttctcgtttcgtttcccggggtcatttctcggttctcgtatcgtttcccgggtcatttctcggttctcgtatcgtttctcggggtcatttcccggttctcgtatcgtttcccggggtcatttctcggttctcgtatcgtttctcggggtcatttctcggttctcgtatcgtttcccggggtcatttttcggttctcgtatcgtttcccggggtcatttctcggttttcgtatcgtttcccggggtcatttttcggttctcgtatcgtttcccggggtcatttctcggttttcgtatcgtttcccggggtcatttctcggttttcgtatcgtttcccggggtcatttctcggttttcgtatcgtttcccggggtcatttctcggttttcgtatcgtttcccggggtcatttctcggttttcgtatcgtttcccggggtcatttctcggttctcgtatcgtttctcggggtcatttctcggttctcgtatcgtttcccggggtcatttttcggttcggttgccggtaaaaatcacttctcgcacagccctaatcaacagccacaaaaagagcagaaggtattttaaaactaattgcttttaccactcgaaataagtcaaataaaattgtgttcgattttagactaatttctactttaatttgtcactatagagtagggttgacactaacccaagggtgcaaaaatattgaaaaaattgcagaaaaagtttcaaaaatgtttttgaaatatttttaaaatttgtgtacccgagtccttcacaaaatggcgcaaaatg

SEQ ID NO: 116551 - DNA, 115 bp, Heterodera glycines
  Promoter: Source sequence=SeqID_45197; Location=1..115; Strand=+; Gene=SeqID_72539
cgacggaatgccaaaatgaaaatgtcgtcaaagagacccccccgggcatcgggcgcagaagaaacgcactatttttgacattataataacagctgtaaaaaaggaggaagtgatg

SEQ ID NO: 116552 - DNA, 515 bp, Heterodera glycines
  Promoter: Source sequence=SeqID_7890; Location=1754..2268; Strand=+; Gene=SeqID_46495
tgttatcaacatgaacatctcaattagaagtctttaactcatttgtcagtaaagcctttaggcaactttaaaattaaaaattttggcgctttgtatttaaaatttaatgtacaataaaaagcctaaaaaatcttttttttcaaactcaaccgtaacatgggaagtgggaaaagacaaaggattgagtgggatctatattttggtacagattatatgccttttctttcaatgggtttgttttctttcaaatgcatgcgaattggaatttaggttattattcatacaatgtctaccttttattcgttaaatgtttcttcgaattggctgaaatatttatctcttgggacggctttggtcgttggctatgcagtttacattgaccgtaaacgtcgccttgacccggaatacaaacaaaaaattcgtcaaagtaaatgggttttatctgatagtttgagccttctgtcttacaattagacaggaaacagaaacaagccaactttttctacgcaaaaatg

SEQ ID NO: 116553 - DNA, 409 bp, Heterodera glycines
  Promoter: Source sequence=SeqID_18658; Location=1246..1654; Strand=-; Gene=SeqID_83318
agtagggcgcggattttttagtggcaaaaaaatgccaaaataattaaataaatagtgacaaaaaatgccaaaatagtggcgaaaagtccgaaataaggacgaatggtggcataattttcagccaaaaattaagcaaaagtaattttttattcactagttgcagttgtaaatgaggtacatttcctttgactattttcttagcaaatattggacatttttaaatcaaaatttgtcaagaaaaaaatgaaggggaagaatttttaagaaaattatgattatggtattgagaaaagggataaacaatagaaaatataaaatttgtgaatacggtattaaaatataaatttcgtattgaaattaaaattaaaataaatataataaaataaaaatgctaatattttcagaaatg

SEQ ID NO: 116554 - DNA, 93 bp, Heterodera glycines
  Promoter: Source sequence=SeqID_11625; Location=758..850; Strand=-; Gene=SeqID_75072
attaacactaattaataattagtaaaatattttttaaaaaattttcatttttattttgttttaaattaaaatttgttttaaaaataggaaatg

SEQ ID NO: 116555 - DNA, 107 bp, Heterodera glycines
  Promoter: Source sequence=SeqID_44882; Location=558..664; Strand=+; Gene=SeqID_72293
actgtaataatattattaccaaattattaaattttaattgttttaaaaaacatttaatttcctccctttgtaagtggcaattttcgccgccgcctgcgacaccaatg

SEQ ID NO: 116556 - DNA, 268 bp, Heterodera glycines
  Promoter: Source sequence=SeqID_7182; Location=1275..1542; Strand=-; Gene=SeqID_64066
tttttttattttccttttcacataaatattttccaattatgatatcacctatttttgacaattcttctgtccataaggtaaggaaaggggcggaaatgtttttgtgccgttttggcactttgtccacgttaatttggcattcatgtcactcttatgtttttattgccaaatttaatgatgccatattatccaaattgggttatttaagtcggcatttttcaaacattccaatcccaattttccattcatctcactcactcataaaatg

SEQ ID NO: 116557 - DNA, 919 bp, Heterodera glycines
  Promoter: Source sequence=SeqID_3632; Location=1015..1933; Strand=-; Gene=SeqID_51204
aatttttcatcggaaatttttaatttttgaaattctgcctcccagagaatggaatttacaaattcattaacccatggaattttaaaatttcgatacccttcaactcaaattcgaaaaatcgaagaatagcaagatttcccaagttgtgacgatcaatttatttcgaaacaaaaaatatttttgccgttacagtatatataacggtaatttgtcccaattgtactgctacagtagtttcataatttaaagtcaattattaatttcatttatttgaattcaaaattcatcatttttctcatccatgacataatgaaattggcaaaacaaagcacaccgcccattgatcggcggcgcttatgattgtgggttttgcctggggcggctattagtggcaagctccgcccatccgtcggatatttgcttggccccccgggggatatcggcggcggattcactccgcccccaattctgtcccctttattcgacggctttctgtgctgccggagggatgggcgccccggcaggcccaattaacaagcgttcacgcaaaaaattttcaattttcaaaaaattttaagattcaaaaattgctgtgctaaatttcaactttttaactaatttttgaaaaatttactggggtacctgccatttttgattgttgatcctagcaattcagggttacaaaagtcgagtttggtccctgtaccattggcactgaatttggccaactgtttcaactttctcatggcccatctaatgcctctgaactttgtgccgaaccccgaacttttcaaaatatgatcacttttaaaatttcgtcatttacctggaaattttgatagaaattaagggcacgtttgaatatttaagaatgtttgcaatttttactcgtctgagcgtgtttaattttagaaaaatg

SEQ ID NO: 116558 - DNA, 116 bp, Heterodera glycines; identical to SEQ ID NO: 105272
  Promoter: Source sequence=SeqID_26544; Location=356..471; Strand=-; Gene=SeqID_57282

SEQ ID NO: 116559 - DNA, 1003 bp, Heterodera glycines
  misc_feature (7)..(7): n is a, c, g, or t
  Promoter: Source sequence=SeqID_28652; Location=568..1570; Strand=-; Gene=SeqID_59246
aaaaacnagaaaccagaatggggagcaaatcacaaaataaataaaaaactttttaatgtccgtttttgggcggagggattttcaacggatggaaagaaaatgaaattggcacgccaattgaggccaaatttgcaatgaattgagaagcaaaaagaatgaaaaaacgaaattaaacaaaccaaaagagaagaagagagaaaggaaaggaatgagtgattcatccgccaatttctctcttttttattgtctttttttggcattttcggattaaagaaagtttgggcaattggcggagggggggggggagaatgggggggggaacttttgcgagtttttaatacattttcagaaagttttgagctactgagtggtggatttttcttatttattgcatttttcttaataattttggtcgaaacgccaaaataggcagaaatatgatttttcaaaattttttacttttttagctcttaataaaaacctacatacaacataggccctgataactcgaaaagtaccttttttatttcaaattttattattcatacgtccaattcgatttatcatgatgaaaaaaggagcaaaatgaatgattattatgaaatgaataagtaaatccttctttaaaatgacaaaaaaattgcccggattattgaaaattggaattaccactttagaaatatgggaaaaagaaataattcttaaatttttcgtttttcttatttgtgtattgctgttcaactgctgacttttgtctaaattttttagtataatttaattttattcactatattatttgtttcatgtgaaattatgatgaaattcatggcttacaattatttaatcttatttactattgatcgcctttttggcaatgcttctccacattcattaaaatttaaatatatttttcgataaattagcttaattttaatacaaatatatatattaaaaatattaaaaacttattaattaattatttattatactttttttagtgatg

SEQ ID NO: 116560 - DNA, 1003 bp, Heterodera glycines
  Promoter: Source sequence=SeqID_4711; Location=3169..4171; Strand=-; Gene=SeqID_55476
attcacattttattttgtggcctttggccggattttcctcccccatttgtccgcccattgtccactttttcggtttaattacccaagtttgagataaaatttggtgtgaattttcctctgcacttgcccccgtttgacccccggcacatttcccgtcccactttttgcttcctctcctggcaatttcaacgcccgaactcctcgggccttgtcgacaccaccgcggcgacctgcaccgcactcaacgtcaagcgcacacggccaactccaagcagctcaacggagctcaactcaatcaatcaatcaatcaacgggtggtgatcggacaagtggcgacctgggcagggacaaaccctcgacagcaccagcacaactgagcgacttcaagcagtattggaactgcaactggtgggaaatttttgagaaaaaattccaaaaaagtatcaagtttgagctctccgtagccaaacttgaatacatcaaaaaggggggagcaaaagtggaaattgtggaatactgcttggtctccgtgccagcagtagtttcacaggggaaacagtgacttactactttggtcttcgtgccattagtatttcactttcaaatcacttattggtctttgtgccataagtaatcggtaaaattactgatcggtctctgtgccgtcagtaattcaagtactgctcgctcttcgtggtagcagtacccaatccaagccaacacaagggggatcggtgtgaactgtttgctctccgtggcaacagttgcacaatcaacacaaacaaacaagtcaaacgacgggaaccccaaggtgtactgcttgacctccgtgtcagcagtacaaccacgcaagtgcagcaagcgcagcaaagcaacaaaaggcaaagcggcaaacgagaagcacaacaagcggcaaaaacaaaagcagcaagcaacgacaaacaagcagcagccgcacacgagctgatcaagcagtacagcaacagcaaaccaacaatcaatg

SEQ ID NO: 116561 - DNA, 344 bp, Heterodera glycines
  Promoter: Source sequence=SeqID_2592; Location=3413..3756; Strand=+; Gene=SeqID_80605
ttgacaaataaggaaaaaaggcaaactaacagtcctccgaggctttagtttagccataaggcaaaaggcaaactaacagtcctccgaggctttagtttagccataaggcaaaaggcaaactaacagtcctccgaggctttagtttagccataaggcaaaaggcaaactaacagtcctccgaggctttagtttagccataaggcaaaaggcaaacaccttgtcctccgaggcaggtgtttagtcacaaaaggtccaggaccaaggccagactgatcccggaaaaagacacaaaacaacaagtgcaccacaacacacacacacgcacaaccaaactgcacgcaatg

SEQ ID NO: 116562 - DNA, 221 bp, Heterodera glycines
  Promoter: Source sequence=SeqID_18058; Location=1959..2179; Strand=-; Gene=SeqID_82648
caaggaaggtcacatacgatgaaaactactctcatcataaactgaagggtatcagctcgaaattttgactcatatatgagttatttgtcattttactgatttcccatgcattccctttttatctctctttccgctcagatgagacgatggtttgcgtggtcgacttccgaagggaagtgggcctttggttcgctgtgattggtgccattctccatggaatg

SEQ ID NO: 116563 - DNA, 354 bp, Heterodera glycines
  Promoter: Source sequence=SeqID_40466; Location=1..354; Strand=+; Gene=SeqID_68792
tcttatgtttttgataaaaaatagtgtttgttctgtcattttagtgtgaccaataatgtgtcttatgtttttgataactttagagtttgttctatgacttcattatgaaatttctttgcaatatgttaaaattaaccaaatataattatttaagcaatgaagtgtgtactgactgggctgaccattggatctcttcaaaagaataatgattttgttattggttaactgatcgtaaatagtaaaattttaaataaataataaattttatgttatgaattttattcatctgattttcatttcaaatatcttcaactttttttattttaaattaatttttaggtatttattattatg

SEQ ID NO: 116564 - DNA, 742 bp, Heterodera glycines
  Promoter: Source sequence=SeqID_20631; Location=1162..1903; Strand=+; Gene=SeqID_51184
attaatatgattttgtttgtaattgatttgatgaactcagcccattcttttttgattctcatttttttaaataaagattcaattaattggcattaattaaatttatttactcattttctggtattttgtgaaaatataattaattcacaaattttatttaaaaaacacgcgttcatataataataatatcttccgtttttctgttacacaaaaattttgattagattgtaaaaaaataaataattatttattagttaatttgtcgtcaaacggggaaaagtgtaaaaatggtcaaaattccaacccgcaagtcgctgtaatatttaaaaaacggggaagcaattaattcaaatgataaaccaatgaaaaaacaacaacaattgcatttagtagaatagttatttaatttaaaatgaacgaaaatttctcgatgtttacgaaagttatgaaattttattcaaaatttttaatttgatataatttctcgttagttagctaaactatcggttagatgccatcgctattaatatttagaagttttttcacaccaacgaaaaaacgacaacaattgtattttgtgaactatttaattgatttaaaatggaaaaaattcaatatttagaaaagctataaaattataaaatatttttagacttttttattcatttttttggctcgtcagctaaacataatttatcggttagatgtaatctgtattaatttttaggtgccttttcgaatg

SEQ ID NO: 116565 - DNA, 459 bp, Heterodera glycines
  Promoter: Source sequence=SeqID_45340; Location=1..459; Strand=+; Gene=SeqID_72653
ggattgtatgggatgaaaaaagatgttagaattttctttaatttttgaaaatttctaaaaaatggtaaaacgaccattttggtaatttgacttatttaggtagttaaaagaatttgcacaattcttatataattttattgaatgtgttttatttagcaaatttcttttcaaattttgaaaaagtttataaaaatgtgtttttatttaggtcgctgattaatttatgctaataccccattctttcaagttcttattttcaatcccgatccaacaagaattgcaaagtcgggatcatgacttgagtttttgaaaaaccaggactggaacctaaaaatcttgattcggggccaatcccggtcggtatctcgatccaatgtggctctttttttaaacaaaaaatggattacagtatttagacttaaaaaggaagcactcagaaacttcatagtgaaaataatg

SEQ ID NO: 116566 - DNA, 149 bp, Heterodera glycines
  Promoter: Source sequence=SeqID_43192; Location=318..466; Strand=-; Gene=SeqID_70923
atcggaacatttacaattcaatgagtgaatcgggggaaaagtgcgtaaaataaacagaatattttatttaaataataatgtaattaaaatattttaaaaacagaaaaaacgaaatgggtgacaatcgcagcgaacgacgcgacaaaatg

SEQ ID NO: 116567 - DNA, 936 bp, Heterodera glycines
  Promoter: Source sequence=SeqID_30109; Location=873..1808; Strand=-; Gene=SeqID_60551
ggggacttacgaaaggaggtgcatttctataaatttgaattatctcatgtaaaaacgagggattaggtttcgcagagaggaaaggggctttaaaagagggaagggtaaggggttcactatgaggaaaagaagaacattttgaaaatttggtgaattttcttataaagattttttaaaaatccaaagtttttccccggctgcgccaattttttgttgaaaaaaggaataaggtacaatatgtagtaacaaaatgaggcttaattagtcaattaatttcaattaattagatagcctcaaacggttgcagccaattcagccgaatccacaagactacgcacgttcgttttaaaaacactaacaaaattctttattttgcatatacgaaaatcgtctctaagattttatttattcaagataaattaaaaacaaactcaatttgcctcctttattactctaagtatatgttcctatgatgattataatgaatttagtcaaaaaaatgaggtttttgcctttctacaaattttcattgtatagagaaaatgaataaaacttcaatcccccttaaattttatctttacaaaaattgattccataaaatatattttttcttggtaaaattttgtggtttaaaaatttgtccttattcgaaaaaaacttaaaatatttaatatatcattataattgaaaaacattaattttttgattaaatttaacgagtttgctacctaaaaagcgttattaatttttttttgtttttctattttaatgcctatttggggatttttatgcctattaatgcctattttatgatttttttctgcctttttaggtgcctatttcccgattttttgcctaaaaaacgaatccttagtgattgtaaaattaatttagtcaaaaatatctttattcaaaatgtaattttatattaaaatg

SEQ ID NO: 116568 - DNA, 669 bp, Heterodera glycines
  Promoter: Source sequence=SeqID_5109; Location=1007..1675; Strand=-; Gene=SeqID_56937
atgagaaattaatttatttaggactcgaaatttccggggaattttcgtattgttgctttttctagggatgttgggcttcgtccgatttttaaggggaatggcccccgaaaatataatgtgtgtatttttcatgacaaaaatcattgggatggtgggtttgtatagttttttcgtaataaaaaatgttttaaggaataaaaagtatagggcaatttttccccattaaacataaatattgtattagctgtgaaactacctatcatattgaggaaaaacatagtttggattgtgaagagaggtgcaaaaaatgctgcagaataggtaacaataaaaaaataatcttttactggaaaatttaaggctttggtttcccctgcccccccgagagaaaaactttaaattgcgaaaattgtaacagaaccttttttaacgagaattgttttgagcaccataaaaacaaaatatgcagaatttataaaaaatgtaaaaaatgtcaaacagaatacacaacagatacaaaaaatcaacatgaatgcggtaaatttaaacataaaaagagtagtgtttaatatttaaaactatttagaccaaaaacattgcaaaaaatgtcacttatttcatgacccaaaaaaattgtgttttatgcaaaaattgaaaatcaaaaaaatg

SEQ ID NO: 116569 - DNA, 71 bp, Heterodera glycines
  Promoter: Source sequence=SeqID_12898; Location=2138..2208; Strand=-; Gene=SeqID_76633
tttttactattgtcatattttttaagcttcgccgcaaagattattttcggagaaatgtaattcccaaaatg

SEQ ID NO: 116570 - DNA, 417 bp, Heterodera glycines
  Promoter: Source sequence=SeqID_42053; Location=1..417; Strand=+; Gene=SeqID_70052
ccataactttgttcatattcaaacaagtcctaattttttattacgtatcattcaaaagcacaaagtcttaaagtctcagcgtttagacaattgccaaaaaagatatgattatttaagtattaccttattctgaatttgtgcttttgaatgatattacaaaattaggacttgttcgaatatgaacaaagttatggtcgagaaattcatgattgctagttgattggactcataaagtgcaatagaacccgggattttgcctaatccgggccaaaatccaatctcaaaaaacctggattgattgaaagctttcaataatccgaaaaatccctaattcttcctttttagcctttctttttgactttccattgactgtgctttttgtccacctttcgtcttcaattttgttcatccaaaatg

SEQ ID NO: 116571 - DNA, 58 bp, Heterodera glycines
  Promoter: Source sequence=SeqID_9188; Location=484..541; Strand=-; Gene=SeqID_70537
tctgaattgaaaaaacaaatgggaaaattcagaaagaaaatgccaaaagaaaccaatg

SEQ ID NO: 116572 - DNA, 263 bp, Heterodera glycines
  Promoter: Source sequence=SeqID_18741; Location=1260..1522; Strand=-; Gene=SeqID_83412
ttcccgcaaattttattgtgtgtcagtaaattaaaaaatcttaaaaatgaaatatattgtttaattttaagcattcataatatttgataagctaattagaatatgccatttaatggaaattagcaaagaaaaactgactttaaaaattaatttctttgaaaataaaaattggtttattatatgataaagtgcacatttgttatgccaaaacacgtgtgctttgccataatggccaaaaataaatttaaaaatgtgaataaatg

SEQ ID NO: 116573 - DNA, 233 bp, Heterodera glycines
  Promoter: Source sequence=SeqID_8611; Location=1230..1462; Strand=+; Gene=SeqID_68676
tcccatcgcccgtaggtgctgctgccccggcgccgtttctgttcctttgccccaacaattcgcgcagcatcaactgatcatggccaatgagttcggtggaattgcgccagcgccgttcgcagtgggaggcgaaagggccgcgcaatttccaatcggaccgatggaagcgcagcatcaagttcagccaatcatttatgtgatcgaaagtgagttcgtacgaaagaaaaaaaatg

SEQ ID NO: 116574 - DNA, 425 bp, Heterodera glycines
  Promoter: Source sequence=SeqID_148; Location=1..425; Strand=+; Gene =SeqID_75160
ggaaatttctggcttcagctagcgtctaggttggtcccaatcagataaactcggaattcaaaaccgttgaaagtacccattgagaggatggttagagtgccggacggagtcccggacataagcacgcttccgaaaggcaaaaacccgtataaaaatcagcttaatgcgcttctgtgcattgtctgtctgatttacaacgaaaaacttgaaaatgagacggattataacctgcttaaaggcaaggaccatcctcaaaatatcagcaaaaatacttctttccagggagatagaatggattctcaaaaaagtccgaaagtaaacggaaaaaatttgatgggaacggaaattaaggattttttgggaaaattcgcggaattgtggcacaattgaggacaattgtttttcaagggaccgaggaggtaatg

SEQ ID NO: 116575 - DNA, 162 bp, Heterodera glycines
  Promoter: Source sequence=SeqID_32011; Location=198..359; Strand=-; Gene=SeqID_62323
ggtgattagggaagaccattcgaaagtctcatttctcgggttgataaattcccggctttttggctgtccaatcaaaagaccgatcatcgcttactaatgagatgatagtcaatttgatctttaataattgatttcttgccctctcaaaaggtgcttctgatg

SEQ ID NO: 116576 - DNA, 62 bp, Heterodera glycines
  Promoter: Source sequence=SeqID_37637; Location=1281..1342; Strand=-; Gene=SeqID_66656
aaaaaaacgattgaaaaagggcatttggcctttcccttcagaaggcacttcaaagtgagatg

SEQ ID NO: 116577 - DNA, 470 bp, Heterodera glycines
  misc_feature (8)..(8): n is a, c, g, or t
  Promoter: Source sequence=SeqID_19619; Location=903..1372; Strand=-; Gene=SeqID_84369
ttaaattntcggtgatctaatcctcattcgtaacgaagatctaaagccgagaggaaaaattattgtcaaattgttgaacggctcaccgaaatgtctcaatgattgttaagtgttgtcaaatattatttaattttatattgtaagtaagtctctcacattatttctatgcatgaaattccgttttttattgggatgtcatatatttaaaaaaaatttcataatttttttaaaatttttcaccggatgcccctgtcagcatcacgccaccaccaaaatttaagggtatttaaacaaaacaaaacaaaaattctttcgtgacaaatcgtagttatattatttatataatgggtttttcactttatttaaaaaaataaaataaaacatgaagccttattaaaaaacaaatattattattctttatttaaattaaaaatatttgtaaattttaagattatgttattgcacaaatg

SEQ ID NO: 116578 - DNA, 108 bp, Heterodera glycines
  Promoter: Source sequence=SeqID_10385; Location=1..108; Strand=+; Gene=SeqID_73574
aaatgtgtataaaaggagttgtttttcaccatttttcacattcttcctacaattcacgcattcattttcttattctacgaattccttattgtcttcaatacaaaaatg

SEQ ID NO: 116579 - DNA, 324 bp, Heterodera glycines
  Promoter: Source sequence=SeqID_10050; Location=1279..1602; Strand=-; Gene=SeqID_73113
taattaatttaaaagggtctgccaaatgtcaaagccaaacgaatcgtttgtcaaaatgatcattcttcaaccatggaatggaccattttgagaagaatttccgaaggcattgttgacacactgttcaagtacaaattcagtaattggccaaacaattcgaggagaaggaaaagcctttcgtaatttgagagaattgaaacaaaattaaaatttgaattttgaagacaaaggccaaagagtgtttcgtccgttccgtgtgaggccaaaagcatagcaaaaattagcagtgaaaaagcgctgatcagagaaacggcagcgaaaatg

SEQ ID NO: 116580 - DNA, 85 bp, Heterodera glycines
  Promoter: Source sequence=SeqID_28104; Location=973..1057; Strand=-; Gene=SeqID_58755
attagacaaatttttaaccgggtttttaaaaaaaatttagacgaagcctaaagtgcggtgtcaacggcaaacagacaccaaaatg

SEQ ID NO: 116581 - DNA, 470 bp, Heterodera glycines
  Promoter: Source sequence=SeqID_19176; Location=1497..1966; Strand=-; Gene=SeqID_83926
aattagttggcatgcttgtgagagagagagagagactatagaagctacttaaaaagtgccatataaaaatatatttttttattacattttttctttttccgattttttattgctgcacaaaatgcatggccttctaaaatagtttaaatatcttttttaattcttaattttttgcttttttttaaccttttttccgttcaattgtcccaaaatgccaatttttgtagtctttttttggttttccacgattgggtctttgcttgactcaacacgtctcgtccaactccatcacatcattgagaccgaaaagcattaaactatttcaaaggtgccaaaataagattaaagaatgtgtaaataaaaaataatactttttttgacgcgacacttgcttttcaacaaaattacggagtgaccaagcacctgaataaattttaatttccataaaagctttggtttcaaaattaatg

SEQ ID NO: 116582 - DNA, 67 bp, Heterodera glycines
  Promoter: Source sequence=SeqID_11217; Location=1840..1906; Strand=-; Gene=SeqID_46935
ggcagagaaagagagggaggggggagacacagatcagtgctcggatttaggacagctggagaagatg

SEQ ID NO: 116583 - DNA, 527 bp, Heterodera glycines
  Promoter: Source sequence=SeqID_27280; Location=339..865; Strand=-; Gene=SeqID_57961
ttgttgcgtcagcgtggtgcaagcagggacgaagagcgtgaatgcaggggaaagtcagttttttaacaaattaattttaattttttcaataaaatagtgttttttataaatatttgtttaatatttccaattttttgttaactaataatcacaaatgcctcaaatcaagaccataatttatgtgaatttttataggctaactaacggcttaaaattcaaataaaaatgcactaaaaatgatcattttgatgcgaaatcttttttctatcggtattaaaaaaaatttttatttggtttccctttttgctgttttttccatgatactctttcaatttgtttttaccataaattattaatgccaatcttccatataaattaattaaagcgcaacaatttaaatcttttttttttgtggtaaattccaattaaattttaacagtgacattgccgcaaatgccagccaattttcggcggcaattttggcacaaaatgccgacacgctgctggaggcaggcaacaaccgcatg

SEQ ID NO: 116584 - DNA, 109 bp, Heterodera glycines
  Promoter: Source sequence=SeqID_8876; Location=2016..2124; Strand=+; Gene=SeqID_69494
atcatttcctaattacttttatattaatacaaataaaagtgttttttagttatttaacatcataatcacaaattacgacaataattgagctgttaattgccgcaaaatg

SEQ ID NO: 116585 - DNA, 1003 bp, Heterodera glycines
  misc_feature (179)..(180): n is a, c, g, or t
  Promoter: Source sequence=SeqID_13944; Location=817..1819; Strand=+; Gene=SeqID_77898
aaattttgtgattttcgagccaatttttaggaaaaatttggagttttggggggccggcggtgccgataggcgccgccgaaaagtttttcgaaatttttaattaattttattaagaaaattgttcaaaatttcaaaaattttcaagagtccccaatcccccgaattagtgtcgggggggnnggggggggtcggagggcgggcaaaaagtcgggagccggggacctcggggggcgacatgtcgggggtcgggaataggtccaaaaaacgtctagggtcggggcggggggctcggggtcggggagcaaccctacttttaacattaaaaaaaaaattttttttttaataaaaatatttattaaaaaatgaaaaatttgccgaaattctggatttttttttgaaaatttccaaaaatttacgtaaaaaatcctcaaaatatgtaaaaaaaaatgaaaataagtaagaaaaagttcaaaatatgtaccaaatatgtataaaatcccgaaatatgtaaaatatgtataaaccccgaaatatgtaaataaaagtcccaacttttgttcacaaacacaaaaaggaaagtgtttttcctactatttagagcatggagaagtgtttaaatatgaacacaaatatttttaacgcttagtttaattattagggatgggttttttattttttaaaatattttttctgcagcttatttgttagttatggcgagcgaagcccaaaaatagcattttctccgaataatttttgattcttattaaaacataaaaacacatattttggcgttttggcacataaaaacatgtcgcaaatatttagaggtttggcacatactttggcattttttagaaaaatctgtaagaaaaaatgcaagaaaactgaaaaatacacccctaaaatgtaactttcttgccactgcttataacatttttcaaaatttatttctttatttcgaatgccaaaagtaatttgttcttcaggaaatgacagataaatg

SEQ ID NO: 116586 - DNA, 174 bp, Heterodera glycines
  misc_feature (127)..(127): n is a, c, g, or t
  Promoter: Source sequence=SeqID_4088; Location=1..174; Strand=+; Gene= SeqID_53140
atcattcgagagcccttccgatgctctattattttgcataattccaaaaaatttgatcaattttgaacaaagttatggccaaaagtacacatgtggcctggttttttgaattcttctagtcataatntaatatcgctttctattttgtttctttctttaaattataaaacgatg

SEQ ID NO: 116587 - DNA, 361 bp, Heterodera glycines
  Promoter: Source sequence=SeqID_24253; Location=1..361; Strand=+; Gene=SeqID_54971
aaaattaaaagaaaaaattccaaaaaaattggggaccaaatcaaattaaaattttccaaatggaaaaagagaatttggaaggaagaaggacaaaaaatttttcagttgaagaaaaaagaataatggtaaaagcaatttgatcaaatatatggcaaattaaaaatgaaattcaatgaaaaattggagggaaaaagagaaaaatgcaaaaaaataatagcaaaacatttggacacaaatatttgaacaattttttaattgaaagaaacaataaaaagttgggaaaatggtgaaaaagcaaaaaaactgatgatgaaaaaagagaaattgttgaaaaatatttaaattaaaaaatgaatttatg

SEQ ID NO: 116588 - DNA, 258 bp, Heterodera glycines
  Promoter: Source sequence=SeqID_6832; Location=2490..2747; Strand=+; Gene=SeqID_63035
attaaatgatttctttattcaattaaaaaccctaattaaggtcatcagatggtaccaaaactggttcaaacttgaaggtaaaatggcattaattatttatacaaaataaaacaattaacattaattttgggttaaaaagtgaataaattatatattgaattttaaaaacggcataattttaattttactaaatttactttcttttaaatatattttaaattcaattactgttttttagccgatgaattccccgaaatg

SEQ ID NO: 116589 - DNA, 421 bp, Heterodera glycines
  Promoter: Source sequence=SeqID_7994; Location=1474..1894; Strand=-; Gene=SeqID_66622
aaagtgaaattagtttaattcgacgtgagttagaattgttgtgtaaaaattgtttagaaaataaacagatttttgtaccttcgccagcagcggaggctgatgccacgtgaaggaatggctatcgatgacaaataggcaagaaggggccttcatcctccttttcctcatcatcattttcatttttatgtacaaaaaatatttaaaaaagatatttctaaataaggaagtttacaaaaaatgagtgaaaattactgattaaagtcagtgctaatgataatgataaaacgaattgatacacaaaagcaaaattgtaatttgagggagtcgggagcggcaatttttcggtaacggtaaaacattaattacccagtaattatatattctacgatatataataatataatttaaggtgaagaaaatg

SEQ ID NO: 116590 - DNA, 599 bp, Heterodera glycines
  Promoter: Source sequence=SeqID_402; Location=2613..3211; Strand=+; Gene=SeqID_51492
attcttatgaaattttgtcttaaaaatttcttaggctactacttgtcctgaaagaagaggaaagaattgcgcaagaccgactacgatcttatcatcttgacccaacattgggtttaagtatgcgtccaagaagcaaaacgtacaaaaataacgatgcggctattcgggctttagtagtgcaatttgatttagtacctaacccaacgccagagcaagtgattaatcacttaagggccctacaataccgattagcatctaatgggtttgatcagtggaattagctcatgccaattattttgtagaattgtaaaaataggctgttgttggggccttcagcaagcctaataaaaaatttaaataattacgaattaatttgttttggcttttaaaaaaatattttggcttgtattttttaatttgttgatgtgtgcttctttagttttgtgtgtctgcggtagggccgaaacacactttttttcttattttttgttttcttttggaagagcaccgcactgacgaggcccactcttccattagaaatttttataacaaaaaaaatttttttcatttaattttttctcaggaattgtccgcaaatg

SEQ ID NO: 116591 - DNA, 102 bp, Heterodera glycines
  Promoter: Source sequence=SeqID_31050; Location=1497..1598; Strand=+; Gene=SeqID_61423
agtggtttgaaatgagttaaattgtttagcattcacttagaaaaattctccattttaaaatctttttttgtataccaaatttattcagtttagttgggtatg

SEQ ID NO: 116592 - DNA, 493 bp, Heterodera glycines
  Promoter: Source sequence=SeqID_2337; Location=42..534; Strand=+; Gene=SeqID_79201
cgtttttttcccggaaccaaaaatttaggaaaattacacttgacaaactatttttgggatggaagagcaaaaataaaaagctctttgggtgcgcacctcccgaaaattttctggttacgggcctgtacagtattccctaattgattaccatacaaataaattaaaattttcttcaatttttgttgatgtaatattctacaaagagaagttcaactttagaatttacaacctaataattattaccagcctgttataatttttttgaatcatataatggcacttttaaaatttaaaaaaaaaaaaactaaaaaaaccatttttttcacatttcatagtgaaaaagatgatgattaaaaaaacgaaaatttatctatttaatttaaaaatattgtccattttttattcaaatttttgccttttttaatcaaaactttagtacgaagaaatttcttctttgacttcgggcagcagatgcttttcccaatccgatatg

SEQ ID NO: 116593 - DNA, 308 bp, Heterodera glycines
  misc_feature (18)..(18): n is a, c, g, or t
  misc_feature (133)..(133): n is a, c, g, or t
  Promoter: Source sequence=SeqID_13015; Location=573..880; Strand=-; Gene=SeqID_76789
cgaaaattagtgatggantggaattaattcaaattaactatgtaaatcccgaaaaaatctgattaccaatctttataccagggatggcattctgaggcccaaaaattttcggaaatcgaaacccaaaaaatantcggaattccgtgccatcctagttctataccctaattatattgttgcctaatttttagcgccaggaatgtccgttaaaaaattgtaataattccacgaacgctattctaaatttacattattttgtttaattgagcaaagcactcaaattcaataaacaattgcagactaaaatg

SEQ ID NO: 116594 - DNA, 482 bp, Heterodera glycines
  Promoter: Source sequence=SeqID_20246; Location=1076..1557; Strand=-; Gene=SeqID_85046
ttttgtgaaaaatatgtaagttttcaaaaaaattatttattcaaaaaagacaatcgttcaaaattttcattataaaaaaaaatcctcggcgcccgcatatttttttttacatattttgtaaatttttttagataaaaatttcatcctatcgatcagaaatgaaacgtttgaccgtttaattcattcgcgcaaaaaaagcattttattaattgcaatttttctatgcatgcatataatgtatcacaagcatccagcgcattagaaagagaagaaatacaaaactctcccattttgtataataaaaaatatggtaatagtgccggtggtacacacccccggtttttaaaaaaaaattcaattcaaaaaatttttttatcaattcgtaattggacctcgatgtgcattaattattttaatttacactatgccttttttaattttattatttgagtcaaatttgaaacaatttagcaacatcaatg

SEQ ID NO: 116595 - DNA, 840 bp, Heterodera glycines
  Promoter: Source sequence=SeqID_19121; Location=751..1590; Strand=-; Gene=SeqID_83865
ttcgcccctaaaataagcttttatccctattttggcgtttcgcccctattttcgccttcatttcgcgatttttattttttttaatataaaattcacaatttttttaacaaaaatgtaattaaaacaaatatttttttaacgcgatcacattttttggctactttttcaaaaatttttattttgaaaaaatattcaaaaatttcgaatataaataattatttgcaattataatcaataaacaaattgttttgctttaggctttaattattatatacaaaaacaatcattttaataatttcacccctacatttgaaactttttcacccctatttcgcgaattttttgcccctatttaggtccctattttggactttttcgcccctaaaaatccgcgccctaattataaccatgaattggggctctaaataacaatttccaaagaggagttgaaatttcgcgttccggattttggtacaatttgttattttttgagttaaaatcccggcgaataaatttgggcaccaaacttttctggtaaattgcaaaataagaaaaataaaattaccaaaagtaacgaaaagtttgcatagagattcaagatttttttttattttgcataacttcaataacgttaaagtttaaattttggttacaatttttttagattttatacaagttttcaaattttcaggcaaatagaggccctagtgaaatcgagcaaaatatattcgtgaaaattaaactcttcaattgatattttaaaatggcgttaatgaaatgttgttaaagaaaaaccgaaaaatttaaaaataatttaatataaaggaataaataaaaatg

SEQ ID NO: 116596 - DNA, 397 bp, Heterodera glycines
  Promoter: Source sequence=SeqID_19669; Location=1377..1773; Strand=-; Gene=SeqID_84402
aaaaagtgaaagattttgaattttatcaaaaaaacaaagggaattttttgaaatcaaaaatcgtaaatatacttttattcgccaaattatgctcaatgcttaatgagttcattctatatcaaaactagagtgccacgggaccgggacctggaagcggacaaccgagtacaactgagtaccaaggtcccggttttgaccgggaccgggactagtcccgggtttttcccgattttcccagccaaaaattcccggatgtgaattaattttttttcggaacggatgctggtctttcattcctttttcaacctgacctccaattttttcatacaattttacattgaaaaaatttttagcaaagtgaaatacctatttaactgaactaaaccgcatcacaatg

SEQ ID NO: 116597 - DNA, 555 bp, Heterodera glycines
  Promoter: Source sequence=SeqID_18004; Location=2288..2842; Strand=-; Gene=SeqID_82573
ttatagacaaattaaaaaaaataaattgcctgaaaccactttacacaataaaaaaacaaacaaaaaccactgccaaaaacctttaatttaaaattttatataaagtaaaaattatgaaagctcttaagaaaacttcctttcataggaactcgatttttttttgttgaagattttaggttcattgaggtcatttttaatttgaatgtattttttcaaatttaaaaaatataccaaatgggtaaataattttctgagagtaagaaaattcaaaaaattttatgttaattttatttttgtttatttttaaaaatgatagactgtgcgtaaattgtatccctgaaaataataaataaatgcaagaatcaataaagatacataattcgctaatgaaaaaaacattatatacgtcagaggatgtttttaataaatagcaaacaactaaggacttataatattaataatcacaaatgtttaaatttattaaatggataataattgttcattacaaatgaaaaagtattatattataataacaaattcaattttagaaaaatg

SEQ ID NO: 116598 - DNA, 267 bp, Heterodera glycines
  Promoter: Source sequence=SeqID_25239; Location=63..329; Strand=-; Gene=SeqID_55987
gctgaaatttggcacattgcttcggggcggcttttactttgtgttggtatggtaacagcaacagcagctgcaccaattcaacataattaacaacatagtgccgtgccccgtcggcgtgccgttccgttttttgggcccattctcttggctaattgttttaaaaaattgtgttttatgtgggcgtttcgccaacaccaccaccgcattaattcgtctcgggtttcccatttaatttcaattttcccaagctttccgttgattgaaatg

SEQ ID NO: 116599 - DNA, 993 bp, Heterodera glycines
  misc_feature (17)..(17): n is a, c, g, or t
  Promoter: Source sequence=SeqID_7676; Location=1636..2628; Strand=-; Gene=SeqID_65604
gggggaagggtaaaggncatttccggtcccggccttacacctccggccctccaaaagaccgtccctggtcgttaaaatttaaataatttccaaatttgaatgaagtcctcagactttttctttcttttcatttgttttacgatgagaaatttgttttgattttaagccaaaactgaaaataaaataaaataatttaaatatttgtttagttactcaaaataaaaatggaaaatgccgagcctcgatgggaatgaactcattccttcaaccaatccacagaagctctgccaatgaaccaaaataaatccgcgttttttttttttttttaattaattttttttttgaaattctgattcattggatttgaattaaattggcattgcttttcaaattataagccaagagaaaatctgacgaaatttttaacttttaaaattatataaatttaataattattttattttatttccaatctactaaaatttagatttttgatatagcccggtgtgactgtatgactatacctccccttcatatctaaggatcgtccctgatccaaaaacttaaatcccacgggattcatataccaatactccattcatttattttattttaatattattattatttttttttttttaaatttatgtattgaacttttccctttaattatcatttctcacttgttgtgtttttgttttttgtgtttatttaatttaatcagctccgcagagcttagacaaatttgtgtgaatatatatgtagagtagctccgcagagcttattttaaaatatcaaatataaatgcgagaaataacaaatgaaccattgggacgaatgatgtcagggtgccatcggaaaggtgaatttccgggcaaaataaaggaagggtgaattttaattccggaggaaagttgaacacatttgagaacaacattgacttgatgatctcttctgaagtgttcaagcggaaaatttgcttgacgtcgtatg

SEQ ID NO: 116600 - DNA, 91 bp, Heterodera glycines
  misc_feature (62)..(62): n is a, c, g, or t
  Promoter: Source sequence=SeqID_9188; Location=1..91; Strand=+; Gene =SeqID_70538
attgatcagcaattgacaattgctaatcaatcatcctactagataatcagtgcttgatcagnttgtattctttctctattatttgttgatg

SEQ ID NO: 116601 - DNA, 1003 bp, Heterodera glycines
  Promoter: Source sequence=SeqID_24400; Location=411..1413; Strand=+; Gene=SeqID_55124
cgtgtaaatagtcactccttttcccaaaaatgttctaaaataatgaaaaatgacaaaaaagattttgataaataattgaataatttttcaagcgaatatactaaaaacatttgtgaaataccttttacttggttaagaattaaaaaatttagcctattaaaatatttagaaattttttttattatattgtatattttttgaaaaatttccgatttccgacgtttttggggtcggaaatccgatttccgacacttccgaaaatttttggggcctcggaatgccatccctgataaggaccgccggaccccctgtttctagtttttgaaaaattgcaccgcaaaaaagtggttttgaaaagaaaaaaatagtcaaatttatgaaccgttaataatttgatttccgatcaactttttaccgtcggatccaatcggaaaatcttagtcgaccaatcagccccttttaatgcatcccgccagcccttaaaaatttatttttcagcatttttttatttttggaaattctttgaatttaattgaaattttttcgattttccaaaatcccgcaatcccgcacgggatcccgcaaattttaattgcgggatttgcgggattaatcccgcgggatcccgtcccgcaaaaaattttgagttccagtcccgcagcgggatccgcaaatttgaaatttccggtctctatgtactacctgagttttcaatgaatttttaaaaatttagaggacagagttttcatttatgttttgggacacgggactgaatttgcgtgatttagttggaacatttcgccattttttttgtatcataaaatttgaattttcaagatcacggtaggggggtccactgcgtttcggcgctcgcgtttcggcgccagctcgtttcggcgctcgcgtttcggcgccaaaaaaaaattataaaaattcagatacttggttaaaatctacaaacaaaaaaaaaactttttttagttaatcaatttcatcgaatatg

SEQ ID NO: 116602 - DNA, 1003 bp, Heterodera glycines
  Promoter: Source sequence=SeqID_34117; Location=277..1279; Strand=+; Gene=SeqID_63992
ctaaaaaattatttttttggaaaattttccggtttttgaggtcaaaaaggccaatttgtctgttgggggccgttctattagaggtttttttgaaaaatgcccaaatatgcacataaaatatgcacgaaatgccaaaatatgcacaaatatgcaaaacatgcatatggaaagtcatcctagaagcttcaaaacacgctaaaaacatgtttttcgtgcgtttcaggcctcccacagtccaggaaaaaaatatgcatgtgcatataattggactccctagtgatgggtgctgaaaatgatatacattgggatacgacgtaaagccgatttacgattgccgatatttcagggttggaaattcagatttccaaaatttttgggcagtcggacttccgcttgccaaaaatttcgatgaacaagggaaaacttcgacaatttattgggatttggcatgcttccaattgtatttatttgttagatttgtactaatttagagtatccgaatcttagaaaataattttattttttaaagataaaatttttagagagcaaataaacaaggcatacacagcaaagattaactaagtaacttaaatagtaaaaaatttttgaatgatgtaatttgagattttattttgtcattgtctcttttattttcgagagacttaattggcctgggacgagaatggcggaacacattgacttaatagcccttctcggccataactttctccgctgtctctcccccaccctcgctccgctgccgccgccgccagcgattggctgtgtcgctgacgtggaccaatgggcttgtgccccggcagagtaacgccggcgtgcgtttccgcggtgtgcacttcgcgacgctgcaccacatccaagccacacttttcgttctgattgctcaaatcactttgtgtgattgcgattggaaaagactcgctcttgacaaccaaaaaaacattacaatattatcaattttcagatttacaatctcttagggatg

SEQ ID NO: 116603 - DNA, 62 bp, Heterodera glycines
  Promoter: Source sequence=SeqID_10050; Location=966..1027; Strand=-; Gene=SeqID_73114
ggaatacgcaaattggacgggagtgccgcggcgcggagagagtgcggccggcgaaggaaatg

SEQ ID NO: 116604 - DNA, 56 bp, Heterodera glycines
  Promoter: Source sequence=SeqID_5006; Location=970..1025; Strand=+; Gene=SeqID_56526
tgtttgggtttccacaaatatcttgtctgatttttttcattttagggcggcagatg

SEQ ID NO: 116605 - DNA, 265 bp, Heterodera glycines
  Promoter: Source sequence=SeqID_31693; Location=1275..1539; Strand=-; Gene=SeqID_62001
aattattgttttaccaattttttacggatatctcaaaaaaatttatttaaattttaaaaattctattatccgaaattgaaaaacggcaatatctggtggaaaaaaaaaatttaattttctccgtcgatgccgaccatttttaaggaatttttagtactttttttaacacgtataggcctttctaatggttatgcattgattgtatgcattatgaagcattaaaaattatttaattattattttttctcaaaaatcacaaaaaatg

SEQ ID NO: 116606 - DNA, 243 bp, Heterodera glycines
  Promoter: Source sequence=SeqID_35084; Location=1121..1363; Strand=-; Gene=SeqID_64727
ttaaaaatttggttttatttaattccccattactttttttttcggcttttttccctgtgtgatgaccgaccttttaccaaggggaaagtggccttggaactgttcagaaactgcatggtcttcacgggactgaccattctttgctatgccatcatttggccaatgctccgtttcaaaaccaacaaatttaacatggcaaaatgtaaaaaataataaatgaattcttcaaattttggcaaaatg

SEQ ID NO: 116607 - DNA, 101 bp, Heterodera glycines
  Promoter: Source sequence=SeqID_11958; Location=2300..2400; Strand=-; Gene=SeqID_75478
ggtcgcccgaactgctcgactctggtggtgttctttacgcgcacgaccagcagcagcacccggcactgctggcaccctccggggggccgctgctcgccatg

SEQ ID NO: 116608 - DNA, 71 bp, Heterodera glycines
  Promoter: Source sequence=SeqID_26034; Location=293..363; Strand=+; Gene=SeqID_56784
tgtaaattaacgcgaaatcgcaaagttgattatttaaacgtaaattcagtgccaactccgaacagaaaatg

SEQ ID NO: 116609 - DNA, 265 bp, Heterodera glycines
  Promoter: Source sequence=SeqID_1299; Location=4480..4744; Strand=-; Gene=SeqID_72001
aaaggtgtatcatgttttgattacctacgaaaataaaaaaagtgggtaataaaactattcagaaatgatgatatagccggggcgttaagtactctccaccgacacggatagtcttgttttctcacatctacgcgatgctttttagctgaataagatcgacactataagcagttaattgatggaaatcgtagaattctgcactgctggtgcaaaatagtatgcgttggctttaagacaaataaatgttctacatgatgcggaaatg

SEQ ID NO: 116610 - DNA, 1003 bp, Heterodera glycines
  Promoter: Source sequence=SeqID_22231; Location=534..1536; Strand=+; Gene=SeqID_52903
aatgaaaagtcgaaaaataaattttcaaaattcaaatttattctcagatacttaattttaaatgctcgaaattacagttaataggcgctgtttagcattgtcattttcaatgatgttgctataattaaaaaccaaaaaaaattatcgttgtaagatttttttaaaattgctttttgaacgatattaaataattaacgctaaatgtcttaaattttgcattagaacgaattgtacaagacaatatttatcgtgtattattatgctgatgaagatcgtgattcagagctttgttcataaaatcaaatcaattttgttcaatgaaatgtgtgaattgcgcgattttccgacaacagcagcaagagccgtgccatctcgtaaattattaaacgatttgatcaattaaataatggcgatttatttaattattatttttttctgtttgatcaggacacacaaaatttgtgtttaacgacaacaaaaataacaaagaaaaggtgaatgtttgtcatctttgaattttaataacgtgtttttttttgttattcatacttttttaattttgattgtatgtatttaactcatccggacaattatccaaaattgtcaaattattcattttaaatatttttctaaatataatttttataatattttgctttatttaaataaatattatacaacaaaagcatgaaaattgaaattactacaacacatgattataattcgagaacaaagaatgtcaattaataaagtcaacacggaaagagcggacggcggcggaggcggcgaaagaatggcggggaaagtggaaatttaaatgggcaaattaacaaattaatgagtgtaattagtaaaacaaatgaatgacattgaagcattttgtcctgagcagttcctgctgataaatggaaaagataagaaaaagctaaggcaactgataagttcactgattccttgaaattaaataaaatatttccaaaatatttaaaattatttaaaaatg

SEQ ID NO: 116611 - DNA, 420 bp, Heterodera glycines
  Promoter: Source sequence=SeqID_34260; Location=1..420; Strand=+; Gene=SeqID_64092
aggcatttaattaagattttcataaaaaattttgctaaaaagattcttaatatgtgcaaaagatgtataaaaagtaaataaaagttacaacccttctgcttcacatagtcctcaaattatgtttttatcgaaaaataaaattctatgcaggttagttgggtttcactacagcactcacaacaaacacaggccttacgctgaataatttgtattatttttctcaacaaaaatttttgctttttagaatatattaatttgttcttgagaattctttcgcttcatttgtagttttgtacacagtaaacacactttctaattgtcattaatggaacttaattattcaaaactgggccaagaagatgcctatttaagctgcaattatcaaaaataaaataattttctttggttttcccaaaaatg

SEQ ID NO: 116612 - DNA, 814 bp, Heterodera glycines
  Promoter: Source sequence=SeqID_12413; Location=1206..2019; Strand=-; Gene=SeqID_76021
tatttttaggggttatttgatgcgctgagtacgaatttggtcttcctttggccttgtttcgaaccccgaacccgaattcgaacaatttatttatttttttattaaaaataaaatttttttaaagtcatgtaaataaaaatctttcctggggttttcgggttcgctgatcacgaataagatatccatttcgaccaatttcgaacccgggaccagatttcgaacaaagacgaaaatttaaattttttgaattttagttctatgtttgaatctgcatagaatggctcatttgctgttaaaattacctgtgatttattttctgctagttttaatcaattttagaataagtgctaaatcgaaatttgaattttcgactttttgttcgaattcgggtcctggtttgaaattggccaaaatggatgtcatattcgtgctcagctcatcaaataacccctaaaaatatgtttttttgttttttttctctttttatgggaccaataatctgcacaattgcctcccaattgtttaacaattgcttagtttctctctatgagccttcgaatgaaaccaagaatgaacattgaacgcctaaaagttcattggatgcctaaagtgcacttagagccgcaaaaacactaaaataatttttgaaaagctattttttcggaaaattagtgtcactgaacagattcgaacctccgtgctttgttaattggttatcttaataaaacaactgccacacatgcaataattgcttttattttggttccaatacgtatatacctaattgacttcaaaggtttacaacattaaaatg

SEQ ID NO: 116613 - DNA, 389 bp, Heterodera glycines
  Promoter: Source sequence=SeqID_1322; Location=326..714; Strand=-; Gene=SeqID_72488
tttctaccctaattatttgctctcttcattcaataattttataatcttgcgataaatttatatttatctggttgggcttggtcgcgtacttcgtaaatccggcaccttgggcgtttcgtaaaatccgccattttagttttttcgacaatacatgccataattttgcttaaaggcaatcaaattctacattctttttaccattcgatagtacagctttttctctattagcttgcaaaagtaacttcaaataaaattaccaaatttaacataagttatagcataaatggcacttaaaaaaattctcgaaaagttgaagttttcatgaacttaacttaattttgtgtattaattaatattgaaacttcccaaaaagtgtgtctactaaaatg

SEQ ID NO: 116614 - DNA, 69 bp, Heterodera glycines
  Promoter: Source sequence=SeqID_10832; Location=1419..1487; Strand=-; Gene=SeqID_74101
tttaattccctagaaattcattggtctgtctttattaggatgatttttcaggttgttgtcctcctcatg

SEQ ID NO: 116615 - DNA, 524 bp, Heterodera glycines
  Promoter: Source sequence=SeqID_8964; Location=1..524; Strand=+; Gene= SeqID_69831
ccaccccgtccaccatttgttgttggtattttctgctcctcattttgagcgtcgtcgttggcggtggaatggagaagtgagagggggaggtgggtggggggattgttcggcaccgttctgccccctccggggatgtgttgttgcggtggtgccaattgctgtactgctgctgattgatgatgaagacgcacaaatgcagtggaaaaaggtacaaaaaaatcgtggggaaaatgggatgacggggttggggtgaggagatgagaaaacggttggctgacttgaatttgaataaaggtcgtggctggaaggagagattaggaaacggataagaaattcttagacacccccgccccctcaaccccgttctgttccatctttcaccccctctgatcattcattcattttccttcaatttttgtgcactttattaataaatgttcaattatttatttcccacattttaagcagttcacttcaacgcaatttgttcatcaacagcaaaaagtgtgtcgacaacaaatatg

SEQ ID NO: 116616 - DNA, 72 bp, Heterodera glycines
  Promoter: Source sequence=SeqID_44474; Location=1..72; Strand=+; Gene= SeqID_71963
tttaccattgctatttgcaaatagttatccaaattttttttagaatcaaatcacaataattttcaataaatg

SEQ ID NO: 116617 - DNA, 401 bp, Heterodera glycines
  Promoter: Source sequence=SeqID_16096; Location=1..401; Strand=+; Gene=SeqID_80450
ttttggagaaaaaggattaaattctctcgtgaaatcctctgctcgtttctaactacatttttttacattagtcaaaattgccgcggagtcccaaattccgcgggtcgcgcatcgcgggtttaaaatcccgcggtcgcggattcaatttctcgcgttcgcggatcgcgcaaaaaaaaaaacgctgcgaatcgcggtcgcgctacacccctatttgcatcaaaagatttcattttttagtttatcaaaatttttggaatttctatttgtctatccaaaaataggtagattgcttcaactacacattaatcgcttctcaaaggtttttatttagaatggtttcttctttaaacaatttgctacccagcattgatttccccttcatttacttgcataatgaaatg

SEQ ID NO: 116618 - DNA, 398 bp, Heterodera glycines
  Promoter: Source sequence=SeqID_15201; Location=1..398; Strand=+; Gene=SeqID_79404
ccccccccccccccccgtcgcccgcaaagtgccccaaaatgggggaccccttcgcatcgagggggccggtgtaaaagaggtggggggggggtcgccggcgaagtggaaaagaggaaaaattctgaaaaatttggctattttcttaacaaaactcattaaaaattctgaaaatttttcctggcggcgcctaccggcaccgctggccccctttttgcaaaattttcttgaaaaaagcgtgccgcaaaaaaaagtgcttttgaaaaaaaaaaaggtcgtcgatttacaggccgggaccattttgcaaaagcaaaattgaccgctgaccccctctcgacccccccccccccctccaaaccccttcgcaaaaattccggttgaccccccctttttcatgtatg

SEQ ID NO: 116619 - DNA, 401 bp, Heterodera glycines
  Promoter: Source sequence=SeqID_785; Location=8354..8754; Strand=+; Gene=SeqID_61216
atcatggaattttttctttcaatttctttttttactgtgctaaaaatgactaaaccctcaagaaactgcgcggctaagcatttaaaccgctttttgggaaggtttaaaactcgaaaaatggacaaaacaccaaaattaattggaaatcctaaaaaaaaaaaaaataaattttctggcggcaaaaaaacattttattgttttctttcacttgaaataaatttttcaaaaatgctgattttttgtcggccaaatgttgattttgacaattttcagttgggcgtcctgcattttatccttttttttttttgtttgaaaatggtcgtcaatatgttattgttttggtactttttgttaaggcatttctctgtgccaccacttcagtcagttacaaaattcaaatg

SEQ ID NO: 116620 - DNA, 1003 bp, Heterodera glycines
  Promoter: Source sequence=SeqID_16173; Location=915..1917; Strand=-; Gene=SeqID_80537
ggggggttgtttttttttttattttatttttttttttgtttttctcttctcctctccctttttttttttttttgacaaaaaaaaaaaaaaaaaaaaaaaaaacaagaaaaaaaatattttttttttttttttttttcccccccccccccgccggcaaaaataaccaaccaaaaaaaaaaaaaaaaaaaaaaaaaaaaaaaaaaaaaaaaaaaaaaaaaaaagagggggttttttttttttttggggtttggggggaaagggagggggggggggaaaaaaaaaaaaaaaaaaaaaaaaaaaaaaaaaaaaaattcgggcaaaaccccggaaaaaagggggggggaaaaaaatttttttttttttttttcccccctttttttccccagaggaatttttgaatttgtgggggccccttttggggagagggttttttttttttttttttttttaaaaaaaattgggaggggggggggttttccccccaaaaaaaattttaaaaaaagggcgccaaaaaaaaatttttttttttttcccccccccaaaatccctaaaaaaaaaaaataagtttaaaaattttttccaattttttttttaaaaaaaaaaaaatttaatttttttttaaaaaaatccaaaaaaaaagtttagattggatttggggggggccgggattttttaaaaataaaaaatttccctttttgggggggttaaaaacccaaagggaatttatttccttttggaaacccaaacccatttaaaggaaaaaaaccccttttttaaaaatgaagggtccaatggggaataaattaatttaaaatttttatgtaatttgttaattttgaagaaccggggaaaattaggtgatggggttaaatgttgaaaaaattatgcaaaaaatcggccaatgataataggcaaatgtgaaaaagaaataaataagtacgaaattgaaattccatacagagcggatcttttatatagaaaaaaggaaatttctaagaaaatg

SEQ ID NO: 116621 - DNA, 1003 bp, Heterodera glycines
  Promoter: Source sequence=SeqID_3300; Location=982..1984; Strand=+; Gene=SeqID_84127
cttttttaataaaatcccttcttttttatgatttatttggaatagagaaaatgcttgccgaaaataaggaaatgctttttttttatggacccagtcaccaaaaaggacaaatgggcaacaagcgccatcgtatcggacaaatatagtacggtacagcgtagtccgtcctctgtggtgtgccattttaattcactgaaaaccatccgccgatgccgacgagaatggccacaactctcattagcaattaattatacccaaagacaaattcaaattattgaggcacaaagggcgtagaaagaaagaagatgacatatgttttcaataacaatgctcacgaaaacaccacccttatagggggagatgaattcattaataatttcattattttttttttttgtttgccgcgcactttacgcgaaaccatcgcttttttcggaataaaatagtcaaaaaaatttaggaagtaaatttaattttcaacattttttaaattagaaatgagaatttttaaaatgtgtaggggtgttttggcgcccacgtttcagcgccaaccctagtttttggactataactttttttttgtcaaccaaatctaacaatcttggtatcattcgaaagcttttcatgtttggaagctctttctaagctattgctctgcgattagacaattaacaaagaagttgtaacatgaaagttgcaaaaaagtcgaaattttagaagtttttttcttaataacttttttttacaggctagaaaatttttttcattttttgtaaggctaatagagcatgtgaaggggctttcgtatgatgctaagaatgctcgattggttgacaaagaaaacagttatagtccaaaaatttggcctggcgccgaaacgtgggcgccgaaacgaccctttcccctaatgatatatttttggtatttttatttttatttaatatttcaaatggcttagagagaagcaaaagtcaatagttttgcgttacattacacaaaaatg

SEQ ID NO: 116622 - DNA, 746 bp, Heterodera glycines
  Promoter: Source sequence=SeqID_26555; Location=1..746; Strand=+; Gene=SeqID_57290
ataaacaacaatcacttccttccttccttctctgtgaccgtcacataaaataatatttaaatacaatgaaataattgaaacatataaatatgtattttaaacatttaaaaaaattttaaatacagaaatactttaaacatttgcaaaatagagaaatgcgaaaaattattggtttttcgcgggcccttgcctcgaaataattctatccacgacgatcgtgtggtcaaagcaagaagcagaattttttaaatcccatatatttattttttaatttaggacaaatcgttttattataatttgctaaaacccaatcgtacacttttttttattattgttattattttcaacgagcactgactggaaaagcgatgaaatttttgttcattaatttgatgcaaaaatatggacagtatgaatcacgcagcatcaatccgagttatcactggaaaaaacaggaatttgtctttaacaaaatgagcgatataatcagatgggattggatggggcaattggtgggtgattttataaatcaaaaaaagtgggtgggcaaaacagacagaatgattcatattcatcaaaaaattccaccaactgagaattccagagtcattttattgtgatcggtggcaatgggtcattaaaattctaatcatttttatttttatggaaaaataataattccgccaattcatttttccgttatatatttaaaatcattaacataattaattttagcattataaatg

SEQ ID NO: 116623 - DNA, 718 bp, Heterodera glycines
  Promoter: Source sequence=SeqID_12666; Location=972..1689; Strand=-; Gene=SeqID_76340
cttaaaaatcataaaaaaatgcaaaatatgtacgaaaaagtgcgaaaaagtccaaaaatatattttccaaaaaatgtcgaaatagtgataaaatgtgacaatactccataatagtgaattttaactttttttagtgacgaagcgccaaaataatgatttctagtgacgataaatgacgttcaaatgaaaaattaaaacgcagaaatgcgtttttgagctcttttcttcaaaacaattgagcaaacaaaatagttaaacttaaaaatcgcctccctattgattactatgaaaaggtagggggataaaattaagaaattcaaagaaaaattcccattaaaattgcaaaaattgcagtttaattattattattagggttgcaaccccgaccccgccccgaccccgaaccccgacattttaggccatttttcggggttaaccccgaccccaaccccgacgcttccaaccccgacgaaccccgaccccgacccttaaccccgactcggggtcggggttaaatatacacccctaagaatggcattttcgtgggggaaaaggcaaaaaagttataagaaatttgaatgttgtctttgaaatgacaaaaaattttgaaattagaacattttgccaatattaataaaattatctaaaaataaatagaaaatttttctcctttctgcatttttcaggttaatatattgtacctaatttagataacatg

SEQ ID NO: 116624 - DNA, 868 bp, Heterodera glycines
  Promoter: Source sequence=SeqID_18849; Location=1..868; Strand=+; Gene=SeqID_83543
attagggcttctttttttaggcaaatgcctaaaattttgcgcacttgatacgcaaagataagcacgaaaaacgcgttttccgcttggtttggggtgtctacgatgacttttataatgcctatttttgtggtttttgtgcctaaagtgcctattttaggctttttgaaaaaatccataagaaaaatgcaataaaaacgaaaaacacacccctaagaaatgacccaaaaaaaattcagaaaatagacccttaagaattgaaaaaattttcaaaaaaatgatcccaaaatttaatatatttttttcttaataaaaatttttggtttaaaattttgtccttatttaataatttcatttgcacttgaaatatttaagtttttacttgttttaataccaaaaaagcgttaataaaaaaatgtttgcctatttttgtgcctatttaatgtctattttgcgatttttgtatgcctttttatgtgcctatttcgtgattttttgtgcctaaaaaaggaagccctagtaatgattgtttttaggcattcaaaaatgcacccccaatatctgaaactttgaaacataaaaaacggttttggcattttgaccgaaaccggtcaataattaattttctcggcacttttgaaggttggccaaaaaatttttaatgccacatgtagaggaccgatgaggctagtaaaatgacacgaaccagattttccaatatttatgcgacgtggcacccagtaatgtctttgggcttttcaaatttttaaaatttaattttagataattggaaattttcaaaatttcgtaacaaaactttaaataaaattttttaaataattattattcagatgatattatggaagaaatg

SEQ ID NO: 116625 - DNA, 295 bp, Heterodera glycines
  Promoter: Source sequence=SeqID_16646; Location=1758..2052; Strand=+; Gene=SeqID_81062
aacggcccaataagcttgacccgtcaaagcgtcgaaggctaaattttgaaaaaaaatttttgcaggatcgatcatttttaataggctaaattctcaaacattcaaagaaatataaaataaaatacaatacaatataaaaatcaatttacaaacttttctccctaaaattcatcaaaaatttcgaaaaaaacgctagaaaaatttacaaaatctttttcttgtaattttcttataaaaaaatttctgagattttttgttgaaatttccaagtttgaagaaaaatcggcgggaaatg

SEQ ID NO: 116626 - DNA, 398 bp, Heterodera glycines
  Promoter: Source sequence=SeqID_13783; Location=1..398; Strand=+; Gene=SeqID_77708
caccatttgccagcagttggcccatttcttcgccggtcttttccttggcgcccgcgtaaaccttggacaaagtgacggcggcagaagtagttagtcgccggtacccgttgccgtttaaggtgtgaaatttcacaccttaaacggtccccggttttttgcccttttttaccgcaaaaacccaagggtattggctgttttttcgcgcatttttggggaaggggagggaggtcgacggtccctggttttcacacctcgacggtccccggttttaccgcaaaaacccaagggtactggttttttcggtaataaaatttaaatatttttgggtttgatttaagatttataaattttttcaactttaattttggtaatacaaaaaaaaagtctaattttgaatg

SEQ ID NO: 116627 - DNA, 96 bp, Heterodera glycines
  misc_feature (69)..(69): n is a, c, g, or t
  Promoter: Source sequence=SeqID_5024; Location=2920..3015; Strand=-; Gene=SeqID_56612
atgtaaaattctgtgtttacgagtacatttaaatattttttagttttccttttccatttatatttgttntaatataaattcctggtttcggcaatg

SEQ ID NO: 116628 - DNA, 469 bp, Heterodera glycines
  Promoter: Source sequence=SeqID_1531; Location=3185..3653; Strand=+; Gene=SeqID_74285
atccattttttaaattttatttaaatttcgaatttgatccgcaaaaaaacccacgctttattagcgattatccgacattagcgccaattataacgggttaaaatacatgtttttttttgtttatcaattaaagtttatatttattcaagaaaaaataggcgatgtttatggaatttgggattgaaaaaaaacagaaaaattttgagtccaattttggacattgacgcaaataaatgtatctcctccctctttttttccacccttagatttcaaaaaaaaaaaatttcgcagaaaattacaattttttactatcatttattacatatttccaaaaatgaacagcaaatctttaataaaaaaagaaaaccaaaaatgggtttgattttggtttaaaaacacacatttaatttcccatttttttgccaggatttatttgttgcaaaatttgccttcgctgagccaagaaatg

SEQ ID NO: 116629 - DNA, 57 bp, Heterodera glycines
  Promoter: Source sequence=SeqID_35399; Location=882..938; Strand=-; Gene=SeqID_64957
gaaatatttttagaaaataataaaataaatgaaaaatattttagaaaaaaataaatg

SEQ ID NO: 116630 - DNA, 134 bp, Heterodera glycines
  Promoter: Source sequence=SeqID_1513; Location=3865..3998; Strand=-; Gene=SeqID_74122
cgtccaaattattcgacaaagtcgtcgaggacttaaatacacagctaaaaacggaggcggaagcaaaaatttttgagtagccaaagcccaaaatcaacgcaattcagcatggcaaatcatcgccaacggaaatg

SEQ ID NO: 116631 - DNA, 153 bp, Heterodera glycines
  Promoter: Source sequence=SeqID_21627; Location=143..295; Strand=+; Gene=SeqID_52224
actgaagtggtcaagaaaataacatttattatttaatttgtatcagttttctaacaaattgcaatgcaaatttggcttttcctgtggtgcctattagcaccccgcccgagctcacaattcgcgctctaattcccaaataaagattacataatg

SEQ ID NO: 116632 - DNA, 276 bp, Heterodera glycines
  Promoter: Source sequence=SeqID_12144; Location=1245..1520; Strand=+; Gene=SeqID_75718
gctaaatgcattaaaacaaatattatcactgataaacaacaaaattggacaaaaatattttgttttcaatataacccaaaaatttacttaaaaaaattaatataaattttgaaaaataaataaaataaaattaaattggaaagaaaacgtggaaaatattcaaacattagaaaaattttaaattgagaaaaagtgggtagccaattttgtaattagtgagtttattgtcttttacttttctaattaatgtttcaattttgcatccccggcaaaatg

SEQ ID NO: 116633 - DNA, 1003 bp, Heterodera glycines
  Promoter: Source sequence=SeqID_2842; Location=1528..2530; Strand=+; Gene=SeqID_81891
ttttcgttattttccaaaatataattttcccctttttacaacaacagcggagtttgtgctgctaaattagctgattatctgtcttcctcccaaatgcttctctgtccaaattaggctgctccgaagtctctgccgttttgccaaatttgccgatgccctcgggcaaagaattaatccttcggcatttcggtcgtcttacatctcgccaaagggcatttcacttctcccccgcttcgcttccattgctcccgtcgttgtgacaattcgacccaacgcatttttggccataactccgggggaaaaaggggaggcaaaggaaggggagaaaagttcagaaattaaaaaaggaattgccggagggagagaaagaagggcaagccaaaaacactcattcattcattcgaatatcacaaaatatgcttattgttatgagatcaactttttgtttttcattgtttttttctcattatttaaaataattttgctgtgtaaaagcataaattccctaattattcgctaattctgtcttttgttcctttgccaatgaatttgcgctccctttgcttcgttggcattctttcgcttctttttccgttgtgccgtccctttttgaccgagcttcgccattggtcgtacgatggcgttggcacttttttgccaatttgtcgcgtttgtttgtgcacgcgacaaaacggcgtggagtgtgtgccgcgccgggagggcgaaaagtttcagcttagggaagtgagtcgcccattcattttggcataatatttgtctttttcccccattttttttgtcattttcggtgcttttgccacgttgggccgattctctgtcttttgtcaatctttcgttctccgcctttccgcttttcgccactgcgcctcgcattcgtcaacttcagctccgccactgtgccatcgatgctccaatctctccgtcggcatttttgccgtttcactccttggaaagtttccatttgacgcattgtcgtctaatg

SEQ ID NO: 116634 - DNA, 491 bp, Heterodera glycines
  Promoter: Source sequence=SeqID_16967; Location=1..491; Strand=+; Gene=SeqID_81392
tttttttaattttttggattttcacaggctcaaccaacacgcgctgaacatgacattcagctttctgtgtaacactgcaatgtttcctggagttcatgagcgtttcatttgtgcgtcattttaaaaatttagaaaattttaaaaatttataataatttatttaaaaattcaatttttttttttaaattgccccccccccccaattttaagtcgtcactttggacgacaaagcgcgcgatgcgctgcacgagcattggccaaatgtgcgcgtttttcattggccaacaccgagcctttacgtaaagccacaaaaaaatttaaaaattttaaaaaattttttttctaaaattcagaagcagttcagttttgccgagggagcctatcagacggtaaaaatttaattgttttttttaaaattaattctgaacagcattgataggcggaaatttttttttttaaattaaaaaaatgattttttccgactaaaaatg

SEQ ID NO: 116635 - DNA, 215 bp, Heterodera glycines
  Promoter: Source sequence=SeqID_24504; Location=817..1031; Strand=-; Gene=SeqID_45871
tgtgaggcgccgcaaattcttttggcatttttgtcacatttctaattgtgttttcaacggcacaggtgagcattgggaccatttgtcaactgtgcgaggaagccagccatgtgctgcgggaacagggatcacttgtcgagacgaaaccaccgctggtcatgtgcggcgacatccatggccaatttgaggacttgaagaggattttcaacaagatg

SEQ ID NO: 116636 - DNA, 553 bp, Heterodera glycines
  Promoter: Source sequence=SeqID_2439; Location=952..1504; Strand=-; Gene=SeqID_79728
atgaatggacattttttaaataattaattgtttgtatattttttgatctcttttcaattattcattcattttattattaatttgataatttactttaattattattgtttttatcactttaaacgacttttgtcactttaaataaatttaattcattttttcatttaaagataaaaaactaacttttgaaagatcttatttaagttaaacacccaaaaaaatttatgcgtggataaagcgccttttcatcgcggcattttgtatgcttatggcagctgaatacaaacgtacatacaatattattctcatttattataggattttctctatattttttgtggaaaattggccatccaatggcattttcgaagcgtcgtcagccttttgtgaagcgcgtgccgggccaacaaataatcggcgaatgtttggccaagtcggcctctgtttccacactcattcatttactcattcattctgccatttctttctccgattttatttcatttaatcgattcaattttattttttttttttttgctctttttgcgcgatg

SEQ ID NO: 116637 - DNA, 246 bp, Heterodera glycines
  Promoter: Source sequence=SeqID_5506; Location=381..626; Strand=+; Gene=SeqID_58276
ggtctgatcattgccaagcaccaagacggagtgatcagctacgaatcgaggcaaatttcaaatgaaaaatattttaaaatttggatttaattaattaagccatggattcgacgacattttcggcaccgaacaaacgaaacaaacggaaaaatatttggaaattaatttgaccaaaagtaaagccaaattaataataatattttaatagtaattaccattttacagatgctgaaccacttggaaatg

SEQ ID NO: 116638 - DNA, 1003 bp, Heterodera glycines
  Promoter: Source sequence=SeqID_11556; Location=3420..4422; Strand=-; Gene=SeqID_74999
actaaaaatcagttttacagtcaaaacataatatccaaataaataaattaatatttttgctagcaatacgtcatggcaaaaccaaatttgttggtggaccggatgaagctgttgttgagcaccggcaacggggcggatgttcaatttgcatttggggaaggagatcagcaacagcagaaagaggctcgcgcaaaaatgcttatttattttatttattgttaaattcattaagaattttttttattgactgtcctacttgaatagggtaattaggtactcacttgtgtgctctattccagtttatgcttccaataaatgaccatcctcagccataactttgctctttattggctaaagcatacattcttggtatcaaatgaaagcttaaagtctcgagaattgtaaatgcagaaaagtgcaaatactgtcattaagaaaaaaaaattacaatgagaaaatacaaaagtaagctttgtttcgagaatatttaagaattattttttgtttagtcctaaatccccgagagtttaagctttaagaaaaaaaagttatggccaagaaatggggatggtcttttcattggacacgttaactggaacagagccatcatttgtggcctattttggcttgctttttcagagttgtttttttaccattctaagcggcccaaatcgctttaggcatttttaaaaatgaggaggcgggaggaccaattttctttaattagcaccggaatgggaggaaattggttagttactctgccggctagaatttccggaaccagattttatttcaaccaaaaaatttctcggaattttcaaaataataaaatccatgtgggtgctaaaaaaatatccttgatcggcggcactctgtgccggccaaatgccgatcagcgccatgcattaaattttagttactttttttttgtttgctgaaatgaatcaaaaatttagaccccctttaatttaagcttctgccagcccataaaacaattctgatg

SEQ ID NO: 116639 - DNA, 74 bp, Heterodera glycines
  Promoter: Source sequence=SeqID_11315; Location=507..580; Strand=-; Gene=SeqID_74693
tctattttagcgtaaacctgttaacaaagcgcatacttttgaagattgttgacaccatacacctcgcaattatg

SEQ ID NO: 116640 - DNA, 77 bp, Heterodera glycines
  Promoter: Source sequence=SeqID_36366; Location=1282..1358; Strand=-; Gene=SeqID_65699
agcgctcctcctcctcatcagagtttgatgatgctgatcagtacagcaaaagcagcgcaaaagtcgaccattgtatg

SEQ ID NO: 116641 - DNA, 89 bp, Heterodera glycines
  Promoter: Source sequence=SeqID_14652; Location=404..492; Strand=+; Gene=SeqID_78750
ggtcgacgaacatttctaaaaaaatatctcgaaaatattatttgaattgtcagaatcccgtctattctcggcttacattggcactaatg

SEQ ID NO: 116642 - DNA, 126 bp, Heterodera glycines
  Promoter: Source sequence=SeqID_42064; Location=898..1023; Strand=-; Gene=SeqID_70061
ttgctttgaatgtttaatttgatcgattttgacaaaagttatggcgatttttttgtcgtcgaattaccaaaatcgtcaacctttaaatttataaatatttcgaatttttaaaatccaattaaaatg

SEQ ID NO: 116643 - DNA, 199 bp, Heterodera glycines
  Promoter: Source sequence=SeqID_5246; Location=7634..7832; Strand=+; Gene=SeqID_57440
attgtctgttggaattttcccccgtttgcgacaaatcgccccgtcaattctcaacgactgtccatcgcttcgctttgtcttttttggctattgcgatctcttcaccgaattccctgccgatgacagtgccgcggcatccgatggacaagcattggccaaatggcttttcactccccatcccgacaatgtgccgaaaatg

SEQ ID NO: 116644 - DNA, 458 bp, Heterodera glycines
  Promoter: Source sequence=SeqID_13886; Location=1473..1930; Strand=-; Gene=SeqID_77831
ataataatatgcgtttgtaagtttaagcaaaattccaaaaccggaaaaaaaaccccaaacgttaattaaaaataaacaaaaattttgcttatcggcaaattaattttaaattttagcgagaaattcaagatttcaaaaattttaacagaaaagttactttgatttagaattcgtaaaaatcaaatttttggatggaatttgaaaaatccattcttagtggtataaatcttttaaaaaaaacaaggcgcacattatcatatttcaaaataaattaaaaatccttgaccatccccaaacattctttttcccatttcagctgacaacaaaaataaaaggaagaggcgcaagaagcgttatttcatggacgttgtctctattggaattctagccttagttttatgcattattttgatatttgcttgtctacttggctatataatggataaaatccacacatg

SEQ ID NO: 116645 - DNA, 498 bp, Heterodera glycines
  Promoter: Source sequence=SeqID_1929; Location=4501..4998; Strand=+; Gene=SeqID_76844
tctcattgtttgtgtttgcatatgtatttacgtctatcctgcctttttgattgtttttggtgcacttcataaataaagagaatcagagcctaccattcactttgacgggcaaaacagaatatctaattttctaaaggaatcacccaaactttgagtattgtcaaggggtagtgtttatcttccgggtatttaactcgacttattcattcagcacatgtacattggtttaccaatcgagtagtgtgtagtaaaattaacgaaggggtagagagaaatgaagtcacatagaaatttttcattccgtcttcaaatccgctcatttatttgttgctcattaacattttcgcgatctcgcagcctaatacacttacaactggatggacaacttgacttcgtataaattcataacgttttacattcctctcccgcactttatcagttatttttttcaattagacattaatatacatcttctaggtagcgctaattgcaggtatg

SEQ ID NO: 116646 - DNA, 558 bp, Heterodera glycines
  Promoter: Source sequence=SeqID_11892; Location=2525..3082; Strand=+; Gene=SeqID_75402
actctccgccaacgctttgcgttgttgcggacggacaaatgcgtgacaatgaactcttggaatgcttttagtcgtctaaattgcctttaattgtttagtgttttgtgactcaattagccgtaatctcttggggcatttaagtttaattttggtccaaatcattatcttcgttcggcacattcccggctgatcaattaaacatccaatgctaacatcccacgctttgattgtaaattatttgtttaattttcagttcgattcgttcgccgaaggacatccgcagccgcgcgcggtcgtccaatgcgccagcgaagcgtccgcgcggttttcttccgtttgtgcgcttttgcacgcgttcgctgtcaggtgcggatacaaaattagagaggggattttttttgtaaattgccctctaatgatccaaaatgcctcaaaactttttgccattcaaatggtcgctgtggcattccgcctccctttttatcgaagtattggcatttgtaaaaaaataattaattaatgacagtatccttctttaacagttaccgtctgaacatg

SEQ ID NO: 116647 - DNA, 76 bp, Heterodera glycines
  Promoter: Source sequence=SeqID_502; Location=1..76; Strand=+; Gene =SeqID_54648
gcgatcaaaaagccatgcaaagtgcgaaaaagggatgtaataagtcaaaaaaaatcaaaaaaacatttacagaatg

SEQ ID NO: 116648 - DNA, 676 bp, Heterodera glycines
  misc_feature (7)..(7): n is a, c, g, or t
  Promoter: Source sequence=SeqID_10408; Location=1..676; Strand=+; Gene=SeqID_73601
caaaatnttagaaactgggcgcaaagcgcccataagagtccgcttagtcgctaaattatcccctattattttcgatcaattcgaatcgcttcacagcctaggtagcgaagctcaagaagcgcgcagcgctttatccccactaaatacccaacggttcacgcacccactagttatctcattatatcattcagcacactattggctaaaaacgtcctcattttttgaaaattgtttataacttggagaaatcactggccgatcaattttttggctctgccgccattagctgactccgaccgatcaatttgtcggtcctgtcttctttagcgatcactttttggctctttcttcgagtgtcaatcactttttggccatatcttctattgcgatcactttttggcccagacgctgatcaattcgccccatttaaaaaataacaccccaaaaaaggataatttttttcgaaattttggaattttaggtattttgttcgcttccaaaaattttcaaattcaaatagaatgagcgatcaaagatcttttaatttccattttcttttataatttaagtcttagtgccattttcattccaaataattggctcaaatttcatttctttaggcccaaagacggccaaatttctcagctttttggagcagttcacactgtgcacaatg

SEQ ID NO: 116649 - DNA, 495 bp, Heterodera glycines
  Promoter: Source sequence=SeqID_18353; Location=1..495; Strand=+; Gene=SeqID_82953
gcattttccgattgaattttacctataattgtaacttcatttccggaaaatgcatattttcagatagaattttacaattgtaacttcattccggaaaatgctataattgtatttcatttccggtaaatgcgtattttccagtagaattttacaattgtagcctcattccggaaaatgctataattgtaacttcatttccggaaaatgcatattttcagatagaattttacaattgtaacttcattccggaaaatgctataattgtatttcatttccggtaaatgcgtattttccagtagaattttacaattgtagcctcattccggaaaatgctataattgtaacttcatttccggaaaatgcgcattttccaatagaattttacaattgtaacctcattccgggaaatgcgcattttccgattgatttttacaaatgtattgtaaaattcatttcatgaaaatgctataattgtaacttcatttcaggaaaatg

SEQ ID NO: 116650 - DNA, 266 bp, Heterodera glycines
  Promoter: Source sequence=SeqID_32570; Location=1..266; Strand=+; Gene=SeqID_62878
gtattttttcacttttattgcatttttcttatgaaaatttgccaatgaccgaaatatgctttaaaaacgcaaaaaatgctttatagccctaatcataaggtacagcggggaaaattttttttattggaaattattttctaacgaatctcttcaaaaataaaatgagtattgggggttttcgagggcgctaatcacgaatccgaactgggatttgcccaattccgaatcccggacccgaataaaaatgaaatatttttccagggatg

SEQ ID NO: 116651 - DNA, 128 bp, Heterodera glycines
  Promoter: Source sequence=SeqID_11649; Location=1129..1256; Strand=+; Gene=SeqID_75101
ttcaacaaaacgcagaacggcgtgaaaattctcagtcgagacatgaaaataccggggatagagctgcacgcggggaacaacaaaaccgtggaaggaaccgagaacagcccaattttacagaaagaatg

SEQ ID NO: 116652 - DNA, 1003 bp, Heterodera glycines
  misc_feature (184)..(184): n is a, c, g, or t
  Promoter: Source sequence=SeqID_9730; Location=903..1905; Strand=-; Gene=SeqID_72512
aagcagcttcaaaataaacaaattaaatttgtttaatttattgcttttaataaattgaaatgtttctctttaattacctaattaaaacaaaaagtgaaaaaattgagtgtcttttggtcgaagaaaatcacagggaattaatgatcggacgacgacggaccaattggtcccattttcttcttgnggattttcgtcatccatttaatctgtttattctcccggaagaggaagtaaaaaaaatgtcataaatgttgtttaatatgtaactcagttaatgttttttatatttaatcaaaaaaaaattggatatttaaataaaattgagttaattttaataattcattaaataataattataaaaagatttattgcataaaaatattcaaataaaaaattaaatgaatgattatttcaagctgaaaattctgtagtattacataagaatttcataatgagtgcacagattatcacatgatttaaccccaactcgcagaagtaattataattaattaatggatgattgattggtcaatcttttactataatataaaaaaatgatcaattggtcaaaaagtgatcaaaccttaacaatttggaaattgcaaaaatcaattaaaaagttactgacaaaagaaaattgcaaattttatgaaattcatttatgtatattttgatttaaagaattgaaaaatttgcaggtaaattaaaaacaattcaattcaataattcatcatgagtgattttttgtataaattcgaaattagactatttgaaagtggcatgcaaaataatcaatatgacttttgatcaatcaaattaaaaaaaaagttaattaatgctttctttatcattttgcattattccgatcgcttagatcaattttaaacaattttaaaaaagattttgctcattttccaatttgggaatagcggaacctaatcaattccgctgatcactcaatcaatcaccatcaattgccaatgatcaggacacacttagaatg

SEQ ID NO: 116653 - DNA, 1003 bp, Heterodera glycines
  Promoter: Source sequence=SeqID_12279; Location=36..1038; Strand=+; Gene=SeqID_75869
gtctctacagaaagaatttaagaagatggaggaaaaaattcggcaccaaatcgaacaattaggtttcgatcatttatcaattcggaggctcaatattttaacttttttttctgttactttattttgctgagaaattcaaaataatgtttcactattaaaaataagtactattttgattcagaaatatttctgtaattttatgtattttttaaattttttcagaaaaattcataacaaacgaaattcacccctatggattgccgccttcagacaattttcaaaaattataaggctaagaaaaaattataattagctttgtgactatttatactcaggtgcaaaagcacggaatcatgtaaatgaaagcaaaaaacgaattttatttttcttgtttaattggcatttatgttttaaaaaagatagggctttagcatgctaattactagggataggacgaacatttatatttcaatattttgggggttttgtcaatgttttgtaaatatttggcatttttcggatttttcatgtgaaattcagaaattctaacaaaaatgcaattaaaaattattatttttttgacacacaatatataagctttgaaactgtaaagaaaactgaaaatggttttacattcacttaatttgctgatttagaacaagaaaaacccagtgagtttttttgtgtatttttaaaaatatttttcaaaaaaaaattcactacaaacggaaatcacccctatggatcgacctgaaaaagaatgttaatgatttttatgttttttatgtaaaaagggctaattattgttttttaatttaattagtgaatctatatttgtgtcccgattgctctggtcgggtgcacaagtcagccggtggcactgtggttggggcaggcagggacgagaccaaatatacacaaagaattacaataattaaaaaataattccggggaggacctctaatttgggtaattaaaccgaacaaattaaaattacaaaatg

SEQ ID NO: 116654 - DNA, 1003 bp, Heterodera glycines
  Promoter: Source sequence=SeqID_5024; Location=555..1557; Strand=+; Gene=SeqID_56613
caaaattgttgttcaaatacgtgtgtattattcgtcatcgaattcgtctctttgttagcatcactataatttcatattgatatccacattaaatttcgaaaatatagaggaatcattcgttctgcaatttttgcttcctttgttgactttcaatttgaagcatattaaattggagagaaactttgatgaaatataacttattaaacacggcgattcaattttgggctcccagtgcaaataagtttattatttatttagtaatcagaacgccaaaactttgcaaaacttgaatttttttggggattttcccttgtaaaattagaagagccgatctcgagttaaaaactagacagctaaaaaataaactgtgattcgatagagggggtcaaactatgggcctatgcaaaatttgaagaaaattggtcaataggaaaaaatttttttcaaggacaaacatttcaataattttaatccttttttagccaagtccacaatttaaggccaaaccaaataaaatttacaatattctccagaattttcccttcaaaatgagcataaaatggttctatttgctctagtattcaccaagttataagctaagaaaatttcataaaattgtcgatgttgtacgtaaccaacactttttgaatataattttttattgacacgaaaactttattaataaaaaaataattctgccttcttctgtaaaagaagaaattgaaattaacatacaacataaggaggactcgaacctgagacccccttttggtgactaacgcacagaccactaagacgaaaaaaccaacttaattgtacaaggagcccaaaattgaatcgccgtgtgtaacgatgtggtgggacacaaaccgacgcgaatgccgtaaatgaaccttacaataattacttaattccagttccctcgggagtactgtcgttgccttcttccactcctttaaactcgtttatcaagaacggtaaaaaaaagtttgaaactaatatg

SEQ ID NO: 116655 - DNA, 533 bp, Heterodera glycines
  Promoter: Source sequence=SeqID_6222; Location=3386..3918; Strand=-; Gene=SeqID_60776
tgactgccctcagcgtcaaaatttctcgaaatacgcagcgtctttttgctgaaacaatcaggaaaatttgctcaagtttacaatttttggcggatcaaacaattgcactcgctgatgcaaacccgacccttttggcacgtttttatttggcaaatccctatttatcagcaagattagtgacaaaagagaccctggaaataaagccgtgttttccattacttgaacgtgacatgcattttagctggcaaaaagggcattgttttgagcagctccccattacttttacattatatgggagacaaaaacacggatttttggacaccaaaactatgataattcgctcgagggcgagcgaaacggattgccagaaatatcgttttttatatatggcaacaaaggaaaatattttgcaatttgaccaattaaatggtgatataaatcatatcccctctgattctctccatcagctcacacggcatgggaaaattgattttcctgaatttccggttcagctttttaagaataaagtaatg

SEQ ID NO: 116656 - DNA, 181 bp, Heterodera glycines
  Promoter: Source sequence=SeqID_5826; Location=488..668; Strand=+; Gene=SeqID_59345
tcatcacaatgcaaaacacagtcagttgaaaaatgagggtttacggatggattaaattaacgaataaaagagcactaaatttcaaatggggtacttttccgttttgggaccaattctacgcgcttgtctgttgatttaaaaaatatatattcaacctttggccccaaaacggaaaagtatg

SEQ ID NO: 116657 - DNA, 1003 bp, Heterodera glycines
  Promoter: Source sequence=SeqID_3831; Location=2594..3596; Strand=-; Gene=SeqID_45654
tatttttttaaaaattttccccaaaaacttcctttttttttgggatttaaacccttccacgcttttttttttttaaagttggggggcctttttaaaatttttttggggatggggggtccgggaaaaatttgtaatttttaatcgagattttttccaagtttttttcaaaaagaccaaaacttgggattttggttaatttttaagaaaaatatgactatgacttaatacataaaatttcaaaaatctcaaaaatacatttttaaatgacataataatgccataatttatcaaaaatattgttgagaattacatagatttctcaaatttcttgattttttttaaacatatccaaatgctcattttcaaggacgtccttgcatacaaggacattttttattttcaagaaagaggatcattttcaaggacgtccttgccattcaaggacggatggcaaccctgatataaaaagattctgttaaaagcagaaaaaaaattttcaagcaaaaaaccgaaaacatttttaattttatgtttctaaccccgtagcccgtgcccatgtgtgcggaaaatgccaatctctactaaacagtcaaaaaaggcagtgacaactttttttgaattagcgcaaaaaatttacaataaatttattggcgttatgaaaaagcacattgagcggtgagtcattttttaaaaatctgttaagaacaccgttaagaaatgatcaaaaaaagttcctggcaacgtttatcggcaccgccggacaccgtcctcttcccaaaaatttttgaaaaatgcttcgtaaaaaattgatttgaaaagcaactctaaacatactttttggcatttttattacccaaaattatggctcacaatcaaatcagcaggtgcctaagaaagtgaaagtccaagccctaccgaaatcctttcatccccttatacatgacacaattcaaattacctaattttagataaaattcaaaacttagtacaattaattcgaatg

SEQ ID NO: 116658 - DNA, 999 bp, Heterodera glycines
  Promoter: Source sequence=SeqID_2376; Location=1819..2817; Strand=-; Gene=SeqID_79408
taaaggttgcatccaaatgtaatttttttttacattgaagcatttggatggcttgctgtttacagttggctaagtcttctttgcaagaagtagcacaacttttgtttgggccaacgaccccaaaccattcgaatagcaatcgattgggctgactagactgcatatttgcatgaatagcaatggcaggtctatcttaaaggcctgacgagttatttttcgacaaacatcctgtacaccataaatcgatttgcaaatttagtcgaactatataatttttcaaaaaatgattcatcttttttatggttagcgcatatgtctctagctttatagaaacggtccccgaatctgcgaggaactactttttagagaatttctatagattattattttgcatgaatccttcgcttaaattcccatttatctcagattaaattaattaccccgatttgttttagaattggtccaaacacgcttgctaatagcttttcttttcgaaaagagaggtaaaatgggtgcgcgcatgaatccgttgggccctgggccaatgccaggggcattggcccaaagcgcggattccccaattgaaggctgttatcaattaacaattggtttattttgcgttgaatgaaaatgtgaggaaaaagttaagaaggcaacaattgatcagatccccgatcgcaaatcccaacagactgatcactccgatctctcccctcaaattttatacgggtaacaggtgggcgggtcgggtgccaagacagaaaaaggccaacaaacagaaattgggatgactggcgacagagaaaaagaaattgtgagagacataggggaaaagaagtcaagacaaaagggaagacataacattcccccacacctgggaaagccgtgccctcacggcttaagctatgccagggcagaagggaggggaacgaaagagaacatcaaatagagagaagatgagataaagagggagagaaagaaaaagattgtttgaaaatg

SEQ ID NO: 116659 - DNA, 197 bp, Heterodera glycines
  Promoter: Source sequence=SeqID_17409; Location=2490..2686; Strand=-; Gene=SeqID_47442
ggtcattataatattaatttattaattatattaatcgcatggcacttttagtctcggggtgaggccgtacttttggagatcggctcgtttatgctcggcgcaaatactgccaattcggacgtcgacgtcattttcttagtgcccgaaaaggcgacaaaaaaagaggaaattggcaaattttttggcacgacaaaatg

SEQ ID NO: 116660 - DNA, 91 bp, Heterodera glycines
  Promoter: Source sequence=SeqID_6364; Location=1..91; Strand=+; Gene =SeqID_61269
ttggtataattcttatggtaatttgaatctaaaattattgaatgagcaaaaattgaattataatttaaaattggaaattgaacaaaaaatg

SEQ ID NO: 116661 - DNA, 295 bp, Heterodera glycines
  Promoter: Source sequence=SeqID_23939; Location=1583..1877; Strand=-; Gene=SeqID_54629
aagcacgaaaaacgcattttgatcctggtttggattgtctacgatgacttttataatgcccttttttgcctatttcgccatttttgacgtcttttttaggttttcgaaaaaatcctttacaaaaatgcaataaaaaagaaaaatataacctaagaaatgacccaaaaacatttcacataatacactttaagaaatgcctgtttggcggttttttgtgcctaaaagtggcagcactgttaattattaaatgtcctggtactcatttatccaattatcccctcattattttaagatg

SEQ ID NO: 116662 - DNA, 289 bp, Heterodera glycines
  Promoter: Source sequence=SeqID_5437; Location=4309..4597; Strand=+; Gene=SeqID_58037
aaaaatattttttgtaaataatttaataatttttaataaaaattccaattttaaaaaagaattccaactcaaattcatcaaattttgaaacatttattcgctgtcgcatgaaacgaatcgccaaattatacgccgaatttgagcgacaacagaaggaatatttcgaatatgtgcaaaatgtttggatgcgaccggacgaattaatcgtaaaaagtgcgaaaaatttaaatggaaaataataaattccgaaaataaatttcaatttttaaaggcgtttttttcaaaaatg

SEQ ID NO: 116663 - DNA, 457 bp, Heterodera glycines
  Promoter: Source sequence=SeqID_12849; Location=338..794; Strand=+; Gene=SeqID_76579
tgcatgggaatagaaaaacaaaaatacatttttatttaaatataaaaaatttagcaaatatttgaatttaataaatttgtgtttgaagctttagttttttaattgatacaaattttgaaatttttaaggaaaaattttttcatgaaatgtttacagtgactaaattatcattcaccaaatcattcatgatctaacgagaaatcttctatattagctgtaatattttaatttttttttttgcaaagttaaagaaattataacaagaaattatttttttatttcagttattttattattaaattagaaaacttaagcttttgagcaaatacaaaaaatagaaaattgttttttttgccgaaattgtaattttattttttcattttcttccacttggcgcatttaagaatttttaaattaaattaaaaagatttaaattttataattaatcagcgctatg

SEQ ID NO: 116664 - DNA, 175 bp, Heterodera glycines
  Promoter: Source sequence=SeqID_2059; Location=5811..5985; Strand=-; Gene=SeqID_77586
aaaatgcttcagcaagtggatacccagcaccgtgcagagatgtcggcattgacgaagaggagcgtgagcgtcgacagcaggactacatcaataagccgtgggagggcaacaaagtgtgcctcgatgcgaacaaaattatgccgaatcccggcctacgttatctgtcgaagctatg

SEQ ID NO: 116665 - DNA, 313 bp, Heterodera glycines
  Promoter: Source sequence=SeqID_697; Location=4862..5174; Strand=-; Gene=SeqID_59217
aacacgcggggacagaacgaacggcacagtgtcgtgagtggcacaaaagcgcattttcacattcaacgcagtttttcaagctgtactttatcccccggttgtttccccccgcaaaattaaaagaaaattccatagacattttttcatgaaaaatttaattttgttaggagtgcaattctttgtttttccttcgtcgaaataatagttttgtaacgtcaatctacgcatttccacttttaaaaatatgctaaccatgaaatttctgttttattaatacacaaatcgaacatttgtcagtgaactgcaaaacatg

SEQ ID NO: 116666 - DNA, 1003 bp, Heterodera glycines
  Promoter: Source sequence=SeqID_8977; Location=1439..2441; Strand=-; Gene=SeqID_69896
aaaaggaaatttttatgaaattattcttgaatgctgaaattaataattatttttgctgccattttaaagtaatatttttgtgaattgttgtgaagaaatgtgcttgtcagtaatcaccagtcacaacagtcacctgttttaaagattgaatgtcagtcaacctatgtaaaattattttgaatctttcatatttttatgaggaactgttcctcatatgaccatgctttgctgagtaatacatggttttatcatgttaaagcaattttaatttaaatataaattttttttactatggttaagaaatttttcatttcgaaaaattaattaccgacattttgccaattggaaactgttagtgagtttattggcagattgccaactgtccaaatgtctatagatacgcctttttttcattgatattttattattaaaaatttatgtcgactgccattttttaaaaatgatattaatttcattgttcactcatacaaatattttaaatcgtgctgaacctttctgtcatttttctatatcaccgtttaacgcacatggtgtcggtttttatgatacatatttttaagattaaggattaggaaataaatcagttttaattgatcaaataaaaaatggttttgctataataaagcaattttgtttttcaaaaaattaaactaccgacatttactctagtatcaaataaaattaaagaacaaagtaataaaaatagaacacagatgggacaaataaataaattggttgacaaaatgatttaaatattttaagattatcaaagacgagtttaaatccattccaacacattaaaaatatgcaaatggaacgcggcgacgcttctcacaattaattcccataacagactatttcctcttgaaatattcttccgaaaaatgatattcatacatgtattcgtaagattcagaaggcatcgaatgggcaccaaaagagggctaaaatgttggctggttgccggaaattgatggaaatg

SEQ ID NO: 116667 - DNA, 874 bp, Heterodera glycines
  Promoter: Source sequence=SeqID_3423; Location=3445..4318; Strand=-; Gene=SeqID_84627
tgttattgtgttgggtggagctgtttttgaaaaaagttctgctgccggtctcaaaacactaataaaataccgtctaaaagcagtgccaaatccctgaaaatgcccaagacattttcggtaattaattaataatccatttgttaattcgtttgtttttgtccttcgcaacacattaatctttatttgatcagctaatgctgcttgcttcaccttttgcctttaatgaatgtaattttaattaaaatttccttttcttgaatttcattttcgttaatttccgtttaaaatttcgccaaataaaattggtggcactgcttttcttcttcgatccgcgcggtgatgtggtgggtagtgccacgatgtgctcatcgacagcaaaatttgggctcttttttgtctatgttttgtttgccatttttattggcccggcaattttcggcgattcgcaacaacggaaacggactttccgagtgcatttctaccgaaaaccaggcaaatgcaaaggccttttgatagtgtttaattgatcgggttaatgttatggtggtggaatggcatttttatttggaatttatcggaagtaaaagaattcggatgaactcatttatttggcatttcttttcatcattgcaattttgaaaaaaacaatcgaattaaatatttaatggtgtccaataaaaataacttaatgtttaatggagattaattaactgcaatttaaaccatgcaaataagcacaaagaagccacattaggtaatcatttcaaaattggcaatttaattgaaattaattatttcagatgggccatggctttcacttcttaattttcgggttgtccaacaaaattttgaccacgatttggaagatgagatg

SEQ ID NO: 116668 - DNA, 70 bp, Heterodera glycines; identical to SEQ ID NO: 110053
  Promoter: Source sequence=SeqID_207; Location=3228..3297; Strand=-; Gene=SeqID_77581

SEQ ID NO: 116669 - DNA, 193 bp, Heterodera glycines
  Promoter: Source sequence=SeqID_3614; Location=1..193; Strand=+; Gene= SeqID_51123
ttctgttccatgtgcgctctttcatttgttgtccatcctcttcactgttttggcatatttttaccctggtaagtgaatgttttagtgtaatcattggttactgtattttctacagtatcaatttcgcttttcttccctttagttatctcactttacacttggccttatctgatcgtttcttcctcattttatg

SEQ ID NO: 116670 - DNA, 752 bp, Heterodera glycines
  Promoter: Source sequence=SeqID_16333; Location=732..1483; Strand=-; Gene=SeqID_80718
ttttgaacgttttgttgttgaactgttgacggacgatgttgacgatgatgattggttgacagatggcaaaatgtgtgaacgctaaatgaaatgtgtgacacaattagaagacaaattgatggttaaaaattaaaatgagaaaaaactggagggaatgatttttgactcgaaaagtggccatatttatacactttttgagtgtgattttcacagaaaaaggaaaattaatgatcgaaaaatttataaaatcattgtcgtaaaaaaacgccaatgcattcaaatggaaaacaagtatatttatgtttgataaaattcctaatcataggaaatccagttaattaactaatgccgggtttgaatgccaagattgggttcaaacttacattttttctatcttcaatggactaaacagctttaaataagcgattgaaagtgattttatgtgatagttttatcgtcagcaaatttttgaaaaaataattaatctttcaaacaacataattattgttcctaataacccaaaagaacgaattttcttaaattcaatgctgtttaagacctctaagattgaaaaaatgtaagtttgacccgattttggacatagtcgcaaatatcaggtcgcaaatgtctggacacgatattttcccttgcaatttaattagattcaaattgaaaatggaaatggaacagaccaagatggacgtcattctgatccagttttggatttagcgtcatcaaatccaacacatatg

SEQ ID NO: 116671 - DNA, 248 bp, Heterodera glycines
  Promoter: Source sequence=SeqID_21784; Location=871..1118; Strand=-; Gene=SeqID_52390
ttcacggccatttagtgcatttgaatcgattttggccaatacatgtgaatgttggtgaaaaaataattttctacttttgttcgaattcggaatgcgaaataggtcgaaattgatgtcatattcttgatcagcgcccacgaaaacccccgagcactactcagaattgcataaaaacccctttttaatctcttttttttatgggaccaataaaatacaggattacccgattatgcgctaccttgacaatg

SEQ ID NO: 116672 - DNA, 798 bp, Heterodera glycines
  Promoter: Source sequence=SeqID_7620; Location=713..1510; Strand=-; Gene=SeqID_65429
aaacgattttatttttaattaattatagttttatgtataaaaaaacatttttaaagctaacaacaaaaaaaaaattaattttttactatattattttttattaaatttaatttaagaattatgatttaatattaatattaaatatatctctcattattctttctatatataagtgatacaaaaatttattttattttttttatataataaaataatttattaaacttttgaattttttaaatattttattttataattacatttttagaatcatttaaatggttcaccaaagaagcaaaattctccaaaaaacaacaccgttttagtgcaacataataaaaacaaaatttcaccaccacaaaatccgaagacgcctagcccagttccaaatcaacgtccaataattgtaattaaacaaatttattttaatttatatattttaatttaatttttatccattttttccatttcaaaaacttcccatagtccaattagtaaattcgggaaaattttggggaaaattcatttttcaacccattcaaatttatgtaaatgtaaaatcatacaccaaaaaatcattgtaaaattcttttttttaaactttctgtaaccaattgcatttttttcgacttttctgagatcattaaataggatttttgtatttagactataagccctgatttgccgtcaaaaaacagtacgccaaattcaccaaagaaaggcggcaaaattagtgcacagccagcccattcaactgttccggggccaaaaaatgccgaaaaaattgtgcccacaatg

SEQ ID NO: 116673 - DNA, 284 bp, Heterodera glycines
  Promoter: Source sequence=SeqID_28115; Location=464..747; Strand=+; Gene=SeqID_58767
tgattttccgagtgtttggccaaatttggcaccaaacaatgtttttggaatggaatttccgccgaatctatcccaattaaatctgagattgggtcatcatcattcaatcccattaattattgttaagcacaaaatgaagaaaatgccgaggaggaggatgagccggaacagaaacatcagcagaaggacagccaacaaaatggagcgaaaaatgggaatttaattgcataattaagctgaaatgattttaaatttatttctcttaatctacaggtcagaagatg

SEQ ID NO: 116674 - DNA, 74 bp, Heterodera glycines
  Promoter: Source sequence=SeqID_11240; Location=355..428; Strand=-; Gene=SeqID_74600
agctcggcattcaattaggcgcattgcgacattgtgccaaaggggtgatcagtgcgattgaccaacaccaaatg

SEQ ID NO: 116675 - DNA, 166 bp, Heterodera glycines
  Promoter: Source sequence=SeqID_34857; Location=626..791; Strand=+; Gene=SeqID_64558
aattattaagctatacattgggagcaggaaaacggctttctctgcttttcgactggaataaactgtttaagccattctctcgcttttctttggaggaaaatggtgataatttaattatttatgttttaatatttcaaatttggcattctccacaattctcaaaatg

SEQ ID NO: 116676 - DNA, 65 bp, Heterodera glycines
  Promoter: Source sequence=SeqID_20724; Location=1178..1242; Strand=-; Gene=SeqID_51286
ttttccgatggtttaccccgtcttttcaggtgttggacttgttggacagacgaaaggggtccatg

SEQ ID NO: 116677 - DNA, 175 bp, Heterodera glycines
  Promoter: Source sequence=SeqID_1202; Location=1161..1335; Strand=+; Gene=SeqID_69859
aaaaactggcatgacaaaaagacacatataatttttcaaccttttatttctataaaaattgctttattttttattccattgaattaataattgttttcattatcaataaacccatgtttttttttaaattaattttccaatttggttttatttctttacaattagtccatcaatg

SEQ ID NO: 116678 - DNA, 117 bp, Heterodera glycines
  Promoter: Source sequence=SeqID_43518; Location=1..117; Strand=+; Gene=SeqID_71156
atgatgatatatgtttcacgatttagcctttattttcggcaactaaggtcatttaaagtcaccaaaaaagtcttaacttaaatttacagtcctaataatcatgtttttagcaaaatg

SEQ ID NO: 116679 - DNA, 461 bp, Heterodera glycines
  Promoter: Source sequence=SeqID_3392; Location=1480..1940; Strand=-; Gene=SeqID_84510
ggtagggaatatgtattcaaattattgtcgggattttgatggtcttgattcctccgtcgtaccccttccggcgaggaaattttaaaaaaatttaccaaaaccaaaacctagactaaaaaaatttaataaacttttgaaaagcctcataaatttggtaagtttttaaaaattttcttgtcttaacaatttttatttgttttcaaaattttttggattttttggcgcagatagaaaaaatttcgttgataaaaatctagttcccctccccccaaaaaaaaagtcttaagttttggtaaattttaaaagtaagaaatttctcagcaatgactttttttccgtatcattactcaccttgtccaaaaaaattaaatttactttttgcttttatgatagaatttcactagaaattctcgcaaaaaattttaaaatatgttgtgactgaatgtattttcagttacatg

SEQ ID NO: 116680 - DNA, 346 bp, Heterodera glycines
  Promoter: Source sequence=SeqID_21224; Location=890..1235; Strand=+; Gene=SeqID_51815
tatttagtttttgataaataatgaatttccaaaaatgaactataatttatttgcaatgcagataggtattcaattaatgtttaaataggtaacaattctccgaaaacaaaccacatataacgtgaatgtgaatttcaatataaaaatttaattccttgttttaaattttgtttccaggtacaaatactatatataatgttctgtttctagaaattctttgcctaagagatctttgtcccatatgaattcgtttttagacaattaatttttgtggcatttaaattttcaattctttggcatttgaggaacaatttcattaaaattattggctcagtttttgagaatg

SEQ ID NO: 116681 - DNA, 171 bp, Heterodera glycines
  Promoter: Source sequence=SeqID_6935; Location=3321..3491; Strand=+; Gene=SeqID_63341
aatagtcaattttctttttttaacttttaattgtttccttggcttggcttaggacccaacggacgtcggagtggccaaaacggcacacaatcggcggccgcacccgcggggacgaggcggtgccgaagcggagaaaatggcagagggaatcggcaccggcgcgaacaaatg

SEQ ID NO: 116682 - DNA, 725 bp, Heterodera glycines
  Promoter: Source sequence=SeqID_8747; Location=3329..4053; Strand=-; Gene=SeqID_69097
caaagtggatacaaaacttaaaaaatttttctgccggccctaaaaaattggctcaaaatgcaaaatttgttcatttttggacaaaatctattaacaaatcatacaaaaaagtaaattttcctcggcggcgcctatcacacagccggaccctctagttctccaaattttttttctgaaaaaagcgcgcagtaaaaaagtattttgtaaaacaaaaaaagtcttcacatgggcttgacttaatcccaacccgggccgcccgtttaagcggggtttttttgaccgggcggccagggcccggccaattgtcgaagcccgagcccgggcccggcattttcaaaattccgttctctaataaggacaccatcgaaataaggacaaggcggcccactcgaacgaatacaaatctcagttattattaccattgaaaattataattcattcttaatgttttaatcaaattttgaacctttacacatttttaattgttaacaagggcacataatttttatgatggcattttatgttcttcaccgcacaacaaaattggcggaaaatttaacaaaaataaaaatcatctaattctttattttaactgttctaccactcaaaatattttgtataattaattaattgctcacaccccatccataccctacggctgaccttttgtgcgtgaaatttggcccattttttcgacaaacattcgccatttacgctttaacatg

SEQ ID NO: 116683 - DNA, 920 bp, Heterodera glycines
  misc_feature (53)..(53): n is a, c, g, or t
  Promoter: Source sequence=SeqID_26976; Location=1..920; Strand=+; Gene=SeqID_57711
ataaaaaaatcatttaataatgggattcaacagaaacggaaatattagcactnttgtggaaaatattttacttacagatttgaaggtttcagacgcggtgtagaatcttaaaaaattaatattatttaaatcttttataagatttacgcgataaaaattaagtaaatagtgaagttcatgtgatcttaatagaaaatggataatgaaaaggtggtttattgaaaaaaatggtgttaattcgagtgcaggatctataaataaattaatattattttaatcattaaaaatattttagttatataaatgataaatcgaaatttattaatgctctgataaaaaaatcatttgataatggattcaacagaaacggaaaaattagcactttgtggaaaatattttacttacagatttgaaggtttcagacgcggtgtagaatcttaaaaaattaatattatttaaatcttttataagatttacgcgatacaaattaaggaatgtcgtggcgacaagaaatttgcgtcgaactctgcggggtgaaggggacgggaaggggatgaaatgggcgaggcgcgcagagtagccgttcgggggaatgtagggggtcgggaccgatcggagagcgatgagtcgtgccggttttcgtccaggcaaatagaccaagttgggcacaattttaataagagtatgtttattgtgtcgacctcaaacttgggtaattaaaccgtcccaatcgggacggtgagggaaacgaaaaatgggggacaaacatgataatgtgaacggggaaaagggggcacaaaaacggtgacagtaaataaatcacaaatggaaaaatgtggcaaaatcaaaaggggtcagaacggcgttgggaaaaggaagggcattcgggcaacggctggtccaaaaggggccacacaatg

SEQ ID NO: 116684 - DNA, 151 bp, Heterodera glycines
  Promoter: Source sequence=SeqID_35643; Location=117..267; Strand=-; Gene=SeqID_65159
tttttgtgccgtttgctaaacagttaaaaccaaatcatccatggtaaaactcacaaaataggtgttcgtgtaagcattttccgatcgctctgatcacttttttgggggcgggggaggaaatgacagagaaaggacggcccttttgaaaatg

SEQ ID NO: 116685 - DNA, 557 bp, Heterodera glycines
  Promoter: Source sequence=SeqID_2111; Location=1..557; Strand=+; Gene= SeqID_77906
gcaaatttttgatgtttgtcgcagtgtcacttcatcaagtaacggaaaagagagaagcggacgaaacggcagcggagagggaattccttttttggcattttaccgcaatggcatttcggccatttgccctctaatttgggttcattaacactctttaatcgttcctcttttacactttcaattttattttcttttcattcatttcatttacctaatacattttctattaatgaatattatttttgttcgtttatttttataaaattaatttattcattcgcttttttatctctttttccatcagtggaatttgcacagtttttacaatttgtcatcgctaacacttttccgcttctatcaaaaaaccatccggcaaaaatcggctctgattttgctaatgagtcatttttcgtccattataatgaacaaaataatggatgcaaaaaaataattatgctaattcaatactaaattatcgaaaatattgataaataaataaataatattggaattgaaaaatgaagaatttaaaaaatatacagtaatcacgataaatg

SEQ ID NO: 116686 - DNA, 568 bp, Heterodera glycines
  Promoter: Source sequence=SeqID_13036; Location=358..925; Strand=+; Gene=SeqID_76817
agttaataaacgaatccaaaaaaaggaaagagcccaaaattgccggggcgccataatttgtaactctaatgattgccacaccatttatctcatcatgataattccatttattgtcatattatattgtccattgtcggatttatcagtgtccaattgtcatttgccgaattgtccggaaacgttcggggtcgagctattaaggtttgaaccaatccattgaaataaatcggtgattcaattccactcaaccagttaatttaaattttttgccggatctatttttttgattattccaaaccgctagcctacccccatcaatggtaagagatttataaaatggtagcctcaagtgattgtcgatcccatgacttcggtgcagcgaccgcctttcacccaaaccagaccagtgctcagcctttctcgggcacttagtatttggtttttggcacctatttatgtgcctaatttgagatattgagcaccgaaaaacaaagccgttacaattataggcttttcctccctttttgccttgcaaatgttccgctgcttacgtctttttccgccaatg

SEQ ID NO: 116687 - DNA, 813 bp, Heterodera glycines
  misc_feature (61)..(61): n is a, c, g, or t
  Promoter: Source sequence=SeqID_20260; Location=1221..2033; Strand=-; Gene=SeqID_85063
gataaatcttcatatgttagccgaaaaaatggatttttttgtcaagcttaaaaagtttctntaaggcattttttaaattttctcacgaaaaaaacaaaataattttttgggattttctgaaaattttaagtcaataaaattaaatatatgcaaacaagtctaaaaacccggagtttgtgttcaaaaagaattaaaaatcatgtatcaaatgattgtatttgtcaattttttaaaaccacttttttattttctaaatcggttacaatttgtttgataatcaaaaatatttcttataaaattttgttaaaattattcatcaagaattaatgtcaaaaaagtccaaagaatgaataaattgccttttccgtcgatgattaagctggataatgctcaataaataccaaagcataatttacaaattaataatcgaacgtgtaaaatttaagcagcatgttaatttattcacaaattctaaattcaagagcataaaaatgttcaaatataatttgtacattctattaatttttattttgtgtgagaacatattaaaaaatgaggcgattcgttataatgaggtttattacttagtatttattcattaaaataaactcgtaaatcattaaaaaagaaggatgtttaaaataaacccattcattgttttttggattaattagcatattttatttaccttcaggtgagatcccaggctttaaaggtatgctttaaaattcgaaatattttttcgattttatgaataaattgcaattataattttgataaatgaatgacattccaacctcattttaatcaatg

SEQ ID NO: 116688 - DNA, 60 bp, Heterodera glycines
  Promoter: Source sequence=SeqID_38787; Location=1..60; Strand=+; Gene= SeqID_67503
aatattcgtgactttcgcgcaaattcaaataaaaccaatgggtccaaattggctgaaatg

SEQ ID NO: 116689 - DNA, 187 bp, Heterodera glycines
  Promoter: Source sequence=SeqID_6753; Location=1553..1739; Strand=-; Gene=SeqID_62748
tcgctttgctgtgttgatttttggctcgttgggacagtataagccactctacaagtacattgacaacacctacgacacaccattgctgctatatttcaatgaggaccatttcgatggtgtgcagaagcagggcggtctgttcggtcaaccgtactgtttggagtgtgaacggccatacgacaaaatg

SEQ ID NO: 116690 - DNA, 92 bp, Heterodera glycines
  Promoter: Source sequence=SeqID_3974; Location=721..812; Strand=+; Gene=SeqID_45688
attcttttactgtttagaactgaatcaatatggcgaaaaacaatatcaacattaaccgtggcgttcaagaccctttttatcgttacaaaatg

SEQ ID NO: 116691 - DNA, 388 bp, Heterodera glycines
  Promoter: Source sequence=SeqID_19885; Location=567..954; Strand=-; Gene=SeqID_84643
ttaagcggcaattattcggtttttacaaaattaaactaatccaagcaataaacaaatgggggttggaagtttttttttctggtttatttgtcgaacatcgccctaatcaattcggcaaaagaagttcacaaatattcttactttggttgtgctgtacttttacaatatatggttctgttttagtgggtgatatggagaaactcaaaaaaagtcaaacttttttatttgcagaagtataataatgaaacctaacaatttcattgaatcaacagaatttccgtgagcgcagaggggaggatttctctaccgatgtgagtgctgaacgcccgtacggtttgtcgaattacaccaacttcgacgccaacagcggtcccacggcgtacgcatg

SEQ ID NO: 116692 - DNA, 840 bp, Heterodera glycines
  Promoter: Source sequence=SeqID_3221; Location=1..840; Strand=+; Gene= SeqID_83753
attattattattagaggatttgttgacttttagttttgtttccctataaataagccattttaagaccaaaaatgagaaattcgaaatttgaattttcgactttttgctcgaatccggattcggggttctacataggtcgaaattaatatcagattcggattctccgacccttaaaacccctaatataatcttttctcgaaaaaactaaaaaatttgttttttgaaaaaagggggcctaccatcggtactattaccgacagcaaataaagcctatatggaaaaaataaaatgccaataaatcacattattgtcggaggtcatcttttcgatattgaaataaatggtcaccgtttgaaacgctttaccttgttactgatctaaaaatttgaaactttcatttacgtaaatcagagtataaatggggcggggattgtcaggtctttttttgttccaaggaatttttgcatatacgagtttagaaaaagtaaatttaaaaaatttcaataaatcattaaaattaaaaattttttggtttctgtgacaaaagttagacctttcaaggaatgagagttgaaccaatagggacgacacactaaaaccagaatgacgttttagacgataatcttcttcaaattttatatatcgatagcaaaaaattttcattaggtttcattttgaaaaatattaatctcgttggggacttaaacacgactccataactatgcacaattaaaaaaacaatttccgagcaatttttcccacccaattttacatagaaatcacgaaattaaagattgcggaatttttaaaaacataaattatattttcagaatcaaaatg

SEQ ID NO: 116693 - DNA, 241 bp, Heterodera glycines
  Promoter: Source sequence=SeqID_18021; Location=1183..1423; Strand=-; Gene=SeqID_82595
ttgtgagcaggtcgctcctagggttttttgtgacccaaggcgcctcccgcttacacggtcggacccgacgagtttttcgtaactcgtagcgtccttcttcatacactgtaagactcttggtgggtctgaagtcaaactcactttgtccactgtttgtccaacttactgctattttgtgaccccgaaccccacacaatttgttcggaagtcgggtagcagaacccaaaagtgagcaaaaatg

SEQ ID NO: 116694 - DNA, 403 bp, Heterodera glycines
  Promoter: Source sequence=SeqID_10208; Location=1..403; Strand=+; Gene=SeqID_73332
acatttattttttatttaaagtatatattaaatatacgaagcaatcaattcacgtattgtattaaaaaaacgtaaacgacacaagagataaaaaagagccaaaacctaaaaccgaaaaaaattgtttaaaacataaatgaaaaaaaaattaccaatttttaaacatatcaaaatatatattatcaggagttttatcataaaaatttaagatttaaacgctgatatgtattaaaataaaaagtgaaatttatttttagagtattttattcgaattcaagaggaattattgatatttatgcaataaaacttcgaatttttagcaaaattatttttcatttaaatcagaacttttttgaaaaaatcaaaatatttttattttgttaaatttgaccctccaataatg

SEQ ID NO: 116695 - DNA, 145 bp, Heterodera glycines
  Promoter: Source sequence=SeqID_20182; Location=1237..1381; Strand=+; Gene=SeqID_84970
cgtgagtttggagattaaaaagaaaataaaatataaaaacgcaaaaatattttaaataatttaatattttttctgtcacagtgccaaacaattggccacaaaaagtgatcagaagcggcgtcggttggcactattggcagaaatg

SEQ ID NO: 116696 - DNA, 467 bp, Heterodera glycines
  Promoter: Source sequence=SeqID_30984; Location=584..1050; Strand=-; Gene=SeqID_61343
agctgttttctacgctatttctaaaacggttatacccatccccagatttttgaatccggttttcagaaaaaatgccttgtggtgaaaacaatatttcacatttcactccataactttgtgagttcggcacggatcgagaccgggataagaccattggaaagagcagctcgagctctacaagaacgtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaaataataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 116697 - DNA, 929 bp, Heterodera glycines
  Promoter: Source sequence=SeqID_4544; Location=1..929; Strand=+; Gene= SeqID_54840
cacaaattaataggttaattcttatttagaactcatttgtttttaattaaataataaatgaattgaagaacttctctgcattgaaaatttcttttattttttcctttttattaaaatttcatcccctctgactttcttggcatttattcggtattctttctgactataataaaacagtaattttcctgctctaatttaggatttaaaaaaactatagagttcgattaaagtttacaaaaagttacagatagataagcaagccaaattaaaaaatacttttctagaaaaaaactgggggttaaccgggcgatgtcaaatctgtgaaatggtgtcacagattatgtatggcacgcacctttctctgttaccgaaaccaatgaaaaaatatacaaaaatttattgagaacaaaaaactaagcattcatatgtcccgcgacagtaattggaaaacccggaccaggacaaggatttttgatcggactctttttactccgtacaaaaagtactgtcttaacaagactccggtcctgttgcattttcctaaaccttaaccggactacatatttggcatcctcaatcagttgtccatctccgtcagaaaaaagtaaatttaatttttaacatttgaaaaccaccctattataaaatcggtattaatcataaattgagcaatttgtttattagctgtattattttattttaagttttttcttctttccatcacttttcctccattgtttttttgtccatcttttttatccattaccttggaaaaaacttccagtcggtgaatcaatcatttcttccattccaattggccacttttggccaatccttcgtttttcattttcattgattcattttatcatccgcataaattgttgcataatattaaatgacatttttcagaaccaaagtcatcaaaaatg

SEQ ID NO: 116698 - DNA, 1003 bp, Heterodera glycines
  Promoter: Source sequence=SeqID_926; Location=3858..4860; Strand=+; Gene=SeqID_64219
ttaaatttgagaaaatctgttcatttctgaatttcgccaatctctgtcgaccaatataacaaattgagccattgaatgccgggacgcgtttttgcaattcgagaaaaagtgcgcagaaatccaatgagaccagctcaaatcgtctgaagtgactatcgttaagccattttatttgaacaaacattgacgataaattgctaaataaaaaaggaaaatattcctttttctgctgatgcatttgaaacatttcgccataattgtttaattttttcaaaattatgccgatttcgatctttttttggttgattgatgccacataattggagatgcctgtcctttaattttcaagtaaaaagcagtaaagccatctaaaaaaggaatttgtatttcgtttcaaagacttcaagacctttctttgaatttccccgtaaaatgttcctcgtgtgttaatggatgtaatgagttttgtgccgcctctttcgtgggcttcaacttcagtcgatggaaacaacatttttcaacacgtgcagtgcgaatttgccatggttaaatttattggcattttgtttgaattccccccaatttctcgaagaaaatgaactcaacaatttgcttgccattttgcatcgcgtgctaaactctctgctcgatgactcaatgcgttccaatcgcgtgcttttggagggagtggaaacgcgagaaatcagcgactttttcgtgatgttcgagaaagtgatttggcacggttttcggactttttgtaaaattaaaatttgaaactgaggcaaaaatgtaacatttatgcattgcagcttctttgttggccaaaaagaggcccgaggcgcaactttggaatttaattgggcagacaaacgaaggaaagggcgaaattggcaatttatacgaaagcgtaaatgagatgagcaatttgaggtgtgattggaagaaatggtttttattggctattgagataacaaaattcagttctccgctcgccaaaatg

SEQ ID NO: 116699 - DNA, 228 bp, Heterodera glycines
  Promoter: Source sequence=SeqID_14712; Location=3296..3523; Strand=-; Gene=SeqID_78840
tcggcggcgccgcacaagcacacagaacgacactccgcttcaacactacgcgcgtggagataaaagaagacatggcctgaagttgtgaatgagtcttaaagtctctttgcttttttcatatgcctttttgatcgtctagttttcttattttgtaccacttgtcgtctttatcagtaatgtatagctattacaaaggctccgctcttctcgagacaatcctcgattatg

SEQ ID NO: 116700 - DNA, 72 bp, Heterodera glycines
  Promoter: Source sequence=SeqID_2596; Location=1321..1392; Strand=-; Gene=SeqID_80628
atgtcattttaaatgtaatttattttagtcggtgcgactgtgttggaattaaattttattcttggccacatg

SEQ ID NO: 116701 - DNA, 154 bp, Heterodera glycines
  Promoter: Source sequence=SeqID_2321; Location=1005..1158; Strand=+; Gene=SeqID_79115
atcggctgagggatttggagcgagaaagggacattttgagggcaagacttgccgaaaaagaggactccgtccggacaaggtgacgacaattgggggaattggccaattaacccaaattgggatgttaattagtcatgagcaattggtggacatg

SEQ ID NO: 116702 - DNA, 798 bp, Heterodera glycines
  Promoter: Source sequence=SeqID_12098; Location=1509..2306; Strand=-; Gene=SeqID_75658
tgtagccgttgccgaaatctatcagtcagggctcacctatcttattttgccaaaaaggacattgagtgcagctatggaaagtgtaaagattgaccaatacttaaagaggccagtctgagtgcccaaaatcccatgagggtaggcaggctgtattggccacagacaaaccatttccattatgagagttattcataataaaaaagcaaataatagcgttggttagtagtataataaagaatccacaatctccaatatgagtagattctttaaaaaacacaagcacatataaagcatgggttaaaaacaaacaaagaaaacactatctccggtaggagcaggttctttataagattataaagcaaaaatacaataagcgttggttagtaatgcaataaagaacacacaatctccagtatgagcaggttcttgaaaaagcacaaagcacatataaagcactggttacaaataaacaaagaaaacactatctccgataggagcaggttctttataaaactataaagcaaaaatacaataagcgttggttagtaatgtaataaagaacacacaatctccagtatgagcaggttctttaaaaatcaaaagcaaatataaagcgtttgttagtttaatgctgatagcatagctcggttatgagcaggttctttcagttgatcctacgttaactctcaccagtccactggtcttggcaaagtgcgggaccagcttcgcaccggatgttggccgttaacgataaggaattattgtaaacctttcggactacaatcgcccgataaaatg

SEQ ID NO: 116703 - DNA, 163 bp, Heterodera glycines
  misc_feature (19)..(19): n is a, c, g, or t
  Promoter: Source sequence=SeqID_7088; Location=20..182; Strand=+; Gene=SeqID_63811
tgtagagctcaggaatttnaactaagccaagtgcgaaagtgataacgtaaaacattgaaaatgaataaaaaatggaaaagaaaaacaatttattcacaaaaaatatttgtccaaaatattaattaaaatttggcattttgccaattaataaagtgaagaaatg

SEQ ID NO: 116704 - DNA, 350 bp, Heterodera glycines
  Promoter: Source sequence=SeqID_5433; Location=1..350; Strand=+; Gene= SeqID_58011
ctcggataaattataaataaataaataaaaatattattaattaatgttcaaaaatgaataacaccaacacaacaaaacccgacatacaaattttgaattcctcagaagagcctaatgaaactcttttgcatgtactacttttttctcattatcttcttgcatttcccgtgtttttgcttttttggttcgttttaattaggtggcttaaaagtctcggtcacttatcgcccagcgaggccgagtcagtaatggaagaaatgcaaaatatcccccgacatccaccaatatttttcgcaacaaaatgacgcagaggttaaagaaaacagacactgaactctctctttagtatg

SEQ ID NO: 116705 - DNA, 540 bp, Heterodera glycines
  Promoter: Source sequence=SeqID_29397; Location=427..966; Strand=-; Gene=SeqID_59899
aagaaaaaagttaaagtccagaaacttggctggggcccaactgacatagacccaacagtgattgaattgaaaagttacaagaggatcgagaccaagaaatgacatcataaaacagcaagaaatttcttgttctgaaaattctcgctcagcaggtcccctaattgattggccctaattgaagccataattttgattttcactttttttttttgcttctagctatgagatgaaatcatttttttaacaaaggaaatgaaaaaagcaatataaaaaacagcaacaatttttatttcaattgaaaacaatgtttacggaggttttcgaaagaaaatggcttttgttgtgcttttttaattaaaaaatggaaggctttaaacatagaaacatttgaacggtaacaaatcattataaatttttgaaaaaaaaattatttctcacttttgctctacagtgaaaaagcaaaaataacaaaaaaatttcattttaaatttcctctttttaattttgtttttattctagtgtttttaaaaatttaaaatg

SEQ ID NO: 116706 - DNA, 116 bp, Heterodera glycines
  Promoter: Source sequence=SeqID_31127; Location=1..116; Strand=+; Gene=SeqID_61509
taaaatgttattttaagcctatttaggtcattttggcccttcttttactcctttctactaattttttgtcccaaaaaattcatacaattttttaaatttaatatacccatttcatg

SEQ ID NO: 116707 - DNA, 618 bp, Heterodera glycines
  Promoter: Source sequence=SeqID_30441; Location=1282..1899; Strand=-; Gene=SeqID_60846
ttttgaagggaaaattctggagaatattgtaaattttatttggtttggccttaaattgtggacttggctaaaaaagaattaaaattattgaaatgttcgtcgctttcaaaaaaattttctagcttttaaaatttcttcaaattttgtataggcccatatttcgaccccctctatcgaattctattttgttttttgaaagtatattttctaactcgagatcggctcttccatttttacaagggaaaatccccggaaaattttaagttttgcaaagttttggcgttctgattactaaataaaaatccagcataattgtacttggagcccaaaattgggccgctgtgtaatgaagcaaacgaaatcagaaatacggatgtttttattttcgacgaagcacctatggcacctaaatatgttcttgaaataatagacaaaaagttacgagaattgcataatagtacattggtttttggaggaaaatttttaattttaagtggtgactttcggcaatgtttgcctattaaaaataaagcaacgaaaagtgaaatattagatttaactttacaaaaaagcgaattgtggactcattttaaaatttttaatttacaccaaaacatg

SEQ ID NO: 116708 - DNA, 287 bp, Heterodera glycines
  Promoter: Source sequence=SeqID_2874; Location=3302..3588; Strand=+; Gene=SeqID_82086
agaaaagtgtttttattttctgcgaaatgagtctgagtgccgagttatgacgtgccaaacttttttttattgcaataaattaaataaacatttgcactgttttgtgttgttcggtggtgcggaggttgtgctcctgccttccctttttgccctcgcaggttcgaatccctcatatgttaatttattttccccgttttatttttgattttatgcaaattaatggccattgaaatcaattccatcgggtcaaaaatttttattcctcctccaagtcattcctaaatatg

SEQ ID NO: 116709 - DNA, 90 bp, Heterodera glycines
  Promoter: Source sequence=SeqID_42941; Location=726..815; Strand=-; Gene=SeqID_70731
agatgacggtcgggaggtggcaccgatcaggagaaggagacgaagttgacggccggaagtggcatcgacccggagaaggagaagaagatg

SEQ ID NO: 116710 - DNA, 1003 bp, Heterodera glycines
  Promoter: Source sequence=SeqID_6935; Location=1036..2038; Strand=+; Gene=SeqID_63342
taatccaatagccataaatcactcacacttttccgccacatattatttgtatgtatttgtatgcaaaaagtatgggtttggaagggatatttcacttacatttctaaatattcgcctcttatcatattcgtattttttcggattacaaaagataattatcctctgctcatcattttacaattttcatttctatatttgttttgttatttttcatttttacatatattttatttccccttggcttttggccgtgaaaatgttactaatacaaacacaagtcatgtaccaaaatatattcttcttattgcaacttttttgggtttttaaacttaccatatttacagtaaattgagaatacaaataaatgaaagttgaagtttgaaatgatcgattgttggagcatgacggagacggactgaattttgaccttgcaaaatttgcaatttttgctgcggagtttgggtggtgcaatgacgggttaagaaaaagggcgggtgaaaagggagaggtaactgaacgaaagtgccctcaaatgtgcaatttatggagatgaatgggttggcgggtggcccttctctgggtggtctttgcgagttaacatttctgccttttcctggtcccctgcggggtcattttccgccattccgtccaatccgtcgcattcattcggtggcagccgttttattggcgtagtctttggtctccgccccttccattgggtggccctgccatccatccgactgaataaacaacaaaacgtcgtccaattgataggccgcctccactctttctttagccaggcgctgataactttttattatcatttaaaatatgtatcaaacattttgtcatctcataaatttttcacaaaatacataaaaaaaataattaattaaccgatttgttttatttttgtaattatatttatgcgttgccttggagttgtaaatatttaggtaatatttccacaattttccatttctcccttcctgcaaaagaaatg

SEQ ID NO: 116711 - DNA, 117 bp, Heterodera glycines
  Promoter: Source sequence=SeqID_5941; Location=3814..3930; Strand=+; Gene=SeqID_59746
attaattaatgatattaatttagttaaataaataaattaagtaattataattgatataattaataattaacataattattaattaatataattaatccaatgtaatgctttagcatg

SEQ ID NO: 116712 - DNA, 1003 bp, Heterodera glycines
  Promoter: Source sequence=SeqID_10284; Location=608..1610; Strand=+; Gene=SeqID_73452
gcataaatttcctatttcccctggactatgtgaggtttgaaacacacgaaaaacatgtttagcttgtttttaaggtttagcatggatttgctatatccgcattttccaaatttaaaattcttcgcagttacattaaagacaaccttaagcccaaaagtgaaaaatttcgccttttaggtcgtttattttattaattgattatgtgttttccaacatatttagccattttcgaaagttttaacttccattttttaatatgaagaggttttggaaaatttgcctacaatttggtaaatttatttccatttttttgcaattttgcgtccttatttcggaagttttagcaattttatggatatttttcgcgattttattgcaccattcgctttctctgatcgagagaatccaatataacaaatcaaagttgggaatattcttcaattattatttccaataatcctttcactgctctaatgaatatttaaaataattacattaagtcaaatgcccaaagacaatgcaacggtttatttgaatttgatatttttcatcggcgaagaacatgaaaaacaaaggaaaaagtttttggtggaaccaaaaggttcaaatgggttcatctgctgctctgtcacagccgttaattgctttgttttatgcctaaggaacatttttctgctggtgaaaagcgacggacgcggtctcacccaaacgcaaagggttaatagcgcaattagtggggagaggggggggggggggtataaaagaggctaatgacactcactcgcgaacccaaactaaattaggcgttaattagcttttggttatgattatatacattcctatatatatgataacaacttgctaataaaaaataaaaatatttaattttaaaacatgggataatcagtgatcgcaaatgctcttaactcatttgaaaactcattaatttatagctgcgtaataattattcaaaattaactgccttggtaattttagcctcatg

SEQ ID NO: 116713 - DNA, 425 bp, Heterodera glycines
  Promoter: Source sequence=SeqID_9310; Location=1406..1830; Strand=+; Gene=SeqID_70958
tctttagaaacccgagagtgaattttgaaaataatttctattttagcgaaagtttaattaatgaatttgtgttgaagtttcaaaaaccaactaaaattaaatcatttaataaatcgattaaataattatatcaataggaaatcgagtaaaattttatgcttcgtttaaaattaatttttcactattaaaatttgttttattttcattttaatttttttcgccccgcccattaaaatcatttaattattacgggtgtgtattgctgtgcgttaatttgtgatgccgagttttggtaaatggttgccaaatttggcacattggccaatgccaataagttggccatgtcggccactgtgtaggcagtgccttgaatagtaaccagtgttgtgccggattgaaaggccaaccaattgggcaaaagaatg

SEQ ID NO: 116714 - DNA, 377 bp, Heterodera glycines
  Promoter: Source sequence=SeqID_39034; Location=664..1040; Strand=-; Gene=SeqID_67703
aattgtcaaaagatcaatctaatacaaattaaatagataccaaattaattaaatgtccaaagagtattcatgcccacgtgaaatggtatttggcatgcatatgtgtttttagagatgggcacggtcgattttatcggtaaatcgagttttcgatttatattttttgatatttaatcgtaaaaaacggtcgataaattttcttgtttttcgattgccagttttgaataattacggtattttcattctgaatgatgacgcaaccctgatgttaatctgtttttaattaatcagtaataattaatatcgttttggattttctaaaaattttaaatttgtccgattatttgcatataaaaaaaactaatcatttcagtatg

SEQ ID NO: 116715 - DNA, 216 bp, Heterodera glycines
  Promoter: Source sequence=SeqID_1810; Location=3160..3375; Strand=-; Gene=SeqID_76103
aaaggcgccgatttagtgtatttctctcacatttgttacattcactgttaaccaaaaataaaaatgtattttaaaagcgctactgctattttattctttttgattgtttttattggtatcgaaaaatgtgcatcggctaatgcaaacaaaaccaaacccaagggggcagtaagcaccaccaccgccatcaccaccattaccacaaccactgttatg

SEQ ID NO: 116716 - DNA, 306 bp, Heterodera glycines
  misc_feature (52)..(52): n is a, c, g, or t
  misc_feature (59)..(59): n is a, c, g, or t
  Promoter: Source sequence=SeqID_1358; Location=1796..2101; Strand=-; Gene=SeqID_73010
aatttcgccaaattaacaatttttatacataaatgcgaaaaatcgaaatttntagtttnttcttaatacatttttataggcttggaaatcttttgatttttttttgattaatagcattttacaaaacattaatttggctaattaaagtcataaatcctaatttcaataaataaataaaccgttcaaattatttacataaaagccactctgaatactgctgttccggctgctgcttctgtccatggcttttcgccacatttactgctttcaaaaggatattttgaaattagtctgacccgtgccatg

SEQ ID NO: 116717 - DNA, 467 bp, Heterodera glycines
  Promoter: Source sequence=SeqID_31299; Location=97..563; Strand=+; Gene=SeqID_61662
ggtcaaatttgtgatcaaattcgaattttaaatgacaaacaaaagaggaaaattgtggaaaaattccataaaaaataaaattaataaaatgggaaagaaatactcgagaaaagaatggaataaaattgaaacgaaaattgctcaaaaatcgggtgttagttataggaaaatctacgaatggtaaagagaatttggaatgatgatcataaatagttattcatatgagcaaaaacttcaaatagtaaaacaatttgatcaaataaatggcaaaataaaaaaaaataaatgaaaaattggagagaaaaagagaaaaatgtcaaaaaataataacaaaatcagaagtattaatagatggaagaaagaaataaaaaacggaaagttggagaaaaaccaaagaatttttgagcaaaaaattgaaattgtgaaaaaataattcaaaataaaaaacgaatttatacaaaaaaatg

SEQ ID NO: 116718 - DNA, 132 bp, Heterodera glycines
  Promoter: Source sequence=SeqID_30364; Location=1..132; Strand=+; Gene=SeqID_60778
actaacaagggaacctcgcgagctgttagtcggaaaatgcatatgtgtgatataccactggatataggagggtcgatttctattgtgaatttttaattttacgggacgatagcgaaaaacaaaaaagttatg

SEQ ID NO: 116719 - DNA, 349 bp, Heterodera glycines
  Promoter: Source sequence=SeqID_18807; Location=3121..3469; Strand=-; Gene=SeqID_83489
gtgaaatgtatgattttttaagcgggggcaggggtctggtcccccgcccccggggccttatactactggccccgttggtagatttttcattggcattccgtttttttccaaaaaggggggggggggggacaaactacagaattaccatttttcttagtccgttttttccgtgttataagttccgttttactacacatcaaagtcttttttaggcctattaatgtcttccaaaagcaaatatctccagtattttaattgcgacataattccaagcggcaatttatggttttgccgttctgaaaattgcagctacaaatttgaatcaaaaaaattgtctgggtatccaatg

SEQ ID NO: 116720 - DNA, 1003 bp, Heterodera glycines
  Promoter: Source sequence=SeqID_16192; Location=35..1037; Strand=+; Gene=SeqID_80555
ttttttgtttccaaatggttaaaggcgctgaaaagttgttggaattggtcggcccggtcggtcggtgtccatccaaccgacccatccgtccccgttaaattgacaccccggggcatgcaaaagcggcacaactgacaaatcccctgtggcatttgcccccggcgggcgtcaaaaacattcggcgccgccaaaagtggacggacaagcacacaaaaagctcatccattttttgtttgaaaccggtcagaagaagcgatattaacacagctaaacacagccgagaaaagaggggggaaagtgtaataagagtaatttaaaaatggaaagctacatttaaattggatttcaggactaggaaaagtggataaccgaaagggataccggagataacaaaaactaatttttgatcgaaaaaccggcaaatccggcctaattgaaagctgaaaaccacgtcctaaaacaaaagagttaagtaaaaatgtcaaattgagaaaaatgccaaaaacattgaaagaaggcggaaagtcggaaaagaataattattaatggattttcattgaaaaagtcacgagcagcagaaaatggcggcactatcaaaagttggggaggaaagaaaatgaatggcaatgaataaaaaaggagggggaatagggaaaatggggaaagaaaagcaaaatggaaaaaagaaaaacaatgcaattttaatgtgaattaaagcattaaacagctagttgaatttaagaccatttaaattttattttcattttcatgccatttttctaaataattccaagagaattttaattaattttaatccggaaattcgaattgcgacactttcgccttttgctgaagaattcattttgtgcacattaatttcctgctgagcgccataaaatgaggaaattgaaatttgaggagagaaagtgaaaaaggcaccgaaaaggaatttaaaaaataatttaatttataaaaaaaacttattatataatagattaaaatg

SEQ ID NO: 116721 - DNA, 344 bp, Heterodera glycines
  Promoter: Source sequence=SeqID_9756; Location=1166..1509; Strand=-; Gene=SeqID_46810
aatttttaggaacatttgaccatattgacaaaatttcgaaaatctatgattttcaaaatcgatgatagaatcaatgctttttgcaagtctgatatcatattcgtgatcagaagacccgaaaaccaggggttagtctttttataacaaaaaaaaaaaaaaaaattatttgggtggagcccagattctccagtattaccaaatttccatactaattcctatgtaaaaaaagtccaaaacttaggttggtcggttaattgttaattggcttcataatattgaaaacccgtttccgattatatttaaaaggctttatgagtttagatctataagtgcaatcaacaatg

SEQ ID NO: 116722 - DNA, 1003 bp, Heterodera glycines
  Promoter: Source sequence=SeqID_14712; Location=1080..2082; Strand=-; Gene=SeqID_78841
caacaaaaaatttctctctttgggctttccgttaaatttctccacatttttcccctgatcacttctgaggcctttctaatttttggtgctttgtccaccctttgaccattgtgaattagccagtggcaatttaggcgtttcagcggaaggaacagcacaatcataaggcaaccaactcagcccctgctaatggcttgctcttagttaatttggtaatatttggcccatggacaaaaaaaaaatccattttcccataatttcccattgttttttatgtacctcaatcctcgagggactgggaaattgttgatgatcccttagccaaagaagggtcaccgaggaggagtttcatgggtataaaacggttggtcagtcagcaatctgctcggatttttgaatccattgtcgttttttacgccaaacattaattcttcaactggtttttaatcaaaacaacataattgagaatttcacacttcctttgtaaaaatttatgtcatatttctggactttttcccatattttatgcggaacccgtcagttgggcgccgacacgtttgggcgccagcaccttttcagttataacttttttctttgtcaaccaaattaaacattgttggtaccattcaaaagcctaagtgtcctctattagcctgcaaaattttgaaaaatttcattaaggttcaaaaaagttatggccagaagaattcaaaaaaccagatttccaacctttttggtcaaaaatgtgttcaaaattgacgaaattttttaaaattttgcatgctaatagagcatattaagagctttcgaatgataccaacaatgttggatttggttgacaaagaaaaaacttatagtccaaaaacctgctggcgcccaactgacgttgacccattttatggccctaaatcgctttttccgttcatacctacctatgctaattttcagccttgaaacctctttttttctttgccaaccatcgcttctctcacttctctaaatg

SEQ ID NO: 116723 - DNA, 318 bp, Heterodera glycines
  Promoter: Source sequence=SeqID_26566; Location=892..1209; Strand=-; Gene=SeqID_57301
ttgtttggaatgagttgcgcaacatcactcaaatttttaacatagattatcaacattaattaaaaatacctaataaataattaatgaaaaataacattttttgaaactgtataattaaataataaataattaccattttttgaaattgccctttcatttaaacaaacaatttttataaataaatgcttattctttttgttttcatttttaacctaattccagtttttaattattttaatatcaaaatttatttttatcccaatttcgactttgttaagcccctttttttagctgatcgactccgacggttgcagcatg

SEQ ID NO: 116724 - DNA, 329 bp, Heterodera glycines
  Promoter: Source sequence=SeqID_32266; Location=1072..1400; Strand=-; Gene=SeqID_62583
ttatgtcactcactattccccacaacccctagacgcccctcactcgcacaaaaactgacgctttctgtcttgcgcgatcaccgcgcgcgtcaggccgggggtattccaatgatgtagttacattttggtatagagcgcctgagttactcttgggcagctacaaatatgcctttggcatagacatatggagcgtgggctgtatattttatgaaatgatacagcgtaagccacttttccgaaaggagcaagtggaaatacagctgcgaaaaatttataggtttaaaaaaataaataaaatcattaaacttttttcttattttagcataatg

SEQ ID NO: 116725 - DNA, 209 bp, Heterodera glycines
  Promoter: Source sequence=SeqID_12686; Location=179..387; Strand=+; Gene=SeqID_76364
ttataaaatcagaaaagagttgaatataaaggtcatcaaggtctatcgactccttccttcacttggcagtgagttatttgattagtgcgaattgttaccatcggcaaggtatgataatgccgaaacgtctcacaatcagcctatttaggtggagaataaaaaattaaatcagaatttagatcacatcacgcaacaaatattttaacatg

SEQ ID NO: 116726 - DNA, 572 bp, Heterodera glycines
  Promoter: Source sequence=SeqID_11059; Location=1..572; Strand=+; Gene=SeqID_74394
ctttttgcacttggagacgggcgacagcgcgtcgcccctttaacggacggtcacttccttcatgggcttcacctacgagtgagaaaaattttaaaaaatggcattttaattttccatatataaaatatccattttttgaagcctatgaatgtgtgaaataatcatattttgagtttccaacaaacaaacaaatgcacatttccttctgattgtatgccaaattttttggccataactttttttaaacatgccaaattggcattattcgaaagcatttcaaaaagtctattaatcaattaaaaaatcaggtatttgaaccaaccttataactttttagagttatttaatggctttccactcgcttaaaaatagcttctatttatatatggagctttaaaattatgccacttaattaaaatttatgtaattttttgtaaaaagttttggcccggaaaccttgcttttccctcctaaatgtactccctctaattgcatttgtcatcagtgaatacgcaactgaacattatcttccggccgaggccaccggggagaagcagtacgagcagccaatg

SEQ ID NO: 116727 - DNA, 1003 bp, Heterodera glycines
  Promoter: Source sequence=SeqID_10566; Location=1429..2431; Strand=+; Gene=SeqID_73804
gacgacgggataaaacctgtgaaatgaatggaattggtgcaaaatgttgggtttttttgcaatcgcaggtgtcagaaatgaatgggggaaaagaggggacaaattagcgacgcgaacgaataaattttgtgcttttcaccgccaattgtgagagcaaattgaaaaaatggtgatgaaatgaacacggctttcattggctttctgttttgttagccaattgaatcgtttttttttcatcaaaaattcaaaacatttttccaccattgtgccattttatgaaaaatgtcactgatctttggcttaagagatcggttgggtcggtgacaagttgtggtaacacttttgtggttttgaatttttgatcacagatacagaaaatttcaaaaaaaaaaattaaaatttcccataaaaattttgaaattttgtatggtcatatccaggggaaacggaaaagggggggcacgacgtgtccccccccccccccttaaaattaaaaatttttgcaaaatttgtccgaaaaatggctaaatttggcgaaaatgcctaaaaattccctattttttccaacgacttacaaaatttttttttttaatttattggaaaaaaattttgggccaaaagaaaaaaagagtcttcgtgtgcccctcctgaaatttttttctggatatgggcctgaatttcatttcgcgagggatggtgatttctgaccatgaaatggaatgttttcttttcttccatggcctatccatcccgatagcccgattagagtcaacagattatgttaatatcgactcttactgatccgaatcttttgggcattcctggtcctggtccaaaatttcagcattttaccgatggtgatccgctttttggtcacacaagtcttgattagagttatggcataatcctcccaactattcccacgatcccgacatatttgaacaaacaatccccacttccaatcgaaaaatatcatctggtcaatcactgatctcatctaatg

SEQ ID NO: 116728 - DNA, 119 bp, Heterodera glycines
  Promoter: Source sequence=SeqID_23514; Location=379..497; Strand=+; Gene=SeqID_54206
agtgagcacaaatacggggcggaaccgctctttgaagagcattgcttgagtgaatttgcacgcaaaccgaattggaacgacagagagtggcgcaagaaaatgaacgtcggggggaaatg

SEQ ID NO: 116729 - DNA, 526 bp, Heterodera glycines
  Promoter: Source sequence=SeqID_5049; Location=2678..3203; Strand=-; Gene=SeqID_56716
agcaaaaaggaagaaaatattcagccaaagaatggagtaaaattaactcaaaaatagcaaaaaaattggggacaaatcgacaatatattcaaaaatggattaaagaatttggtcttcaaaaatacaaatcaaaaactgatgaagaaaaactcacaattgtacaaaaagatgtaaaagaataacggatgatgaaaaaatgggaaaaatgcaaatttattggaaaataaaaagagaaaagtcacggaacattcgccatggccacgctgaccgataattgggcgaactgtatataagagaattggaaatcatggtcgcaacagaacaagcaccgcaaaacaatttgaaaataaataaaacattttacagttgatcataatcaaagataactttaaataaaatattttacagttaaaaataatttccatgaataatttatttgttcagaataatttaattcaaataaaactacaacaaaaaattttagaaaaatttaataataaatagataacttatgttttaatacatg

SEQ ID NO: 116730 - DNA, 350 bp, Heterodera glycines
  misc_feature (34)..(34): n is a, c, g, or t
  Promoter: Source sequence=SeqID_24839; Location=1..350; Strand=+; Gene=SeqID_55588
ttttacgggaatcactgtgatagacccaaatatnaatatgatagactaaaaggtctttttacataaatgacatgatagacacaaattaaaaagatattttaaataaataatttttcgtgaaactatcagccaataattgattaaaaattatttattaaaattatatataaaattcctttattttttattgtatccaattaaacgggccataaaattcaaattggcagagaatatattaatgagtatttaaaatacaaatattttttttatatccttatttagcatttcataaacttaaagtataatcaataaacgaggagatgcacaatttccgcaccgacttcaacatg

SEQ ID NO: 116731 - DNA, 141 bp, Heterodera glycines
  Promoter: Source sequence=SeqID_6249; Location=118..258; Strand=-; Gene=SeqID_60877
ttctctttgacatcgattaggagaggagattttatgcttcttggagcggcggcctttggtgccggcctcgtgagttgtcctaccatcggtagtattacctaaatttgttccaatttttagttatgcggtcgctcgctcatg

SEQ ID NO: 116732 - DNA, 86 bp, Heterodera glycines
  Promoter: Source sequence=SeqID_35410; Location=1..86; Strand=+; Gene= SeqID_64962
tcttggaaatttctgcttcagcagcgtctgttgtcccaatcgataaactgaattcaaaaccgttgaaagtacccattgagaggatg

SEQ ID NO: 116733 - DNA, 208 bp, Heterodera glycines
  misc_feature (44)..(44): n is a, c, g, or t
  misc_feature (49)..(50): n is a, c, g, or t
  misc_feature (87)..(87): n is a, c, g, or t
  misc_feature (103)..(103): n is a, c, g, or t
  Promoter: Source sequence=SeqID_41108; Location=1..208; Strand=+; Gene=SeqID_69303
ttatttttgcgtctcctttctcccagagcagcagatcaaacagnacagnnaggacagaccccttgtgggaacaacgctacgaaacgnacaaaaacaatgcggnaagaaatttctactttttaaaagtcattgcacataatgcatttttgaccgacagacaatcgaccaggacaaaaggagcaacattgagcatttgtacaagcaaatg

SEQ ID NO: 116734 - DNA, 195 bp, Heterodera glycines
  Promoter: Source sequence=SeqID_40173; Location=472..666; Strand=+; Gene=SeqID_68589
ggtgagtgaagaggcaaaacgaattcactcttttttccatggcacattcaatctattcgtttgggtcaatttatggatttgacgatttggtatacaatcaaacaatgctttcagttgattagcaatggtgcatacggcgccgtttatttggtcaaacatcggcggagtcggctgagatacgcactgaagaaaatg

SEQ ID NO: 116735 - DNA, 538 bp, Heterodera glycines
  Promoter: Source sequence=SeqID_11704; Location=259..796; Strand=-; Gene=SeqID_75191
atttacaggaaacgcggaagaaaattggaaaatttcttaaaatttaaataaaattcttaacttaaagagtgtgacaataaaaggggcgaggggttaacatttggaaaattctaaaatttttaaagctggaaacctttacgagaaaataagctaaaaaactatttatttttgttggccctgtaaatttttagttttctcaaaaaaaatttgccaagtttttttaaattttagcacattatgttgtttaattatgtttgaaaattttaatttaaaaaatgataaatgaaattttaagcttgtaaataattaaaaaaaatattttcctttcaaattataataataataaaaataattattctatttaagtttaaaaatgtaataattaaaaattcttttatttctaaattctataaaaaaataataattatttaagtttaaaattgtaataataaaaaaataaattcaaaccaaatagcaatggtggccaaatttgttccaatttggtccacataaattgtagcttgtcggttctgaaatg

SEQ ID NO: 116736 - DNA, 837 bp, Heterodera glycines
  Promoter: Source sequence=SeqID_74; Location=1088..1924; Strand=-; Gene=SeqID_63055
gtatgaaaagtttattgggggaaaaaaagactttacacttcacacccgcatgggagaagggagtgggaaacatgatttcaacttttcaatgttttctagtctaatctactcaaaacggttcagaattcaataaaaataacattcacggtgcgaaaaatggggtttgaaaagtttattttgaaaaaaagactttacaaaataatacccctgggagaagggagtgggaaacatgatttcaaaattttcaattttttatagtctaatctactcaaaacggttcagaattcaataaaaataacattcacggtgcgaaaaatggggtatgaaaagtttattgggggatgttggatagtgaataatttgaatttatggcgatctgacttattgactttatttgttatttctatgtccatccgccccctccctcgtccataaaagtggacacctcctcccactttttgttcttccctttcatcattcatttatttatatttccaatttgccctccgaccgaatcaataaaattatttatttatttctttttctttgtgtgttctaagtggaagaacacaacaaattggcgcagtcagcagccattcttcatcactgaggacaaggacagctgcaaattcaacaaaaaccaatagcatccaggtggtgtgaggtctgctaagaagcagtttaactcaacaaaaaaaaaccaatagacctaagaagggtgaggttccgcaagaagcgggttttcaacaaattcgtcagcttagcaccaaacggtgtaagcatccaccaggtgtggattttgtggactttttcaacaatttcaattgacggacaatg

SEQ ID NO: 116737 - DNA, 957 bp, Heterodera glycines
  Promoter: Source sequence=SeqID_3673; Location=5911..6867; Strand=-; Gene=SeqID_51387
ttgctattacattcaattagttatcttatccgcaagtcctttcgcattggcgatgcaaatgtgcatcggattagaccgattgccggtgttacgtttccaatttggtaatttctttaaaatagttaaaaataattatgataaaaatagttttggggtataacccttcaatgggggcgtgctgacgcgtttcctaaacagtgccacccatgcgcgtttcctaaatgagccaaaatggctgtcagcgcgtttcctaaaagtgccattttaatataatatcaatattattatacaaactattccattgcatatattttttgttatccgtgaaaggaagtgtctgtctagactgtcatttgccttgaaaaaaacaaacaaaattttaaggttcagaaatcattttgtatacataaattatgcattagaaatgtaaacatttcaaatgcataaatttagcccctttaattttaatattttgtttctttttcacttccataatgtttatgtaaatattggtgaacctatttaactagtttccgttctattttcactttcaaatatttgtatagcaaatttagggaccaaaaaacggggaaagtaaactaagtcatgctaatgggctgctaatttgttccgtctgtcggaagcgcatttcgcttcatcattcgccgcgcattccgaacaacttttaattagaaatatattaacaattttgttaataagggaagtaaatgtattataaaaacagagggataatattcggcctattagcgatatcattacgttttgcactcataataataaatgtggtaataaattaaatgaataaaaaagtcaagtcaattaattagataaattaagaaaattggaaattcatttttattctgcagcaggtcagtttatttattttttatttataattttcaaaatattttttacgacttttattaagcaaaaatg

SEQ ID NO: 116738 - DNA, 81 bp, Heterodera glycines
  Promoter: Source sequence=SeqID_21365; Location=2672..2752; Strand=-; Gene=SeqID_51967
ttgaatatgtgtgcgttgattttatgaaaatttaaaaatatttttacttaattaaataatattttagcaacgaatattatg

SEQ ID NO: 116739 - DNA, 62 bp, Heterodera glycines
  Promoter: Source sequence=SeqID_19590; Location=2384..2445; Strand=-; Gene=SeqID_84329
aatatcccactattactttgtctttaataatttattaccgaattgataatgagtatagaatg

SEQ ID NO: 116740 - DNA, 302 bp, Heterodera glycines
  misc_feature (8)..(8): n is a, c, g, or t
  Promoter: Source sequence=SeqID_39349; Location=1..302; Strand=+; Gene=SeqID_67935
ataaaatntcgagattatatgaaaaatatttttttttacttatattttccaatatatataggttttcccgggtctaactacattttttgttgaaaaagttattaacaattgagctcaaagaaataaataaatgatgtcgtcctgaacttttaaaaaaatacaaagcattctttttaggaagacttaatcagtgaaaaatttttttataaaatatttattctcccaagtctaaaaatttcctgtttcatgggtcaattctcgctctcggactctaagtttactatttttgttcatcttgaatg

SEQ ID NO: 116741 - DNA, 681 bp, Heterodera glycines
  Promoter: Source sequence=SeqID_8571; Location=903..1583; Strand=-; Gene=SeqID_68565
gcgacgcaaaagccctcgttctcggaggcaatgattgaccgcagcgcgtggagtgaaagcaaaagttagggtagagagagaggaagagtgagagtgagagagagagagagtgagagagtgagagagagagagagagtgagtgagagagagagagagagtgagtgagagagagagtgagagtgagagagtgagagagagagagagagtgagtgagagagagagagagagagagagagagtgagtgagagagagagagtgagagtgagagagagagagagattagttgatcggagagaggcgacagagaaagaagggtaactccaaaatcactttgaaaatgctttatttcttcgggttgcggcaattggtcgaaaagtttaaatgagaaaacaaacaatagaaaacatattacttatctaaataaataacttctgtcgtcgtttctatggcaacaaaacaaacaaaaaatctttccgcgtgggccattaaattgccgcgggtgccgtcgtttggccaaatgctctcctcggctcacaatcaatggaagtgtccatcgtttgtcgtccgtttctttttcgattggatcggttgcgcagcgattgcattgaattgggtcatttgctggaagagaaattgacagaacgaagtcgaaaagaacggcacgagcagaacaaaacgatg

SEQ ID NO: 116742 - DNA, 424 bp, Heterodera glycines
  Promoter: Source sequence=SeqID_14673; Location=2294..2717; Strand=-; Gene=SeqID_78775
ttttaatgtgctggaggcaaaaaaaaagcgttatcgaagacaattgagataataatgattgtttgctaatgctccgattccatttttaagcgattactgtaattttgtgacttttttagatttttcctacgggcaattaaattgtttaatttattttcattttattttctgatcagatgttgaacaccggcatttaggagagtggtgtggtgaaggcgattggatgagtgggcgtgacgaaatgccgccatattcgtttttcaaataattattttaagttgccaagggaaatgatacaatatctttcttgtactgtaatcaattctgcagtttaaggtgataaaaatttccaaattgcttaaattaatcaaattaattcggtcaaaatgcaaaacatgtttttcgcgtcgtcccattattgatg

SEQ ID NO: 116743 - DNA, 893 bp, Heterodera glycines
  Promoter: Source sequence=SeqID_16490; Location=1..893; Strand=+; Gene=SeqID_80896
tgaaattttttttttaatttatgaaagaaaaaaatttccctcacaaggtcatatactcgaaacaattttgaatttctaccctttgacaattagaaaaacaagttatggcctatgaaactttgaacgcgtaaactggaaaaaagccaatgaactttaagtaaaaaaattttcaataaaatattttaagtgacaaaaaaaggaaattttaatcaattaaatgaaaatcaacgaattactagtttttttttaaatggatctgtataattaaaaatttaatttattaaaatacatattaagtcatacctccgcaatgactcaccattctcttttactttttttattcggtcaaattttgcaaattttgttcggccaagcaaatgccaatgccatcgccagtgttgggccacgttttgggccaacccaattgcaatgtgtggcgggttcgaccaaaaaattgacacaacactggaacattcagaattgttccgcaggacaaagttgtgtggcatacgtttgtgcccatggtatgaaaaattgtgtcatttcaaatcatgattagcaattataaaatgcctaaatgatttttatcattttaatgctaattatattacacgtctcatgcttttattaatagttttatttcaaatattccctcgatttaaacaaaatttatataccgaatttcctagatagagccagccccctggggctttatttttcaacctcctcaaaaggggctttattttaggagggcattaattatggggggggggcgctctatttaggaggaactattttaggaattacggtaaattacttcactaattggtcttttacaatagaggaggctatatttagattatgccggagagccggttgaggtcgtcacaatg

SEQ ID NO: 116744 - DNA, 768 bp, Heterodera glycines
  Promoter: Source sequence=SeqID_4472; Location=3863..4630; Strand=-; Gene=SeqID_54576
gccccccccccccccccccctcgtcgtccccccccgcgggggcctgtgcttttgtttacgatttaagcgttttgtgtggggccctaatagcctaaaatttatgtatgaaaattgttgttttcgggtttagttgacgtaatattttgctttcttttttagtgtttggtgctgagacacatttttgctaatatttattctgatcgatcgaactttgctttttgacaaaaaaaaattgacttaaaaatgtttcgaaatgcactttttggtggtaatgatgttttttaatattctcttttactccactcacactaatcaatcacttcattaaatcttaattgcttttgatttattttttttgctcaaaaatcttttcgtctcataaatttttgcatgccttcttttgtaatctgtgcattgtctttttccatttgtattgccttaatcagttttattccaaccggaactctgatcaattgatcatcagacactgtcctaatttgctgatcacactgcctaaaaaggtgctttgctgattaaaagtaattgatcagactttctgatcagatcactgatattgattacttgatgcttaatcgttatggtccttctcatttccattattattatgcatatatctcactcttgacacacaacaattagtgacattcatacacacattgattagtagtgatcaggcctgatcgaatcagcgcaggtcgcttccgtcgctttagcatatccctctttctatacgactgctgcgacatg

SEQ ID NO: 116745 - DNA, 350 bp, Heterodera glycines
  Promoter: Source sequence=SeqID_7945; Location=2097..2446; Strand=-; Gene=SeqID_66462
taatctgtaaaaaatcaataaattggcttgggtttcactgtgtgtttgaattggcgcccttttgtatctttctctaaccactacactctcgtctatgtgtttgtggatgggcgtggcctatcgattaaaagggacagcccgtctggaggtcgctgcgcgctaacacccctctcactatcaatcaataattacgtgttttttcgcaggttcattttatgcttttaacaattataatcataaactatttcttaatcgtaatggcccgagaaaaatcaatgatcaattggtgtttgagaacaaaagtaatcattttttgggttttttataataattttaaatttaaagaaatg

SEQ ID NO: 116746 - DNA, 1003 bp, Heterodera glycines
  Promoter: Source sequence=SeqID_514; Location=6219..7221; Strand=+; Gene=SeqID_54986
aattgtcaatttgttttaattgtgataattatttaatactttaaagagaaaagttttggttcgtttttattttcaaatttaagttcggatgatcaacgacccgaaaaaacaagttttctgtctattcatcatctttcaaaaaatttttgctaggcaaaagggttccgcccttatggtttttaataaaatttaaattgggccatttggccgcactttttccatccagcaaaatccatacaataaaagcatttttcatttatgtccccccccccccccgtattagacaacccaacaatcaatcactaggccaaaaaagggcaaaaagtgacaattttttggcaaaatgccttataaatttttgtggccatataaaacacgtggtaatcagaggaaatacaaatgcttttgtgaattctatgaatttatttataataatcattcattttatattataaataatatttcagaagtaaaaaagaatcttttagcgtataatttcattttttcctactaatgcttcttttttcttctgctctgctacggttttttgtaattttggcccatttctgcgcgattcattcgggtttttaactaattgaatttaattttaaaaatatatttttataaagctaaattgcaaaccaatgaaaattaaaaaagcccgaccccattttgaccttttccgaatcccgaatttaaatttgaacaaaatcgaaaccccaaatttatttttttaccatttttttggaattggtcaattggatttatctgcgatgacgaaaaccgttaaaaggattttcacgtctttttgttaaaaaataattttacaaagcaaagggtccttttggtttttaataattttcaaaattaatgaattatgaaaaagcgtcgttttccattaaattcaataattaattaaaaatgaaaaaattattcttcagcacccgttaaacaaagtgtggaattggtattcacacaaatctcagaaatagtgataaaaatg

SEQ ID NO: 116747 - DNA, 373 bp, Heterodera glycines
  Promoter: Source sequence=SeqID_39206; Location=1..373; Strand=+; Gene=SeqID_67827
ttgaattcatatattttttttcaatttattttttttttacaaaaatttcacattattccatggtggctcaatcggatttgtattaatagttgaatttaaggaatacacctatttcctggcatatgacccattttttacatatattttttttgcaatttaattataatgatcaataattcctatatatttttttaaattaatctttttgttcaagtctgttttggtatgcgaaacggccatggctcgtatacaccggtatacttaaataatcatatattatcatatttaagttaaaaaaaacagtttaatgcatacataattaactaaattaaacaaattaagctattattttgctggccccaaaaaagggatg

SEQ ID NO: 116748 - DNA, 1003 bp, Heterodera glycines
  Promoter: Source sequence=SeqID_11669; Location=171..1173; Strand=-; Gene=SeqID_75132
aaagaataaaaaaaatagacaataattattttaaaaaaataccaagtatttaaataaaaagccgaattcgaataataatattttaatttaataacaaaattgaacacatcttttgagcctaatcgataatgtattggccaatttaatggccatttcatcgctgttccatcgcatcgccttttactgagatgcaaaaaaaaaggggggaggggggggggggcggaaaatccgacactggaaaatccgacacaagcagaaaatccgacattggaaaaaccaaccccaactttaaattttaaaaataatttttgattgtttgagttagtaaatatttaaaatacatataataaaagttaaatacttaagttatttaaaataaatattttattgctataaaatagattaaaggtaggtatataataatcatattatttcaatgttctttttgatcatctcaaaaaattgtaacaatccggcaaatggaatcagatgaaagggcatgaagcataagaatgtacttggtgcaagacatgaatctcacagagatttatgcgactcgcaacaatcgacaacccttttattatttgccatcaatatcccatcgaatggcagaatcaattaatttttttaaatccaaatcgaaaacttgataaacttagccagatattaactcaaacaatcaaaaatattttttaaatttaaagttggggtcggtttttccaatgtcggatttactgcttgtgtcggattttccaccggtgtcggattttctgcttgtgtcggattttccagtgtcggattttccggtgtcggattttcctagagccggattttcctagagccatttttatgggggggggggggtagcaaacctacaagtaccccacaatttttacaagccaactgtcaaatcagagctaatttgttgagcgcgtactgtttgaacttgaacctcttcccccttaattgtagaataacggtaattattataattataaaaatg

SEQ ID NO: 116749 - DNA, 82 bp, Heterodera glycines
  Promoter: Source sequence=SeqID_3484; Location=1..82; Strand=+; Gene =SeqID_84859
aaaaaagaaaatttgcagctgctgtcaagcccgcgttttggacgcttttttccgcttccgagtgacgcgcgcacaattgatg

SEQ ID NO: 116750 - DNA, 279 bp, Heterodera glycines
  Promoter: Source sequence=SeqID_28674; Location=736..1014; Strand=-; Gene=SeqID_59264
ttctacttaaaattttttaaatttaacagaaatctctagtgaaaggacatctttttttctgaaacaagttgtcaccagaaatttaattttgtttttaaaaatatgctgtattcttggaaagcttaatattttcaaattacctgtaaattgtttggtacaaatgttgattatgcttggcaatgcaaatgtccgtgcctgcggcgcaaataatgcgcgaaaaattaaaaaaagctgtctcattaagtattttaaattgaatgcatagtgaattttcagatg

SEQ ID NO: 116751 - DNA, 424 bp, Heterodera glycines
  Promoter: Source sequence=SeqID_12303; Location=1338..1761; Strand=-; Gene=SeqID_75891
tttgaagtgcaaaattaaaaaaaagaaaataattattataattttgagaaaaatattgaatgaataattatgtaataaaataaaattaaatttcgatttaaaagatttgcaagaaaacatttgaattggccgcggattccgcgagtgtccgtccggctgctcgggcagcgcttacacaggcaattttctgtatctgtccgaagcgaattggcacttttcagatgctcaattcgtacgttctgaataaaattgccatcgaggtaaaagcgttttggagggaaatgcaaaagtaccaaaaaacaaatgaaacaaaaaatgggagaaaaaaatagcagaaaaaactgaacaggaaaacagcgaatcggaggaaaatggagcttccaaggacgtggcggcacttttgggcgagttgatcaacagaatg

SEQ ID NO: 116752 - DNA, 147 bp, Heterodera glycines
  Promoter: Source sequence=SeqID_7816; Location=3326..3472; Strand=-; Gene=SeqID_66060
aattttaagcgaagaataaattatcacttattaaatagttatttttgttgaggatatttttatatgagctaagaaattttatttaattaaaaattttcttttgaaaattgtttagatggccaacagagggaattttatgccaaaatg

SEQ ID NO: 116753 - DNA, 338 bp, Heterodera glycines
  Promoter: Source sequence=SeqID_26987; Location=1..338; Strand=+; Gene=SeqID_57720
ccccccccccttttgcctccccccttggttacgggcctgggtgcattatgtttccgtcgtccatatttttgcatcccaccccaaaaatttttcaaaaaaatcttgtccattttttataggaaaatttcaagtaagaaatttcgaaaaaattttctaatttaacagctgggggtgggggggggttggatgacgagctgctccctcatgtttagcgctcaaaaaacaatgaactaattgccctaaggcattgtttcaaattgccttaggcacccaagaagagggttttcaatgttttgaaaacattttgacaggtttctgtccatgccggaaacattatg

SEQ ID NO: 116754 - DNA, 63 bp, Heterodera glycines
  Promoter: Source sequence=SeqID_33548; Location=1..63; Strand=+; Gene= SeqID_63579
aacaaatactaactgttcttttagaatttgcccaactttcttactcaatcgacctcacaaatg

SEQ ID NO: 116755 - DNA, 148 bp, Heterodera glycines
  Promoter: Source sequence=SeqID_2419; Location=3842..3989; Strand=-; Gene=SeqID_79624
aatatagtaataaagtaatcactgcaaaaagctatgtaacagggaattgcactttggttattaattgttcgtattcaaaagaaaatgattagagtaactatttgtactgaaggaatttggtgccgaggcggtgactgacgatgggatg

SEQ ID NO: 116756 - DNA, 489 bp, Heterodera glycines
  Promoter: Source sequence=SeqID_23701; Location=1177..1665; Strand=-; Gene=SeqID_54397
ttcattcacttcatttcacatttcattaaatttataatatttagttgaatggagaataatgcaaattttatgatgatcatttgttaaaattaataaaatataacataaatacctatgttaaaaagcaaaaaaaggactaaatatttttgaaaaatcaaaaaattgataagcctaggtagcgaaactctaaaagttgtacagcgtttgcattaaacttaaatgagttgttttacgaatttattttatttttctgcggccacaataacaaaatgtaattaatggaaaattaaatttaatcaatattttacttattattgccactaatttgttcagtaaaataacaaataataaaatcttatatttattttcaaataaataggtttttttctgatttctaacaattatttcatttataaaatttaatttatgtttaaattatagtaaaaataataattgcttgttaatttttaagaatttttaaataaaatg

SEQ ID NO: 116757 - DNA, 51 bp, Heterodera glycines
  Promoter: Source sequence=SeqID_7298; Location=1089..1139; Strand=-; Gene=SeqID_64393
ggtatctttgctcattggtttcattttgttatttgcccttttcagatgatg

SEQ ID NO: 116758 - DNA, 906 bp, Heterodera glycines
  Promoter: Source sequence=SeqID_4624; Location=1108..2013; Strand=-; Gene=SeqID_55129
tttttcacatttttcgctaataatttttacctccaaaaactaaaaacgataaatttaattaatataaaataatttttgttttaatttttaaaataatttattattttgcttttaatttgatcacttccactttttcgcacttcgcctattttgcaccttttcgtatttttcgcccaatcttgcacttttcgtacttagtcattgcgcctttaatttaattcgacatatttataaaaattcttaatttatttgttagctcatcatctaggctatgtgtaatcattattgtttttttgaccttatatcaaataatttcattaattcgttttttaaatctcttttaaaattaattaatttttcctaattattttattagtttattaattcattaattactcattttgagataggggagagttacgtcgagaatatttgctcacctaacttgtttttttcaattattttttcctattttttgggttgaacaattttgttttttagtccattcgctatacatttgcactgctgcgcacaatttacacttttcaaatttttcctaattgcaaaatgacttcctccgcaaaacttgattgaaattaattggtcgttaattagtagcgttatgatgctttgattaactaatgagtgattagcgttattgagtttacaaactaattgcagaaaagaaatgcatttaaagaaatgaacaattcaaatgaattcactcatttatttaaactcaaaataacctttatatataaaaaatatttcttaattgaaattatactcaatttaaataaaatgataattttcaatttcaaagtctttcactcatcagatgatagggaacattttgaattgggcaattaaaataaattgtccataatttaagaaaattgaaaaatg

SEQ ID NO: 116759 - DNA, 250 bp, Heterodera glycines
  misc_feature (18)..(18): n is a, c, g, or t
  Promoter: Source sequence=SeqID_31861; Location=1..250; Strand=+; Gene=SeqID_62171
tgattataagaggtacancagtgattagaagaggtacaatggtgattagaagaggtacaaaagtgatataaagaggtacaacagtgattagaagaggtacaatggtgattagaagaggtacaaaagtgattataagaggtacaacagtgataaaagaagtataaaagtgattagaagaggtaaaaaagtgattagaagaggtacaatgtgatttagaagaggtacaaaagtgattagaagaggtacaatg

SEQ ID NO: 116760 - DNA, 629 bp, Heterodera glycines
  Promoter: Source sequence=SeqID_42390; Location=1..629; Strand=+; Gene=SeqID_70286
tttttttttcttctaaaatggtttttaataccatatttagccatttttaaagttttactttttatttagcgaattagaaaaaattttacgaaatttagacctcaatttgaaaaatttatgtccacatttttcgccattttatccatattttgtggtttttggtccatgttttatggccatatttcgcgattttatttatacccatatttttttatgccctagttataacagtttctttcttggtcaattgcctacattcttggtatcaatcgaaagcttaaagccccgggaattcataaacacaagaaaataacaaatactgacattaaaaaaaaattacaacgagaaaacacatcgagtacattcaagaataattttttgtattgctcttagcccagaattttgggttcgaaaaaaaaattctacaaactataagccttcgtttgataccaagaatgtaggcactgaccaattaagaaaaaaatgatgaccaaagaaaaaatatggattattccaaaatccctaccgattatccccccccccccccaaaaaatggatttatcattcatatatactaatctacctatttccttttttcgtatagtggccttgtgataactcaaataatg

SEQ ID NO: 116761 - DNA, 175 bp, Heterodera glycines
  Promoter: Source sequence=SeqID_18773; Location=485..659; Strand=-; Gene=SeqID_83447
aacaaataaactcataataagggaggaggatcgagtaaatacttctcacgaatcaattagccagtcaattgatatgaaattttgataagttggataatttaatttctaccgcacttttgttgacctttttatattaaatcaaatcaaattccattttctcacctcaactctaatg

SEQ ID NO: 116762 - DNA, 165 bp, Heterodera glycines
  Promoter: Source sequence=SeqID_6211; Location=887..1051; Strand=-; Gene=SeqID_60726
tttggacaccagcagcagaaattcaaaagtcaaaagaaaattcatcgttgatgctaaaatggtggtaaattttggggtacataattaaaaattaattaattacatgtttaactccccagggaaattcgattgaaaaggaatgtttggaaaagatgccaaaggatg

SEQ ID NO: 116763 - DNA, 296 bp, Heterodera glycines
  Promoter: Source sequence=SeqID_3816; Location=170..465; Strand=+; Gene=SeqID_51990
aaaacagttggatgaaaggtttttctttgtttttacagaaaataaaattaaaaaaaaattcttggcttctttaaaagttgttttatcatttcacatatatttatttgctttaaaaacctcaaaatacagctataacatgcattggattcgaacctgagaccccccttttggtgactaaaaaacatgctggcgcccaaacacgcgcgcccaaacacgtggctcccctgattggactcacatttccgtttaaattaaaagtgaaaaataatgttggcatagtgttttacccgaaaatg

SEQ ID NO: 116764 - DNA, 207 bp, Heterodera glycines
  Promoter: Source sequence=SeqID_37659; Location=1..207; Strand=+; Gene=SeqID_66672
acaaaaaatttcaaaaaatttactttctcataattcaccgttttatgttaaataaaataattttagaaattttgccaaaaaaatagttgaaaatttcttctctgttcaacctgcaatggcatcgccgccggactcgcgtttctgtccaccaccgttctcgacctctgtgccgatgctgctgctggtgcgggtgatcttgacgtgatg

SEQ ID NO: 116765 - DNA, 194 bp, Heterodera glycines
  Promoter: Source sequence=SeqID_45219; Location=111..304; Strand=+; Gene=SeqID_72556
gccactacgtctaaggatggcagcaggcgcgcaaattacccactctcaacgcgaggaggtagtgacgagaaataacgagaccgatctcttatgaggccggtcatcggaatgggtacaatttaaaccctttaacgagtatctatgagagggcaagtctggtgccagcagccgcggtaattccagctctcaaaatg

SEQ ID NO: 116766 - DNA, 491 bp, Heterodera glycines
  Promoter: Source sequence=SeqID_2778; Location=1943..2433; Strand=+; Gene=SeqID_81543
ttttaaaagaaaaaaaacataaaagctaaaatttattaatttttaagaaaatttaaatttattttctttctctctcttcgctttctctgtcctctctcttctctctctctcacgtcctctcacctctctctctctctctctctcacgactctaattttttctcactttctcttttactctctcttctctctctctgctttctctttttatctctttatctctctgctttctctctcttcgctttctctgccctctctcttctctctctctctgctctttatctctctctttccttctctttcccttctctctctcacgtcctctcacctctgtctctctctcacggttctctaatttcttctcagaatttcttcattctgtcccctctcttgcttcttttttcatctctctatagttttcctcttattctcattcctgcacccatcataaatagggcatccaaaaatatggatataaaatcgcgaaatatg

SEQ ID NO: 116767 - DNA, 71 bp, Heterodera glycines
  Promoter: Source sequence=SeqID_43357; Location=1..71; Strand=+; Gene= SeqID_46735
tctttttaatttttataaatgatctgccgtcctttattgctaatgaagcatcatcagttggcataaaaatg

SEQ ID NO: 116768 - DNA, 1003 bp, Heterodera glycines
  Promoter: Source sequence=SeqID_3644; Location=1883..2885; Strand=-; Gene=SeqID_51261
cccaaaaattagattttttctaaaaaagaaagataaaaaaaattaacaaataagcctaattagtttccttttactgtatttttttcttattcaattttttctatgaattttttctataaaaagtttattaaaaaaaatggtaaatatttgggggtttttgtacaaatttcttacacatattttggagttttttttaaattttttttttgaaataatttctaggcctgcagtgtttttgggagtctaattaaattttttaattttgcataacagaaccgtggcaaaaggaacggaacaaaggctatttccatcgagaactccttcaggtatttgaatttgtttaaacaaataaattaattataaattcaaatgatttacatgatttaattaaaaatattcgacatactgtagataccgtatttcaaaaatttgcgcccctgaaaataaagtcacccctaaattttgttaacaaagtgtcgcttgttataaaatgcccgtttttaattttcttttttttcaaattattttcttttgtatttcatttttattttggtaaaaactcaactcgtttttttggtagaattcgaaaatcgaggtacaatcgatgattccaaatattttgggataaatttcagcttaggaatgcttattcaccattttaactgtgttttggtcaattgtggaaaagcctaaatttctaaaaaaaaaattttttccgttattatcaataaaaatgaaaaaagttttaatgtaactaatatttaaataatataattactattaaattttaattcaaataaatatttgaattttaatttgatcaattgcatttatttttcgttcttcgtcatagcaaccatttgcaactagtgccacaatcattcagatagagccgttgcattttgacaaccaaggcattcttttggtcgactttatcgagcatcagtgggccaatttccctttggatggcgttttgggcttagcgtggccctacgacccaatg

SEQ ID NO: 116769 - DNA, 701 bp, Heterodera glycines
  Promoter: Source sequence=SeqID_32581; Location=1028..1728; Strand=-; Gene=SeqID_62886
tcgtctcatgttaaaggcgtgttccttcttcgtcggtctttcggtgtggtggcctcgttggctgggcggccgtgttgtccgcaagttgctctcttccttcggtgcacgggtcaccggtattccgaccgattcgctgctcgatcaattagaaacagaaagcggtgaccacccgcggcgacagtcggtgaaagagtgcatggaatgctccgtctgctgggagacgaccaccgtggacgaactgtgcttttgtgacgggacgacaatgacagcgacaagcagcagctcaggtggtggtttaattaatgaaataatagcaaaaataaattcaacaatggagcaactgctagcaaaaattggtaatactatcgatgaaattgttattttatacaggtacgaacataaaaatgaatttttaaaattttgaattttcgacttttgttcgaatttgggtccaggattcgaaataagtgaaaattaatgtcagattcctgatcagcgaccctgaaaacccccgtaaacatgtttccacaacgttttagaacaaaaaattttcttccaaaaaagggggcaccatcgatagtattacccaaaaattaaccattcgttcaaattaataattgatagctaaactgaccaccgaaactcacgctttttgtcgtcaatgtttggaacgccacgcgcgcgccgctgttgaggaaatg

SEQ ID NO: 116770 - DNA, 189 bp, Heterodera glycines
  Promoter: Source sequence=SeqID_1535; Location=2442..2630; Strand=-; Gene=SeqID_74310
ccttaatttttgttttttttacaaagaaaaattattaattattaatttgggcattttaattattaattgcgccggtggcgatgggcacgaaaatttttttggcaacactaattaagaaaggcggtaacggatgaaagccaaatgtcaattcttaaaatgcaaaataattctgaaatcaatttccagatg

SEQ ID NO: 116771 - DNA, 77 bp, Heterodera glycines
  Promoter: Source sequence=SeqID_8487; Location=2553..2629; Strand=-; Gene=SeqID_68249
tccatgaacacatcactcagttttgccaattcgtggagcgcaaaattcgcttaaaaattgcgaatttcgacgaaatg

SEQ ID NO: 116772 - DNA, 83 bp, Heterodera glycines
  misc_feature (33)..(33): n is a, c, g, or t
  misc_feature (36)..(36): n is a, c, g, or t
  Promoter: Source sequence=SeqID_9115; Location=1..83; Strand=+; Gene =SeqID_70292
ctgtattttgaggtggaaattttggaagaaatntgntaataaaaatgatttgtattttccatatttatttctttttcagaatg

SEQ ID NO: 116773 - DNA, 145 bp, Heterodera glycines
  Promoter: Source sequence=SeqID_20064; Location=53..197; Strand=+; Gene=SeqID_84847
actgaagggaataaaaagcaattagaaaagggtttttcattttaataatggtaataaattttgatagatctaacactcgcaaatgttgattaatttataggtaattaaatctgttttttgactataactgcccaatttcaacatg

SEQ ID NO: 116774 - DNA, 62 bp, Heterodera glycines
  misc_feature (42)..(42): n is a, c, g, or t
  Promoter: Source sequence=SeqID_31715; Location=1204..1265; Strand=-; Gene=SeqID_62020
cgtaaacatttaaaaacattttttatttattattattatttntaaatttgaggcttttgatg

SEQ ID NO: 116775 - DNA, 450 bp, Heterodera glycines
  Promoter: Source sequence=SeqID_10785; Location=2545..2994; Strand=+; Gene=SeqID_74042
aatgattcagggataaagggtcaaagagtgcaaataaaaattgggatatataagggaacgatggaagacaataaggcacattcaaaccaatcatattcccaaatatttaaaatttattttgtaaaaatgccttcggaaaaaatggattttttgaaatttgcctcccaaattctggcatgtgcgaagagagacatcggaaattatctacaacaacacttctaccgaaaactattaaccaaacacaccaaactggcaataaaaaatggtgccagacttctctaccgctgcgaaaaaggggtttacgatattttgaatgggccggaatttttaattttgggtgaccggcctaattttgggctgagacctcgggtcccaagtcatatatttgcactccaaattctgagactaaatggggtcattgggtctacaattggccctacactccttatg

SEQ ID NO: 116776 - DNA, 216 bp, Heterodera glycines
  Promoter: Source sequence=SeqID_6346; Location=1032..1247; Strand=-; Gene=SeqID_61227
atcatcagcttttgattagtgtgaaatctgcacaattcgttgattactttgtgtgcataaatagttgattatgccacacaaaaattcagtttaaaatagtgcggacttttgtaatctaaattaattggcataattctgatttaagcaatccaactcaaaatcaattcatcccataagattttccctcaattaatattttgacggaaataagcaatg

SEQ ID NO: 116777 - DNA, 789 bp, Heterodera glycines
  Promoter: Source sequence=SeqID_9803; Location=5537..6325; Strand=+; Gene=SeqID_72751
agtaaatgagacagcagattaattaagaattttggggagggcatttagggagtgggaaaggaaagacaaaagaattcactaattgtcagaggaaaagcattcgatcagaaagtaaaagctttcgattagaaagggaaaagctttcgattagaaagggaaaagcattcgatcagaaagtaaaagctttcgatcagaaaaggaaaagctgcactccgtccgaaattttgcactttttaactttttgcggtgtttttgtatttcttcacatttttcaatttctttcactttaactaacctttttacctctgaatttgtccttttattctcaaattctcatcccaaatttttcttcccaacagatggaaaatcggacgcaaattgtacgaattgttctgtgcttcccaataaaagttcgaccagtgaattacagcgaaaagttcttttggatattaaataattattttcgttgttaattttagccaaatggaccattcgctaagctttaccatcaaaaaaattcaaaaggaagcaaaacgtccattcccggcgaattgtgtggtaaattttttcattttgcattgttttcttttgacattgaatccaacaaatccaaaaattggccttaactgatctctcatccattcgcttggcattggcactttcacaggaccatttgattcttgcgccggtggttcgtcgtgcgtggagggcttttgcttgtgtccggccggcactcgtccgtcccccgtgagcggcaactgcgaaacttttgcgcaacaacgcaaaatg

SEQ ID NO: 116778 - DNA, 97 bp, Heterodera glycines
  Promoter: Source sequence=SeqID_25086; Location=1..97; Strand=+; Gene= SeqID_55821
ctggtcatagatttgttgttgctgtttgttgtaatttgtgcgggtgctagacgccgccaagccgagagagttttttgtccatcaattttcaaatatg

SEQ ID NO: 116779 - DNA, 262 bp, Heterodera glycines
  Promoter: Source sequence=SeqID_8042; Location=3493..3754; Strand=-; Gene=SeqID_66792
tccgtccctctccgtccgccgtataaatgggcggatttgctgtgtgccaatgccaattgtgtaacgcgaaatgggggaacttatcagcatgtccatctgctgccgcctaatgtccaccacaaaaaaatgtagaagccaaatgccatttatagggggggggagagactggagacacaaaaagtgcccgcaaaacgattaatttcttctttttgcgtataaaaatattatgccattattggttttctttattttttgaatcatg

SEQ ID NO: 116780 - DNA, 128 bp, Heterodera glycines
  Promoter: Source sequence=SeqID_3982; Location=3436..3563; Strand=+; Gene=SeqID_52687
aatcaaaaaatatacagaaaaccaattaatatggttggtcgtcgtcttcatttttcccccttttcagctacattgaccattctgtgctcacatttctccgttccaacaagccaatttgggacagaatg

SEQ ID NO: 116781 - DNA, 117 bp, Heterodera glycines
  Promoter: Source sequence=SeqID_5276; Location=1916..2032; Strand=+; Gene=SeqID_57531
tttttaagtcttccaaatgcttttcaatgtgtgaaaggcccacgcatttgagaacttttgggcgtccgtcagcgcgtggagtgtgaagccacttggacagtgcttggcctacggatg

SEQ ID NO: 116782 - DNA, 63 bp, Heterodera glycines
  Promoter: Source sequence=SeqID_21908; Location=1..63; Strand=+; Gene= SeqID_52543
gtggcacggtcattttggttttattgtggatatcaagtggaaatcgaactgaggcaaataatg

SEQ ID NO: 116783 - DNA, 291 bp, Heterodera glycines
  Promoter: Source sequence=SeqID_28269; Location=124..414; Strand=+; Gene=SeqID_58901
gccaaaaggttcggtgccgtgatgaaacgaaccagcactgcttaccccgcggcacccggcacggtcccccgaaggaatggatttaattaaattctctccttcggggatttttttccattaggtcatccgatagcggtcgattgctctagtatctttttcaaaatttttgatgaaatatttgtcgggctctgaagggcgtggaagggggggacgaacactgatatgatggaggagaacacataaaaattggaagaaatcactaaaaaattattggaaaacattgagaaaatg

SEQ ID NO: 116784 - DNA, 68 bp, Heterodera glycines
  Promoter: Source sequence=SeqID_11856; Location=504..571; Strand=+; Gene=SeqID_75355
actagtattacagattcagctctccaaattaaaactataaatcttagagcattgtttactttaaaatg

SEQ ID NO: 116785 - DNA, 326 bp, Heterodera glycines
  Promoter: Source sequence=SeqID_5101; Location=3748..4073; Strand=+; Gene=SeqID_56913
tctcaaatgctgcaattgtgccacaaatgatcagagcgaacaacggcagaatgacacatgaatgcaaaagaaattgactcatttttctgaatgaaatatggaaaatttagcgggcaaaatttagatcagtcggtgcccttaggcgccgccaggaaaattgtttggaaattttaaagcattttaaaaaattgcttaaaattttaaaaaagttgtcttttttcttgaattttttttaatttttcatttcggggagcgggggggggggggattgtccaccctttccccttgttgatgcctgatttatgttgtaaaatttacagagcatg

SEQ ID NO: 116786 - DNA, 1003 bp, Heterodera glycines
  Promoter: Source sequence=SeqID_4002; Location=1326..2328; Strand=-; Gene=SeqID_52770
ttgcgttcgggccagttgcgtctgaccggttgcgtctgggccagttgcgtggggccggttgcatttggggcagttgccgttgggccggttgcatcgggccggttgcgtttgggccggttgcgtttgggccggttgcgttctggccggttgcgtctggccagttgcgtggggccggttgcatttggggcagttgccgttgggccggttgcatttggggcagttgccgttgggccagttgcgtctggaccagttgcgtcagggccagttgcgtctgggggcggttgagtcttgagccggttgcgtctcaagtatttggtaataaaaaaatacatttttttggtacttttcgatttcttaggcttaagcctgagcgttcacgaaataaaacggaatcacaaaaaaaaattgcaaaaagggtccctcccctttaatttttctagtaaatccatgatattctttccaattcgtgtcaaaaaattttcaaaaagaaattctccaacaaaaatatttttattaatagacacgtaaaagcaccaattcaaatgtgccaacaacaaattatttattgaagaattttatcattacccatggcatttacatatttgttaagtggatagtaatattaacacatatattgctttgatttttcaagcagaatttaatttcaaatgaataaaattgaaaataataaaaattataggattaatattttaaatataattatattttatataaatttatatttattcttctaagttatatatatttatataacaaattaaaaataattttataaataatatattaactttaggctgagtgatgcaaattttggcaacaccgaatttattcaattaatcagcacagcttagggcaaatttgataaactgacgaaataagattaagctttaatatgaggattttttattgataaaattattttaatagaaacacttttattttatcatatttcaaaattaattgccttttgtttcagaaaatg

SEQ ID NO: 116787 - DNA, 182 bp, Heterodera glycines
  Promoter: Source sequence=SeqID_18036; Location=2718..2899; Strand=-; Gene=SeqID_82613
ttttaaatggttcgctttttggccaatgttcgaaagtggcattcctccataaactaattaaggagtgtcattgccaaaaaatgagcaaagcgatcaaaggcaactgaattaaggccaattaaaatgcataatttggacgggggaagaagcataggccggtaaaggcaagcccaattcaaatg

SEQ ID NO: 116788 - DNA, 241 bp, Heterodera glycines
  Promoter: Source sequence=SeqID_25261; Location=330..570; Strand=+; Gene=SeqID_56009
accaaattttggcaatcgttgaaatttgtgcaaatatattgagttttagttttaaactaacgaacaaacaaaaaagaaggttggcacaatacgccgatttttatagagaaattgccaaatctcgttcagagaaaacggcaagaaaaaggatacaacaggggagtggtatagccctgggagctgtcttgatacctgtactgagtgttttagcccaacatttattagaaaaaataacatcatg

SEQ ID NO: 116789 - DNA, 258 bp, Heterodera glycines
  Promoter: Source sequence=SeqID_1157; Location=1236..1493; Strand=+; Gene=SeqID_68982
ttgcctcaaatacttcggacgcgtgtttcaaaatgagtttatgtgctggcacaagcttaaaggaactaatgtaggaaaaaaataaataaaatacataaaataaaattaattaaaattatttaaaataaaattattcattcttcaaaactcgcctttcggcgctacttgcaaagagcactattttgaaaattttttcaccttttttttcatattttttttttgtttattttgttacagaatttgcttttttaccatatg

SEQ ID NO: 116790 - DNA, 226 bp, Heterodera glycines
  Promoter: Source sequence=SeqID_10853; Location=2585..2810; Strand=+; Gene=SeqID_74130
acaaatttgtgccatttccattgccggaccgtccgttgcccagcaaaatccgttttaattaccttcggattgagtacttaaaaaacagttttatggcaataaaagcattccttccatttttaggtacgttgatcattccgtcatcgcttttcttcgttccaatcaccaaattttcgacaaaagaggcacctatttatacttgcggattcaatcatcacacaccatg

SEQ ID NO: 116791 - DNA, 627 bp, Heterodera glycines
  Promoter: Source sequence=SeqID_2632; Location=270..896; Strand=-; Gene=SeqID_80810
atcttatgtgcaaataaacttataaatatattttttttcgctaattacaataaaataatgtcactatttggtagtttttatgatccgattggaagctgtgtaagagaaaacgaaaaatttgggataaaagaacatgcgacaagctttcattttagagttgtagaagatgaggacaattatgcaaattttgagcttatcttaaataaaatgttaaatgatgcacgaattagcaagccaaaacgagggtggaaaatggaaaaaatttctgtcgacttttattgtaattgtctcaatggaccaataagtatcccgttaagtccgctcaacaaaatcacagccaacactctttttaatgtatttatgatgcttcctggtgatggaataatacttgacgatattggattaattactataattattagtacttattcatttccaagaaaaatgaatagaaaaataaaaaatgtagcgggaaaaaatgaaaatattgcttaatgcacataacaaatgaaaaaaaagtcctttaaccaaacataattttgaacccaattatcgtattattaatttgccttatgatgtcagactttaaaacagaataaaaccttccaccgaacatttattaaaatg

SEQ ID NO: 116792 - DNA, 604 bp, Heterodera glycines
  Promoter: Source sequence=SeqID_5669; Location=2423..3026; Strand=-; Gene=SeqID_58847
tagaatgctcagttttcaacacaaaaaatcaccgattaatcaatgtaaacagcaccaaattttcacaaaataagcataaaaaagcacaaaaaattggaaaaaagcataaaattaagggattaaaaacacaaaaaattgaaaaaagtcgtcaaaaaacgtttgtttgctccctgataataaaaaacccaccaaaataggtgcaaaatgggaatgtgagatatatgattttaaaaatcaaaattcttgacaaaaaaataaattacataaatttcggagatgaatttttgataaaattttccatttcttaacggtgtattttctgaaatttttcggatcgcttcttaggggtgtattttacatcatttttattgcattttgttaataaattttttgaaaattgctgaaaaaattttagaaaattcttcaaaatgataaaatagcacaaaaaagcaccaaaatgccaaatcagcacaaacattaaaaaatctagaaaacattaaaatcagcatgaaaaaaatggaattagaagtctcaaagcaaattagaaagaagtttttaatgcttattatcacgccccaagttagcaaaaatttcagcatatatg

SEQ ID NO: 116793 - DNA, 148 bp, Heterodera glycines
  Promoter: Source sequence=SeqID_38902; Location=1..148; Strand=+; Gene=SeqID_67602
taatgtactgtttgcatatggtaacaaagcgaatattaagtacgcactcaagtacccgtttaaagggccaggacattgttatgtcgagtgcaaagaagagtccggcaataaaatcggaattgatgagccggctcaatatgccaagatg

SEQ ID NO: 116794 - DNA, 100 bp, Heterodera glycines
  Promoter: Source sequence=SeqID_17579; Location=2387..2486; Strand=-; Gene=SeqID_82089
aattaaattcaaatttctctaaaaactccaaaggtttccctcgaaggcaaaaaatgtccacttggcaacaccaaatacaatttttctcattagttaaatg

SEQ ID NO: 116795 - DNA, 1003 bp, Heterodera glycines
  Promoter: Source sequence=SeqID_7118; Location=67..1069; Strand=-; Gene=SeqID_63893
tgagttcaatttgtttacaaattatgccaagcatggtcaattttttatgcgtgtttttgtatattaattattagggtgcggatttttaatggcgaaaaagtccaaaataatgccgtaaataagggcgaaaaaaaacgggaaataagggcgaaaataaggtcgaaaaagttacaaatttagggatataattcttcaaattgctaaggactttaaaacgcaaaattttcgaacaaaaaatgtgtttttcatgcatttctcgtcgagttaatgccgcagaaaacataaggaaaaacttagaaatgcgcaccctattaatcataaaaataaattcaaaagaaaacgtcaaaaaagtacagttagtgaagaagaagcactaaccacttaacaaaaaaaaaattaaaaaacaaaagcaaaatcactattttataaaaatttgtcaagatattaaaaaaaatattcaaaattgtatcaattttttgccatttatcccacgaatataccattcttaggagtgtattttcacccccgcgcccccgcgggggcgacggtcgcgggggcgccgggattgcgggggtctgacaaatgagtcacgggggcgggggcgggggtgaggccaaaaaacctgtcccgcccccggcgggtgtgacgggggcggggctcgaaccctaatttcaaatgaatcaaattttcaaaaaatgatctgttaaatttttgggatgtatttcgaaaatttattttttattggtatttctgcatattcaaaaaactttttgcaaaattttcaaatgccataaatatggtaaatacatcttttatcagctgaatttgattcaacaaaaaataaatggaaaaatttgttaggatatcgcttgatgactttatccgcttcttctcgagactacatatatgttatctggggccccatgcaatttccggaagtcagtgcaatgacgaaaagagaaattgaatagatatttggtggcgtcatgtttgacggaaaatg

SEQ ID NO: 116796 - DNA, 85 bp, Heterodera glycines
  Promoter: Source sequence=SeqID_15006; Location=1815..1899; Strand=-; Gene=SeqID_47257
tccatgatgtgaggcgccgcaaatttttttttttggcattttttcacattgctaattgtgtttttcaacggcacaggtgagcatg

SEQ ID NO: 116797 - DNA, 436 bp, Heterodera glycines
  Promoter: Source sequence=SeqID_23177; Location=1149..1584; Strand=-; Gene=SeqID_53884
tgtatgcacataaaaatggtcccccccccccctctacggggacactcattttggccaaattgcgtttccgggcccgaaaatgacacacaaaatgctgaacatgacagccccccgtcccctccttaacaaatatggtggttggcggctgggcgtcaggccaaaactgaatgtgaatgatgaagaaaatttgttttaaattggcaaattaacgaacccctcgggggttcttttttgtgtgtcgaatgaaaaaaaaactaagactgctgctgtttaaaatatgaaggccaaattttgaaaattaaaaacaattaagagttgaatgaattttgaggttttaaaaaaaaattggaaaggaatttttcaaataaattttattttttgcgtaaaaattaacataaatgccaatttttgttggctttcagaccatacaaaaatg

SEQ ID NO: 116798 - DNA, 120 bp, Heterodera glycines
  Promoter: Source sequence=SeqID_29408; Location=780..899; Strand=-; Gene=SeqID_59910
taataaaggcccatagttgaaacattggtcgaccaaatcgacgatctctaacgatcaaatgatggaacagatgccaacagcacagtgcgcgagcaggacgactcctcacaatttgaaatg

SEQ ID NO: 116799 - DNA, 251 bp, Heterodera glycines
  Promoter: Source sequence=SeqID_31138; Location=1..251; Strand=+; Gene=SeqID_61516
tttttccaatttttatttttgtttccccccctcattaagcaaatggccggtgactccgaccgcgacccgggcaggcatcatcaccacaggcatcatcgacatcgtcattcagcgcgcacgtttttgagaaatttgggctaccaatcaccgcacaaactgggcagtggacaatacagcaaagtctacaaaggtggttcacaattccatgtgcttttccagcaccatttcccttcccttttcagtgtttgatg

SEQ ID NO: 116800 - DNA, 121 bp, Heterodera glycines
  Promoter: Source sequence=SeqID_41667; Location=1..121; Strand=+; Gene=SeqID_69743
gagccaaaaaacgaaaaaaccaaaattgaactttatggtgccagatgaatgcgaattaactcgagttgaatttccacctcaaaattgcgcaacttttaagcattctgccatttctaaaatg

SEQ ID NO: 116801 - DNA, 569 bp, Heterodera glycines
  Promoter: Source sequence=SeqID_1379; Location=2729..3297; Strand=+; Gene=SeqID_73144
aagggaaactttggccgcggaagtattgtcgcggaaagcgacaaatgatatattttgataataattaatattttttcctttcattaatttagtatttttctctattttttattttgtgtgttactggttctctccctctttctttctctctctctctatgcgcgtacgcatgcgcacgcgtctctagggctataaaagccgcaccattcgcctattggggcacttcttctcacttctatttaatatttatatttaatcgtcccttctccatttattcacacatttatttgtgactaataaaggaattgaaaaagggagtcaaaaatcgaagagaaagctcttctcgcataagcatacaagggaaaggccaaagcctcttcctttgtccaacaaatcaattaacgttccaaaggggaacgttgaaagggatcgaaatccctttctcttttttgtccattccgcgacaaaaattggagccccgtaggggtcaagctccagtcgtagcttaccccctcaattgagagaagtccaagctttgaacaaagcttgtccaacattcgtaagagatg

SEQ ID NO: 116802 - DNA, 899 bp, Heterodera glycines
  Promoter: Source sequence=SeqID_9513; Location=139..1037; Strand=+; Gene=SeqID_71704
tctctgtaataaaaaaaagttggatatctcttaatgacattttatagattattaaacaactatatttttaaacatgtataatttttataaaaaaaatataataaaatgctttctaaaaataaaatctaaaaaaaattaataaattagaaagagaaaatgtaaaagaatgaataattttgaataattttgtaaatcaattggatatacgcaaatgatatgcgtaatatagaaattttttatattttacaattttaatttctctacggcgcccattgataaattagttattttggccaacaatcaattgctaaattggtaaaatggcaaatataatttgaaatgataatattaaagaaatggaaaattttaatgaaattgtttaaaattaaaaaataaatgactttaatgagtggagtggttctctcatcagatttcatttgatctgttcatttggcattgtttcgccgagttccatccgaaacaatgccctcatcaccaatttcggcacctttgccgttttcggcattattgctgttgttttggttggtgtacggtagcccaagagttagcggtggtgctaaattttctgtcattatgcatagaaaaagatcatgaatagcttttgagataacatttctaagaaatttggttatttttaattttttttttcgttaacgagactataactgactgagacttaattttcttaaaaatagatttaatatttgttaataaatcccaaaaattttcaaattttgcccggcgcaaccgttcggcaccgctttaaaagccttcccattcaaaaactcgattgatacaccattaataatgaatgatcctacccttggtaaatctacaaatgacaacaaaattttttccagaatttacgcgttagcatg

SEQ ID NO: 116803 - DNA, 701 bp, Heterodera glycines
  Promoter: Source sequence=SeqID_3601; Location=4839..5539; Strand=-; Gene=SeqID_51048
tcttaaaggtgggaagaggagttaaagaaaataaacaaaatgattaaatgacaaaaaacgacgctattgcagtttacacgaccataaaataatttgacaactttaatggatcataactttttctagaagcatcaaaataaatattctttgtatcattcgatagttaaagagttctatattagcctgcaaaatttcaaagaatttcgttatgtttcaaaaaagttatgatcagaaaatttaaaaaattgctttcctgaacattttttggcataagtttttgaattttgggtgaatttttttaaaccttcgtagactaatagaggaaggactcttggggctatcaaatgatgccaagaatatttaatttggatgcttttagaaaaagttttaatgcattaaaattgtcaaattattttatggtcatgtaaactggaatagaaaaccaaaaaaacaactcaccactttggtgtactcaggcgaactctgtcgcttccctttcttcttccggccgaaacacattataataataattgcagagaaatacaattgttgaatgattacagatagaatgaaaatgagagttcattccgtctctatttataaaggcgtaaagacaaaaaatggtaatcggcacgaatcgctttttgtgcaaaaaaaactgtcaattaaaaaatttcagggaaattttttgtataaaaatg

SEQ ID NO: 116804 - DNA, 76 bp, Heterodera glycines
  Promoter: Source sequence=SeqID_4920; Location=1122..1197; Strand=-; Gene=SeqID_56193
ggtgaatcaaattttaaaatttaaatcattctaattaattaaatcattttattaaataaaggtcactccaaaaatg

SEQ ID NO: 116805 - DNA, 1003 bp, Heterodera glycines
  Promoter: Source sequence=SeqID_16506; Location=675..1677; Strand=+; Gene=SeqID_80910
caatcaactcggtctgtaaaagacagaattttttgcggcagtcactcttctgtaatgtagacaaatgcattgtaaaaagtgtataaaaggagcgatttttggccgtccatcgccatcaggaatatgagaaaatcagaaaaataactttccaaaatggaagaggaaaatattttttttttcacgtaaatgaaatgaaaataaaaattttaaaaccggaaatgtttccgagaaaaaatcgtaaaacattgcttaaacgcaaccaaattaaatcaaggtaacttcatactatgtatatctccaatgaaaagaaaattttttgttggacgaaaaggaaacaaaaaaaataacacaaaataaatgttttcgtacgaaatgaaacgaaaatctcaattgactaacgggaagtaggtgcatgacaaaatttcttgattcataaacgaattgctttccccactttgccgctatttttaagctcggaatttgggtttttgagatcgctactctaacaacttattgtcgataatatcttccaaaacataatttatgcttcgtccgcatcatgaactcgcaatatctctaagtggttgtggctttctttgttcttaccatattggggcgatgatttgttttcaaaagcatgccaatgtacaaatatacagtatacaaatacgatacatataatacaatagattttttcaatattttacatttggaatgctccatttacagaaaaatcattataccaattgtttaaaaatgtaaaactgcttctttttggtttagtctctcctctctcgtgttaacttttattgtggtgcgtccgctggtgccctaatcgcctctttgctcgttttatcgcctcattcactggaagtactatattatttggtttacattattaatctaattatttttatagactggattaaaccaattgtacagacttgcagaagaggtgcaaaaccaacgcccttttggtgctcttactcctgggtttaatatg

SEQ ID NO: 116806 - DNA, 310 bp, Heterodera glycines
  Promoter: Source sequence=SeqID_10999; Location=3882..4191; Strand=-; Gene=SeqID_74317
ttatcgatttgtcttccaacaataaattttatttttctgttgttccttgtggaaacaacattggcgacgcccgagtgcatattttgtgctttaccgtgaacattccaaaaagctactctgacggccacctcacataacccataacactaaagttattccccatctgacgcaagcctgaagagtttctcagtattctgactgagtaaagctaagtgtttgttcggtatttgccaaatattgcaagtggcataaatttaattttatatttgttatttgtcactgtcatttcaaattcattttctctatcatg

SEQ ID NO: 116807 - DNA, 980 bp, Heterodera glycines
  Promoter: Source sequence=SeqID_24460; Location=845..1824; Strand=+; Gene=SeqID_55192
tttgaaaaatttaataacaaatattagtaataattttctgccttaattaggctgaagaagaaaatgccaacaaaaaatcaatgatttgcataagaattttccagaaagccacgaaaagataaaaaatcatttattaaaaaataataaatttataacaaatgtaatgcttgcggtctctagttttagaattaattatatttttccttgacgcaccttggtcaaaaagtacaaaaaattggtttatttaaattgtaattatgtctattttatatgaatggaagccctatttttttgttaacttatttcggcctaaaaatttttatgggttgcgaatttttcaaaaattcaaaccaattttcagaaatttttgtctatattttcgtactttttgtcaatacttaagcgtttttgttttgatttcgtcggtgtactctcaaaggacccacagacaagggacccacaaagacagaggacccacggacaaaggacccacagacaagggacccacaaagacagaggacccacggacaaaggacccccaaaaatataattaattaaaatgtattaaaagatttaaaataagctgtgagagaaatgccagttactaaatttattcaaattggactgagaaaaatgctatatgacaaaaaatcactaatcttaatgagaaaaatgttacatgaccaaatgctatatgatcaaaaatcactattcctattaatgagaaaattctatatgaccaaaaaccactaatcttaactaattagaattaaattttgccaatggatttgcccgaatagcctgaaatacaataagtgctataaaagctgaactaaatttacaaaattcattaaatataatggctacgtttttccttcacaaatgggcggctacaaactcgttttcgaaggccatatgtaccaaaaaaagaagcacgaagggaattaatttattggcgctgtgaccaaaacaaaacaatg

SEQ ID NO: 116808 - DNA, 693 bp, Heterodera glycines
  misc_feature (51)..(51): n is a, c, g, or t
  misc_feature (57)..(57): n is a, c, g, or t
  misc_feature (61)..(61): n is a, c, g, or t
  misc_feature (187)..(187): n is a, c, g, or t
  misc_feature (246)..(246): n is a, c, g, or t
  Promoter: Source sequence=SeqID_42634; Location=1..693; Strand=+; Gene=SeqID_70485
ggttgacctttttggtgtgactcaaggtctttcttttcctctaaggggggnggagangagnaagaaggaggggagaaagtcttatgaagagaaagaaaaaaagaaagagaaaaaggaggaagaaaaaggaaaaggaagaggaaaagaggaggacaaaggagaagaaaagagaagaggaaaagggaangaagaaaagaaaaagaggggagaggaggagggaagaaaaggagatgaaaagaaagaaangggaaaggaagggagggagaaagagaagagaaaaggaaggatagattgaggatttatttttgatataaaaaaaaatagtttagagttaatatttgataagggatatgtaaggagggttaaaatttcttaataagttgagtatatattaggatttgatagtatagattttatgatataggaaaatgaagaaaaatttatgttagatatgaatggtggagtataatattttaaagtttataatcgagatttgattgaagcaatgatgattggtgatgtcatagtatcagtgttacgcatcgtcacaattcgaggaaaaccttgatgaaatagttgaagaacaatttttagcaatacaatatcacaaaattttaattaaggaaatttctgaactcctgatcgaaattcgtacaaatagcgggagcctaatgccattccatatggaatatg

SEQ ID NO: 116809 - DNA, 198 bp, Heterodera glycines
  Promoter: Source sequence=SeqID_7410; Location=5012..5209; Strand=-; Gene=SeqID_64739
agcgggcggacactatgatccgatcccatacaagttcatggagcactgtgttaaagcatagaattagacattctttttggagacaataaaattgtaatgtgtaattttttattcttaatgacacgtcattacgaacatccattatttatatattttaattcgcacacttattttcataataataatataaataacatg

SEQ ID NO: 116810 - DNA, 152 bp, Heterodera glycines
  Promoter: Source sequence=SeqID_2748; Location=4365..4516; Strand=-; Gene=SeqID_81388
tcaagaatggaattaaaagggtttgatttttggttggactctctgaaataattaaaaaattgatttttattctatttagtatatttaaaaataacaaacaaaaaacgttggagcaaaaaaatgctgaaacacgagcactgaaagaaaatatg

SEQ ID NO: 116811 - DNA, 80 bp, Heterodera glycines
  Promoter: Source sequence=SeqID_5850; Location=2162..2241; Strand=-; Gene=SeqID_59438
taatactgatacagtccgatctagtaaagtacctttatttgtacctgtccacattttttatacctattttcaggaaaatg

SEQ ID NO: 116812 - DNA, 257 bp, Heterodera glycines
  Promoter: Source sequence=SeqID_16401; Location=618..874; Strand=+; Gene=SeqID_80800
ggtaggagagagaaagacaggggaggggagaggcggagggggaggagagacagacagacagagtgatggagaaagagaggggcatagagcagacagacgaagcgtgagagaaaaaaggaccagacagcagacaaacagagagaggagagagagagggggagacaaagagattagactgatctgtcgccaaaggtgagaccggactaatcactttcgactcggacggcaaccgccagccgacctttttcgtcactatg

SEQ ID NO: 116813 - DNA, 1003 bp, Heterodera glycines
  Promoter: Source sequence=SeqID_16210; Location=943..1945; Strand=-; Gene=SeqID_80576
tataaagtgacatcattctcgtggtagcaattaatgcttaagaagaaataaaaaaatgatgtgaccggcagggcggcaccatcacaaaattacaatttgcattcagaagatttttgatggatttatttatttataaatgacatcattcgaattattttttttttcgtttaaaatttggtttaataatttatttttttgttatttttttaataatttagatgtttttgattttgtttttctgcgcttcgttggcaaatgaatggacaaaagcaaatgaaaatgaaaatgaacagcgaaattgtgagaacaattttaaattataattgaaattaaagtttaaaatttcaattttaaaaattagtggggaattaattgttttggtatccgttaaaaatccaaatggcatgcatttagcgaaccaaatcctcaaagagttggagcagtgctacgttcagttgagcggcattttgagtgcggcgagaagctaccaaaatgaccggcaacagacaaatgggcaaatcgaaaagcaaatcgaacggattgagcaaaagcaaagggcgacggaagggcaaaaaaaacgaacgaaaaaccattgcctaaggggaaaatttgagggcattttaaagggcgaaaaagggaaagagaagtgccaaaaagtgggtgaaaatttgcgcgcaatcagcagaatattgggcatccaacagagccgattaacttttataatggacgcgacaacggacgtacgaaaaaatggggagagataagggataaagccgggggataaagccaaaaatgggaaaagggaggtataaagccgggagatagggccaaaaatgtggaacgggaggaataaagccgggaaaaggacaaaaaatggggaagagcagggataaagccggggaataaagccaaaaattggaggagaaatgaaaatgataatgggatctcgaattcaagagataaaccatttgaatttatttataaaagagcgtttcagctgatg

SEQ ID NO: 116814 - DNA, 110 bp, Heterodera glycines; identical to SEQ ID NO: 98226
  Promoter: Source sequence=SeqID_34145; Location=337..446; Strand=-; Gene=SeqID_64016

SEQ ID NO: 116815 - DNA, 157 bp, Heterodera glycines
  Promoter: Source sequence=SeqID_14731; Location=1..157; Strand=+; Gene=SeqID_78860
tggactacccaagaataaacgaaagtgaactcgcttctctatcccttcggggataattgtcagtgggccgtcctcttcgggcaagacccagctggtccttcgtctgttacggcatgccaacttgatgtttgacccgccgcccaaggcaataggtatg

SEQ ID NO: 116816 - DNA, 387 bp, Heterodera glycines
  Promoter: Source sequence=SeqID_7429; Location=1..387; Strand=+; Gene= SeqID_64787
accatggtattggcatccaagtacaattcagaataatttttctctgctaattattttttaaaaaaaacttcaaatattgtgtaaaaataagtgtcaaaattatttgatgggctaaaatttgaaaatagggatttttaggttcgagcacctaaaataggaattctagggtcgaatggggggcttgaaaaggaagaattttcgcgctacaaatatgtttttcgtgcttttctcattgatttaaggatgtagaaaaataagtaaaaatctaaaaatcaatccgctccctaacggtttagcattttgattaatattttttgttcccaaaattgaatttaaatttgattccatttttgtacagaatcatcatcgactgttgcgtcgacgatg

SEQ ID NO: 116817 - DNA, 136 bp, Heterodera glycines
  misc_feature (34)..(34): n is a, c, g, or t
  misc_feature (54)..(54): n is a, c, g, or t
  misc_feature (77)..(77): n is a, c, g, or t
  Promoter: Source sequence=SeqID_38113; Location=488..623; Strand=+; Gene=SeqID_67024
gctgggacggcacatgactaagcacttcgatganagccgattggcgtgccttgngggaggagggaaaggataattanaattatatggcaaaaaaaaataattaaattatacaatattttttgataaaaaaaaaatg

SEQ ID NO: 116818 - DNA, 524 bp, Heterodera glycines
  Promoter: Source sequence=SeqID_18298; Location=766..1289; Strand=+; Gene=SeqID_82886
ataagcaaatcctctcttaattctttaattttttaatttttaaaataaataaaattgggcgacaaattaagcgttggggtccaatattcacggcggtgtcgaaatttctgtttagtttcaaattttctggtgtccaaatttccaatgtccaattttcgcgcatcacctcctctaaaaacttaaaatttaatgttattctccaaaatttcaataaagtacagaaaatctatgcgtaagttgacaaaaacccaaacattttttgtgaatattggtccaatcttttttgtatatgagcgaaaatttaaattttgtaaatcatataaaaatgatccgattattgtttttatactgagaccagaattttacgaaaaaatgatcaagattaacacactttcaatgactagttgtctatcttttcaaacataaatacaattgacccatgaaccctggaaatttcctctggcggggagtcatttaggaccgtaatttatgtaattaaaaaaataaaagctttgatttgcatg

SEQ ID NO: 116819 - DNA, 383 bp, Heterodera glycines
  Promoter: Source sequence=SeqID_42806; Location=1..383; Strand=+; Gene=SeqID_70609
aaaatgggttccggactttttggctttttgaaataatttgtgaaaaatatacgaaaattattttagctttaattacgctgtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatgggggcgctcttttctaaaaattcctcttttcgtctaaccatccctcccttttgtgcactatttcgtttcaaaattgaatcattttttttggctttttgaaataaattgtgaaaaatatacgaaaattattttagcttttaattatg

SEQ ID NO: 116820 - DNA, 328 bp, Heterodera glycines
  Promoter: Source sequence=SeqID_13242; Location=3965..4292; Strand=-; Gene=SeqID_77072
ggatttgatttgattttttgttttgtttgatgatactttcagcactttgccattttattgtggttaaaatattgttcgaatttgtgcgggaatcattttttgttatgaaatacaaaacaatatcatatttttttatttccaaattttattgttgaaacttgttctatgaaaatggtttcattttacctgtttgttataatattttcaaaaaaatttcaaaaatccaaatgacagtctttgtttattgaatttgtcatgttttttcatgcccttctcccctttattttagttatttttcatttattgtcctaactttgcattaaaaatg

SEQ ID NO: 116821 - DNA, 1003 bp, Heterodera glycines
  Promoter: Source sequence=SeqID_15493; Location=576..1578; Strand=-; Gene=SeqID_79762
gtccacaatttaaggccaaaccaaataaaatttacaatattctccagaattttcccttcaaaatgagcataaaatggttttatttgctctagtattcacagagttataagctaaaaaaaattcataaaattgtcgatgttgtacgtaaccaacgcgttttgaatatgattttttattgacacgaaaacttttattaataaaaaaataattctgccttcttctttaaaagaagaaattgaaattaacacacaacataaggaggacttgaacctgagacccctttttgttgactaactcacagaccactaagacgaaaaaaccaacttaattgtacttggagcccaaaattgactcgccgtgtatatcaaaaatttgacaaaaattgcctaaaagtttcgaagcgaaggataaaaaggtgaaacagaaaaaaaaacagatttttgaaaaatttttgaaggttttcccatttaaattgaacaatctcggtatctatcattcgaaagctcaagactaatgggagctttttcaagctaatgcaattggatgtactagagaaagctgtgttgcttcgaatttttctttttagtgagcctttgtttttgtaaaacaattatattttgttcgaccaaaaaagtttctctatctgtattatgaaaaatttgaattggattaaacgtgtaaaaaagaaattaaatgtcatgaattaattcagttttctctcgacacatttttaaaatatttgttttagaacattttgaattataaagttctacttcttcaaaaatgctccgttttttgcacgccggctgtgtgccccattgtcgcatcaaaggtggcacaattgggggaggggtggaaaaatgccaaagaattgcggggggggggggaagtgccgaaggaatttgagaaggggatggaaaagtgccgaacaaattaggtagggaggggtggaaaattctaaaagaatagtggaggggggggggtggggaagtgcttaaaaatg

SEQ ID NO: 116822 - DNA, 154 bp, Heterodera glycines
  Promoter: Source sequence=SeqID_3124; Location=1..154; Strand=+; Gene= SeqID_83303
gcctgctcttgctgcaccatcatcatcaagtgctattggcatcgattccggtgtcaaaaatgggtgccaatcaaaacatcactcgtcggggaagcgtcagattattaatggcagtggtgccactaccggtgccaaaaacaacaacaacgccatg

SEQ ID NO: 116823 - DNA, 944 bp, Heterodera glycines
  Promoter: Source sequence=SeqID_35421; Location=1..944; Strand=+; Gene=SeqID_64969
agcggagggggatataaggcatcgagataagctatcatcaagaggaagcgaccataaggaaagaggagagggaaccggagggaagagagagaaaggtgtgataatgcggcactctcagacatacgacaatcattttcgatttgaaaaagctctgcaaaaatcgcgtaaattttattacattggcattttgaatggcactattttttctacgaatgttgctgaattgtctgcttcttttcaaaatcaaaaatgattgtagaatgtttgtgcatgaatttcagtggaggatttggagtttattatgctaaaaaattgttagagaaaattaaggtcctagtgggtgttaaatcttgatcactcctgatcaccctgaagaatgacctctgaacacagaggtgcaataaacggaacgagacggagggcggacgacccaatctgacgagcgccacaggcggttgactgcggtggtctgaagggcccccgccaatcaatcagtcaaccgcctgcggatcacgcgagaactttttccgggacccagagtctcagcccaactattggccgccgtagtcgaatgtgcgctggttttaagcgcaataaaaaaaaatttaatttttaaatttaaataaataattaaaatttttcactgattttaagcaattttgcaaaatcttctgatttcaaccctaaaaactgattctttcaccagcacaagtttttggactataactttttcattgtcaacccagtcgaataatattgatatcattctaaagcttaaatataattacaacttttattttttttaattcacaaattttatgttctaaaaaaatgaagatggtcatttatgtctaaactgcataagacccaaaaagttttatgtgttaaattaattccacttctaccattcccacttactattactgtttcagataataacgatg

SEQ ID NO: 116824 - DNA, 581 bp, Heterodera glycines
  Promoter: Source sequence=SeqID_41119; Location=1..581; Strand=+; Gene=SeqID_69315
attagtccctaagcatatcggaagttggaattccgtcccaccgcggttggtttgaaattttttaaaaattctaaaattttcttagtttcaaaatagtaaaagttaaatttactttaaatttttaagttttcccaaattcctacctttcggagcttttaacaaactttcataaagaaatttttgccctattttgaaacaattgcaaataaaaatgtattaatgagttttatactttttacactcttaattgaggacaaattaaaaaactatattaattttagaactttttaaagcattttcttaaatgtccaaaattatttccaaaatttttcaatttttttgcacatattttcatcttttttataaatttatcattttcattttaataatttaattttaaaaaataagcatatgatttttaattatgtttttattactttttttgtttctcatcaatttttattttaatcacattttcaaatgcaattccatcggtgcgttaatactgaaaaaataataagttaatatttattgcgtttttattttatttgataatttaattaaaacagaaaaacaaaatg

SEQ ID NO: 116825 - DNA, 111 bp, Heterodera glycines
  Promoter: Source sequence=SeqID_6739; Location=757..867; Strand=+; Gene=SeqID_62702
ggtgaattttttaacatactttttgttttgtgtaaatgctgattttgagttgtaagaaatgaaattaattaaaaatattcacaattaaataattgaagttttcgtcaaatg

SEQ ID NO: 116826 - DNA, 497 bp, Heterodera glycines
  misc_feature (12)..(13): n is a, c, g, or t
  misc_feature (87)..(87): n is a, c, g, or t
  Promoter: Source sequence=SeqID_24992; Location=1..497; Strand=+; Gene=SeqID_55730
taaaaatatgtnnttaagaatatatacgaattatatatttttcttacgtttttcttcttttttgattaacagttattaaataatctnttgtcttatgtgtgtagatatcttaaaaagataaatttgtaaattaaatttaaaagatctttgtcagctgaaataattttaaaatggtcatattaataaaggttaaaattttttataatcaacataattcattttaatctttttaaaccataaatattctttttattaatttaataatcttggggggttttttttataaatattacatatgaaggaatgtgaattcattaattggaggtaatgatgaataatcaccattgctaaactatttggtaacgtgaacccaccaaaatcatttcacaaatcacattctcaaaaactaaagaactctgtccaaaaactaacagtttgtttaaaataaggaaattatttttattttaataagaaaaatattttttaaggctaaaatg

SEQ ID NO: 116827 - DNA, 899 bp, Heterodera glycines
  Promoter: Source sequence=SeqID_450; Location=858..1756; Strand=-; Gene=SeqID_52988
atcaattaccaccaccgtaacatttgctgattaccgtatctttcatttgtcacttctccaccccgccacttcattttgcattttccataaacttttctctttattctctcaaattattaaatagattttgtttttttaattaattagttctcgttaattacccaattaacaaattgacaattacctgatggacgcgctttcttttcgcactgccaccccagtgattcattcattcgcccacttttttctttctttttctctctctctctctctctgtttccttgtcattgtcatttaccacaaaaaagtaaaggtttcgcttcaataaataactttttgatttaatttgctgtaagccaacaaattaatttgcggtttaattaaaagtgatttatttggtttattggttggttggtttttactaattgcacatttgaattggtgcattgaaagtggaaattgcattttggcatccttttgaattctttcctttgccgttcttttgctttgattgtgccgccattttccaccaaaattccattttctgtcttttgcctttcttcagagagactttcaataagcacaacggaaaagccgctgccttcgaccattgagccgggactaaaacttggcgaatttgttgacatcgaagtcgaaagggaaaagccgcgggagggagcggttggagtggttgggcccgatcagatgctaagaacggaggagcggagagggaaaaatttggaggagggaaaggggacaattgaggaggaaattgaaaaagtaagggaattaataatagaagaatgggaatgatcattggtcggaagacaaaagataattcaggaggaggagacggaagagggggaggggacggagcggggccaaggcgcggaaccatg

SEQ ID NO: 116828 - DNA, 875 bp, Heterodera glycines
  Promoter: Source sequence=SeqID_18185; Location=996..1870; Strand=-; Gene=SeqID_82773
cctgaattattattctacaaatagtgaaactttgtgtaaacaaatgtgccaaaatctaaagtttttgcttcctttgaaaactttcttaaacataatcactgattggataaaattttaaaaaaaagcttagtggtgctaaatatatttttaaaatttaaatttaaatagaatcccataaagtggtagatgatgttgtattacaaacaatttaaagaactacccaaaaataataagattatatattttttgagataaataaaaaaagcaaattttttagttcttttttaatagtttttgaaaatttccgttgtttaagcctcataatataaatcaaaaaaaaaaatggtttccaatataatttaaacacctataacaaatatggctttgaaacgaattaaatttaacaaaaaataaaagttgaagatgttcctccctctgctcgattcaacacaaactttttttgggtcctcccaaatttacttcaaaaaatcgatggatttttatgtttttatttttgaaaaatgaatttttttattatcaaaataatgcgatggaattggacgggcggtgatcagacagccgacagacagtgggggcggctgtcaataacaattgataaggcccaccccgttttcacgcattttcagcgcctaatttgtcaataattggtctctttccatataaaaataatcaatacaaagccctattagaataaaaataaataaatatgtgtgggcggttgctgcactaattagctaattaccattaattcgcgtaaattattgattgcgctgtttgccttttattggccagtcaaagcattcatcacttcagcagagattatatggatttcaactaccttgagctcagtaatg

SEQ ID NO: 116829 - DNA, 1003 bp, Heterodera glycines
  Promoter: Source sequence=SeqID_9663; Location=433..1435; Strand=+; Gene=SeqID_72252
gttgatccatttgtgccatttgctgcggcgacaattgggcatacgccacaatcatacaatgtgttacgaaaccattgtcttgaggcaatttttatttaattaaattagggttgcgactccgaccgtcggggttggaaaactcggggttcgcggttgtcggggtcaccaagatcggggtcaggatcggggtttttcaatttgtcttatgccatacatatagtcaaaagactttctagtattttggcttaaaaaatatttattaattttcataataataataataataataataataattttatttgcatttatttttttaacataaatattttgtatagaattaattataaaacgcctatttagtgcatagaaaaaaaggtcataattcaaaagcggtctctagttataaattaaaaaatttattatattaaaatattactgtggaaaaaaggcaatttctagaaattaccttttaaaaaataaattatatcaataaaaatagtagtattttattcaaaaaaaaaaatttcttttagatcactttttttttgctttccaaagcaacttttttaatttttttaataagatttacgaatttttgggtacggcgatgccgataggcagcgccaggcgaattttataatttaagctcaattttctaacatatttttaccaaaaaatttataaatttccaagaattttttgttttttcttggtatttttcaaaaatatttttaaatatatatgaaattttctggattttgtcaagaaaattgaattttttaatttcaacgaatggaaaattggcttcaattcgtcaatgaattatgccaaggatgttttatagttatgggttggttaaaattcaaattcgtgtaaattttttgcattttctcccgcgaaaatgcaattcttaggggtatatttagccccgacccgagtcggggttaaggatcggggccggggttgtaagcgtaggggtcggggttaaccccgaaaaatg

SEQ ID NO: 116830 - DNA, 639 bp, Heterodera glycines
  Promoter: Source sequence=SeqID_27546; Location=1..639; Strand=+; Gene=SeqID_58250
aaatttaaaaaatattgaaaataatttttggattcagggaacaaaattttgttgtgcacaaagaatataacgtaaattacttaatttacattaaaaaattaaaaatatttattcattcaattcgtccaattagtgctttttgcctataattattaattactaattaattgtggacaagcctagtctatttaaaagcaaatgattgtgtttaattggaaatcattggaatatttttgtagcagcaaatttcacactgaaaatgtcttcttcgtccaccatttttgttgttctgctggtaattgccatctgctgctgttcattaacaattgccatgccagcagcggtcaatgaaattgataggtattattttattttgattttggcattcaatttatctccctaatggctgtgggcgaccaattctggcactttttggttggctgtgcataaccaattccggcacttttagcgcagggatttcgtattccgcaaatttctagaaaaattcaagcaaaagatttgaatgcttcaaaagtgcaaaaaatatttattaattttgaaaattggtggtttcgaaatggattttattttttatatattaaattttaagtgttccacttcggcaaaagcgtggctatg

SEQ ID NO: 116831 - DNA, 122 bp, Heterodera glycines
  Promoter: Source sequence=SeqID_14398; Location=340..461; Strand=-; Gene=SeqID_78435
attttatatttgtttttatttattgtaataagactgaccgattgaattcggcaaaaaatacatttcttattttaaaatgaattaatggttaatttggaaaacaaacggaaagtgatgaaatg

SEQ ID NO: 116832 - DNA, 128 bp, Heterodera glycines
  Promoter: Source sequence=SeqID_30690; Location=1212..1339; Strand=-; Gene=SeqID_61094
attagcatcgattatgcttacgattacgtatcctatcaagcaattgatgtaggcttttcctttatcaatttaatggcattttttaaatgtaaatttcatttttagttaatgatttctttttagatatg

SEQ ID NO: 116833 - DNA, 88 bp, Heterodera glycines
  Promoter: Source sequence=SeqID_23676; Location=691..778; Strand=-; Gene=SeqID_54372
attaattaataataaagaatatttttaaggcaataaattacggtatttatttgcgctgccaatttgttatggctttgcaatagccatg

SEQ ID NO: 116834 - DNA, 426 bp, Heterodera glycines
  Promoter: Source sequence=SeqID_12050; Location=971..1396; Strand=+; Gene=SeqID_75578
ttgtcggtggttatcgatcgcttttcagttgagtgttgaaattggacgatgaaaaccgcgtattgcggaaccgcaacccgcctagggtctataggtttttcggcgattgaaaaccgcgcctagcggaacctcacccttttagggtctattggttttttgacgcgatgaaagtcggcggtcgaaatgtggacggtttgttttcgtccacttgaagaccggcggcagaatgttgaaatccacaaattactctcgcctggagatgtaataaatgaataacaaatgcgctttatgtcgtttgctttttagctgactgcgccaattgttcggtccgagggatttgtttaagtccaattaaatatttatttattggagaaggaaaagaaagtcacaataatttggggaacaaatataaaagcaaaatgaatg

SEQ ID NO: 116835 - DNA, 224 bp, Heterodera glycines
  Promoter: Source sequence=SeqID_21278; Location=1976..2199; Strand=-; Gene=SeqID_51873
attgaataattgtcattaatgacatcggcatttttacccgttcatgcaaataaacacagaaatttgaaggtgaattcagtgaattggtccaagaattggtcgtaaatgtcatcgatcagttgaggttcgattggcttttatattcgaaacttttttggcattatgacaaaaaaattcgtttgaacgttgaaaattttgcgcgaaatggcaaagtgtcaaaaatg

SEQ ID NO: 116836 - DNA, 983 bp, Heterodera glycines
  Promoter: Source sequence=SeqID_1126; Location=2313..3295; Strand=-; Gene=SeqID_68221
ttatttaaaaaacaaaacatttttaatgggattgtcccccctagcgtaaaatgatttccaaatcttattttaattttataacctgattatataacggaatttgtggacggaacttgcggataacccaatggtatgagatgcaaccgaaagcccaaaaggttgcagcggtacagtgcttaaaatgatggcaaaaattttcaaaatagtgtcaaaaagatgcataaagtttgatagtaggaaaaaaatatttgccgagttagtttccaaaattttctggagagaggtgagtccgcggttctagcaggcgccgaagtgaaaatttcaaaaaaattttcaaattaaaaagtcagcataaactttctcatttataagcaatcaaatttttatatcattcgatattacaaactgtctgcgaattttgaactaaatttttgtttggcttaaaaatttagaataataccctgaatgtctaatttgattgtttttaagaccaaaggaaggcagagtttttgtcaaaaaaaacataccaaagttgttccaagaaattgactagcaacgaaatttactccatttctttaaatgtccgcaaatgttgggacgcgaaaaaaacattaatttataaaaattcaagccaaaattatgggagttttggcgatagtttaggccctttgaaagcttacagcgaaaacattttacatttattattttctctaaaaaataactacttctttgtaaataatatgtataaaaaatatttaaatgtatccgagaatgcctattaaatcaataaatgccacaaaatccaattaattagtgcacttaagtattaattaaatcataatttattcatgtgtcttccttccggattttatatgacactcaaaaatataaaaatgaatgcttttcttttgatatatatataattttttcagtaataaaaaaaattaaattggtaatttttcttagaattaatttgtaaaatg

SEQ ID NO: 116837 - DNA, 723 bp, Heterodera glycines
  Promoter: Source sequence=SeqID_22721; Location=1..723; Strand=+; Gene=SeqID_53408
ttcataaacagggcttcggtttagaattttcaaaggctcggttttgaaaagtttagataaatttgaaaattttgtgttttctaagccaaagaatttaattgtgataaattttctgacaaatgaaaactttttacatttttgtacaattccagaaaatttattttgttgaagcatttgatcatgcagcagcacacgtacacggaacagcctcaacgccaggcaattaattaatcgaaacttttcgcaatggcataaaccaattggattttgtttagaattaccaatactacccaaatccgcctcccccggtggtgtaagtgccaattgttaaacaatttgaaattaaattaatcagtagggataggaaggaatttgaggcaaattgttttttttaaacaaaaatcgtctatttttaaaaccaattaagcgcactcattagctgcctaattaggcactgccaaattgcttaaggtacgaacgtcgttacgtggagagggacagcggcccgcgctgtgtgccgtgctgctgctgcattccgtgcattccgatccctttgtgcttcgactgcggctgctgaacaccggcggagaagcaaaacgaatgttttgggaaatgcgcgaaaatggaaacgcttttattacaactcatcactcaattaattacataattaattgtcattaatacaaatttacatttgtgaataaattttttcagatctttatg

SEQ ID NO: 116838 - DNA, 290 bp, Heterodera glycines
  Promoter: Source sequence=SeqID_4308; Location=1..290; Strand=+; Gene= SeqID_53983
attttgaaaaatgtattattttacaatttatccaatcaatatttatcaaatatattttttctacctctcattttttattttaaaaagatttttttgcggcgcatttttcaaaaaagcatctttcattttttattttaaaacatattataaaaattaaattttttggccgatccttttatttaaagctgtccttttaaacggtattttactgtatgtattcttttaaacggtattttactgtacgtattcttttaaacggtattttactgtatttatttaatgaccgtatg

SEQ ID NO: 116839 - DNA, 251 bp, Heterodera glycines
  Promoter: Source sequence=SeqID_18385; Location=1408..1658; Strand=-; Gene=SeqID_82986
tttttaaatataaaacaaataattatttagttctatttaaattagtttgttgtgcagtgttgtcgaggaggtgggtgggaagagaggggaagaaacaatgcacgaattcggtcaaagggtaaaaacgcatggaattgcgtcaaaatattatttcttttttgtccaaaaatgcttttggattcgttatttaaatgtcgagaggaaaatatcggactcgctcagttgggccggaacggttgggccccagcatg

SEQ ID NO: 116840 - DNA, 1003 bp, Heterodera glycines
  Promoter: Source sequence=SeqID_10732; Location=1447..2449; Strand=-; Gene=SeqID_73982
aaaaattttttagaatataatttatggacaattagcaaaattaatattagtacgtatgcattttatgatttacaaattttgaagtagatttttaattttccagaaaattcctgagaaattgtgaacaaaataaaatttcattaaaattatgtcatactaaaatattattatactattttatattgtttttctaatccacccgtattcaatggacgataaacaaatatttccggataaattattgaaaatcaatagacaaaaattatatgccacaaaattatattaataatgttgtttacggaagtgatggatggcaaaacaaaaataataaacatgtataaaaacacgaaaatagattttaaaaaactagataaattatttattaacgaatttaggtagcaaattgaataaaaattaatcatgaaattaatgttggttatatttctattgaaaatgaaattattatattttaatgtttttttcgtataatggaatttttaaaccaaaaattcatgtgaacaataaaattttatgggatgaatttctgatagtttctcactcatttctttgaggtgtattttctcagtttttttcgggtaaattcttagaggtgtattttttttaaatttttgttaaggatttttcagaaaatctttaagttaggcaacaataatgtaggaaaaactcacaaatggttcagattttactttggacatcgataagtttttttttttttgctatttccatgttaataattaatttgaaaagtttttcgtgataataaattttacgtaaatgcaaaaatattagttgtctcctttttttaattttttttttaattcattatttaaaaaaaaatcattaaaaatttaattttttctctcggtgccgaaccacaaggatttgcacatttcaaatttcatttaaaacgaaattcaatacaattaaaagaaatttaaaagaaattcacaagacaattttattttttcccaatcaaaaaatg

SEQ ID NO: 116841 - DNA, 266 bp, Heterodera glycines
  Promoter: Source sequence=SeqID_2578; Location=732..997; Strand=-; Gene=SeqID_80511
agtcacggaactgccggatcatttggacggatacgaaatctgttattgatgcccttctcatttctcaattttggttggacattgaggtgccttcattgccaaggggtgcaatggggcggtgcacgagttgaaactgcgcgtcgccgacggacattcgcggcgcatcgctccaatgacttctcagaaggcaaattcggcacttttaagtcaaagcttaaagaacgctttaaaattttaaggaatttccactcgccctcaaaataatg

SEQ ID NO: 116842 - DNA, 239 bp, Heterodera glycines
  Promoter: Source sequence=SeqID_19225; Location=549..787; Strand=+; Gene=SeqID_83966
ttcctcactttcacgtatggtcaagaattaaagttcgatttcttttaaacaaacatataaataattttttgtttacaaattttaattttatgatttttgagcaacgatccattaccaaattaattcttgaatttgtctaaatatgtaattgggtgtgcttcattcatttagtagttgcactgatgagaaatgttggcggtggccgatggcaacgggcgcaacacaaacaaaagaaaatg

SEQ ID NO: 116843 - DNA, 712 bp, Heterodera glycines
  Promoter: Source sequence=SeqID_17202; Location=1..712; Strand=+; Gene=SeqID_81665
atccatatgatcacttcataatatcatttatagggattacatttatagtttttcactatttttttcctgagctccgcgtggcctgaaatgcacgaaaaacatgtttttttcggctgttgttaagctacttttcgagttattagcaactattttctagttttttatttttagcaactaaaaaactataaaatttttgaaaaaaactattttcaactattttggcgttttgcccaaaatttgttaataaaaatgcaataaaaacgaaaaatgcacccctaagaatcgacgcaaacattttttcaaagaatacacccctaatatcgaccctaaaattttcaaaaatatacctatgaaaaaagaaaaatttctcaaaaattcatctccaaatttatttatttaattttttgacgagaatttttgattttaaaaattatttatattcttaatgatttggcaaaatatttttgctttttgaagaaaatttttgattttacaccccctaaattcggaagtttttagcaactattttgggggttttttagaaactaaaaattaattattttggcagtttttagcaactataaatgtaatccctaatcatttatcgtctaaaatgaatttgaattcagtttcttgaaactgagttttcactccacggaattggcgttaagaatggcgagatgcatcacataaatttcccgactttggcatg

SEQ ID NO: 116844 - DNA, 1003 bp, Heterodera glycines
  Promoter: Source sequence=SeqID_6899; Location=1649..2651; Strand=+; Gene=SeqID_63234
ttggatttaatttccgacataatcaattttttttcaagagatattcaaatcggaaaatatttgacgaaaaatagcaaaatatgcaaaaaaatctgaaaatatttacaaaaaagtgcaaaatatgcaaaaaaatctgaaaatatttacaaaaaagtgcaaaatatacaaaaaatctgaaaatatttacaaaaaatggcaaaatatgcagaaaaccgcaaaatatgcataaaagcttaaaagtcccgacttttatacgtaaataccaaaaagatgatgtttttcctactaaataggtgattatggtgaagtgatgtactatccatcattggcgaataataggataatgatctttattgcgtaaggacaaagaaatacatcattgtgattccccaactcgtaacgggaaaggggaggttggtcgggatccggatccgacaaaagtggaaaggggagttcaaagggaagagtttatataagcggagtcataaggggcggggagagtacaaagggaccgccccccgtaaagcaaaaatgtagaaaagcaggaggggccaaactaactaaagagtaacaattggtcatcgggggccccaaaaattgaccgtctcggtcaaaacacaaaatcaattaagctaagaaaggagatgatggtttaatattttttgattaataaaattgttttattattattattattattttatttttttttttgtaaatattaaatattaacagggcggccaagtgtgcttatttctaagatttgtgcttattttgaggggtcggatcttagaaagctaaaatgtgcttatttctaagatttgtgcttatttcagcattacgtgcttattttgtgcttatttttgggtttgaaaataaaaagaaaattttgaatgacagttttgacttatagttttttattgaagcgaatacttgaattaattcgatttttgaaaaaaaaattacatttttattttattttttgagtgaaattcacaaaatg

SEQ ID NO: 116845 - DNA, 181 bp, Heterodera glycines
  Promoter: Source sequence=SeqID_36531; Location=731..911; Strand=-; Gene=SeqID_65814
atggcatgaagaatttctgattggaacatagccaaaggcaacagagggaccctggcgttggaaattgagaaattttcggaatttgcgcgagagggagtggggagcaggcgaaacagtggcaccgatgttttcataaatggacttccgtggaaaatacttgcacagattacaaagaaaaatg

SEQ ID NO: 116846 - DNA, 174 bp, Heterodera glycines
  Promoter: Source sequence=SeqID_21456; Location=1..174; Strand=+; Gene=SeqID_52063
caaaattaaagcgaaatataaaaagagagcggtgaaacagcggtggaaaaagaaagagaagcgaagacccaaaatggcacaaagcgacgaaagcccgatggcccaagaaaagtgagttttttcacacgcaattttttggattcaatttggaaggtgctaatttttcaggagatg

SEQ ID NO: 116847 - DNA, 1003 bp, Heterodera glycines
  Promoter: Source sequence=SeqID_19693; Location=1163..2165; Strand=+; Gene=SeqID_84443
atcaaaaataaatattacgtataaattcaaaaaaaactaaaacttaaacaatatttgacagaattgttacttatctgataaaaatagttatgcttttattttttattttgtataattattattatttattagttttaacatatttgactgttttatttgaattatcataaatttgaaaatgataatcgattaaattacaaatgtttttgaatttaaacccatgatttgaacttttattaatgattaaaaaattccaaaaaaaacacaatgagaaacaatgattttgctttttttttgagacgacaaacaatttactgtactacgatctgtcgcataaattgtttgcgttcaaaaaattggacatcaatgaggtttgccattttggcgctattttattaaaatagactggatttttgttagtccttcttgttcatgaatctgacatctcttaactaattttatactttcctcacctaaatttgaaaagaaatttcctaaatcgaaattttttttatttttttttgaattttcccgttaaaaaatttaaaatattttttaattttcgggtaggggatccccggggagggggggggggggtatgctacacggggtatgtaccccctggaacaggacaaaacacagcctttgaacacagtcgagacataatacagccgagaataaattttttttaattttcaaacttagaaatcttattgttataaaaaatttttcttagaaaattctaagaaaaaatttttttattttccagcgatttttaaaaatttaatcataaattactatgttttttctaagattttttctttaaaaatttgcttgaaaattttttaaaaaaattattctcggctttctcgcttttccttgttgttgaagcccttgaagacacacatcacccgaattaccaaaaaaatttcgaacacaaatttaaataagaacagaaaaatttccagccactttttaacatatttttgccttttgcagaatg

SEQ ID NO: 116848 - DNA, 216 bp, Heterodera glycines
  Promoter: Source sequence=SeqID_26998; Location=1250..1465; Strand=-; Gene=SeqID_57728
cccccaaaatgcgcacaataaaaggcgagcaaatggcataaccaattcgttggttgttattcattataattgaaattcataaaatatttaaagaagagtttctgttgccaataaaaaataactttaatttaatttattttattttcatttaatttaattttctttcctttagcagatccaatttctaattcaatccttctactacttcccaaaatg

SEQ ID NO: 116849 - DNA, 76 bp, Heterodera glycines
  Promoter: Source sequence=SeqID_33559; Location=820..895; Strand=-; Gene=SeqID_63585
tagggaaggctttagcacaaaataaatattattttacataatttatggcactttttacagggtgatgatgatgatg

SEQ ID NO: 116850 - DNA, 88 bp, Heterodera glycines
  Promoter: Source sequence=SeqID_14760; Location=2771..2858; Strand=+; Gene=SeqID_78894
ttttgtaaaaatgattttggggcttgagcgggtaaatttaatctgcttaaagtgggcggagtcctaattctcaggtatataaatgatg

SEQ ID NO: 116851 - DNA, 510 bp, Heterodera glycines
  Promoter: Source sequence=SeqID_25869; Location=1473..1982; Strand=-; Gene=SeqID_56644
tgagaaatatttttttttgcaattaatttatatacctaaatgcaaaataaaaatttttttgcacgtctttttgttgaccgaagtttttttttctctatttatatgcaaaatttgtacaaattggtattgatggtaaaaaagttaattggagagaagaagcaaatgttgttttttacactgttaaaaatgaagggaattaattttcaattcattttattagaaaaaaagagattaattcaatccatcaaattcttttctggtcttagcctcttttttaggtcatcattttgccgtaattttttgtttgtgccctcccctaaaagaatgtctccaatttgtgtctctttttccaaatacacttttttagttatgtacttttatttgtatatttaccatttttaaaaattttatttttattaaaaaatggagattttcgaggagacaataaaagatgacataattgtcatcattttatgtatcataatctaacaaatatttcagtttatcatg

SEQ ID NO: 116852 - DNA, 681 bp, Heterodera glycines
  misc_feature (18)..(18): n is a, c, g, or t
  Promoter: Source sequence=SeqID_2458; Location=5981..6661; Strand=-; Gene=SeqID_79827
gtcagttaagtcggtccnaagtatctaaaaaattttgataatttagacttgacccttttttaaaatatcacgtgtatatttccttctccaacaatttcttttttcggtgacgcggtttgagagctggaaaaaacaaaatttatttaaggttctttatattattataatttttataaatttaattttaaataattcactacgacaggaatctaaattcccaaaccggaagcgagaaaaacaagcattggcaggaatggggggggtctgatttgtgaatggtaaatattgacggaaattgggagaaaaaaattaaaaatatatattttttaaagcattagcaatttaatgaatatctaaatagcctattcttgagtaaaaagaaaaagaaaattttttcttaatcgaactaattaaatacttgcaaattctgttcattaatttcacgatattttgcattaatttttaaaaaataaaataaacctacaaaaattactattaaaaaaggtgtctaaaatcaaaaaaggggatatttttactgcaaattgcaattattatattatgccaaaaaaaacaaaaagagtgctcctaatggcgaaatacgtcacaattttctccagaagaaatcctacaaagaaaattaggattttggtcttctttgacccaggttcgcaagtaaccatg

SEQ ID NO: 116853 - DNA, 467 bp, Heterodera glycines
  Promoter: Source sequence=SeqID_8294; Location=4798..5264; Strand=-; Gene=SeqID_67607
aaagtggttcaataggttttggttttgaaacacccccccatcgtggattttttatggggcggcaaattcaaagggctgcgccttcccataggcacgggctcgtgcgggaaacacccgcaaccttttgggactatatactacttatttcattgtcgcattaattgttttttaatgcttattctttaatcaaaaatgaaaaccaaaatggcgaagaaaaagttttaacgataaaaatgctttgtaatcattcaaatgcttgtctggtggaattttaccattttttaattaaaacacaaaaaaaagctttttttcatcgcaaaatttgtttcacattcattgcactttcattccttttgtcatagaaataagcacaatgaatgtttggtataaattgataaattctttaaattataattaaattaaatcccaaaaattcctccattattgaaaaattaaaattaaaaatg

SEQ ID NO: 116854 - DNA, 365 bp, Heterodera glycines
  Promoter: Source sequence=SeqID_23712; Location=339..703; Strand=+; Gene=SeqID_54409
agaaaaaatttaaaaattttttatccctaccagtttctcccactttctttccggaacgggccaactccgtctggccaactccgtctgagccaactttgagtaaatataactcttgaagttattgaccgaatcaaacaatcttgatatcattcgaaagctcttcacaggctctattagcctactaaaaattacagaaaatttcgaactataaaaaaagatagaaataaaaaacttcgaaaattctgccttttttgcggttttcaactgacaacttttttgagagctgattaatcactgagaaatagcttataaatatcttctaaacatctagggcttttgaatgataacgtgattgagcgaaaatg

SEQ ID NO: 116855 - DNA, 52 bp, Heterodera glycines
  Promoter: Source sequence=SeqID_4871; Location=1..52; Strand=+; Gene =SeqID_56037
ggtcttttggtcctatttgatacaatttgagtattttaactcatccctaatg

SEQ ID NO: 116856 - DNA, 797 bp, Heterodera glycines
  Promoter: Source sequence=SeqID_4411; Location=2507..3303; Strand=+; Gene=SeqID_54354
tttgtttccgggacaggaatccgagtacttcccaaatttatcctttgtcggtagaaattttctcatcaacacccaagttttcctaaaaatgtaatcctctacctttcggcggttttgtatgtgtttttgggtctcaagtttcgagtgttttcattctttttcgggacgttttgcattttccacccattttcttaaccccccactcaatcgcttctctgccaggtgcagccgcaacaacaaaatgtccccacgccgagtcagctgcagttgttgccaactcgccatgacaacacgtcgtttagcgactcatggccaatactcggcggagcgagccaaagcctgacaatgcgtgcaagcgagacgtttcgaaaaacaactcacccgccaccgaatcttgggcttcatctgtttggcattcaagaagtatttcttaggatcacaaacaaacaaaaaatacacagttgcgggtttcactttactcaatcaattaactgttctagaaacattcaaatttaacattcttggaatcattcaatcgctcgaagaattcgctaatggctacataattcaaaaaatttcttagcttcaaaaagattgaaccaaaaaattcaaaaaccgactttcgaagtcaaagaatcaaaaactgactttctaaactttttttaaaaaagatcccgctatgggattgaaactcaaaaattttgcggacggcattccgcagggataaatcccgcgcgggatcccccgcacctggctctaaatcccccttccctcttcgtcaacaggaggcgaccatg

SEQ ID NO: 116857 - DNA, 430 bp, Heterodera glycines
  Promoter: Source sequence=SeqID_12061; Location=2782..3211; Strand=-; Gene=SeqID_75606
tctttaaaattaaaaaaaaatttgactttttgtaaaactcgctttttcaaaaaattttgtcaacttgaaaaacccgaaatattatagtaaggaaaaataaaaaaataaaactttttttaaaaattttgcatccaaacagagaggatttcaatcagttagagctacaaaattttactttattgactttgatatgtatgaggaaaaaaaacccattttaggcattgaatttttgtttttgttttttttacttttattaaatacaaaaataattaattaatgttaggtgtaccatgtgtactactcaaacaagggtgcacgttttatgaacaaatttggcaaagtcattgttaatacaatgacagtagctggcaaatttttcaaatattgtggtggtaaaattgcatggggcgtgtcaaagttggtcgaaatg

SEQ ID NO: 116858 - DNA, 273 bp, Heterodera glycines
  Promoter: Source sequence=SeqID_27965; Location=732..1004; Strand=-; Gene=SeqID_58625
tgaggttatcaatttttcgaatgccttattggtttgagattttttgggggagggagaagaagattgggctttggaggcccccttcatatttatagtttttattgattgattgggtaaaatatggatatatgaattaaggaaagtttttttttttattttatgaagtaaagtttttataaaaattttatgatttaattaagtttattggagttttttttttttttttttttttttaaaattgagggatttatattaaaattaagtggtgaaatg

SEQ ID NO: 116859 - DNA, 1003 bp, Heterodera glycines
  misc_feature (659)..(659): n is a, c, g, or t
  Promoter: Source sequence=SeqID_1308; Location=5372..6374; Strand=+; Gene=SeqID_72240
tttcggacggtgtgtttaattaaccttagaaatattgatggttttgatgggattttacgaataataaatgaatgagaatggcgaattctgcgggagagtgacccttttctgaagggcttaaaagggaatgataaactcacaatgaaacactgctaaagtgaggggagggaatggacaacgccgtctttacattggccatcccccggggggggggggaattcgaagccaatgcatttggcatgcccaattcgccagcagctgtcagttgggactgacaaaaattaaataaaaatggccgaatgaatgagtgaaaacactaatatgtggcctttggcaaaagcaaaaattacacaattatttgaaattgcaatggttggggtcggcggtgtcagaagatttgcttaatctctgccggagccgctgatctcttttaatctttgtcggccgtcatcaaaatgagaagatgagcgtgctgctaatgctatggaaaaagtggtgatggaaattaaatgaatattattgtaattagggtttgaaatttttttttgtgagtagcgacagccgaatttacaaagaagcatttgaaaataccattgaataatcaaatgaaatatttatggaaataaaaaaacaattagcgaatggatgttaccttaaangctcggaattttgaaaaacctaatcaaaaatcgtgaatctcaacctgacttaaaaattctatttatcctctcctggtccgggcgcttttttcaaaaattcgtaacacccttggaaattttgacagggtccggcgagctccgatttctgatagttataaattaaatatttttggaaatatttaaaattaaattaaaataattcttttatttttctctctttcttttcattttctctttgcttgtccgatggtttccatggcttccgttggtgttgtaaacattcagcagaataaatcctttgcattttcccctttaaatttcttatggtcctttcggatcgaatg

SEQ ID NO: 116860 - DNA, 347 bp, Heterodera glycines
  Promoter: Source sequence=SeqID_8123; Location=1549..1895; Strand=-; Gene=SeqID_67046
tttttcatctaattagctcaatttacttaatttggtttgttagaacacaaaaatgaattagacagaatttgtgttccaattataaccaaaggcaccaaaacgaatttggaaatgcagcgaaaagcacaaaatataaaatttaatttaatcttttcttcctccccgcctttatttttgtgtctcttctgtgttttgtgcctttccaattgcgcaccctataaaagggcaggtcaaagtgacaaattcaaactcaaattcaaatcatcatcagcaacaaaaacagcaacaaattcatttaaattcccacaaataattaattaattaattattttattttctacaaaatg

SEQ ID NO: 116861 - DNA, 579 bp, Heterodera glycines
  misc_feature (51)..(51): n is a, c, g, or t
  Promoter: Source sequence=SeqID_5597; Location=1..579; Strand=+; Gene= SeqID_58600
acaaacagcataattaaagctgttttttaaacaactgtctgccagttattntggagtttaaaaaaaaatttaaattttgattattattcattaaattaaggtgaattaatgaaagaatgtgtcaccgatttttcaattctacgaatatttttcgaaacggccaatttcattctgcaaaatgcttacatggccaactttgaggaacgtgccgaacgtttagctgatttttggagccaattctctaaaaatgaacattcgaaaccaccacaaattggcattagcactttccaaacgaaagaatcagaaataagtaaaattcttgtgattttttgaattaaaatcatcatccaaaacacagactttcaaaaaataatgggagataggacccgactagacgatataaaaaataaaataccttcagagatactttatgccaacaattttcacactttaaatactaaaacgggcgaagtgttgctgaaactgttaatggccaatattagtggtcgcattttgcaaaaaaataaattgccaacatttgaaaattgtgatgaaattgccgacgaattgggcaaaatg

SEQ ID NO: 116862 - DNA, 316 bp, Heterodera glycines
  Promoter: Source sequence=SeqID_10951; Location=1..316; Strand=+; Gene=SeqID_74258
gggttatggttttgtttgtacacttggcagccgtacgttgctcctgttttatggaagttaagggtgggatgtctgagcaaatgatgctcctctcaaaagtgataaaaattaaatgtggtcattaatttatatattatatgacatgaaaagagtattttttcaaaattttcccggttttaagtatattttggacgatcaagatcacaatgaagtgaatgatctgattaagttaatgctaatgactttttaatcatcataaaaagatatataaatttgtttgaccataaaatattcagttttttaataatttataatg

SEQ ID NO: 116863 - DNA, 830 bp, Heterodera glycines
  Promoter: Source sequence=SeqID_24951; Location=1290..2119; Strand=-; Gene=SeqID_55687
accgaaaaaataatcgacatggaaaagggggaggtcaacataaaatgtaagttattgcatttattgaaaaaccttcccccctccccccccccctgctgaattagcctgaaaagcccactttttgaaaggggttgaaatataaagcccctggggcgggggctcaatttcaagaaaaacggcaattaaattatgtctttaaagcccctggtgagggggctcaatttcaacagcaattaaaattatatttttaaattgaaaaaactgaattaagacatgtttcacaaaatggacacaaaacaacaaacaaagggataaagctgaaggaaaagcgaaaactcagaattaagagtagcaaagatatgggaggaatgagaagcaaagttaaaaaattgatcatgtaagttggcgcgggggatcaatggtgggtgatcactgatcaggagaaattttgatcagttctcgttggagccatgatttttttaaaacaaaaagtaaaacaaattattttttcaaattatttaaatttttttttgcactttatttaaattttatgttgaaaaaaagcatagaaaaataaaaaggaagaaaagtcttcaaaaaaagtaaggtttatatgctcaaactaagcataactaatgtaagaaaaaagaaacccaaaaaatgattgcttcttaaatgtctctaattagtgtgaaatttactaattttaaaaattaattgatttccatgtaattaaatttgtgaagcatttgttcatttttttatattgcctttcatcaaggttctttgctttcttgctgctcagtgtgagcacgtatactgacaaaatg

SEQ ID NO: 116864 - DNA, 893 bp, Heterodera glycines
  Promoter: Source sequence=SeqID_9571; Location=1..893; Strand=+; Gene= SeqID_71929
ctcatgctgcttggattcttgaccaaaatgtggaactaccgttccttcatgatgagtccttcttgaaaattgatcagaatttgttgtgttacattttggagcgtgatcagctgaggatcgatatggaaattaaaatttggcgagccgtaattatttaatcatttctttacttttttattttaaatgttcaatgattttaggcacttcgttgggccgatgaaaaatgccgtcaaaatggcattgactgttcggcgcaaaatcagcgtgcgatgctcggcccggcactgttcaaaattcgttttgcgctaatccctcacgaagaatttgtgagaaaaattggtaaataaataatatttcaaagcatctgaatagtttttgtctttgtggctgccataatgcaattctatcatttaaataaggaatataaaaaggtataattttatatttcaatcacttgattgaaaataaaaacacctgttttctttttccccgttattactttaaggacatttgatttttggcaattatcctcatttataattttttggagtaggcggagtcaaaaggatttttttgaaaatgaggatttgtgttttttcaatcccatgagtttacattaattagcccatcagaatagagagagtttccacaaaatgattacaataaacgagtgacaaatttgctattttttatcattatccatacttattttggcttggcactttattttgaattcagttccttccggtctgttgtcccaggaagagttggacgacgtttttctgtgcaattatcagctttccgtgccgaatttgccgcccgaaagggcggcgcgcaaatttctattccccgcccagcaacggtttctgtccgcgccgattgaccacaaaatg

SEQ ID NO: 116865 - DNA, 1003 bp, Heterodera glycines
  Promoter: Source sequence=SeqID_19032; Location=790..1792; Strand=+; Gene=SeqID_83763
tggctaggttccaattacactcattctcattgatttgtgcgccaaccattttcgtcataaccaaatggaacaatttctcgtccgccattttttgcaatacgttgtctgtcagtacaatgcgatatacaacacagagagaaatagagtgcacagttaatcaatttctgagttttggctagatggactgcgtttttggctaggtgccaattcactcccgtatttatttattcgcgcgccaaccatttccgtcatcaccaaatgcaaaatttttcacgaccgccaatttatgtgccatacggcgcctgtcagtacaatgcgatatacccgcccaaagagaaagagagtgcgtggtataggcatttggttgagttttggctaggtaggcagagtttttggctaggtgccaatttactttcgttcttattgattcgtgcgccaaccattttcatcctcaccaaaggctacaattttctcgtccgccaattatcgtgccttatgatgtctgtccgtaccttacacacaccaaacaatagtgaaaggggcgtgactcagtcaaccatgcgcatactttgttcgctaatctcggtaccagccggtaccgtttatcacggacagtggccggcgtctctttttgtgtatttaagcagcggatttataccattttagtcactttattaaagcagcaaaaattaaaattgattatttttaattaaatatgtccgaaaaaaaattccttaaaactggaaaggaagtaagagcaaaaagaaatgtaattaatttttttaaaacgatccctaaaaaaaatgaggaaactaattatttcgaggaaattgagagttatataacggaaaacaaaaaattcggcattacgggacatgttacaaaattctattttaaaaatgcctataccgagtcagctgaagaaaactttaaaaaaacaattaacaaactgattgagaaagcttgtgataaagaggaaaatcaatgtaaaatttgcaaaatg

SEQ ID NO: 116866 - DNA, 524 bp, Heterodera glycines
  Promoter: Source sequence=SeqID_2895; Location=2162..2685; Strand=-; Gene=SeqID_82230
atttatttaatttcgttgcctttttttctctccgtcccttcgcatttttcgcaaaatgacactttttgattaaccgaccgaccgattggaaagtgaatgttccaaaaaaggtgctgctgtaaatttcggtgagtaattccatcggcggatttttcgcgaagttttcgataaaaaaagaaacgcgagaaatttttaaaaagtttaaagtgaaattattttgccttggaaggaattggaacaattaatgactcatctgcaaaaccattggggggaggacactcatgtgaatttgtgaattggggccattggaattaatcaaatggtaaatatttgcgagaggcgttccaatttaacaattaatcactgatcaaagcgatcgatccggcgaacactcgccgatggatgcgcaatttggcggaacgccccctccccggccgaccatttttaagagcgttggccccctctttttggcgacattctcaaaaattaattggaaatccaattcaatttttgagtataaaatg

SEQ ID NO: 116867 - DNA, 119 bp, Heterodera glycines
  Promoter: Source sequence=SeqID_14324; Location=1477..1595; Strand=-; Gene=SeqID_78353
ttttgaaataatattttttttaaatggttcaatttttattgatttaaaaaatctttttttaaatttatgtttaatattcctcttataatgaaattaatttaggtcaactttgcattatg

SEQ ID NO: 116868 - DNA, 181 bp, Heterodera glycines
  Promoter: Source sequence=SeqID_14634; Location=1001..1181; Strand=+; Gene=SeqID_78722
tcgatttggtgacccccaccacacccctacttcggcccccacccctaagaacggcaatgttcaatggggtcaaccaccgcctttctctggctcgggcgccgtttctcagatgatcaccgaggcgatcatcaactccgaacagctgaaggaaaagtccactcgggcagtcatcgaaaaaatg

SEQ ID NO: 116869 - DNA, 601 bp, Heterodera glycines
  Promoter: Source sequence=SeqID_16585; Location=1..601; Strand=+; Gene=SeqID_80997
ccccccagggcattttccgcattgatcatagttttgggccacacaatgccaatgggatgacgcattttgtgccgcgcgatgcaaattgggcatccaaaagtgcatgggaatgccaatggttgatcggttgagggccccattaataatgggccaaattttgttggagacgacaacaacagcaataacaacttcaaagcgatcagaccgctttcaaagcagtagcagcgaagaagaagtggcacatttttggcttttttggcactttttagtttttggtgtgttggcgagtttcttaaaaacttcgatttttaagaaaattttcgaatttaaaaaagaaatttccttgaatttttatattttttcaagcaggaatttcaattatttttttaaattggttttttggaacttagggggagggctgcagttttaagaaactcgccatcgctcctttttgcgcatttccatggcttagcacaacattggcattttttggtactttggtggtgcatttttcacccaattaggatgactttggcactgtccctgaggggccaattactgccatgcaaattttccaacggatcagacgacgtgcaaaatg

SEQ ID NO: 116870 - DNA, 924 bp, Heterodera glycines
  Promoter: Source sequence=SeqID_1285; Location=2762..3685; Strand=+; Gene=SeqID_71575
aactaattattcatttgacagatttaatttatttttaaatgttgaaatttttcttttgaaaattaatattcgtattagagaccggacgagggatctcgcgggattaaattcgggacccgaccttgggagccatctcgagccttttttaaattcattgagattgatcgggatttcatcggcatcctaacttgggtccctctcgaccatcgccaatcccgcggattggagtcaaaattttacgacaattttcattttcttattaagatcttgcaacactaaaataaaaaaaatattaaaaaataatattgtcatttgctaatttccttaacaaattccttaaaaattccgagttttatccgcagcgtctaacggcaccgccgttctccacaccctcccttccgccttacaagggaacatatcgaactgtaagtgtccaaatcactttaaaaatgttaatatttctcgatcaagttgatcaattgtaattcagttgtccggtctctagtcctagcattgattttggggttcgatggcgttgataggcgctgccgcgaaaaatttgaaaattatggcccgatttttaacataatttcgcaatatgccatttttggggtcaaattttgaaaattttaggggaatttttggagtcgccgccggggaaaaagtggcgaaatttgtgaatatttgcaaagtcacttttttaaaaagaaaattcaaaactttattttaaaaatataaattcatagcccgatcaaaaaattacaaaatgagtttagaaactcatatctgacacctctagttaaaaaaatcggaagtgatagttcgcgagtgccaaagttctgcaagaaaaacatttaaattaaaatgaaatttatttaaaatcgtatttctatgaaattcagaatgaaaataatttcacatatg

SEQ ID NO: 116871 - DNA, 52 bp, Heterodera glycines
  Promoter: Source sequence=SeqID_20755; Location=136..187; Strand=-; Gene=SeqID_51321
actgaaagtgatcaaattggacaaagagggaaagagaaaagtgatcaaaatg

SEQ ID NO: 116872 - DNA, 1003 bp, Heterodera glycines
  Promoter: Source sequence=SeqID_20077; Location=999..2001; Strand=-; Gene=SeqID_84864
ttcgtctcaataaattatggcgttatgtatatattgtggcgttttgtcttgttttgcgtattttcaaagttttttcaccggactacagtacccctcgcagtgatgacgtcatcatctttgctgcatatagttgataattatcctttttttggcaagtggtttcgtggcagagtggtagtgtgttgggttggtggcagaccaaaagttcgagtccgcttgcctgtggctaatttattggaattattcaccggactacagtacccctctcagtggtgacgtcatcatctttgcagcatatagtggacaattatcctttttctggcaactggtctcatggccgagtggtagtgtgttgggtttggtggcagagcaaaagttcgaatccgcttgcctgcgacttatttattgcgaattttcaccggactaccgtacccctcgcagtggtgacgtcatcatctttgcagcatatagtggacaattatcctttttctggcaagtggtctcgtggcagagtggtagtgtgttgggtttggtggcagagcaaaagttcgaatccgcttgcctgcgacttatttattgcgaattttcaccggactaccgtacccctcgcagtggtgacgtcatcatctttgcagcatatagtggacaattatcctttttctggcaagtggtctcgtggcagagtggtagtgtgttgggtttggtggcagagcgaaagttcgagtccactagtctgcggcagaatttttcgaataaaaaatttgaaaaaaataaaaaatattatttaaaaataaaaataataaaaaataattttcagaaaaaattttacaaaaaaagtcgcgcacccctgcaatagttttgggtttcaaaaaaagtcgcgcacccctgcaataggtttgggtttcaaaaaaagtcgcgcacccctgcaataggtttgggttttcaaaaaaaagtcgcgcaataggttttggcttcagtactgaaaaattttggcgctcagatg

SEQ ID NO: 116873 - DNA, 54 bp, Heterodera glycines
  Promoter: Source sequence=SeqID_45408; Location=1080..1133; Strand=-; Gene=SeqID_72704
aaaaatatggacgtaatttaggaaaacaggcaaccgatgagcacacaaacaatg

SEQ ID NO: 116874 - DNA, 206 bp, Heterodera glycines
  Promoter: Source sequence=SeqID_22502; Location=804..1009; Strand=-; Gene=SeqID_53170
ttaatgaggttgatgtggaggaggaaattttgcatgggagcgaatgcgaatttattgaagcgactttccaatgggccgatttcgcctgtgtgtcttctgaacttggaccagaaacaagcacaccgcagatcattctagaggaggaacagccaaggagaaggctgaagcggaagaaaattgtgcgcaagaaaaggagcagcacaatg

SEQ ID NO: 116875 - DNA, 680 bp, Heterodera glycines
  Promoter: Source sequence=SeqID_84; Location=1..680; Strand=+; Gene =SeqID_63766
tggttcgcagacaggcccttcggggccatgtcgcaccaatgtggttcgcagacaggcccctcggggcatgtgtcgcaccaatgcggttcgctgacaggcccttcggggcacgtgtcgcaccaatacggttcgctgactggcccctcggggcacgtgtcgcaccaatacggttcgctgacaggcccttcggggcattgtcgcaccaatgtggttcgcagacaggcccttcggggcacgtgtcgcactaatacggttcgctgactggcccctcggggcacgtgtcgcaccaatacggttcgctgactggccctcggggcatgtgtcgcaccaaaaatggtcgctgaacctaccccttcggggattgtggttcgcaccaaataatggtcgctggacctaccccttcgggggattgtggttcgcaccaaaaatagtgactggtcctgcccttttgggttatggaccggacatttttgcatctgcattcttaatgggatgtgtgagccctgactgatggatttcagcacaggacgactacactccacagcgaagaatgatgtctttgacatttatttgtgcattttttgttaataataaatttttaacatatgtgtgcatttattagttaattacctcatatttttgccacatttgcaacactttctgatttgttgtttcagatg

SEQ ID NO: 116876 - DNA, 103 bp, Heterodera glycines
  Promoter: Source sequence=SeqID_31907; Location=1212..1314; Strand=-; Gene=SeqID_62218
ttgattaatttttggggttttaggatgcttaaaatgaaagaaaaaaagttggaatattttttttaattaaaatttcaattaaaataatggtaaagaaaatatg

SEQ ID NO: 116877 - DNA, 665 bp, Heterodera glycines
  Promoter: Source sequence=SeqID_17812; Location=3026..3690; Strand=-; Gene=SeqID_82343
ttattttcaatcagaattgctgttccctgttataccatttatagatagatcatacaaatgtatgttattttaattttatttaaataatttacttttaaatatatcttttaattccaaaaaaacattttttcactcatttttttttatttaaacgaattgttttcacatttctaataaaaaaaattttaaatttgttgaatgcgggtttttctatctttatagatagaaatcgaatagccttttttaattcgtagttcagtatttctttaaaatttatttttaaatatttttaaccccaaaatatttttaaaattattttgaaatttaatggctttattacacaaaaaattaacaatttttcataattttttaaactaaattttgttcaattttgtattataaatttttattttaaattacctggatttttacctgttttattcatttacttttaattcgttaatttctccatggcaacaaaaaggccatattattttacacaataccatacattaagcaatttgtaggaagaattaaagtacacctaaattcaactgccaacataaaattcgaagatttattcatattttttttagcattttttaaatttaaataaaatttaaatatatttttattttatttttagcattttgtaacaaaacatg

SEQ ID NO: 116878 - DNA, 367 bp, Heterodera glycines
  Promoter: Source sequence=SeqID_10650; Location=47..413; Strand=+; Gene=SeqID_46893
ggtactctttttccacaccccgaatttttcggctcaccgcacgacggaattgtttctttcgccgaataaagttgacgtgcaaatatgcgtgtttttaagaaattttcaacgtgagccattaaaactaaataactaactcgaatattatttaaggttaatttgtttttttatcgcttatcgattgaacgttttaagacccaaaggcatcttaggcagtgccgctcgcccgaaaatggcaaaattttaatgaaaagatattttaaggttttgaaatatctaaaataaatgtcttattcccgaaataaaaacgagcggatcagaaatagttctccttcatcagactattcggcacaaagaaacagaaatg

SEQ ID NO: 116879 - DNA, 252 bp, Heterodera glycines
  Promoter: Source sequence=SeqID_23968; Location=813..1064; Strand=+; Gene=SeqID_54672
aacgcagcattggaggccggctacacagtccgcaaagtcttccacgtcctccaatacgaccaatgaagtcggagcctggaaagcggtacattgccaaactttgcctcaactcactctggcgccgtttctccatgcggaacctccgctccaaagcaataatcaacaacgacccttgtgttctccgacaatacaccgacgacaagaaaattgacattatggacattgagctgatggatgaggacaaaattaatg

SEQ ID NO: 116880 - DNA, 67 bp, Heterodera glycines
  Promoter: Source sequence=SeqID_8395; Location=400..466; Strand=+; Gene=SeqID_67914
atgcttaattaattgcataggacgaaaagggaggcggaggcgaagaacgagggaaagcggacacatg

SEQ ID NO: 116881 - DNA, 653 bp, Heterodera glycines
  Promoter: Source sequence=SeqID_11428; Location=2955..3607; Strand=-; Gene=SeqID_74821
aatgaaatgaattgttgagaagagaccgatcaatttgaatgatttaattgttgacgtgctcatgaaaaatgttccttttttgttgttggaatgatcaatcaacctttgtctgtgtaaatcattaggataaatttaacgatttcctgaaagatttccaaaaaatccaaggtactgaagtgtccatttttaatcgggactcagttatccattatcacaaacaaagaagaaaatgaactatagttgaccgggaccaaaatacgaacaactgagtaccaaggtcccggttttgaccgggaccgggaaattcccggtttttcaatccgattaggtcccggttttgcccaaaattcccggtcccgctcaactctaaaattccatgcaaaatatacatttatatgaactaaaaaagccttcaccaaatcaaataatttccctttcttcatcatggcaaatgcgcagaaaattttttaataatatcaaatttattcaaataaaagaatccaaacgaaggacaaaagccgcttactcatttggatatttttgcaaaattatacaatttataagcctagcctcattctgtccaattaatttggctatcactttgtgtcttcgaattgcttcccccgcgtcaacttggccttggaattgcgatg

SEQ ID NO: 116882 - DNA, 454 bp, Heterodera glycines
  Promoter: Source sequence=SeqID_13072; Location=1704..2157; Strand=-; Gene=SeqID_76860
gtcaagtcccgttttctgtttttttcccgtcgatctcgaggcaattacctaattaattatctgcagcctttctttaatttgagctcttattaatgaaaataagatcccgtcctcttttattatattttaactttttttctgttcttttaggcattatttgtgccaatgcttccgtcgccgtcattttccattcaattggtgtctcgtcttttttcccagttttttaatcgacccttatgttcgtccgcacatttattggtgagtttaactttgaaaacggaccgctgggttggtcacgaatattgaaaaactcattttaatgtttcaaagttaacgtttttgctcataaaaattggtttttgattttgccaagcttttttctcgtattagttgtttctacaataatatgaatttataaaactagccaatttcagagttctaaatagtccaaatg

SEQ ID NO: 116883 - DNA, 716 bp, Heterodera glycines
  Promoter: Source sequence=SeqID_20286; Location=428..1143; Strand=+; Gene=SeqID_85084
tttttaatctattttaattaaatattattttttgtgttttttgaataaataaaatgaaacatggagaaaaagcaacatatttatatatggtattcaaattggcatggatgtgcaaaatttgtgtatcaattcagttaaatgtgttaatttcaaaaccaaccattgacctgaagagcagcgcactgccacccatgaagcacaagacgacagggcacctaaacagctttggaaattagaattgtctaatgcactacctcaagtcctaaaagtcaaattagaaattgctgccaggataaacggggttctgtaagtcgagctcccgccctggttaacagcacagcaaataataataattatttaaaaatagagcaaatgaaattatgatgcccgggtgtgtgttttaaagtcgtccaaatgtcgataagctcctcccactaatcaataattttcgacgctatccctcaaggaatgtatttttgaatttcttagtatttggcacaattcccaagggaattgtgccaaatgctaagaaattcaacacgttccgcccagtaatcgataattttcgacaccaataccctgtagtggaggcattttcaaattttcctttgattttattcccttggggcttatcgtaagacaacgggtcttccgatattgagcccttcgttgccaatgcaaccagtcaaaccattcatttcatcttccccaaaatg

SEQ ID NO: 116884 - DNA, 436 bp, Heterodera glycines
  Promoter: Source sequence=SeqID_21920; Location=1..436; Strand=+; Gene=SeqID_52555
caatcattttcgccatgccaatcatttggtgggccgttcactgcccgagaatcaaattcgggacattgtggcgatgatggagcaggagccaattgtcaggtggggaaggaaaggaactaattgatcatcgaattttactactaatgaataaatgaattaaaaaaaaattctattaacaaattagccaagttatgtggtaactccccgaatcactaatttcctttgtttttttataatgccctcattaacaaatattaatgctaaaatgcattttttttttctcggctgtgcttatttttgggaaatattacttgaaaatttgctcaagagcaaaaaatattcggcggattcttctgtctaaaataatgtgcctagcacagatgaaaaccgtcgaattactatttttttatcaaactgctaattaattttgaatatg

SEQ ID NO: 116885 - DNA, 451 bp, Heterodera glycines
  Promoter: Source sequence=SeqID_34923; Location=1..451; Strand=+; Gene=SeqID_64609
agactacgcgacaagcacgtgtacaagccaatgacggtggagtataggtggcccgctccagcgccatccattttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatg

SEQ ID NO: 116886 - DNA, 94 bp, Heterodera glycines; identical to SEQ ID NO: 97954
  Promoter: Source sequence=SeqID_31631; Location=411..504; Strand=+; Gene=SeqID_61952

SEQ ID NO: 116887 - DNA, 260 bp, Heterodera glycines
  Promoter: Source sequence=SeqID_10522; Location=2519..2778; Strand=+; Gene=SeqID_73752
aaaaaaataaataaacccccagggcaaaatatttaaatttaattaaaatttatttttatttttgcaaaatgccaaaggagtaataattccacaatatacaaaccaccacaaaactgattatgaatgaatgaactgttgttgttccggttccaatgcttttgtcgtgctgttccagcgcttaatttccaaattttaaaaccacgaaatatcataattcattttggcatcggtgccaaaatctgctaaagggcaaaaaaatg

SEQ ID NO: 116888 - DNA, 108 bp, Heterodera glycines
  Promoter: Source sequence=SeqID_33978; Location=1..108; Strand=+; Gene=SeqID_63890
tgtcgtcaaaaagtaccaattcttctcacacctttgactgacactgatcagcatcaaacgaattccgctgctcaaactaaacgtttcaacccaacgatcggccaaatg

SEQ ID NO: 116889 - DNA, 316 bp, Heterodera glycines
  Promoter: Source sequence=SeqID_20937; Location=1..316; Strand=+; Gene=SeqID_51517
atatttttgggattttgcctgcttttctgataattttccttaatagccaatgcaattatgcattcataaactgaattgctaaataaatgggagcagactttccatctctcaaaatttgttttatttattttccaatttattttcgtttttttccaaaaattatgaaaaatttaatttttaatgcatcctaaaataatgtgtcatcttatttacacctttaattagcatcacttttctgtccaatttatattcacaattatcacctcattaacaaacacagatcactgacggcttctcattgttccaactgaacatg

SEQ ID NO: 116890 - DNA, 216 bp, Heterodera glycines
  Promoter: Source sequence=SeqID_25272; Location=767..982; Strand=-; Gene=SeqID_56019
tgggagaatggccccgacgacacttcccttctgcgcgctttggccatttgcgttccgatggcatttaacgaattttgtaaaagtttaaaaaatgggcagagaatggacgaattaacgcaaacggagcaaatcaaaatgataatttgtgtggggaaacagctgcgaaatgcgaaccgaagggacgaaattgtggccaaattgagggcggaaagaatg

SEQ ID NO: 116891 - DNA, 874 bp, Heterodera glycines
  Promoter: Source sequence=SeqID_188; Location=7211..8084; Strand=-; Gene=SeqID_76954
tgcatatctgatgaaatttatttatgtgataagtaaataaataaaaaatagaatttctaattaacgtgatgataatttttccaaacttgttttttggtcggcgattttttgtaagcaaatttggattaaaaaattttaaaacaggaacacaaaatataacggtccatttgcaccaaaaaagggggccaccatgtacggacaataaatgcacaatattcattatttttttggaagatgtacggacgggagccaaaggagattttcgccgggcacttctcaatgtggtttttatggtgctagtgcgtttcttaaaaactgccagccataaaactaaaagccatgcacgtttcttaaaactgccctcccccctaatttcaagaaaattcttgaaaaattttgaaaacttgaaaaatatttttaaaaatttttggaatattataaaaacatgggaaaattaatttttattcgtaaattaataaataaaaaattatgaacttttctaaaaaaaatcgttgaattgcattttaatgacttgaaatttaatttctttttggagtttaaaaccttttgtataatctattaaacactagaatttcaaaaactaaaaatttttaaattttaatacaaacttttttatatactttgtaaaaaatttaagtattaatattttgatagaaaataattaaagctattgaatgataccataaaatattggttgcagttgagtaaagttatgaattttttttacattttttatttagaaatatttcttcaaaaattctaattttctcttagaatttttcgttgaaaattttctttaagttttttaaaaaaaattaatttttgaaaattttttgaacaattttcaaggatg

SEQ ID NO: 116892 - DNA, 1003 bp, Heterodera glycines
  Promoter: Source sequence=SeqID_6661; Location=1577..2579; Strand=+; Gene=SeqID_62375
ctattttttcaaaaataggaacatttcagtttaatgaaaaattatttttccttaattaaaaatgaatttattggaataaatttaagtagagggaaagatgtaaccaatgctcttgcaaatataatacgttggaatcaaaatgagtcttatgaacgaatgattttaaattttgtctttcatgctcttttcgctctttcatactgaacattttttgcaaattaattttgaattgtcttttcatataaaaaactgatgaaagagaagcattctttctcagattatttataatcagaatatgtacattagatatgtacattaaaaaaatgcattattttaaaaaaaaagtagtttcacattgccctgagcaattctattgactgacgtttttgagttagaacttaaagataatccaattcgttaagaaagatgtgagacagaattaatatataaatgaatttaaatttaaaatcatttgttcataaatatcaattttgatcccaatgtattatattaaaacagcatgggttgcatcttttccgttttttaaatttattaaaaaaaattttgttaaaaagagcaatttttattaaaaaggaaatattcgtttttaaaaatagcggtagtttttaaaaaattctttggatttaaaattccctttttttgacttcttgttcctttttcaactacttttatttttaaataattttgactatatttttttaaagagaaataatattaatggctgtacgcaaaatgaatgacaacgaatttgaaacgttgttgcaagggcgcaatttttttgcgcgtttctcctctttgatgagggacatgcgagctgaattttcaactataaatatgttggcaatagtggaagctgaagacctcatcgtctgcaagggcggagctgggacgcaaatttttaatttggcagagtgtaatttttttttgttttttttttaaatttattaattaagtgcgccagcgtttgcgtagagctcaaatg

SEQ ID NO: 116893 - DNA, 291 bp, Heterodera glycines
  misc_feature (96)..(96): n is a, c, g, or t
  misc_feature (98)..(98): n is a, c, g, or t
  Promoter: Source sequence=SeqID_14746; Location=1..291; Strand=+; Gene=SeqID_78872
agtgtatgtacatatgtttatgttccgggacaacccaacatttttatcataaaattttcctccaaatttctgttgtgtacgcaattagtactttcncnaatgaatcaccaatccaaatgataataaaaatatttcaacaccatcactttctactgaatcacatagaaagtatgtatgcttttttggtttggtaaatcacaagttctttcactttttaatattatcattccttatttttaaaaataaacgattataaccatcatcagacattttctttaattgttaataatg

SEQ ID NO: 116894 - DNA, 182 bp, Heterodera glycines
  Promoter: Source sequence=SeqID_17075; Location=1..182; Strand=+; Gene=SeqID_81502
taaaattatctaatttagaaccagaaaaccatttggcgtagtttcagaagcttaaaaatttcatatgtttagtgctttatgataagttttttaagttatcttgcattcaccagttcggtattgcatttcattcactagcgaaatataatttatttgtttctaatttgaacttatcagaaatg

SEQ ID NO: 116895 - DNA, 393 bp, Heterodera glycines
  Promoter: Source sequence=SeqID_5695; Location=1545..1937; Strand=+; Gene=SeqID_58937
ttctgtgttacggtctataacacttgacaatattacgactccagttttggctcggtttccggataaagaaacaacaaaaaaagttttttttcttatttttgatttgcgtagcataaacaaattcataggttgtgaagcgcgcgacacaggctgaaaatgtgccttttgcagtcccgactagcatcgcagagctccaaatccctctggcctacagtcaatacgagtgatcagaaaacatcacagaaaattttctgttggacgattccggagtatatgcagaaaacggtcaaattcaccggtaaaatttaactattttctctgaagacgtgcttttaattttataggattcttatttttgggagagcgtcacacagtaaaagggcggcacaaatg

SEQ ID NO: 116896 - DNA, 149 bp, Heterodera glycines
  misc_feature (14)..(14): n is a, c, g, or t
  misc_feature (67)..(68): n is a, c, g, or t
  misc_feature (70)..(70): n is a, c, g, or t
  misc_feature (138)..(139): n is a, c, g, or t
  Promoter: Source sequence=SeqID_12138; Location=1..149; Strand=+; Gene=SeqID_75711
tttttactgagttntatcagcgcttacggcacagaaaaaaatgccaaaatcgaaattctaatatgtnnanccaattaccataaataaagtaatttttttgaatagtaaaattaattaattggctaatcattgcctttnnaaaaggaatg

SEQ ID NO: 116897 - DNA, 253 bp, Heterodera glycines
  Promoter: Source sequence=SeqID_7288; Location=1328..1580; Strand=+; Gene=SeqID_64356
attaaaccgataaatagtgagataaatagatactttagataaacttttgtccaatattccttgctttctgttaaaaagccgaaaaataaaacacttctcaaaattaatattgtttaaaaattgtgaactgatagaattattatttagtgaccattttcctcgggtcttcccgcattttatagttttgatcatttaaacaaaaactatactagggacaaaacttgcgtaacattcaccacggatctgagccatg

SEQ ID NO: 116898 - DNA, 57 bp, Heterodera glycines
  Promoter: Source sequence=SeqID_31973; Location=1343..1399; Strand=-; Gene=SeqID_62288
ggtaaattattttatttatttaatttttgaataaataatttaatttttaggttcatg

SEQ ID NO: 116899 - DNA, 181 bp, Heterodera glycines
  Promoter: Source sequence=SeqID_14224; Location=2274..2454; Strand=+; Gene=SeqID_78241
attgttcactgtttggtcatccctgatcggtcacacggggttcatttatgagcgcccatctcgccaaaattatcgttataaaatgggcgtggcacctggcccgacttttttgcgtataaatacgggctcaccgggtggcatttttcatttggcgtcccttttcaaattcacaattcctatg

SEQ ID NO: 116900 - DNA, 554 bp, Heterodera glycines
  Promoter: Source sequence=SeqID_4365; Location=3210..3763; Strand=+; Gene=SeqID_54186
aacaatttggaaagaaaatattatttatttaatttttaattttaggggcatcgatttaaatttaatatgagtaaaacaaaagcacctaaatcatttgcaaatgatcgcagaaaatcggtgaaaataatcaatcaattaaccgactcattattcaataattgttcatttcttcaattgtattaaattactacaaataattttcacatattatgcataaaaagctgctcccttttctcattttccatttaagtaatttatttaattaatacaattagcgcaatttgaatttacaattcacttttgataattccaagggtaatgtaagagggaaaatcgcttttaataatgaaatattgtttttattttttgcaggcattttgtcaatattggtataacggagtcactcagttgggccagcacggtttttttacactataactttttactttatcattcaaatccaataatgttggtatttttgctaattttctaatcgcgaagcaatagctagaaaagcttctaaacatgttaagtttcgaatgataccaaaaatg

SEQ ID NO: 116901 - DNA, 80 bp, Heterodera glycines
  Promoter: Source sequence=SeqID_4456; Location=790..869; Strand=-; Gene=SeqID_54515
cgtgaaaaaattccggctccgtataaaaggggcgacgcggaaaattgtcaaaaaacatcaagtcgtcatcattgaacatg

SEQ ID NO: 116902 - DNA, 1003 bp, Heterodera glycines
  Promoter: Source sequence=SeqID_15024; Location=1151..2153; Strand=+; Gene=SeqID_79186
actaattaaatttggcatcaattaaacggtcgtcgttgtctcggtccccccaacctgttcctttggcttttcctctcgattttcgagactttttttttcatttttttaaccgttcgttcgtttgtttgtttctttctttttttgtctcgaatgagagtgaattcatctcaatttcgtccgttcttaatctgacaattcgaattccattcaaaggaactttttcgctcatttcgcaaatctttgccccaaaaaggcctttggcctccccagtggcatttttctttcacaatttgtgttcaacaaattaattgtacacacatgtgatcgaaaacactaatagatttgaaatgggccttggtccgccgtcccctatttcgtcccccctcttttttcccattttttccctttttcccatccgttcgctgaatttccatttgttgtaaaattaaaccggagaaagttgctcttcccttcccttctcttccattttcttctcttctcacagtgacgtgggaagtgatcactttgggccgtccaaaagtcgaatttcgacaaaacaaacaaaaaaaagcagaaggaaggtcaaacggaggaaattgcaattttttacgactgaataaatgccacaaaagtatttaaatttggtaactttttgtaaggggatgagaggaaaattgggaaattacaaattttggaaataaaaaaaagagggaaaatggaaaaacggcgggcgaaatgcgaacaaataacaaaatatgagcaaagaaaaatggtcatttattaattactcgttttggccactttctcggaacgaataaataaataaataaataaataaataaatgttctcttttcctttccttcctattttaatgcgcaattattttgtgtaaatgttttttaacataaatatttacaccgaaaatactttttaataattataatcaatattatttaattatttattcgctattaatgtgcatttctgaatttaagcaaaatg

SEQ ID NO: 116903 - DNA, 285 bp, Heterodera glycines
  Promoter: Source sequence=SeqID_5492; Location=1..285; Strand=+; Gene= SeqID_58239
aattcaattgctggatcagtgtatgccttttgggtggccatttccactatcatttatataataacaatcttattttcaattttttatttgtcctataaataaattaaatttttcgataattatacagagcgaaaattttccctccctcattccctactgtaccattggtacggtagggagtcccttgctcctttttttggtatttgttttgcttgggcttctcgtcgtcctccaggtacaattgagggttcaaatcctctaaatttttgatagctcttcaacatg

SEQ ID NO: 116904 - DNA, 52 bp, Heterodera glycines
  Promoter: Source sequence=SeqID_4211; Location=2271..2322; Strand=+; Gene=SeqID_53610
tgtaattgtgggggaacagcgcgtagcgacatcgactccttatgtcgaaatg

SEQ ID NO: 116905 - DNA, 388 bp, Heterodera glycines
  Promoter: Source sequence=SeqID_17312; Location=1..388; Strand=+; Gene=SeqID_81788
ctgctgatcgaccactccgatgaacaaccaaatttgtacacattatattttcatgctgcttatactttgattgaattttgtttcccagccaccaaatctcatctaatggtattttacttttttgagtttgtgccggaattgtcgaattttattctttctccaaacattacaaatatatgcatctttaaaaaaatcatccgccaaaaatattacacgaatttgcttatgattctgcctttattttatttcaatcacatttttcttttcttttttgtgcaaataaaattagtgtaaaatcatcttaactttaaaactgttcaaaaatgtttaaatacgttgccatttttcttttattttttatcattattcttacaattacgaaggaatg

SEQ ID NO: 116906 - DNA, 749 bp, Heterodera glycines
  Promoter: Source sequence=SeqID_24295; Location=1126..1874; Strand=+; Gene=SeqID_55016
ttggacttcctttcacttcgggcactttttatgaaaaaattaaaaatttaaatgattaattttggaaatctctttttttctctgatttacatgattaattaataaggccggcatttatatttatgaaaaatatcaaaatatttaaatgaattacgaatgaaactacaaaatatttatcaaatatggataaaatattaataaaaatattttccataaattaatattttatttatgaaagctccaaacatttaatttatattatggatattaaagtttcaaatgaaacatttacggcaaaaaatgaagtaattttcttgcatttttcatcaaataaacctggcagaaaaaagtttaaataaataaatttccgccctattaattacacaaataaattcaaaaaataaataaattaattaattgtcttaaaaaagtaattgccgcttacaaataaaagaaacttttcgagtcataaaggacactctgtgacagcaccagggctggacgcaattgcggattgcggattgcggattacggaaattgcggggtttttggacccccgtaattgcggattgcgggttgcgtatttttgggatttatccgaaattttgatccgtaatttgactattggattatttttcgagacgatttcttgtaagattattttttataaaatgaatttttttctatttttatttaaagaaaatatgtacatttgtttaaattcttatttctttagcaatttaaaaatg

SEQ ID NO: 116907 - DNA, 103 bp, Heterodera glycines
  Promoter: Source sequence=SeqID_20980; Location=1750..1852; Strand=-; Gene=SeqID_51553
tccatggaaaaagccctttaaaagggggcagaaaattttcaaaaacgaagccaaagcagtggacgggaaaaacgaacaaacgcagaaacggcagtggaaaatg

SEQ ID NO: 116908 - DNA, 130 bp, Heterodera glycines
  Promoter: Source sequence=SeqID_525; Location=4409..4538; Strand=-; Gene=SeqID_55300
ggtttgatatcatcggtaagcgcgcccttaggggacactgtcaaggttgctttggtaaatccgacaaatgagccgatatattttgttaaaaacatgcacttggcatatgccaatgagttagaggacaatg

SEQ ID NO: 116909 - DNA, 194 bp, Heterodera glycines
  Promoter: Source sequence=SeqID_7575; Location=1863..2056; Strand=+; Gene=SeqID_65280
tttatgccatccgacccactaaacgcctccccccccccccccccccgaatttcagtcgatgccaattttgctgagcaattacgcgaaaaagttcgaagcattgaagcgaaaaaagcggaatttacggtggctttttgtgctttggaacattttctttaattatttatttttttacaggaacagaaaaacaaatg

SEQ ID NO: 116910 - DNA, 186 bp, Heterodera glycines
  Promoter: Source sequence=SeqID_16519; Location=2051..2236; Strand=-; Gene=SeqID_80927
gaggaggaagcggaggaggagggggaggaagtggaggaggaattggtgggggacgagacggtggaggaggaggggcaggaagcggtggagggcaaaacggaggaggcggaagcggaggaggaagcggaggaggcggaggaggaagcggaagcggagggggaggaagcgaagggagtggcgggaatg

SEQ ID NO: 116911 - DNA, 768 bp, Heterodera glycines
  Promoter: Source sequence=SeqID_30386; Location=953..1720; Strand=-; Gene=SeqID_60798
tactttaattctgcgttggatttttgctccccatacttttttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtcatg

SEQ ID NO: 116912 - DNA, 523 bp, Heterodera glycines
  Promoter: Source sequence=SeqID_11480; Location=2849..3371; Strand=-; Gene=SeqID_74891
atctagcaaagacgcgaaagtgattgatcgattgatttctttgaaacagcagataagcatttcagaagatgagagcggatcggtagcatcttaaagtgagggacaacaaataaataggaaaagctgttgttccatatggataaatcctagtcggcggatcgatactgatttgtgactatggagcgaattcatggcttttacttgaaaaagacacagatttttaaaatttacgcacctgtttatcaatttttgcccctattttatcattttttgccgttatttagacatttatacacctaaattgaagtttttcgcgtcaaaaataaagctagacattgaaatatttcattttttgtcttcgttttcccaaaaactaatcaattttaatttatattttccatttaaatgatttttattaccatatttagcccttttcaagaattttagcttcacatagtgaaattaaagaaattttgaaaaattttatccaattaaaatttaaaattctccggccttcacaatg

SEQ ID NO: 116913 - DNA, 125 bp, Heterodera glycines
  Promoter: Source sequence=SeqID_23349; Location=873..997; Strand=-; Gene=SeqID_54060
gtgtatttttaggttaaatttaattattattataataacatttgctaaatataaaccaatttagaatatatattttcggtgatactcgttgtcaaaatataaattttaggttagtaggcgaaatg

SEQ ID NO: 116914 - DNA, 52 bp, Heterodera glycines
  Promoter: Source sequence=SeqID_35260; Location=1..52; Strand=+; Gene= SeqID_64850
tatctaacaccgccgtaatttcaaccataattaattcacaaattgtcagatg

SEQ ID NO: 116915 - DNA, 81 bp, Heterodera glycines
  Promoter: Source sequence=SeqID_12723; Location=1561..1641; Strand=-; Gene=SeqID_76418
gcatttgatagacagaaaaataggggaaaataaatctcacatagtaaataaatttaaaaggaggaaacaaaatgaggcatg

SEQ ID NO: 116916 - DNA, 164 bp, Heterodera glycines
  Promoter: Source sequence=SeqID_42817; Location=1..164; Strand=+; Gene=SeqID_70620
atatttgtctctcatcagtatcataaggtataacaaaacaatgttttatcggctaatttgtaccgattggcgaactattgttatgtcatagtgaattttattgtttattaattatttaaaaaacaaacaaaaaatatttaccatctatacgcctatgtcctatg

SEQ ID NO: 116917 - DNA, 67 bp, Heterodera glycines
  Promoter: Source sequence=SeqID_8925; Location=1212..1278; Strand=+; Gene=SeqID_69654
ttcgttttccccgttggtttttggggttgattattcggcccgccctttagctttgcatttccaaatg

SEQ ID NO: 116918 - DNA, 1003 bp, Heterodera glycines
  Promoter: Source sequence=SeqID_5108; Location=2547..3549; Strand=-; Gene=SeqID_56936
cgcaaaaatatttcactttaatcgagaaaaaataaaattgcttataaaaatattttacaaattgaattttatttcaaatttaccaataaaatatttattttatattaaaaaaaatgaaaataaataaatgatttacaaaacatgaaaaataacggaaggaatttttacggtttgagttcacagcgaaaaataactttcttttgcattcaaaattcaaatttggcgcctcttttgacctaattattttggaaaatccagctgttgctggcacagctgtcaacttaagtgattgatggctcaaaatttgcattcaaattggggaccggaccttatttcgcaataaacacgtgactcatcggccagtcagtgcgacgcactgtgtggaaaaggccaatcaatactcgcggtcccgcctaattgactcatgaaaaacaaccacgtgccaggcggtccgcctgtcacctgagcgttctgcggtcgctataaaaagcgcaatttcgcaaaaatatttcactttaatcgagaaaaaataaaattgcttataaaaatattttacaaattgaattttatttcaaatttaccaataaaatatttattttatattaaaaaaaaaacatatttcacttaaaaaatgtcccaggtccaaaaaaaattcttggccgtccccggtgaaaaaataaaagaaagaaatataaaaaattttttcaaaaaaactattgatgaaataaaattaaatgaaaataattatatcgaaatatcaacaaccgaaaaaagtatgcccgattacgggattcaagaaaatattacaagatttatatttaaaaatccaaaaaaagaaaatcgaaaagagagctccgaaaactttaaaaaaataatcgaaaatttaattaaaaaagcaatgatgaaaaaaagaattgggtgggatgttaagaggatttctattgatttgttttgtgagttgctaaatgacccaatcattttgccggcccgggacccaaaaatg

SEQ ID NO: 116919 - DNA, 69 bp, Heterodera glycines
  Promoter: Source sequence=SeqID_1941; Location=1..69; Strand=+; Gene =SeqID_76927
aaggcaaaataatcagaatccgtgtgaaagcagtggtcagccaaagaatgcatcccctggtcatatatg

SEQ ID NO: 116920 - DNA, 151 bp, Heterodera glycines
  Promoter: Source sequence=SeqID_36227; Location=995..1145; Strand=-; Gene=SeqID_65607
tttgtgacataaacatttatttgatttattttaccatattcacaatttgattaaaatataggtggtcaaaagtgttgtcccatttcattttttggcacaaatatcaataattaaaaaaatctaaaaattcaggtaagcataactttggatg

SEQ ID NO: 116921 - DNA, 536 bp, Heterodera glycines
  misc_feature (529)..(530): n is a, c, g, or t
  Promoter: Source sequence=SeqID_11748; Location=1145..1680; Strand=-; Gene=SeqID_75240
tttcaattcttaagatacttgcatcctaaaatctatttaattttttaagttgttcatatcagcatttccatttcttgatattttatttaaagggtatcctttctgacaaaatttagaatttaaatctggcaaaatggggggggggggctcccatgttttcttttgttattttcggaaaacaggaaacttggagttttcaaggacgctaatctcgaatctgacattagattggcgattcgttttaactttttttaaaacgacaccgacggtgactcaccgtgggatcgatggatccgattatttatactcaattttcatttttgagttacaatttctaaacttaaaactttttgttgctaccattttcatttaaatatagaaaataacaaaaggaattcctcagtcaatctcaatttcttcttctccgactgttccattctcaaaagcgtcgcccataacgtcacacatatcacaacccggtagattttagtcatttgttttacttatttgttttaatttcaatttttcnnagcatg

SEQ ID NO: 116922 - DNA, 114 bp, Heterodera glycines
  Promoter: Source sequence=SeqID_6764; Location=1368..1481; Strand=+; Gene=SeqID_62808
cctggagtttgcattctgccggaaggaaagcatggtaagcatgaaattttcggcattttcccctccccaaaaaaggctttttttcaaaatttcgcaaaatatatatatataatg

SEQ ID NO: 116923 - DNA, 90 bp, Heterodera glycines
  Promoter: Source sequence=SeqID_675; Location=6620..6709; Strand=-; Gene=SeqID_58773
attacctaattaaaattaatgaaattaatttcattgccgctttcggcaccgatcagatcactgttttttgggcttgtgaagagcaaaatg

SEQ ID NO: 116924 - DNA, 574 bp, Heterodera glycines
  Promoter: Source sequence=SeqID_1327; Location=4291..4864; Strand=+; Gene=SeqID_72640
agaaaaaaataaaaattcgagaaaatgaaactgcatgggaatcaaaggttgtgggacataaaccaaaaacaggtgaaaagggaaacaggtgaaaataggtgaaaaggaaacaggtgaaaacaggtgaaaataggtgaaatttcacctaaaaatatataggggcgtgtatttaatggggcatattagataatgtctcaactagtatcaataaaaagtgccaaaggaaaattttgtgatggttatcgctattacaaacataaaacgaccaagttcaaactttggtggaaatgtgaacttaattcacatgggtgccagggctggggttttgaaaaggaagggttttttacaatgacgcgccgacacaatcatcatcctgacactatattgattgaaatcgaagaggacataaaatatcataatttttctgcgggggcaaaatgctttttgggtgacaacaagaaatagttgatgatgctaagaaaaatccgagactccaaactgaatttagagatgaatttattgtttgtaaactataaataggatcttgaaaaaaaataccaattaaataaaaatg

SEQ ID NO: 116925 - DNA, 271 bp, Heterodera glycines
  Promoter: Source sequence=SeqID_1853; Location=1..271; Strand=+; Gene= SeqID_76370
ttcgggatgccctaggatgcccttcgggatgaaaaacaataagaagaatgccccgggatgcccttttggatgactgtgaaaatgcccattaggatgataaaatagtgaattttgaatgcccttcgggaagacaaaaagtgaaaagatgcccttctggatggctaagaaaaatgaccattaggatgataattagtgaaaataaaattcgaaatgtcatgaaaaaaaattgaattgaaattaggaatactcttcgggatgaaaaatgaaaatg

SEQ ID NO: 116926 - DNA, 1003 bp, Heterodera glycines
  Promoter: Source sequence=SeqID_4901; Location=2692..3694; Strand=-; Gene=SeqID_56146
attaacatttattccaaatcaattcaaatgcatgaaatggctattttgtatggcttcattgcctctccgtttcaaaatctgcttgctgtttttttcttttcattcgctattaattaaaaaaaatgtgtatgtgacctaaactccacaagagccaaaacgaaaaatacacccataagaatcgatcccaaaaatttcagaaaaatataccccctaaaatttgaccaaattttcagaaaataaaccataagaaataaaaaattttcccaaaaatgcgtctccaaaatttatttatttgttttcttgacaagttgcaactgtgcgggcgaaattgatcaaaaatgagtcactttttgaattttagtgcataaaaacactggatttttccaatttttaacacctattttgagtattttgggcgtttttaccacctatttgcactttttcagcacccattttagtacctatttcagcattttgtctctactcataacagagaaaggaaatatgaagatatgtagtgttatatatttggcaaagacattttcttctttccaaaaaacccgaacaaaaaaccaaactacctaacatgattccttccatcttaaaaggccaaaaacctctaggagtacgagttcaaattgtacaaattttatgattgttttaaaaaaatttagaaaattcgggattttctaaatacttagggtgtaacataagtttccgcacaatttttttttgacaaattcaaaaattcataactccgtaatttctgcagttattttaataattctttttttattttgttcgtcagaaagtcttctttcatttcatgccattgtttcattttttatttgcttattcaatttttttagtattttttcccgaccatgcaaaaattgaaaattggcccactaatttttctcgattttttatggtcaaaaaagtaacctgatataacaaaaaagaaggttttctgtacaaattagaccagtagaatccgaatatg

SEQ ID NO: 116927 - DNA, 499 bp, Heterodera glycines
  Promoter: Source sequence=SeqID_10116; Location=1..499; Strand=+; Gene=SeqID_73199
agtaaaaatgaatttatggcatttattattttttatatttttctttccttttgaaaacgaatccggcaaaatccgaccaaattttgatgaaatatttggcaacgaatgggacaaaaaggaaagagaaaatggtatctaatcaattattcaaatgcaaaatgaccagaatattatcaaaaatgatcaaaatacaaaagaagaacaaaataatcaacagaaaaaagaaacaattcataaatttgaaacaattaaagaaaagttaagagaaaaaggaaattatcaatggaaaaacagagtcaaaattgagagaaaatttggaaaattattaggcgtaaatcgcaaaaaaaatttacaaatggaaaaaggaattaaatttaaacaaaaagaaaacctatagaatgaaaaagagtttttatgatgaaaaaagagcgaattcaatgaacgtttagatgaatttaaaagattatatggccaaggcaaacagaaagaatttgtgatg

SEQ ID NO: 116928 - DNA, 81 bp, Heterodera glycines
  Promoter: Source sequence=SeqID_24537; Location=733..813; Strand=+; Gene=SeqID_55263
ccttgaaaataatcttttaagttttcaaataaatatttatttaaaattatttggtttgcctttgcttgggtgtccaaaatg

SEQ ID NO: 116929 - DNA, 76 bp, Heterodera glycines
  Promoter: Source sequence=SeqID_8630; Location=1..76; Strand=+; Gene =SeqID_68723
tggaaatggcccagccaatgcccttggaaatggcatcatcggtgcccgtggtaatggttggatgcccgttgaaatg

SEQ ID NO: 116930 - DNA, 1003 bp, Heterodera glycines
  Promoter: Source sequence=SeqID_6568; Location=262..1264; Strand=+; Gene=SeqID_62042
tcaccaaaagttttttggaaaatgcgccgcaaaaaaagagtttaaaaatctgattttttgattccgaatgcactgaaatttacgatttgcttaatttctcaccaaaattgttaaaagcgattaatgggaggtgaaaatataatatttaatacatttttgatcgaataaattgtaaaaataactgatttgaagcattttacgaaatttatattgtttaaagtttaaaaataagtgattttaaaatgaaataagaagacaaaaaataaaaaaattttctacattaaccattttgttaaatatttctcagttacaaaacgatagtgcttaaatgatcggtcatcaaatcttcgagctaaaaaaagttttgaaataaaatttaaaaaagtttttctttcttatcgaacctgaaattatgaataaaaattatatctctgaattggtttatttttaattactaattaaaaaaattaaaatttagtagcgaaaaaaataaaaatgaacttctaatttttcttacatgtattaaacaatcagcatagcctggaattttgataaaaatgggtaacggaatttatgcttggaaatagattttgccgagacgtaatttcgccaccgaaatttctttaaaaaatttttcaaatttagaaactttcaagaaaaaacttagaagctttttttaatgtaaaattatttaaaaaactaataaaattatttatttttttaatatttgtacttctttctttgtctgctggtcattattttcattctccacgtcactgtttcttccatcacttttgatggcaactcgtcgccttttttggtattttctggcgatttatttcctttggcaccagcggattcggaataatttgttgcaaaaataaaatcaaaataaaatatgtatatggaaaacatttctgcgattttccttaatttaataaattttcataaaatatgactaaattattgtttgaaattgaaatattttatatgcagatttatg

SEQ ID NO: 116931 - DNA, 333 bp, Heterodera glycines
  Promoter: Source sequence=SeqID_3759; Location=2026..2358; Strand=-; Gene=SeqID_51759
tgtctgcatgtttttttccgacggtgcctatcggccccgccggcctcaaaaacccttattttttcttaacaaaattagcccaaaatctcaaaatttgggcattttttagtcaaaatctgctagcaaatggcactaaaaatacaaaattttccccggcggcgcctatcggcaccgccggctcccgcgttcgcgaaatttttttgagaagaccgcgccgcaaaaaaaagagattttaaaaagcaaaaaaaaaaaaaggtcgtcaaaaatttcggaccccgtcataaggaaaatcgcatatgaccaccccccctgagcccgatcgtacgtcgtatg

SEQ ID NO: 116932 - DNA, 440 bp, Heterodera glycines
  Promoter: Source sequence=SeqID_42097; Location=683..1122; Strand=-; Gene=SeqID_70077
tgctcaattcgtcggaggacagtgacaaccacgacaaaaccagcaagcaaatgcgacaattccgcatttgccggacatcggaatcttcgaaccatatgaagaaaagagcagaatttccgaatggtttgacaggttttcgtttgcaattgattgtgcgtcaccaaacgcacaggacgaagatatttttcaccatttcaaatattttgtttaattacccaagtttgaggtccttcccggaataaattttttatttattctgtgtctcgtccctacttgccccgaccccagcaaatgcgacaattccgcatttgccggacatcggaatcttcgaaccatatgaagaaaagagcagaatttccgaatggtttgacaggttttcgtttgcaattgattgtgcgtcaccaaacgcacaggacgaaaccaaagtgaaagctttgatg

SEQ ID NO: 116933 - DNA, 1003 bp, Heterodera glycines
  Promoter: Source sequence=SeqID_13498; Location=1028..2030; Strand=-; Gene=SeqID_77394
aaagcggaaaattatttgaaattattaaaagcggaaaattatttgaaattattaaaagcggaaaattatttttgaaaatttattttgaaaacccaaaagcattaatcgcaatttatatggccatattttttgacatttataatttctttggtgtcatatgcacaattttttcattctttcataaataagaaagaaatgccaattcaagtgttatgccaatccgagttagtcatgcgttttttcaattgttcacaaatagaaatgttaaaaaccagaataattaaattaatcaaaaaaaaagttggaaattgtgagagaaaataaataatatttaaaaatttatattttattgtgaataatttagtccctttcaaaatgcaaatgcttccgactttttctgtttcacaatgcggacggaattcagcttcagtggaagttacggtctgaagaaatggatgaatttattttccaatttctttttatcaattactttttgtgctttattttattttgagggcaccttttctatacaataccaaccttaatatttttcttttcaattaattcaaaatttaattgtttaatgaaccgatcgattcagctttaaacattttctctgtcattcgccctcctcccacacattttcgtcggcagatgttttagctgagccattcgatcggaaatccgtccgctgtttggataacaaatgtttgttccattgcgattgatctgttcccatcccttccaacactttcccattgctttaactcaatttgctgttctttcttttgtcttcaagaaattccattcgattttttttaaatttttctttgaattaattgccctattttaatttgataaaaaaattcttcaaaatgccgtaaattggatttgttgcctttttagctaattatgccgcttttccgctctttgtccgtgtcggcgttgcaccattctccaccgttgcccgagcgcaactaccgtattacgtcaatggacgatg

SEQ ID NO: 116934 - DNA, 159 bp, Heterodera glycines
  Promoter: Source sequence=SeqID_21293; Location=1134..1292; Strand=-; Gene=SeqID_51890
tttcagtttgtcctagtaggtctttttatttaagccgtaaattaacttttattttttccttttgcataaatttgaaaaaaaaaatttgttctgcaatcttataaatatttattttttatttataaaaatacgaaattatataattttagttttttaatg

SEQ ID NO: 116935 - DNA, 153 bp, Heterodera glycines
  Promoter: Source sequence=SeqID_22734; Location=1830..1982; Strand=-; Gene=SeqID_53426
taatttgtagggctggtggtaactcaacttttgtgcatccattggaggaggtgaaacaatcccgacaaaaatttgatacggtaattatatacgaattaatttcatccattcataagcaaatcatattattataggaattaaaaagcaaaaatg

SEQ ID NO: 116936 - DNA, 197 bp, Heterodera glycines
  Promoter: Source sequence=SeqID_3535; Location=1934..2130; Strand=+; Gene=SeqID_85070
tttcgatagaattttttgaaaattttgcaaatgaatcctgattttgggtgggtgaaggttgggaagcgaaaaatgggcggagcttcgaactgtcgaaaagtgggcggagcctaatcgaatgaaaacatataaaatcggcacgcttttgaacttccgccaaattttgcaaatcattcatagttctatctacaaaaatg

SEQ ID NO: 116937 - DNA, 487 bp, Heterodera glycines
  misc_feature (49)..(49): n is a, c, g, or t
  Promoter: Source sequence=SeqID_4340; Location=1..487; Strand=+; Gene= SeqID_54105
ccaaagaacccaaaaaattgggctaaaaatcgcaaaaagtggctatttntggtgaaaatctgctaaccaattcggcaccgccggccctcggttcctgaaattctttttggaaaagcgcgccgcaaaaaaaaacagttttgaaatgaaaaaaaggccatcggcggcggaccccttttctcaaaaatcccgaccccccccccccctttttaacgtatgacagacagacaagcaagggcattccgacactcagatttttgataaaacccaaataaatctagaatctggcatgtttcataaaacccaaataaacctagaatctggcatgtttcataaaacccaaataaacctagaatctggcatgtgtttttcggcaccgtgggttctaaactattatttttttagcaaaaaatttcctgttatattgaaatttagtataattcctcaaattaaaaattaaaccacgcattctttagaaaaaggaacaatg

SEQ ID NO: 116938 - DNA, 245 bp, Heterodera glycines
  Promoter: Source sequence=SeqID_3582; Location=2132..2376; Strand=+; Gene=SeqID_50948
tttagacaatttggaagctacaattttggaaaaattagcgaatggaagactgcaatttatagggtaaaactgaaatattaatgagatgaagacaacaaaatgaaaaaattaagcaagtataatgctatttataatgatttcgaatgagccaaatttattttatgggttaaataaacattgaaaggtataaaatgcaaaatttttagttctttgtattattattcttcaattttttcctaaaaatg

SEQ ID NO: 116939 - DNA, 174 bp, Heterodera glycines
  Promoter: Source sequence=SeqID_12781; Location=1760..1933; Strand=-; Gene=SeqID_76494
tcactacgctctgcaggacccgattacccggacccgaccaaccctagttttacacataaatgttgcaaaaattgtttctttatttgctgtttttgttttcaattaattgagcttgtttttaacaatttaagaagaaatcttgagagcgttgtttgaaaccaaatattaaatatg

SEQ ID NO: 116940 - DNA, 80 bp, Heterodera glycines
  Promoter: Source sequence=SeqID_15249; Location=1..80; Strand=+; Gene= SeqID_79456
tacccgggggacctctagagtctcgccacgcagagagtcattcactgagaaggagagtaacggaatgggaaggagggatg

SEQ ID NO: 116941 - DNA, 159 bp, Heterodera glycines
  Promoter: Source sequence=SeqID_26837; Location=803..961; Strand=-; Gene=SeqID_57590
tttataaatattaattgttatattatatttttgtttgatagtattgctaatatatgaataaattttaaaaatttaattttagtaattaaaaaaaaatttaaaatggaataaatgaatttcttttaccatttgtgtatttgtttttctattataaatatg

SEQ ID NO: 116942 - DNA, 1003 bp, Heterodera glycines
  Promoter: Source sequence=SeqID_13155; Location=1135..2137; Strand=-; Gene=SeqID_76967
ttgaactagaggtgctgtgtcgaagtgacaaaaaggcaaatgagaggtgatcagagggggcgggtcatttcagtacggaagagttattctaatgattaattaattatttaaatttataatttaataataagctaataataacaataaatatttttggctctatttcagtttacacgaccacgaaaaaagacacgacaatgttatattttgataaatttcatgcaccataactttctctagaagcatccaaattaaacaatcttggtaccatttgatagcctaaagtttcctctatttgcctttaaaattcaaattcctttgagtttcaaagaagttgtggtcaaaaaggtttaccaaataaatttatgaaaatactagccacaacctttttgaaacacaatcgaattttttgaattttacaggtaaatagaggacacttagggctatcaaaaggggtccgtatcgttttggcgccgacgttttggcgccagcccaagttttcggactataactttttttgttgttaaccaaatccagcaatcttggtatcaatcgaaagcttaacatgtttagaagatatttctaaggtattgcttcgcgattagacaattaccaaaaaagttataacatgaaattccaaaaaagtcgaaatttttgagtttttttcttaataacttttttagaagctaaaatttttgtttgttttttgtaaggctaatagtgtgaagggcttttgaatgatatcaagattgttagatttggtcaacaagaaaaaaagttataataaaaaaactgaggctggcgccaaaacgtcggcgccaaaacaacccagtcccgaaatgtcccatagtatgatgattgataaacatacatggtatattggataaatgatgcaaaagatgataattctcaaataacatttcaatgtcctttgtagggcaagcgctttcgacttgtgactaaaacacgaaaaaagtgcgagaaatcagagagcgagagaatg

SEQ ID NO: 116943 - DNA, 64 bp, Heterodera glycines
  Promoter: Source sequence=SeqID_34156; Location=1044..1107; Strand=+; Gene=SeqID_64023
ttgcactgattaattcaaatttccattaaaattttcaactcaatctccaactgttttgacaatg

SEQ ID NO: 116944 - DNA, 1003 bp, Heterodera glycines
  Promoter: Source sequence=SeqID_1769; Location=6103..7105; Strand=-; Gene=SeqID_75858
gtttttaatcaagaatagttttttcagggtaaaagcttctaattcattatcaactatttaggtgtaaaacaatgtttcaatttttaattaaaaaaaaataagcaatttgcgccgaaaattgacaaactaaagccattctcataatgctattttgaaaaaaacgaaaaaaaaacttttatatattgatcccaaatccgcaccatataattttgcagaaatttgaattttatttaaaaaaatatatttaattttattgtcgaaacggtcattgtcgaaatgtccgggagccagcgggggcccaaacgctctggtccctccgatatgggtccgtatcgttttggcgccgacgttttggcgccagcccaagtttttaggttataactttttttgttgttaaccaaatccagcagtcttggtatcaatcgaaagcttaacatgtttagaagatatttctaagctattgcttcgcgattagacaattaccaaaaaagttataagtagtaaaccatacgccacctctgcagcatgacactaattaaaagtgacagctgaccagtggaggggggctaattagctaattgattgacagctggtcaaagggaaaagtgacagatgggggggggaattaaaatcaaaacctatgggagggttttcgggtgactaattggggggatggtcaattaattaattaattatttgggtggggaaaaagccaaaacctatggggatattgctgacaaattggtaacacgaattaattgtttactgcatttcaacaatttgtttggctgaacatttgagcagggttgggggggacgcgggggtgaccaatcctaatcccatggatgggagggtgggtgattgacagttctgctaaagggtgtggaatttccggcaacgaaggattatgcaaatttgtgcgcggcactagtgctgttgtttggagctaccaaatatccattccgcaaaatattcttaattcagggggcgggctcaaaatatg

SEQ ID NO: 116945 - DNA, 282 bp, Heterodera glycines
  Promoter: Source sequence=SeqID_15864; Location=1181..1462; Strand=-; Gene=SeqID_80195
tctgagcaggagttagttacacgaaaagtgaatgcgtgctttttgaaagaatgaatgttcgaatcactcactcactacacaccctcaaaatttgtattcaaattttgtgctaaaaaattcgcttcaaaaaatcgcacatagtagcctatttaagtgcagattgtatgcttaagtatacactttaatcattcattaaaactaattttttgaaaaatggacaatttcattaaaaaaagtgaaggagtttgtatgaataatcagtttcagcatgaggacaaaatg

SEQ ID NO: 116946 - DNA, 374 bp, Heterodera glycines
  Promoter: Source sequence=SeqID_11970; Location=1..374; Strand=+; Gene=SeqID_75489
tataccataggtgccatcaccgacacacgaatattttcgcttcttgccaaatgacaaataacttcttaagtgaaagttttaccgttaccaccagcgccattaataaaaaaataatgctggtctttttttattgtgcaatttttcaaaaaccgtatcaactattaatttttgctcatttgtcaattttgcataacaacaaacttgaatttaaaaaaaatttggatgtaatatcgctaaatcgttggtttaaaataacagatttgagacattaaaatgtaagaatacatttactgtgtttggtatgaaaaaagtaaataaaaacaactacatatttcatcataaaatcacctatagaatagatttacattcctatg

SEQ ID NO: 116947 - DNA, 116 bp, Heterodera glycines
  Promoter: Source sequence=SeqID_1880; Location=2609..2724; Strand=-; Gene=SeqID_76553
ttttggcgcgaaacgcgaatattacacccctaagaatgagggatgaaattcctcaaaaattttcaaaattggacctataaattggctaattttcagtgaaaacctgtttaaaaatg

SEQ ID NO: 116948 - DNA, 1003 bp, Heterodera glycines
  Promoter: Source sequence=SeqID_40510; Location=308..1310; Strand=-; Gene=SeqID_68819
gggggaaaaaaaaaaaaaaaaaataaaaaaaaaaaaaaaaaaaaatttttaaaagggggggaaataagggggaaataaaaaaaaatttttttaataaaaaaataaaaaaattcccctttttgaaaaaaattcctttgggttacaaaaatttttttgggcaaaaaattggggaaactgagccaaaattttttcgtattttttccaaaaaaatccttgccaaaatcccattccccctaagggcctggatttttagggtgcggaaaaccccaattttggaggcctaaatagaaggcgaaaaaaccccctaaatagtgcggaaaatggtaaaatattggggaaaattttaaaaaaatttgtgctttttttcaatgaaaaataaattaagacccagtgtaaataacttattcaacaaattttattcacaaaaaattaaatttcatttttttgaataaaaagcaaaaaaaaatttgcttaatgaaagttcgatttttcagcttatttttcatttgaagtctatattcaaagagaaagtttttaatttttttttgtccaaaatcttaaaaattatttctatttttgcaatttttgaaaaattttcaagaagtcggtccttatggtgcattttttaattgcatttttggtaagaaatttttcaaaaatgccgaaataggggtcaaaataagggcgatatgccaaaagtgccaaaataggtaccccctattttaggggcgacaattcaaaaatagggattcctagggacgtatagaggagccttaaaacgaagaattttcgcgctaaaaaggttttttttcgtgcttttctcattgaatttaagccgcagaaaaaataaatactaaaaaactaagaatccgggcactaattttaggtaaatattcctggctttattctagtttacgcgtccaatatcaatgagcatcctcagtttctttggccctaactttttttttccctgggtcagtgccaacattcatggcatcaaatg

SEQ ID NO: 116949 - DNA, 240 bp, Heterodera glycines
  Promoter: Source sequence=SeqID_42240; Location=469..708; Strand=-; Gene=SeqID_70187
gctgaagtgcaataattaattgatcaatgtgtgagataaaacctgtttccccaattaattaagctaattttgttttaatattcctctttatccacatgtaaatgctattttagtttatggttttaaaagtttcaatatttaataattcttccatttattttaaatgatttaaataaattaaaataaaaaatttatggaaaaaatatattttatttcgttaaaaactaaattttttagatg

SEQ ID NO: 116950 - DNA, 188 bp, Heterodera glycines
  Promoter: Source sequence=SeqID_3933; Location=3274..3461; Strand=-; Gene=SeqID_52505
aattttcttaattattgtagaggaactcagagcggcagcgaaaagtgccacattgtttttcattttaattgtaaaattatttttaaaatttaattattaaaattttccaaccactaaaaataagctataaaaatatttgttattttataaatatagccaaaaatttaattttttgtatcaaaaatatg

SEQ ID NO: 116951 - DNA, 373 bp, Heterodera glycines
  Promoter: Source sequence=SeqID_21468; Location=1..373; Strand=+; Gene=SeqID_52076
tttctttgagttttttaattgtttcccatttcgcactcatgtgatttctgaaagaggagagtgggaagagagaagacaccataaggaatttcaggaagatagacagtcgattttcattgaaaatccacacaataaaaggaatgtagcgagtagcgtgcgagaagatgggtttaaaaagatatgtgaggagttcgaaaagacagctaatgaattcggcctaccattaatcaaggaagtaaatgtccttgaagaattaggaattgatctggaaagggaatgggtagagaaaacggcagtctcatctgttgagaaaagtgaattgttagaacgagctaaccaaagtcgagaggctgaagagctcagtgacgaaatg

SEQ ID NO: 116952 - DNA, 624 bp, Heterodera glycines
  misc_feature (501)..(502): n is a, c, g, or t
  Promoter: Source sequence=SeqID_22894; Location=1756..2379; Strand=-; Gene=SeqID_53601
ttgattaaattcccataaaatttttcaaaattttacctataaattggctaattttcagtgaaaaactgtttataaatgatcaaaattttcaatttttttccccggcggcgcctatcggcaccgccgcgcccccaaaactcctattttttcttagaaaatggcccaaaatcgcaaaatttggtaatttgatgaaaaactgttctcagcggcgcgccaaaactcttatttctcattagaaaaatgatacaaaaatcacaaaatttgatgattttttggtgaaaatctgtcaacaaattttaaaaagtttttttggaaaaagcgcgcctcaaaaaagcgttttattgatttttaaatttggaataaaatttttaaaaatgatttttgctttatgattttaactattaaaaagttgtagaaaaaatttcgcttttcgcatttcgcttttcgcattttcgcatattttggcttttcgcatttcgcttttttttcatttcgcatttnncagtttcgcaaatttcgcttttcgcatttcgctttttatttttcaatttggcccatccctggtatgaatgtaactggccagatttcggtacttttcacaaaaatgtaaaatgaaaaaaaatg

SEQ ID NO: 116953 - DNA, 92 bp, Heterodera glycines
  Promoter: Source sequence=SeqID_33570; Location=613..704; Strand=-; Gene=SeqID_63591
ttgatctgatcagcttcttttcccttttaggggtcggcgatctttcgaatcgaacggtttcagcggagatcactttttaattagtgaaaatg

SEQ ID NO: 116954 - DNA, 168 bp, Heterodera glycines
  Promoter: Source sequence=SeqID_21668; Location=1370..1537; Strand=+; Gene=SeqID_52275
atttttgtctaggcaaccgaaaagtaaatttaattggcactcatttgtttggcattttgtaacatacaataaagaaaaagtacccgtgggcgtcgttagtttaaaatttgttgcgctcttccttctaacataataaatgggcagcaaagaatgaatgactgatgaatg

SEQ ID NO: 116955 - DNA, 381 bp, Heterodera glycines
  misc_feature (70)..(70): n is a, c, g, or t
  misc_feature (106)..(106): n is a, c, g, or t
  misc_feature (128)..(128): n is a, c, g, or t
  misc_feature (191)..(191): n is a, c, g, or t
  Promoter: Source sequence=SeqID_2489; Location=1326..1706; Strand=-; Gene=SeqID_80028
cctcaaatttcaaattttgattgtgattgacaaaaacaaacccccccccccctatatgacaatcgcgatntgtacgttggattgttacgatttttttgaatttttntaatttttctcccagttttttnttaatattttcaatgcctggaaaaagcagaaatttctgaccgttgttcgctaaaaaccaccantggattttggtggacggcggtgcccgtaggcgacgtcgagaaaaattttttggttttatcaatttgatcgggaccaggagaggatcccgggtccggaatttaatttattttacatttcttaaaatatggtcatatattttttcttcttaaattgataattttttttttatttttagcctcttggaaaatg

SEQ ID NO: 116956 - DNA, 1003 bp, Heterodera glycines
  Promoter: Source sequence=SeqID_9215; Location=720..1722; Strand=+; Gene=SeqID_70639
acaattccgtatttaaaaatgtgttgaagttgcaacccataaagtaatttattttttcttttcttattgttcttcttaaaaactccaagaatttttatgtttatttcaattttgtattagattaaaaaattagaaaatagtcaaatattaattctacgattccgattcatttgtttaaattaatacaaacccctattttgatatgattcaaagaatttccattttttaaattggataatatatgaaaaagattacaatgatgcatgattaccacccaaagatttctgatcatccgctcatcagttcattactgatcactgatcgccttcttcgcaataattcatgaatgagtgagtaatcatgttttccgatcactttggtgctgacgagtgatcaatcaatcgcattttgtgcatccgctttttctctcctcgccccctgctcccgctccctaaattttttcggcacttttggttgactaattaattaactggcgaataatgcgttggtcagctgtttctgattttcgcggatcaccgacggacgagagcagcggagaagaatggaaatgctttagcaatatcatttgttagcgtttgcatcataataaataattgcgcttctgcaagcgattcgcgagaggaatcaacgggaaaagcgaagaaaacaaaactcgtcccatcggacgaacattggacagtgattataaaagtaattgagcataatcagtggcagaactttattatgggcaataataattaagaagatgaggctaattacggtccccattaaaaagcgcataagtgcattttaatttgataatttaatttaccattaaaaagtcattcttatttatgttcatcactctaaatttattatttccaatttttctttaattttacaaatcctttgtccattttaattgacattttaccgtcatattttacatcttcggcatctattatccttaacttatcgctgttttagcttctccaattcaatg

SEQ ID NO: 116957 - DNA, 141 bp, Heterodera glycines
  Promoter: Source sequence=SeqID_32431; Location=944..1084; Strand=-; Gene=SeqID_62737
ttttcaaatattgcggattttttcaaattattattttttgtcactattggtgatcactgatcaggcccaagccaacgcttgtgccgttaaggtgtccgtgatttgctccgcgtgttggcccagttgcacgccttgtccatg

SEQ ID NO: 116958 - DNA, 285 bp, Heterodera glycines
  Promoter: Source sequence=SeqID_34537; Location=736..1020; Strand=-; Gene=SeqID_64301
ttttgcatcgactcaatcgccaggtgtgccatttcagtctcaaactgtcgcgactcgcgctgccccaacgccacgcgggcgatcacatcgaactcattttctacgaaatgcctacaaaaacgggggggggggggtaaataaattttgactcaaaattttaaaagagttcatgatatgatacccatataacttggaacaaagaaaaaaacttggcacacactcaaacatattttatctctaccgtaacgtagtgacgtgtttcaaaaatgtatagtatatggcatg

SEQ ID NO: 116959 - DNA, 77 bp, Heterodera glycines
  Promoter: Source sequence=SeqID_21858; Location=1187..1263; Strand=-; Gene=SeqID_52490
gagataataggtttatcataaattttcattaaaaataaaccctcaattattggtatgaacgatactttccaaacatg

SEQ ID NO: 116960 - DNA, 359 bp, Heterodera glycines
  Promoter: Source sequence=SeqID_18804; Location=1889..2247; Strand=-; Gene=SeqID_83482
atttcagtgttcgctgttgtaaaacatttttgcccgcttttttctccttttatgacgccgcttcggtacgaatgcgcaacaacatgctggtgatgatgaccgacctgtgcttccgcttccccaacgtgttcaacaagttcaacgacacattcattcaaaagtgcaaatttaatttatcatttatcccgaataatgcaatgctcctcaattttaaaataattaaatgcttttttggggtcccgactccttccttgcctaatccgtcttatattaatttcaattttattactaatttctccattcccttccaaagggttcgtgacgagaacaacggcgtccgctacacgtctctgctgatg

SEQ ID NO: 116961 - DNA, 510 bp, Heterodera glycines
  Promoter: Source sequence=SeqID_20554; Location=1..510; Strand=+; Gene=SeqID_51100
agaagagcgaaaacaaactttttttttaagagagagaaaagaggaaaattgtacggttttgtgtatgagaaactgttgaaagaaagcaattagtcatcacacgctttgatcagtaaaatgaggaactgattagtattttcgaaaatgggattctttagagaaataaatgttaaaatatgctcggacagcgattcaaagctcaaaagaagagaacattgaatagatctgcaaagagaattattacattgtttcatatatcaatgaaatatctttaattaattttaagaatagcgtgcagaaacaccatcattgatatcattgatattttaacataaataaaaggtatttgtaagctattgatacgcgataagacaattaccaaaaaagttatacatgaaaattgcaaaagtcgaaatttttgaagttttttcttaataagttttttctaagcttgaaaatctttttgttttttatacagctaatagagctttttttaagagctttcgaatg

SEQ ID NO: 116962 - DNA, 253 bp, Heterodera glycines
  Promoter: Source sequence=SeqID_8758; Location=631..883; Strand=-; Gene=SeqID_69127
ttgttctccgcttaatcgtctcaatgcgaagaattccccactattgtggtcttagtaaaacctgctgaaaatgggggggggagtataaaacgagcattgtttagtcatttgatcgcacatttttataggtgaaactaacagctaaagccaaagcatttcagctttccaatcgctcaattaatttaatattattaccaaaaaagcactgttaaattttatattttttaatatttagcaggaaaagccaacaatg

SEQ ID NO: 116963 - DNA, 418 bp, Heterodera glycines
  Promoter: Source sequence=SeqID_2310; Location=1523..1940; Strand=-; Gene=SeqID_79033
tctaaaagtcaaaaatgggagtgatcagtgtcaaatggagagagatagagagagagagagagagagagaaaaaagtgccgaaactgaggaggaaaagagagccagaaagtgaaaagaatggttaagccgggagtcaggatcaatgtcgagaattcagaccacaaaactggacgcataattcggtcgagaaccgggattgaaaagtgtaaagcggagaagagagagaggataaagagattgagagggagagggagggaaagaaagaagagagacggggaaagagagaaaaaagaaaatagggatagaaagggagagagagggaggggaagaaagagagacggggaagagagaggagagagagggaggggaaaaaagagggaccggggaagagagagagcgagagattgggaacggaatg

SEQ ID NO: 116964 - DNA, 127 bp, Heterodera glycines
  Promoter: Source sequence=SeqID_3108; Location=1618..1744; Strand=+; Gene=SeqID_83219
tgtgccgaatggaatcgccgaacattggccaaatggtggacacgaagaactccgaaatgcgaacattttcattcttaatgcgcaaatatgtatatgttgtaattgaagtgaaaaagcggtgaaaatg

SEQ ID NO: 116965 - DNA, 713 bp, Heterodera glycines
  Promoter: Source sequence=SeqID_6133; Location=1..713; Strand=+; Gene= SeqID_60466
atcaataaatgtttatttaaatattgttttatttaacctctttgattttagagtttttagaaatagattatggtatatttattcattttaattattttatgtattactgttcgggtggtcaaccccgagagatgaaagtttgcatttattttccctttgcatttgtctctttcttttcctcttattttccccactctctaattgttgtgtcttcctttattaatgtaagacactattgatttattttgtccaatgcatgtccattcccctcattcattcagttgctttttatgcacttatttctcttcgcctaaatttttgttctcctccaatttatttattccgcctccgacttcgcccatttttatttaaaattgtttaatttatttgttcatcaaataaacattttattgtgtcggcttgaagaccgaacaattggcgacgcccgtcttaaaaaagaagctcaacgtcggaatattttggcaatttcggacagattccgaattgctattcatcaattcttcaaaaaagcaatagacccaataagggtgagcttccgccaggcgcggtttattcatcataaaaaaaccaagatacccaggtggttgcggtttccgccaggtgcggtttactcaacaaagacaaggaaattcaccgaaaattgatcaacaaaaattgcgcaaaatccgacaatcgatcagctagtgaaaatg

SEQ ID NO: 116966 - DNA, 1003 bp, Heterodera glycines
  Promoter: Source sequence=SeqID_2933; Location=38..1040; Strand=+; Gene=SeqID_82411
tttcgcattttttggcgtttcgcatttcgcttttcgcatttcgctttttggcgcgaaatgcgacttttacacccctaagaattggattaaattcccacaaaatttttcaaaattttacctataaattggctaattttcagtgaaaaactgtttataaatgatcaaaatttccagtttttttccccggcggcgcctatcggcaccgccgcgcccccaaaactcctattttttcttagaaaatggcccaaaatcgcaaaatttggtaatttgatgaaaaactgttctcagcggcgcgccaaaactcttatttctcattagaaaaatgatacaaaaatcacaaaatttgatgattttttggtgaaaatctgtcaacaaattttaatcaaattttcaaaaattttcccggcgccgcctgccccctcttcccaaaaagtttttttggaaaaagcgcgcctcaaaaaagcgttttattgatttttaaatttggaataaaattttaaaaaatgacttttgctttatgattttaactattaaaaagttgcagaaaaaatttcgcttttcgcattttcgcatattttggcttttcgcatttcgctttttttttcatttcgcatttttcagtttcgcaaatttcgcttttcgcatttcgctttttatttttcaatttggcccatccctgttgagcatgctatgttttttgcgatggtaatgcatacataattataaacatttaaaaagccttgaaaatgcagttgagccaaaattaatataatatattcgatagccctaagaattccctatttatctaaaaaaattccaaaaaaaaaattcattgagttttaaaaaagtcctggacaaaaattcctgtttaagattttgtcgtttgagccaagttatgaatttttatggagtttgaacttatcccatttctattattaataaaatcgcatcaaattttatttacaggttaataagggattcaaatgcacatataataaaaatg

SEQ ID NO: 116967 - DNA, 996 bp, Heterodera glycines
  Promoter: Source sequence=SeqID_14348; Location=1..996; Strand=+; Gene=SeqID_78377
ttcaccaaaattcacgtttattgcattaaattattaattaaaatatatttattatctattctttctctctctctctctaggcaaatttactttttaactatttaaaaaacattaaggtaaccaatattcctgaggttacaaattttccgtacccccctccccgacttttttattttgccaattttgcccctattttgggacttttcgcccctaaacaccaccgggccctaattattcatatcattaatgctctttcgtttcgttccattcttttttttctatttttattttctctttttttgcaaaaacaaaggcccgattttgatggatttgcataatttttttgctttttgctctttgaagaaaaaagagatcgaaaatagcggcaacatgtgaagccaacttttgcatattaatgttttggcgtcgttgggatttggccaaattaaaattaattaatttattgtttctaaattttctatttttgctcatttggcccaattaattaattaaaaactgataaaaaaaaaagtaaccaaaactgctgaaatgtgcttaatgaaagtaagcaaacatttaacaaaaatactttgatgttccaaactttctgactagaataaatttggttgaactgataagattttttaaaatatttttgatgattttatgtaaataaaatggtcaaagattgatgcccaattgaatttgcttcgtgcggaaaaactgtgttaataaaagtgattagtgaaggtcacaaatcggaaacgcatgtgatcatttgcaaattatttgggtaattaaatggcatttgacttttatcggcccacaaattacggtaattgtgctaaaaggccaaagattccattcaaatgattgattgattatctgtgctgattaagcgaattttctccgtaaaaaagccctttaaaaggcatgccaaaaatggaaattcattcaaaataatttaattttctctgttttccgaattacaaaatg

SEQ ID NO: 116968 - DNA, 84 bp, Heterodera glycines
  Promoter: Source sequence=SeqID_24120; Location=1..84; Strand=+; Gene= SeqID_54822
tagaagtttttcacgagtcgtgccgccattttgcgcctttgccctgcgtccgtcggcacaacaccccgaaagtggctgggaatg

SEQ ID NO: 116969 - DNA, 1003 bp, Heterodera glycines
  Promoter: Source sequence=SeqID_100; Location=8241..9243; Strand=-; Gene=SeqID_67532
aatgccaaaaaacggcacccacaaaaatggcattatcagcatcaaagagtttggtgagatggcccgcaattgtacagacgtcaaagatggaagtgacggacagcacggggcaaaggcaaatgctggcaaaaaatggagcaaatttaaaaatcgttttttcaatgaatataaattgctaaggttaaccaattttttggtaaaattatttccaaacaaattgtgccaaaataatattaatccttttttttgcaaattgtaatccaaaaaatgggcaaaattggacgtaatttttgttttttctcgccactgaagttggcatttttagtggtagcatttctggttgcattggtaaaatttcgaaaatagctcgaagtttttggaaaaaccacgccgcaaaaacggtttttttaaaaaaaagtcgtcgacttgcaaaaaagtcgcaaaatttggcattttttggttcgaaatatgttaacaaaccgcactcaagttttcaattttttttcacgatggcgcctgccggcaccgtcgggcctcagtttttgattttttaataacacaaaccaaaacaggaatggttttctggaaaaatacaaaaaacaaacagaaatagttttttggaacacaaattaaaaattaaaaaagttttttgaaaaaatatatgcaaaaatgggaattgttatgttttggatggttggtaaaatattgaatttctagagtgagtatttaatgacaacttttcattttttattaaaatttgattggaattaattggtttaaggccacctattggccctcctcccccgtttaatgtttgaaacctgaatcaaacaaaatatttgaataaattatgcgtttaagatttttttgattaaaattcggcttgaatacatggaaacaaaaaagaagttaaaatgttacaagaccgtttaaattatgtgcaaataaagtgcattaaatttttaaattttttattattcacagggaaacctttttaacaatg

SEQ ID NO: 116970 - DNA, 154 bp, Heterodera glycines
  Promoter: Source sequence=SeqID_10752; Location=2267..2420; Strand=-; Gene=SeqID_74001
ttctgtgccgcaccggcgtcgaccaaatttcgggccccgtggccaactgcggcaacttcaacccgtgcctgaacacaacttcgccccgggcaagcgttttttcatgtgaccacggcggaatttgtgaaagcattttgaacattcgcgacggatg

SEQ ID NO: 116971 - DNA, 453 bp, Heterodera glycines
  Promoter: Source sequence=SeqID_33605; Location=278..730; Strand=+; Gene=SeqID_46350
ttaagttttcacctaaattttattttgtatataaattaattatttctgttaatcctttctttactcgctgtacataagtgtcagcttattgttagcccaaacacgtacagattaaagttaggtaattaaaaagatttgaattatttttcatggcattatgtttttggataattggcatttagatcaacctaaccaacaagaactaaagatcgattcatcaatcaaataacttttgatttcgtttaatgtggtcatttacattcatacatccaagcccgtagttagtggtgaatgaaagggcgggtggggttaggattgggtccattttgaaaatttctatcaatttattaaaaaatttaattgcaaatattcatttagatttaagcattttctaatttaattaacggtttgccaacctctgcacattcttcgttacaacttccgagattaatg

SEQ ID NO: 116972 - DNA, 73 bp, Heterodera glycines
  Promoter: Source sequence=SeqID_6076; Location=1153..1225; Strand=+; Gene=SeqID_60227
tgggccaagcgatggaactgagcgcgtgccgaagccgttctcggctgtcctcaatctcgcctttgtaataatg

SEQ ID NO: 116973 - DNA, 1003 bp, Heterodera glycines
  Promoter: Source sequence=SeqID_3253; Location=3367..4369; Strand=-; Gene=SeqID_47566
gtggcaaatcactgcatagcataaattaatgattcaaaaaagaaaatcgagtcaatggatgaaagaaatttttctctccttttatcgtactatttttatatctctaatcaatcgaggcgttgagaacaacaaagaaaatgacaaatacccagatttttgaccacattttcacctcactttcatctttttaacattttcgaaaaatttgatggtttgaaacgagttaaattgcttagcattcgcttagaaaaagattcaccttttcaaaactttttttagataccaattttgtttagtttagttggaaatgaagaaagttacggctgatcaaaataaacaatcaaaaatgtcagtgatcattgtaaatttgaattagcgcgcaataatttacgccaattacgctatttggcgttatgagcaattttgtctgttgactagagaccggaaatttcaaatttgcggatcccgctgcgggactggaactcaaaattttttgcgggacgggatcccgcgggattaatcccgcacatcccgcattttccaaaaaatgcgggattgcggactgggatcccgcaaaatcccgcgcgggatcccgtcccgcgacggtctctactgttgacccatagtgagaaagagagtatagagaaaaaactaatatctttttttctctaacttttctcttcttttggtggattatctaatattttcagtattataaaataacattcgcattccgatgcgcataacttttgatgcattccggaatttcattattaaattttgcttatcgatagagaaaaaattacgaacaaaactggagaatttttagagcaaaaagtgggttagctaaaaagttattcaaaaaaacaaatttttgaatgcccttatctttttttctaattctatcaaaatgcttagcatttgcttagaaaaaggttctcctcctcaagagctttcaaatgataccaagtgttttcattttttaaagagatctctcaaaatg

SEQ ID NO: 116974 - DNA, 248 bp, Heterodera glycines
  Promoter: Source sequence=SeqID_11567; Location=146..393; Strand=-; Gene=SeqID_75010
ttcgaaagctcttatcatgctctattagccttacaaaaagcggatagattttcaagcctgtaaaaaattttattaagaaaaaacttcaaaaatttcgacttttcgaaattttcatgtataacttttttggtaattgtctaatcgcgaagcaatcgcttagaaaaagcttctaaacatgttaagctttcgaattatatcaacaatgttggatttggattagatagaaaaaagttatagccaaaaacatg

SEQ ID NO: 116975 - DNA, 1003 bp, Heterodera glycines
  Promoter: Source sequence=SeqID_118; Location=3027..4029; Strand=-; Gene=SeqID_72236
acatgttaatgacgcaaaattgctcaattttaaatataattaaaatccattaaaaaaaacaaatagaaggaaacttgtgaagaatttgtgattattaatctccaataaaatttttatgtttaaaatatataatgattaaatattttcaaaaacttttttttttaccacatcttccccctttcactttctgccccctcggcccctctcccgcgtgaaggtcatttgcacttttgtgagtgaaagtagcgaatttttaataatgcaatttacgatagaatttaagtacaaatttaaggtcatataaaattcttttgttttgcattgcgatttcgtaatttttttgttttacgattgcgaaatctttttttttgcatgactcactttttttttgccccttttaaataaaagctgtcaagaaaaatgattgatgactcccgaaatacggctttaaatgtgcataaaatttcgtcagacaattttttgccccgtttttgaataaaactgtcaataaaaatgattgattggttccttatttcgcaattttcaccctttattttgtaatgtgcacgtgacttttagtttttggaccaactatttcacaatatgcgcattatttgggtcacctgtcacaaaaaaatgattgacgactttcgaaataaagaatatccagacgatttttttttgcagtttttgaataaaatgtgacagttgtctactaaaatgattgatgaccctctaaattaaggtagacccagacagtcacgtgactagacccctcccctttcccccaattcgtacacccggcccaaatcgcaaatcattcaactaaatagttggatttcattaaactctctttgcgctctaatttattttactccgctctatttttttttctacattttatttccaatctactataatttttctgccgtctattttctttaaatctctctgctcttttctattactcttcttaaatttcgcgttttggtttttaaaaatg

SEQ ID NO: 116976 - DNA, 352 bp, Heterodera glycines
  Promoter: Source sequence=SeqID_6401; Location=3860..4211; Strand=-; Gene=SeqID_61424
tatttttgcggggggataccgtaggattaaccccacaaaattaacttttgtataaactatatattggggtgttgtataagttctgtcaccccgaccaaaaatttcattcaaaaatttataaaaaatcaaataataactcaaaattaatcaaaatatgcaccatcattcccgatcatattctgccatttttgagattttaaaaatgatctatcgattaaattcaagatagttagactcaaataaactgatgggtctacttaaaaaagtggacaaattcaaccactgatttcttggctttagtcagttgctgttctatgaccctgtactgcttcaacttcttgtcaacgacatg

SEQ ID NO: 116977 - DNA, 269 bp, Heterodera glycines
  Promoter: Source sequence=SeqID_41374; Location=114..382; Strand=+; Gene=SeqID_69516
tctgggataataaatattaaaaggtgatatatcaacaaaaaaacacacttgaatatcaaacgaagaaattacagtagtctaaaaattttgacaaaataaagtacagtaaccgagaaaattttgacgagcaaattcggtattccagaaaactatgataaacaaaatatgatattccagaaaattttcctaaatgaagtacggtagtcagaaaattcagaatacagtagtaaataaaattataaaaaatacagtaactcaatatattaatg

SEQ ID NO: 116978 - DNA, 912 bp, Heterodera glycines
  Promoter: Source sequence=SeqID_16873; Location=163..1074; Strand=+; Gene=SeqID_81302
attttttcaaataatttttgatttgattttttgttaataaattgtttttcatttatttccttttgtgcgcatttatgtcagtgatttgaatcattttcaatatttttgatcatttttctttaaaattttctcattattttttttcaacgagaaggcaaagcaaaagctacacaaaatgtgctccaaaccgacgaatgttttcctcttcaaacgccttgtcagccccgtccaaatttgctgccgttcaataaaaggcggcggtttggtccatccggtgaccggcaaaaatccgccaacgcttgaggaattcgacccgtaaagacacaattttaattgctatgattgaaagcgatttgttttttcagtttgaaccccggcgagtggcagttgggggtgagttttctcacttaacaattttcgagtgggggaatacaaaaagcacacgtattttacaaaaacaaagcctagcctaaagcttaggccgaagcctctgggccaaacctaagaaatttttacgagttgtcttttaatgagttgccatggcatcattttgcaaaaaaaaaaaaatttttccaccatttcaaaactattctaaacgacaaagccataattagtgaggaataattcatgtttcttgatgtttgagcccttaaaagtctttaacagtgttgtatactgtactgtgtcattaccacaaattttttctaccgtgtttttattttatcattttttctttctacaggcctatggtaaaattttgcctcgtctcccggagggcacgcgttgtggcggtttggtgatgggcaaatacggcctgtacaatccgaaggtgcgcgcgctgcaggaggaatgctatgtgagactgagaccaattttggcattttttgccatttcaattatttaaacacgatg

SEQ ID NO: 116979 - DNA, 770 bp, Heterodera glycines
  Promoter: Source sequence=SeqID_10671; Location=480..1249; Strand=+; Gene=SeqID_46895
aaatcactcatttttgttaccactataattgataaaatggtgcacattctatacgacacatcggtttcgggctatgatgcattttttgtgcaaaatggatgtggagtcggggatgactcctcctaccaagtttttcgaggcgcgcaaccgtttcagcgagggtggggcactgcacaaacgggtgcaggaataggagatatttttcgtggtctctggcgctttttcctgcctttaattcgcagagctggagatactgtagcagacgaaacaattcagactggaaaacgctttataaatagagtaatcgatgaaaaacccggcttaaaaggaagtatagagacattgacaactgagagtaaacggggagcagacaatgttttagagaagggcggatttcgacgtcaatttggcacaggaggacgaagaaagcgtataaaagctaacaattctcccactctatcacatcagactttaatcggaaaagcaataacgaaaccattaattaaaagcaaaaaaaggcttcgatcagacgcgtttggtctttattaaaaatgacatttcacaaaattgacgtgagtagcatcgattcgattaccaacgccgtggattttttcagtataccccctacaaatgttacagtatcatcgtcaaaggttttcgagattttgccgagtaatcccctcaccgacacaccttaccattttaaaatacactcgagccaaaactacattgacctgtcaaagtgttaccttttgaccgaatttcgaatg

SEQ ID NO: 116980 - DNA, 94 bp, Heterodera glycines
  Promoter: Source sequence=SeqID_8421; Location=105..198; Strand=-; Gene=SeqID_68000
ttttttcaattggtaatcagagaaaattgaagaagtgaactgaaaaaaaaattatcaaaaaaatgtgaatggaattaatgggatgaagaatatg

SEQ ID NO: 116981 - DNA, 949 bp, Heterodera glycines
  Promoter: Source sequence=SeqID_20297; Location=714..1662; Strand=-; Gene=SeqID_85099
tcccctcgaagaaacgaaaaatcttaagaaaactaagaaaaaaaatttcgaaattcattttcttagagttttcttataaaaaagctctaacaataagattttttcttgaaaatttctaagatagtaaaaatttttttgaatttttcgacgcgggaaacgtagtgcaccgatttttagacacctatttataggaacagtttatttccttcccgaaaaatattaaaaataattcattttttattttaaatttttcaaaaatttcggaattcgcgtgaaatgtattggttttcattgtttttccacaatattttttgcatattttctaaccaatttttcataatgcctaaatgtaaatttatttttagcattttattgcctccgccgacgctcgagggagtgttggccgaattgaacggcacaatttgcgcgttggagcaattgttggagcagcgacagcgcatccgacaaaaattggtgggttttgccgggaaaaaattcttaagaaacttattgttagtaagaaaatttcaagaaaaaaattttttgaaacttttctgcgatttttttgatgaacactaccaaattttttcaaaaattttttgaacttttcttactaacattttttaaaaatattttcttttgtgaaatttctaaatttgaaaattaaaaaaaaactttttcgagggggaaatgaagtgcacccaccatttgtcaatcgcaaattttagaccgaaatttaaaattttactcccccttgatttacaaaatttgcccaaaaattcttctctaaattgcaatttttgaattaattattaacttattttatttaaatgtttatttaacagcaatttttgtttttttaattttataattaatataagtaataaaattgttgtgcttaattaattgcaaaattgaattgtttcagtttcgtgaatgccaaaaaatg

SEQ ID NO: 116982 - DNA, 1003 bp, Heterodera glycines
  Promoter: Source sequence=SeqID_21931; Location=350..1352; Strand=-; Gene=SeqID_52569
ttatgacgtgccaaacttttttaatgaataaacaaattaaacatttatttgcaccaatcgagtgtccagtggtgtagcggtagtgcgcttgtcattgatttttaaaccctaggttcggaatcccctacatgcaaattcatttttttttttttgctttttataccaaagtcaattatccaaaaaatgttttgatctaaaattcttatttttaacccattttgacacataagttactcaaaaagtattagacaaaaattagattttatgaactgaaaagatatttattacattattatctttaataaattttttgttaatgaaataaaataaaaaataaaagatgtgttttataaaaaattttttataattgacttttgtataaaaaagcaaaaataaaatacccatgggtgctctatccacccaccaaatttcatttggaaatcccacggacacctggggaccttcctttgtcagcacgctttcttttagcttataattatggatagaattttttaattttatctgtttagcttttatttcccgagtgatcattcaaaaagtcaattaaatttaatgaaaacgaccaaactactaaaggtggcgtctgagcccaataatgagaagcaaacaaatttaattgatgaaaatttatctcggccaaattaacaaaagaaattggccaaatgacaaaaatatttcagctaaacaaatttttgtttaaattttttggttttccgtcaactcgaaacaaaagtttagtttagtcaactgtcaagtgcaacaaaattatttaaaataaattttaaataatttgaatcgatataaattggcatcaatttaatggttggctaaagaaagagcagctaaacaaatttgaaatttcaacaaaatttggtccgcctaagtgcaaaaaaaaatttgtttaaaagcgattaactttttagacattttcacactaaaataacatcaattaataaattgaataaaaattaattcatcaatg

SEQ ID NO: 116983 - DNA, 347 bp, Heterodera glycines
  Promoter: Source sequence=SeqID_32704; Location=1..347; Strand=+; Gene=SeqID_62977
aaaaatggtttagatgattttttattagtgaagtatcgacttttagtttgtttccctatatgtaagacattttaggaccaaaaatgagaaattggaaaatttaaattttcgactttttgctcgaattcgagtccgaggttcgacataggtcgaaattaatgcaagattcggattcaccggcccttatattgtataaaaacccgggattgtcaattgattggactcataaagtgcattagagccggggaaaattcttgaaaaatttcaaaatttttgttgaattttttaagcatttgtcagcgcataaactcattttggcatcatcttccgaagtttttgaggcaatg

SEQ ID NO: 116984 - DNA, 360 bp, Heterodera glycines
  misc_feature (58)..(58): n is a, c, g, or t
  Promoter: Source sequence=SeqID_28291; Location=1..360; Strand=+; Gene=SeqID_58915
gaaaaagatgaagcaagaactgaaaacttaagctactaagcatcacaccccctgcgcnttagcaagctaaatttatttttttaaataaaattttttactttttcatttcaaaatacttttcaattttttcatttattttactatttgagtgttgttggttcgttttagaaaaagtgatgagtaatgaagaacaaatttctcgttttcacatcagcggtttaacggataaattatttgtcgttataataattattattcatagagaataaattttttcattccattcattttagcatccattttattaaacacaaaaaaatatttgtattatttttaaaaataataaattttcaaaaaatg

SEQ ID NO: 116985 - DNA, 992 bp, Heterodera glycines
  Promoter: Source sequence=SeqID_1098; Location=1..992; Strand=+; Gene= SeqID_67762
tttgaccaaaacaatgtattttgataataatctgataaacaatatttaattgtgaacaaaaaaattaaattaaaatcgtgggattcgaactttttggggaaaaagtaaagccacaggcataaccactggccaccactgctcaccttgctttacctttctttgcaaaatataaaggaaaggaaaaaaggaaaagccgcataactcggcgcacacgtccattcagcaaaaacggtaaaaattcacataacaaaccggggtcaatctacccacccaccaagtttcatcccgaaactccacattcacttgggggcccctcctttgtgaggaaaaatcttgacttttaatgaaatttattaagaaaatttgttaattgtttcataaattttggaaatctttttgatgaaatagttatgaaaatgttactcaattatgtatgggtttggggtctttttaacagttgaaattgccccaaattttcaaaaatacaaagttctattttgaaaatttgaattaaagacatttcgccaaaaataataattatttatcaaattttgggcagtttcgctggtgaaatttaagcccgttttagcccggtcaaaatgaccgggcccgggctcgggcttcgacaattggccgggcccgggccgcccggtcaaaaaagcccgttttaccgggcgtcccgagcccgtttaaaaactataaaataaattttcaaaaaatcaatgccaatcccgcagaatcctgcacaaaaagtaaaatttgctgatcacgctgggggatttgaactccatcagttaatcggtcactgaataaaccaagtgcattgttaagcaatccgtcctttgtgcctttgtttgtgctaattctttttatttatttttttaccgcgtgggagaagaaatcagcaaattcaatttaatttttctacctaattctttaaaattcttttcttttttccaccaaaaaatggtgtttttcatttgcgaccaatg

SEQ ID NO: 116986 - DNA, 1003 bp, Heterodera glycines
  Promoter: Source sequence=SeqID_3323; Location=704..1706; Strand=-; Gene=SeqID_84209
aaaaaagctttctcctattggtgtaagcattatccaacggcaaacgagcaaaccttttatctttgtgattaggttgtaagaattattgttaagcaggcattgtttaattggaataattgttaaaataacaatctgtttgttaatttcttaaatgattgaaatatgcccaatttcttcacaaattatttctgtttacgttggccatataaacttttaaatcatcaaatagatgaataaagtagttcactatttaaatttaattcttttttccatttgtgtatattttttttctcgatttgcgcctaataattttgcaattttgttgccattccattggaatttacttttttctctcaattatacattaattagaccaaaattttaaattattattttttttactgatcattttgggtcagtccccatttctacaacaatttgatcaaccgctgattcattttgctcatttgttttgtttttaatttttttctttttctttcattttttcccatccatttccgaatatttcatcaaaattttgtctaattttgccggattcaattttatagataaagaaaataataaaaaaattaaatgccataaaataatttttagttttaacaaatttttctaatggcataatttaataaggcaatttaatgctttgactaatttgttaattaaatagaataaattaatttatgattattgtatatgtttttttaagtctctaaccatatttcagtggtgcaaaacaaaaaattaattttaaaaatagtaattaattttgaaatttttacatgcaaaaattaaaaaactgcctgataagaagaaaagcattcccccgggttttattacatcatatcaaataatacatgaaaataatgatgaaaatgataagcgaaagtgtggaattgataaaatgattcaatttaaagaaaaacaatcagttccaaaaacatttgtgttttaattttggataattttatctatattcgaaatg

SEQ ID NO: 116987 - DNA, 167 bp, Heterodera glycines
  Promoter: Source sequence=SeqID_38505; Location=787..953; Strand=-; Gene=SeqID_46565
atttttgatttgatttttttgttaataaattgtttttcatttatttccttttgtgcgcatttatgtcagtgatttgaatcattttcaatatttttaatcatttttctttaaaattttcccattatttttttttcaacgagaaggcaaagcaaaagctacccaaaatg

SEQ ID NO: 116988 - DNA, 137 bp, Heterodera glycines
  Promoter: Source sequence=SeqID_36643; Location=1..137; Strand=+; Gene=SeqID_65901
atttccttattttattaagtaaaataatgatttattcagttttttaatcagaaaaaaatcatttaaatgcctcgaaaaatgaattgccatttaattgaagaaaaataaaataaaatcatttcgagacgacaaaaatg

SEQ ID NO: 116989 - DNA, 1003 bp, Heterodera glycines
  Promoter: Source sequence=SeqID_8146; Location=3648..4650; Strand=-; Gene=SeqID_46552
gaacaaaagcttaaaaatttattttcgtcaaaataatataaaaaattaccaccttgaaaactttttttttataaattaaaatatttattttatttttttattaaaacacccatttatatgattaaatttcttgttatgaccttatttttaaataaaaaatatggcgctagttgcaaagaggtccattttgaaaatttttcacttttttttgacacatttttttttaaatttttatttacacataatgataatattaagcattaacagtaaaattatggggaataaaagtataattataacgaaggagatcacagaaagcattaataatagtttttcctttagccctagcattaagtcgaaaaatttgttcacacatgtatgaattcgttaaatttgtactggttccatgaattcttttcgtcttttgtttcaattgagcccagagtccttcacatttattcgtgttgacgttgaattcggtaccgtaatattcatcatcattatatgtgtaaaaaaatagaacaaaaaaagtgaaaaatttttcaaaacgccacgcttttaaagtagcgccgaaaatgtaaagcgcattaaagaaaccgatttgaataactcagagactacagattcaatttgttggcatggcattcccttcaaaatcgcctttgccttatttttgggtccctttgcccttgtttatgttatttacttctttgcttattgttagttttgcatttcaattccgcagaatgcgttgtccgtccgtagccgtgcgtatctgcgcagctgcgaacgcgtgaaggcctttctgactgccacagaagaagtggaggttcgcaatatgaaagtgacggagccgggcggtgaccaatcggtgtgccaatttttggagttgcttagcacgcagcgaatgtacgaaaagtaagcattttgtcgttggtttcacatttaaatctcttcggcgtgttcaaagtaaatggaagtgggtggttgtgcactgacaatg

SEQ ID NO: 116990 - DNA, 397 bp, Heterodera glycines
  Promoter: Source sequence=SeqID_31565; Location=1..397; Strand=+; Gene=SeqID_61896
aatgattgactgaaaaagtgatgacgcattaaaatcttccagtaaatgataattctttccttattccttaatattgttttaacttaagcccattaaaccaggtgcacattttgaagtaacctataaacacatgttattattttttggccgttttcattttaaatatttacctaaaatatgatattttattgtttaaatcaattataaaatatttttaatatgggtctgggatgagggtctgtgtttgtcagggttgaaaccttctgagtcggcaaattacccctaaaataacgaagttaggtctctactttcctaataataaaaaattaactactctttatttcaaattttatttaatttaacaatttgtcatgcttttttgtcactttaaaagatg

SEQ ID NO: 116991 - DNA, 517 bp, Heterodera glycines
  Promoter: Source sequence=SeqID_45485; Location=1..517; Strand=+; Gene=SeqID_72776
tttcatggatggattaattttgactggagaagatcgtctcattacgtctacgagcctctgacagatttttgccatcccgttaaatactgctttgaagtgccaaaaaatgacatgtgtcagaaattaaattgtgaatgttttattttattacggtgtgcttattgtgaattatatttatgctttaaccatttttttaatgattaccatttgtgtgaaaatgaataaaattgaatgaaaaagaaggaataaaaatttttgacccgatggaattgatttcaatggccattaatttgcataaaatcaaaaataaaacggggaaaataaattaacatatgagggattcgaacctacgagggcaaaaagggaaggcaggagcacaacctccgcaccaccgaacaacacaaaacagtgcaaatgtttatttaatttattgcaataaaaaaaagtttggcacgtcataactcggcactcagactcatttcgcagaaaataaaaacacttttcttaagaacccatg

SEQ ID NO: 116992 - DNA, 1003 bp, Heterodera glycines
  Promoter: Source sequence=SeqID_820; Location=4558..5560; Strand=+; Gene=SeqID_62030
caccgtccgtctgtctctatccccattccgataattattaatttttttttctaattttttaattaaaaaggattatccccctgttattgcccaaccgacggagtgccaaccctcaatttgtactttccttgccactttgttaccttatttagtattattattttaatttttgtcaccccctccgccccccccccattttcccattaaaaacgtgggaaaactgacaattagcaaaattgtttcccctggagccaatgcgcgaaaacgacttcaaagcgcctttgccgacattacgcctgaggccttttggccctcacttcaaaatgccattcagtcaagtgccgtccgcctcttgcgcaacgccgctgacttttcacgcctttttgttttctaatccaattagcggcggcatggcgccgtaaaaaggcacaagccctcgcttatacaatgtgacacttttttcggggatgctaaaaagtggcttaattaacggaagaaggaaaatatttttttactagaatttgttcgggagtttgttttttcgggaaattcttcaacatactatatatttgtatttttttcaaacattaatttaaaattgttatttttttagctttttatattgaaatatttttaaattatttaacataattgtttggaaattgattcttttatatattttttaaatataaatttaaaatataattatttttttatttgttatttttaaataaactttatcctaaaaattatatatccttgttcatttcaatgtttaattatttttaaatttaaattattttttaaaccttccctttttaaaagaatgtaaaaatagatttaaataaaaatagacaactttcattataatgaactaattcataatttgcctataatgctacttaatttaaaaaatctcgctcgaaaaatcgcaaaattttatattttattcattttaaattacactaatctccaataaaaattcatttccattttcaaaatg

SEQ ID NO: 116993 - DNA, 168 bp, Heterodera glycines
  Promoter: Source sequence=SeqID_42513; Location=1..168; Strand=+; Gene=SeqID_70381
cgaggccgcgaagaggccgagggagtactttcggtgcaggaaaattattaaaattttaaaattttttaattgcttttaaatatgccaaaaaatgtaggcttaacttttttagtgaaaattcgatcactcatattttttgctaattgagcagaagcgtaccaaactatg

SEQ ID NO: 116994 - DNA, 1003 bp, Heterodera glycines
  Promoter: Source sequence=SeqID_7175; Location=94..1096; Strand=+; Gene=SeqID_64050
tgaagtcggttctaattaaaacaaaaaaaatcaggcttctatcatgtgattcttttaaaatcgctgcatatatagacattttcattctattttacggctatggagaactttttttttttaatttgttgctctaaactaatatttaaattaaaaaatcccaaaacacaattttctttttaaatataaatattttggaagctgtcatgaatttcttaatcatttcttcttttaatttttgctggcttaatcagatagtagttactatccagtcattgtcgcggtggtgattgatggcttttggtctttgatgtttgccgcgtgattaattacctatggggggtgattaattagtgcgcgagcctaagcctatgggggggggggtgattaattagtggggagcgagcctatggggggggtacttaattaatgcctatggggcgaagtttttgcgtgaaattttcgcgcatttttttgattttaaatttcggaagggggggggggggtgaagcctaatttcggcgggaaattttcgcgcattttgatgaaacttttttaaaagttttggggtgtcaaattttgtttttttgttttttggtgatcattggtgggggggactatgcagcagcgctgtggtgttggtgatggatgagagagataaagtgagagagagagagagaagaagcaacgagagaaaagagacgggatgtgagataagagtgccggggggggggggatttgagagtatgcgatgccaaagtggcgtcctttcgttgaatgacgcgcggtgagggagggatggcgcaattgtttggcgtccgtaaaaacggagtgacctcaatggttggggggtccactcgcttttggcgaatagagtgacctaacaggggggggggattgattctggtgagtatgagttccccactttcattattttctcctttttttttgcatcatacgaacatttggcttccccttcccccattaagtttctttttttagaatg

SEQ ID NO: 116995 - DNA, 769 bp, Heterodera glycines
  Promoter: Source sequence=SeqID_22791; Location=811..1579; Strand=-; Gene=SeqID_53489
taatgtaaattttgcaatttattaaaatcaaaaatatcactaaaaatgaaattttaatggaatttgtctattggcttttgccttgagttttgatttcttttttgagttatgttcaaaactattttcattataaatattaattttttcattaaaacaaagttttatagcggtagaattccattttttgtttgttgtcaattttatacaaattttcagatgacatttaaatgtttttctttcgaattataaatttctgttaagctttaattcagaaatattttctgagtttgatcagttacaattatattttattaataataatttgatgatgatggtttttggttaatacatttccatatttattcattcaaagaatcaacgaaaacatttttagaattgaacattctttcggcattttgtgattttgtcgaatatttcccattaattatcattttaacttttaaaattaaaaatatttattttaataaatattaaaattattccattaatttctttaagcttcttttcacctcccctttctctttttcattgctcaaaatgacttctcccattgcttatgaccaattgcgagaaatgacgcgcaatttcctctcaaaaggcgtcagtgccgtggaaacaaatgccattttccagggaaaatttggcaccgaaaattctccgactctttgcacggttaaaacaatgaaaatggaaatatatatttttatatttcttatttatttgattaataattttagatttacaaatg

SEQ ID NO: 116996 - DNA, 285 bp, Heterodera glycines
  Promoter: Source sequence=SeqID_9167; Location=1..285; Strand=+; Gene= SeqID_70462
cccccgaaatcagaatttttaaaaaaaaaatttattttttttaaaatattatattaattttttcgtaaaaataacaaacgagtttatgaaatgaaaaaaaacagatcatttacaattgaacgcgtctaatacacccctaaatattgaggtttacaaaaacgaaaaaatacacccctaagaaccgactttttgagttgcccccccccgaaacgaaggtcctggctacgcccttggcatggcttcgattgaattcattttaaatctccgtttttccaaggagtgatg

SEQ ID NO: 116997 - DNA, 51 bp, Heterodera glycines
  Promoter: Source sequence=SeqID_16274; Location=1572..1622; Strand=-; Gene=SeqID_80666
ggttgtggactgggtcttcggcattaacaatgtacactttttcagctgatg

SEQ ID NO: 116998 - DNA, 439 bp, Heterodera glycines
  Promoter: Source sequence=SeqID_4242; Location=999..1437; Strand=+; Gene=SeqID_53738
tttttttttcctgctgcggttaaaaaatgtcaatgtgatcaagatttatgtagtaatgggtaaaggagatgttatgtcccccggatttaaagcttttaagccatttctaattaccattttaaagagatgaatttataataaggaaaagcatttacaaaataatatgtattaaataaaaggggggggggaataagtttgttcaataacaacgacctctgttttggtgggatcagtggaatttgttatttggaaaaggattgttgaccaaaggcatagaacagcactgacaaatgagcagactgaccaccgcagaaatctcgcagcccccgagggggaaagtgggaggaattaaatactggggcataatggggagggactttggataggatgagtgggataatgacggcaaaaacacaaagggaatgatggaggaggaatg

SEQ ID NO: 116999 - DNA, 61 bp, Heterodera glycines
  Promoter: Source sequence=SeqID_2168; Location=1..61; Strand=+; Gene =SeqID_78228
agcaacaacaatgaatggcaggcattgagtacacagtttggtcagaaaatcactgaaaatg

SEQ ID NO: 117000 - DNA, 328 bp, Heterodera glycines
  Promoter: Source sequence=SeqID_41689; Location=1..328; Strand=+; Gene=SeqID_69760
tcaatcacatcgtctacctcatccacgagtagtagctcgacaccatatggctctacaagtactccgaccactttttcaatttcaacctcaactaccacgaccctggagccatttacactttttatacctccacatatatgcccgccagaagaagatgagaccacaacaagtccctcaacagtttcaacttcgtcatccagtacaacaatggttattcaaaaatgcatttataatttacttacctaaatgattttttaagtcatacgattcgcttgagcacaagtacagagtgttgcgaaaagaatattatcaactgaagataaacatg

SEQ ID NO: 117001 - DNA, 1003 bp, Heterodera glycines
  Promoter: Source sequence=SeqID_2248; Location=2619..3621; Strand=+; Gene=SeqID_78692
ttgattacattcaattttatccttaatcaatttgcgcaagcattgcgcataagcgcggcgaaagcgtggtgggggggggtggcggaagaccattggtgaatcgattaaatttagttgaacggaaatttcaggagggccaaggggggggggtcaaagagagaagccaatctacggtgagaggaggattatcattgatagattttgtttttataattaattaaattaatatgtaagttggcaaatgtagcaaaagaaaatacaaaaaaaatagaatctttagatggcatttaagttttagcatatttaatctttaaataagccttcgtaatttaatcattttgagcattcattccgctgaagcgcagaagggggattgaaaatttgcatcgattatgcgactcggggaacggaaagggaggggccaaagaatgcaacaaaagagcgtggagggagatattatcaacaaataaattgggttcaatatggataattttaagtgaaagagaatccctacaaaaagcaacaataaattcatttgaatgataaccgccaacaaaaataaattagcagtattttaatttacggtgtcaaaaataatactagagaaaaatttatcgaaaataaaaataaattcaattttaaaagtaaagggaaatttagggtttttgtcatcaaattaaaaggaaatatttgcaaaaaaaaaaaatgaaaattttgatggtaaaaatgaaaagcctttaaatggttacaaagaattcaattttgtttaaaaattagaaaaatttttggtagatattaattcgaaaaatactcattttcaatttatttttttcctaatcaatttgcgcaatcttttcatagaagtacagccagggcagcggcaggtgggggggggggggggaacattgacgaatccattaaaaggtgaacggaaatttagtcgggggtcaaatggtgaagcgaatgagtgggcaggggtcagcgaaagaaaaagcgggaaatg

SEQ ID NO: 117002 - DNA, 1003 bp, Heterodera glycines
  Promoter: Source sequence=SeqID_14111; Location=373..1375; Strand=+; Gene=SeqID_78099
acgagaaaaaaaaagtagcgtgaatacataaatgaaaatttttaatttaatttttaaaatttcttaccgtctgttcatttttgctgcaattagcacacgttggtctttttcaattgattgatgtcacaaaaatgcacagaataattgttttggaaaaaccctttctaagcaaaaagattatttgaaaattaaaaagaataggtggccgggccaaaggcggaaaaatgtgttgatgtgaaaatgattttaagggtaatagtttagatggtagcacacctttttgacagaattttttataaattttaaaatttgtaaaaccatgtctcatggggttttcggggtcgctccagggcagcgcaccgataccctccaagccaaaatcctggatcgttttggcgcccacattcggagccaactcgattttgaagggaaaatacggtaataaaactgtagtcaaataaaataatgttcttttctttttgtgcttacatacctatgtatcagggatggcattccgaggcccaaaaaattttcggaaatcggaattccgaccccaaaaatgtcggaaatcggaattccgtgccatccctgctatgtatcacacacacatattaaagtggctctactgaatgaactatgaatccatcaaaattacgagtccaataaacctaaccaatcttttgaacaataactttttctttttcaaacattcattcatttttgaaagcataattgtctaagtaaaacaatatgccaaattcgcagcatttatgcactttgcaaacaaagtaaacaattgttgattatttccgttttcaatttacaaattcaatgtgttaacaaacttagtttattgataattaaatcggtagggctcatataaagtgcatagaacgtaaagttttctttcgttttctcctaaataaccaaatttgtgttaggtgaactttaccgttgatgaaattcattctcttatagacaagaaaagaacatccgaaagatg

SEQ ID NO: 117003 - DNA, 381 bp, Heterodera glycines
  Promoter: Source sequence=SeqID_27253; Location=612..992; Strand=-; Gene=SeqID_57941
acgaaaaaaaacttattggaaacaattaaatattatatataatttttctctaattaaattcgcccaataatcaacaaattgtcccgccacccatatttggtatatacacatttaggtttgttttccttaattatgaatattgtttcgaatcttttgtctctaattacgccccgtttgccccttcgccttcctatgccctccttttttgccgtgccattcatcaatttatttgctggcgattgacccgaccaatgcgacccctccccatcaacaataaaaacgacaattcaattattcattttttcaaacactaacctttcacctattttatccttttattatagaattttcaatttttagcaaattttttaactaaaaatg

SEQ ID NO: 117004 - DNA, 176 bp, Heterodera glycines
  Promoter: Source sequence=SeqID_11648; Location=733..908; Strand=+; Gene=SeqID_75100
atacgtaaatcaaaccgggattttgactgacgcgggaatcaaggctgtccttatctggttgtataatgtggcaaatttcccgggagagcgagagatgggacgaaggcgttcagtgatcgggaatgtgccttcggggtctcataaccgtctaggcgacggtagtgggcgagaaaatg

SEQ ID NO: 117005 - DNA, 140 bp, Heterodera glycines
  Promoter: Source sequence=SeqID_1949; Location=3133..3272; Strand=-; Gene=SeqID_76977
ctaatccattgtcatgccctccctcccccgttcggcatgacgagttagcatattatcaacaacacatttttgattgttcgttggcctactgctgatccaaacagaagcaacaatgctatataaaccgctgctgacaaatg

SEQ ID NO: 117006 - DNA, 428 bp, Heterodera glycines
  Promoter: Source sequence=SeqID_37782; Location=1..428; Strand=+; Gene=SeqID_66776
ttgctcattttttggcatttacagtgcccaaaacagcctaattgggaaccatgtgtgccgaaagagatcgctaatcaagttggaaaaaggctttatttttaaattttttgtttttcaaaatagacatatttaaagaaacatataggtagttttaagtgaaattattcggcttttgcttttaacttcaaaatttaattttcatgctttatttaaatatttttaagcaaatggccgtttttcaaatattttaattaacctatttatgttttttttgtaatgttcgaaatgttattaaaatttttgctagctctttaaaattctaacgaaaataaaattcactaaattagatgaccgtatttactgaaaccaagccccctgggctttatttctcaaccccatcaggggagggcggctttagttcaaatatg

SEQ ID NO: 117007 - DNA, 446 bp, Heterodera glycines
  misc_feature (78)..(78): n is a, c, g, or t
  misc_feature (102)..(102): n is a, c, g, or t
  Promoter: Source sequence=SeqID_9444; Location=1074..1519; Strand=-; Gene=SeqID_71450
gatcgctccgcgggcgaactttttggatggaatggaaaagctgaagaagcagtggaggagctgatggacggaagcganccgaagtgtggcagactgctttgnttgttcgaattcggcaaacactttgtgaacaacaaaattttgtgggaaaacagcgaacgatggcaaaagcgattgatcagtgagaaaatggtcgaattggtaattaattatttaattaaattaattaattaccaaattaataggaggagacgaagcgaacggaaaattgggtgaagccgaaatttgacgaagagaaagcagaggaatattgcttcactttcttacaattgtacgggagcaaaagcgacaccaattacatgatcttttttgtcatttgcgatctgatcgatgtttctttggaagtgcggcgctttttttgcgattcgtccgactcaaaagccatg

SEQ ID NO: 117008 - DNA, 918 bp, Heterodera glycines
  Promoter: Source sequence=SeqID_16537; Location=765..1682; Strand=+; Gene=SeqID_80945
agtgagtggggatgccagaattattcgtccgatgtttgcggcaaacacgcggacaaatatggcttttctttttacaaaaaagatgaatgctattgcgcaattggtcattccaactacaatattacgtcactgttgaaaaaattggaattgcccgccggtcgtttgaattaaataattttttatttaattaatatttttgcattatttatttttacaattttgaacaaaataaatatggtaatttttatatgactcccgaaggatgcgttattggaaaatgctgtagtggtactactgtattttaaagtaagatactgtagcataacataaatttttaaacataaatggtcaaaattctataaaaatgaattcatcttttgcattttccattgacgcattttctgtcaaaatattattttaaaaaataaacacttttctaggatagttttctgatcacaaaatgatgcaaaaagtgctaacatgcatgtgcaaatttgggcgattcacaaaaaattacaaaaatcaaaatctgaaatttccaatcattttttattcaataaaaacattgaccagtttaacatgttttgtcgtgtgaattgtagataaatgccgagtcattctcgcgcgatttatttattgattttatttatgatttaaatgataaaaaaaaacataggaaaagtgagacttttgatttttgcacatttttgtgaactgccaaatttgcactttttgtgaatcgaccaaccactgatgcaaaaatctaattttccattttgatttccattaacaaggcggtggcgttggtttttttaacgcccattaatttgattatttggtaaattcatataattttttatatatttctaattttttaatcattttttgttttttagacttccaatcggtgtttaaatg

SEQ ID NO: 117009 - DNA, 538 bp, Heterodera glycines
  Promoter: Source sequence=SeqID_1489; Location=5130..5667; Strand=+; Gene=SeqID_73887
ggtgttggttgtggaaattttaaagagaacaacaacaaatcagagaaaaaaaacatttctcattttggcgtactatttctttgtctctgttaataagaaaagctgaatttacttcgtgacgtttaattttttttctacatgataaatccattttaaattttgcttaccgatagagaaagaattaacggatttttaacgctcgaattttagttttttacgctcccatctaaagttattcagaaaacaaaatttcgaacgtccatatctttttgctctgtgttaaaattcttagtatttgcttagaaaaagcttctcctaatcaagagctttcgaatgatatcaagattatccagtttggatggcaaaaaccctcaaaaatgactctgaaatatggtcattttttaaattttttttctctgtaaagaaatagtacagcaaaatgagatttcgttcttgtcattgtattttgtttctcataatgctagtagtgaacttttttttcagttcgcctattttttaaaaattttgtttgaaaatg

SEQ ID NO: 117010 - DNA, 96 bp, Heterodera glycines
  Promoter: Source sequence=SeqID_30397; Location=1..96; Strand=+; Gene= SeqID_60809
attaccaatcgccttcttagcgaaaaatttggatttacgaaaaatattacggaatttcgtgtcaacccggatgtggagcgccccgatgaagcgatg

SEQ ID NO: 117011 - DNA, 1003 bp, Heterodera glycines
  Promoter: Source sequence=SeqID_15266; Location=2253..3255; Strand=-; Gene=SeqID_79478
tctgagtgctataagattttgcgccattatgataaaaaattaatttttgccagaatattaattttgaaaaacctattttgacatttttggataatttattaacaaaatgcaataaaaacgaaaatatacccctaagaatcgacactaaattttcaaaaatacatttatatgaaatgaaaaattttctcaaaattcatctaaaaaatttattaatttatttcatgacaaaattagattttaaaaattctttatttcaatactgatttggttacttttggtgatttttgagtaaaatcttacgctcttacacctaaattttggcttttttagagcgtattttccattttaaatgcctatttttgagggtttttaggactaaaatatacctttttgcgatttttagagccgaaaaattgcatccctaatcattagggttggatttatatagttcaatattgatatggaaattaaaaccaaatcaaactgtacaacttctaatactgtctacaatattaacaaaattgatgaagcgtaatttgaaatggtgctaggtcgtttcctaaaaaccgccacattgggcgtttcctaaaaaccgccaagtgggcgtttcctaaaaaccgccacattgggcgtttcctaaaaaccgccaaatgggcgtttcctaaaaaccgccaccatgggcgtttcctaaaacccgccaagtgggcgtttcctaaaaaccgccaagtgggcgtttcctaaaaaccgccaagtgggcgtttcctaaaaaccgccaccatgggcgtttcctaaaactgcaaagcaaaaatttcgaaaatatatctttcctttttaataaaatttttatgtcagttgtttgccaacgttataattaatataaatcttaataatatttttacgccatttatttgccaacactatcatcattgtcaagcgcaataaaattaaaatattaatatatttattgctacttataaattctaactaataaaatttataaatg

SEQ ID NO: 117012 - DNA, 217 bp, Heterodera glycines
  misc_feature (103)..(103): n is a, c, g, or t
  Promoter: Source sequence=SeqID_23362; Location=302..518; Strand=+; Gene=SeqID_54074
ggtttttttgtttttttattttatttgaagaatttagaagtttttaatctttttattttttgttttggttttttggttaataaaaaattttatttaagtttanattaacccagggcggaatcctgcgcgacgacgagttttgtaaaaaaaaaatttaaatttaaatttaaaaaaaaaaaataaaaaattataagagaagaataaaagaaatcaaatg

SEQ ID NO: 117013 - DNA, 330 bp, Heterodera glycines
  Promoter: Source sequence=SeqID_9306; Location=2443..2772; Strand=+; Gene=SeqID_70934
gctataaatattcaatttctgaatagacaattcattttcaaacaatataaatatatttttattcaatattttaactaaataataatcattaaaacataattcctaaaattgaaaattttttttaaattaatttaatctaatttttcattcggatatttttaaatgcaaaaactatttttaatgaaataatttatattcataaaattaaacattaacatataattcctaaaattgatgaaattttatttaaattaatttaaacaaatatataataacattttttatttttagatttgtgcaaattgtcttttttaactctctgttacaatg

SEQ ID NO: 117014 - DNA, 177 bp, Heterodera glycines
  Promoter: Source sequence=SeqID_7776; Location=1017..1193; Strand=+; Gene=SeqID_65921
tcgccaccccattcattacccattaccagtgccaacatccgcttcactgattacaattcaaagttgcatatatatatgtaaaaggagagcaattaaaaataaaatatttatatttaatttctcttaaaactctcatccctcataatgttttgctactcaatcccatcatcaacaatg

SEQ ID NO: 117015 - DNA, 101 bp, Heterodera glycines
  Promoter: Source sequence=SeqID_40969; Location=829..929; Strand=-; Gene=SeqID_69187
ttggagtgtcacatccgatcattctcccaccttttttatttcatggtaatttggcttttaaatgtttgtgttgtttagatgataaactgctattgttaatg

SEQ ID NO: 117016 - DNA, 107 bp, Heterodera glycines
  Promoter: Source sequence=SeqID_17966; Location=1795..1901; Strand=-; Gene=SeqID_82532
ggtttttgggggcattttgcagagaaacgcgagtgttttttggtggctgtcccggaccgcactgcagcaacacttcttcctattattgcgcagcgcattgcaccatg

SEQ ID NO: 117017 - DNA, 529 bp, Heterodera glycines
  misc_feature (122)..(122): n is a, c, g, or t
  Promoter: Source sequence=SeqID_26599; Location=1..529; Strand=+; Gene=SeqID_57336
tttttttttcattaaaattcccaatttaggatccccaaatatagggtcgcaccaaatgccggaacccgctagtttgtgtgtcgggtcccgttacaaatccccaaattcgcgccatgtaaatntagaatgggaaagagaatggggaaacgagcggagagaagcgagaggaaaatggggagaaaggtgcactctctcaaataatgcctaatctcttttccatccgtaaaagcatgtgctatttcttttctctgtccgtcggctttttgttaagtctttactagtacataattgtttctctatatctctggttaaaataaatgtgagagaaaaaagaaagaatttaaagcgtaaacaaagaaaatgaaaagggcactttctctctccctttcccactgcttcattttgccaaagtgaccacaatcttttttgaggtcaatccattttttctcttttccatattacttctttgagtaattataaaatatttttagctaattttattaaatatatagcgaaaccatagaaaatg

SEQ ID NO: 117018 - DNA, 269 bp, Heterodera glycines
  Promoter: Source sequence=SeqID_14299; Location=2916..3184; Strand=-; Gene=SeqID_78327
gcaataaatgagatatttttaaaccatttcgcaggttgtttacgatgggaggtccacaattactggcattttaacttcaaatcctgaccaaattgtcgtccacgatttcacctatggtattttaaatacaatttgttgtggtataaaatgtgtattccccaaaaggccttcaatatcatctggactttgtacaccatggaaaatgtggccaaattgggccaatcagtgctgaattggccgatgtcgggcgcaatgccaacgggacgatg

SEQ ID NO: 117019 - DNA, 502 bp, Heterodera glycines
  Promoter: Source sequence=SeqID_4592; Location=2992..3493; Strand=+; Gene=SeqID_55010
ttttcacatctttttaaattgttcattattcaaaagaagggattttggtatccaaaataatggaacataaatttttggaacttaacgaaattttatgacttaagcctattgaatgattacaagaattaaaaatatggttgcggttgttttttttttgcaaagatttataagcatagattttttattttaatttttttttgagcaacgcccattttgatggttttagagtgacgtcataacatcaagaatattaataagccgcctcctttccatatttggcacttttacgagaagtgccaatgccaatttgctttcctatcaatttcaaattcatcaacatgcttgcttcttctctgctttgctgggtcacacctcttcatttaggagggggcggggaggcgggtggcacccaaccgaaaaattgggtcccctctcaagacaaagtggtgacggcactgtttatgttttttttgccaacccatttttgttggcacaataaatg

SEQ ID NO: 117020 - DNA, 427 bp, Heterodera glycines
  Promoter: Source sequence=SeqID_18323; Location=1486..1912; Strand=+; Gene=SeqID_82922
ggttttaaataaaatttttttcaaggactagtgattaattaaatcgtcgctgatctgacggactaatataggcgttattttaaaaatataactttgctcaaaacaaccaaattttaaatacttggtacaaatcgataggcctaaatgttcactattatcctgaactatttaaaaaaaaattatttaacattcaaaaaagttattaccaaaaatgctcgaataacaagggtttcttgagttcttttgattacataacttttttgaaacttacgaagttttttgaaattttgcagactgatagagaactcttattgttagggctatccaacagatacgttttaatgatttttgttccactaattaatgaaaaattcactcattagtaaagtgccaagaaattgctgtccgcataaagctgagcattatg

SEQ ID NO: 117021 - DNA, 237 bp, Heterodera glycines
  Promoter: Source sequence=SeqID_25466; Location=921..1157; Strand=+; Gene=SeqID_56198
ttgcgtcgacgagggcagctcttggcgcaattttgccatcaaattattccatggttctttggatgccaaaaacgggtcaaaactattttttgaatgttttgtccattaactttggcacaatgccaaattcagcggatgtcaaacggcactaccgtaccccaacaaatcaccacagacgtcattcacgcccttcactgatgctgctgttacgctcctccttctcatgcgcgaacaatg

SEQ ID NO: 117022 - DNA, 526 bp, Heterodera glycines
  Promoter: Source sequence=SeqID_34956; Location=1..526; Strand=+; Gene=SeqID_64638
atggcatttcaatctcccacctcagacgtttgtgggcactattgcatattttttatttatttggcttcaaccggaatgttatatgatgaaattttgaaacaactgaaattgtattgtgtggattataattgtgacattgcaattaaaaactacgtgaataaaattttgttttatctcttggggggagccttcaattagtaaaggtggatgattccgaatcatgatttaaaaatataccagctagtgccagtctctgggcattggggtcaaaaggcgtcagctgacacatttctcctgtgtctatctcattttgatgcgtcagctgtctagcattttagtccttaatttattagagaaaaagaggcattgagtatcgtaaaaagagaggtattgagtatcgaaacgattcattcataattttatggaaattactgctagtacggggtataaattaagtgaaaaattcaatacaacctcatttattggccaattccaaaaatcatcatgagcaatcgatcaaacaatg

SEQ ID NO: 117023 - DNA, 286 bp, Heterodera glycines
  Promoter: Source sequence=SeqID_975; Location=4067..4352; Strand=-; Gene=SeqID_65289
tcggtgcctaaatggatatctgacgcgggttctccaaccgtaaaaacctctaaaccaactttaattcgaaaaggagttattccctaaaacctgacttggcgcctgcattccatcgtcagaaataataacctttagccttctgctattttttaaaaatcattatttactcatgcaatttcaggttattatcaaaagcaacttaatgaatgaatagacgaataattgctcagcaaaaaaggcgacagcaagaacgcaaatttgacgaaagtcttgaaaggcgcggatg

SEQ ID NO: 117024 - DNA, 310 bp, Heterodera glycines
  Promoter: Source sequence=SeqID_4437; Location=1703..2012; Strand=-; Gene=SeqID_54457
ttgaaaataataattccgcttaaatcgaaatttgatcaaattgtaggctttaaatgatcattgacagtttaggtgccacgtgaaaagccaaaaggcgcacggtaaaattgaagtctacaaatgctaatcgtcctttttcaaaaaaagccaacgttttttcgagaagtgcttattttattggttttaagagttgtggaacttaaatctgacatccatttctacttaggttggaccccgaacccggatcagaaagtcgaaactcgcatttatgaaacaaaaaatggttccaatacacagaataacaaaaatg

SEQ ID NO: 117025 - DNA, 84 bp, Heterodera glycines
  Promoter: Source sequence=SeqID_16768; Location=1..84; Strand=+; Gene= SeqID_81175
atgcacaatggtaattaatggttttttaaaaattataattaaattaattaatttgtttttttttttaaattttcggtcgaaatg

SEQ ID NO: 117026 - DNA, 222 bp, Heterodera glycines
  Promoter: Source sequence=SeqID_24373; Location=1..222; Strand=+; Gene=SeqID_55105
acagcccatgggaatggtggaaccgggcgcaattgccggaattcgaagggaacggccggagaattggagacgggacaaaaagaggaggggggaaaggcgggacaaccggacaataacgaagatggcacatatcagagtcagaaaagttttgaagcctcaatttttggggaatcggaatccaactcttaaaatgtcggaaaacgaaatttattatagaaaatg

SEQ ID NO: 117027 - DNA, 1003 bp, Heterodera glycines
  misc_feature (975)..(975): n is a, c, g, or t
  Promoter: Source sequence=SeqID_3201; Location=809..1811; Strand=-; Gene=SeqID_83658
atttcgaatttatctgatgaaaaatattcaaaaaattttccaataaacttctaaaatgacctatgattatgtaaattttacggaaaaacaaaattatttttataaagattagtggttattacggattgaacgctaattcattcctacaacatttactaaaaattagaaatgtttgataaactaattaatcatttcttctatatgttttaaaaataacttattaaaatacacaaaaattattttaaaattttttaaactataacaactattatataatgcgacgaaagaacagaggaaaatttattttaataagaattttctttccaaaaaaattttttgaaaaatatatatccttttcagaagtaaaaaaattttgaattaattattaatatggacaaataatttgacaactgaacatcgttagtatgatgagtagggttgtaaattatatggattaaacatattttttctgcacatatgctatgaagaaaggggctcaaaaatagaatttctacgttaaaattttttgatttggtgaaggtttttagtccatataaaaccagattttggggttttgggggaatcatccatatttcgctatttttgcctttttagtacatatttcggccatttttgacaaattttcacaaaaaaatgcaaaaaaaaagcgaaaaatacacacgtaaatgtagactattgggaaattttaaaaaattacatacccaaaatttacgaaaatttgggttttcgtcgttattttgggatttttaacaaatattttcactttttttttgcaatctttcttttttttaaatgcggattttttttgaaattggcatacttggaggtgttttttatacaactgacacgacaaaataaaattgcattttttaattttaaatccatttttttggttctttatagtatttttaagtttactagcggggttagcgccttcggcgcatcccccgctanggtagtacgattgtgttgtagaattatg

SEQ ID NO: 117028 - DNA, 586 bp, Heterodera glycines
  Promoter: Source sequence=SeqID_15751; Location=655..1240; Strand=-; Gene=SeqID_80078
tcctcccttttgcattggacggcacaaaacgaagcgaacggagcgcggtggcacaaaatgggaaatgacggcacaaaaacaaaaataaaagtgaattttttgacttctaaggcactcctaaaatgggacagttgaaaaattgcaattttatgagtattttaaatggaacaaaaaaggcaaaaacaaaaatcttttactgcaaaaaatatgtacgcttagaattatttatgtaagcaaagataataaaatgtacgcagtgaaaagcctaaaaaactaatttttttcgaatttccaaccaacaaaagcaaaaagaaagagcataaattgaatttatgacgaaatgacatttaattttttcaaatttgcggatcctgctgcaggatatgaactcaaaatttatttgtttcggggcgggatcactcgggtattaatcccaccaaatctcgcacttaaaatttgcgggatgccgtgcaggagtgcttggttttttaaattccaaaaattagaattaatttaaaattaataaaaaaacaataataattagggcctgtaattatatgtaggatatataaaatcgcaaaatatg

SEQ ID NO: 117029 - DNA, 364 bp, Heterodera glycines
  Promoter: Source sequence=SeqID_41936; Location=1..364; Strand=+; Gene=SeqID_69970
taaaaaaaaatgtgaaatggaaaaatgaatttggcataaaacgcagcaaaagtaatgcctttaaatttttaatatttttttataattaattttattaatataaaaataacgatacgattttcaaaaggttgtaactgttgagttgaggttgagaaccgaacgaaaatcactttgttaccgaagaaaaaagtcattaaacgaatattcaaaaaagtaattgttaaaaaatgatcagttttgtataccttattaagggtccacaagttttcaaattaattgcctttctaataaagctttcagcacttgaaaagtgtctgcccaatttggcattccaaaagggaacaattggcatttatgctcaatg

SEQ ID NO: 117030 - DNA, 148 bp, Heterodera glycines
  misc_feature (22)..(22): n is a, c, g, or t
  Promoter: Source sequence=SeqID_11763; Location=1..148; Strand=+; Gene=SeqID_75260
tatcgcaaatgataagtataantttttctctaaatattagttttcttattgttcccttcttttctttctctctgtttatatcactcatgtgggacggaatgacccctggttgatcctctctaacaccccaggccatccatctgagatg

SEQ ID NO: 117031 - DNA, 603 bp, Heterodera glycines
  Promoter: Source sequence=SeqID_3004; Location=3656..4258; Strand=-; Gene=SeqID_82726
tacaatgaataaaagggattattattattatggcattgtttcttttaatttttgtgggcttttttggcgaaaaaaagttgtcaattactcatatcaaaataagcaaaaaagaattaggaaaaacaaatcaaaaaatagtaaaatattaattgctaattaaaaacggaatattcggattcagagagatccctgacccttcgccgggagaatccatgtggggatttggtgaattacaacagaaaataacgctatatacatatatttatgtctgatgaaagggctcccggaaaatgagtcagtaataagtttttctaaaataaagttgtgtagcattattatattgaattaccaaaggacaaaattgtataaaaacatcatactgaatttgcgattgttttttaaaggcaaaaaaaaattgaaattacccaaatccataaaataaacattctgtaaattaccaacccacgtttatgatttcaggtaataatactaccgtgtttgttttttcaagaaatcctgacttatgacgcattttccggtaacggacgaaagcagtaaaaaaattgtaataaaaaattttaatggagaaaaattaaaagaatg

SEQ ID NO: 117032 - DNA, 1003 bp, Heterodera glycines
  Promoter: Source sequence=SeqID_12927; Location=221..1223; Strand=+; Gene=SeqID_76674
aactcagaagcgcaaaaaaatttgattacagtgacagatatcgattacatacattcctttttcgtttctattcacataatgtgtcagttttgtcattgactcccccccccctttttttcagcaaatcataacaacaatgtttggatggacaattacccattttttgccatgctcattcgccccgtttcgatgcaatggttgacaaacttttcgatggcaatttcaatttcggcaagttttttttaattttttttttgtaaaagtcagtagttatttagggttttaatgtttttaatgattttgtgtccaaaaacggacctctaattttcaaaattactcagaaaataaagaaaagtcggcaagttttttttttcgggcatttagaccatagggcgtgagttcaggaaaaaattggtaaaaaaataaaaaatattagccctattgatgactttttatgaattttttaagctggatttgaaattttactaaattaagccaataataggattttcttttgtaaggattttgtgccaaaaactacccttcattttcaaaatggctctaaaattttttttccaaattccgcgtatttttattaaagtgtccgctttttagggtttttggtaccacattttttgatttaaaaaataaattttttaatgatttcaaatttttaatctttagccgatatttcggacatatttcgtccatttacaatcaatatttcactcttgatttttttgtttttagattgattttcaacgacatttggatggatattttccccctttttgaccgtcctcaactcggtctcaaattggcattgcttttgtcacgtttcgatgtgctggtggacaaacatttcgatgccaaaaaagtgaattatttttaagggtttttgttgtattaaggattttgtgccaatttggggcctccgattctgcccgttttaaaagatttttgcacttttaattcttaacttttcagcaaccaaacaacaatg

SEQ ID NO: 117033 - DNA, 211 bp, Heterodera glycines
  Promoter: Source sequence=SeqID_2038; Location=2333..2543; Strand=-; Gene=SeqID_77451
tattagggatagagaacgcatttaattaggaaaatttgacgtgactaataccagtgatgtaaatgtcatttaactttgtaagcttaaagctagctattcaattaattggagtgtttgggctttatttcttccgcctctgtttttaaattattctctcccaatttctttgcctttgaatgatcttttactgtttttaagatgtgttgagatg

SEQ ID NO: 117034 - DNA, 182 bp, Heterodera glycines
  Promoter: Source sequence=SeqID_1422; Location=787..968; Strand=-; Gene=SeqID_73479
tttttattggagacaatttattaagaaaattaattctcacattagcgtgggaatagaacttaaattaaaaaaaaagaaatttaagtacagaaattgaagaaaaataatataaaaagaaatttttaaattcattttattcacattttaattcattaataagccaaaaattacagcaaaaaatg

SEQ ID NO: 117035 - DNA, 531 bp, Heterodera glycines
  Promoter: Source sequence=SeqID_17035; Location=584..1114; Strand=+; Gene=SeqID_81458
tagttcggcctcacgaattttttgtaattcgtgtcgcttgccttccccagggtttggccccacggattttttgtaatccgaggcgcttccccggtcccatagttcggccgcacgaattttttgtaattcgtgtcgcttgccttccccagggtttggcccctcggattttttgtaatccgaggcgtctttttccttgctcagttggcccctcgggtttttcgtaacccgaggcgtgttcctttctccagtgaccaacccctcgggttttttgtaacccaaggcgtcccccattgtgagcaggtcgctcctagggttttttgtgacccaaggcgcctcccgcttacacggtcggacccatcgagtttttcgtaactcgtagcgtccttcctcatacattgtaagactcttggtgggtctgaagtcaaactcactttgtccactgtttgttcaacttactgctattttgtgaccccgaaccccacacaatttgttcggaagtcgggtagcagaacccaaaagtgagcaaaaatg

SEQ ID NO: 117036 - DNA, 201 bp, Heterodera glycines
  Promoter: Source sequence=SeqID_25856; Location=1..201; Strand=+; Gene=SeqID_56625
atttaaagcggctgttgagcagcttaaacaaatcaatgcctttgttcaaagggctaatcccgaacagactcatcacacatccataagagagaaacataagagtgaagaaaaagaatcaaccttaaacttggctatcagatacaaagaccaagagaaaaaggctaatcgacaaacatcgggtgctgttaagccaaagccatg

SEQ ID NO: 117037 - DNA, 60 bp, Heterodera glycines
  Promoter: Source sequence=SeqID_3027; Location=1669..1728; Strand=-; Gene=SeqID_82828
tcttgaaaatttaaaattcaaaaatttcacggcctccccccccctcacttcatcaaaatg

SEQ ID NO: 117038 - DNA, 197 bp, Heterodera glycines
  Promoter: Source sequence=SeqID_6842; Location=3517..3713; Strand=-; Gene=SeqID_63078
tttttttatgcttataaacttcgccaaataccttagcctactccatatcccaaaataattaaaatttattttcccaaaaagaattaaattatcataaaataattaaattcgattttacccaaaaattaaaattattttctcaaaataattttaaaaaccttttttttgagttataagcatttattttttaaaaaatg

SEQ ID NO: 117039 - DNA, 96 bp, Heterodera glycines
  Promoter: Source sequence=SeqID_22747; Location=1..96; Strand=+; Gene= SeqID_53437
aatttttcaggaaatatcaaaatattgcatcctttttcagctccgttagctttctctgccgcggccgccggcgcttttgcaaccgccgcggcgatg

SEQ ID NO: 117040 - DNA, 59 bp, Heterodera glycines
  Promoter: Source sequence=SeqID_4375; Location=767..825; Strand=+; Gene=SeqID_54209
cgtaacaatgaaatggaattttcattaatccaaaaaatcatacttatatattaacaatg

SEQ ID NO: 117041 - DNA, 86 bp, Heterodera glycines
  Promoter: Source sequence=SeqID_7932; Location=1707..1792; Strand=-; Gene=SeqID_66420
tattccccgggtcaccctattctcttaattttgatagaaacaaatacattcgagcatttgttgacatgtatacggggctcgggatg

SEQ ID NO: 117042 - DNA, 151 bp, Heterodera glycines
  Promoter: Source sequence=SeqID_40349; Location=1..151; Strand=+; Gene=SeqID_68712
tgccgcatttttattgccattttccttttgttttttatttatttttttttccctttccaatttttttccccccttaaatttttaagttttatattctcacaaattcgacgagccccttttttttttcagctctttttggcactgaaatatg

SEQ ID NO: 117043 - DNA, 247 bp, Heterodera glycines
  Promoter: Source sequence=SeqID_688; Location=4730..4976; Strand=-; Gene=SeqID_59041
acgattgattggcagtgcgtacgggattaatttgtggaagcacacttcccctttttctctatcagtttattcatgtaaagccatttctttctcgctctatatctctctctccattttccctctttctctctcgctctcatctttcctcttctctctctcttgtttctctctcactctcattctctccttatttctttgctctcactttttctcgatcagtctcgagttcaaatcaatctcaattatg

SEQ ID NO: 117044 - DNA, 63 bp, Heterodera glycines
  Promoter: Source sequence=SeqID_11979; Location=3499..3561; Strand=-; Gene=SeqID_75497
ggtatttgcacggagcaaatattttaaatacatttaaattcaggggcaattgttccgacgatg

SEQ ID NO: 117045 - DNA, 501 bp, Heterodera glycines
  Promoter: Source sequence=SeqID_25534; Location=537..1037; Strand=-; Gene=SeqID_56276
tttgcgcctttgtccaaatcgggttcaaaattgttttttcaatccctgatcgcctaaccagcattattttttaccttgaatccgatttgacctaggcgcaaatgtcggggccaaaagtcgtgccgcaaatgtcggggccaaaagtcgtgccgcaaatgtcggggctcagttcatttttagcctggcttaaagcttctgtaattttaatattctacctaatttctgctgtttttctcatttgaatttcgtttaaatttgctcggactgaaaatgctctgtgcttacgtcgcttaaaataaaaccaaaaagggacagttctcgcattaatttatcatttcttttttcgcatcaatcaaatgccgctgctgacacagttttcctcgccaattgggcggaaagtttggctataaaaatgggaaatggacaccgtaataaccaaccactcattcattagtgtattaattaatttgctatttttgtgggccgaagtgtgccaaaatg

SEQ ID NO: 117046 - DNA, 892 bp, Heterodera glycines
  Promoter: Source sequence=SeqID_2110; Location=1270..2161; Strand=-; Gene=SeqID_77904
ttgtgcacacgaagcaatcaataaatcaaatttaaaaaaggttattttatgcgtttaggctcattaatgcattttaattgaatccatttgcaaaattaggagaaaagaaaaataataacaaaaaattagtgtttgggttttgtggaatgagaatttcttgcattggcattttgtgccaaaagacggaaaaaactatgtaatggcaaacaaaaattaggaagttatttgactaagattaaaattgggtttgtaacttttaagctgcatgggcatttcgcctatttaccgattctcgaggccgagaacgaattacaccatttctttgtatattgtatatctttttaattttccatttattattttatcatttttattttcgataatttagtatgaattaacataatttttttgcatccacaattttattcattataatggatgaaaaatgattcattagcaaaatcagagtcgatttttgccggatggttttttgataacagcggaaaaatggtggtgatgacaaattggaaaaactgtgcaaattccactgatagaaaaagagataaaaaagcgaatgaataaattaattttataaaaaataaacgaacaaaaataataatcattaatagaaaatcgtacaaaatgaaaagaattttaaaaaataaaattgaaagaataaaaggaaaaaaagtaaaagtgttacctatttgatatttccagtttctgcatttatttaaaattttcaaagattttctagcgcgcaatggacaaacattccggagacctacaaaaagtttagatattaattgtaaatatataaagtcccaaaaaagcgataaaaataatctaaaaaacaacaaaaataattgacataaaattgcagtctaacatg

SEQ ID NO: 117047 - DNA, 662 bp, Heterodera glycines
  Promoter: Source sequence=SeqID_5332; Location=804..1465; Strand=-; Gene=SeqID_57706
ttttataaatttcaaaaattttcccggccgcgcctatcggcttcgccggaaccttgttccctaaaagtttatgggaaacatccccctcccccccccccccctctcgaccctctccccgctcatccgatcccgttacatcccccctttttttgtggccaccccggcacagcttttttgacttaatttgttgccgccgaaaaggaagaaattggcgatgcgcccgagggggaaacatttcgtgccattaatcgcttctctctgagaatagacagcacaaagcaaaagcaaaaaagttggttttggcggggtgtggcgtcgtcgtcgtccatccccccgggggacggatgaaaaagcggtgccaccaacagcccaaaatcccgtcagaaaatctgcgggactgccgctgttttcgcccccaaattggccatcgaaatttttgggatatttttgcttcttcgttgaaattttgaatgtcaatacggtgccaaaagggatatgaagccatccaaaatagtaatgcattttcgagtttaaatgcgtttaaaaaataaatatttaaattataaataaattgttcgattctttgaaattccttttttaattttcaaaaaatattttaattttcctttcagagcaacaaaacttttccgcccagctcaatg

SEQ ID NO: 117048 - DNA, 669 bp, Heterodera glycines
  Promoter: Source sequence=SeqID_24695; Location=477..1145; Strand=-; Gene=SeqID_55441
ttcaaattaataatcaaaaattcttttaaaatttttttgaccccaattcaaaaaaggaaaaaatttcccgtcaaaaaattattcgattttctccattttgttttccatattttccgaaatttattcggtatcataatccaaaccaaaacgaaatcgttttaaaatattcctttctggacttgacttggtttcttgatatcgaagctgttttctccgctatttctaaaacggttataccaaaccccagatttttgaatccggttttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 117049 - DNA, 816 bp, Heterodera glycines
  Promoter: Source sequence=SeqID_15540; Location=596..1411; Strand=+; Gene=SeqID_79821
aaaaaagtttttggaagggagaatctttttctaagcaattctatatataattttcgtaatgtatgtcacaagaggagagagagagaaagagaagaggagagagagagagagagaaaagaggagagagagagagagaaagaggagagggagaaagaaagagaggaggagagagagagaaaggaggagggagtgaagaggagagagatagaaagaggagagagagagagaaagaaaagaggagggagagaagaggagagagatagaaaagagcgtggtgagtcgaagtgcaaaaagtccgagtgtggcgaagtgcaaaaagtccgagtgtggcgaagtgcaaaaagtccgagtgtggcgaagtgcaaaaagtccgagtgtgggcgaagtgcaaaaagtccgaatgagtgatgatcagaagaggcgggtcatttcagtaccgaagatttattctaatgattaattattatttaaatttataattgaatgataagctaataataaaaaatatatttggctctatttcagtttacaagaccacaaaaaaagacacgatcatgttatattttgataaatttcatgcaccataactttttctagaagcacccaaattaaaccttgctaccatttgatagccctaagaatcttctattttcctgtgaaattcaaaaaatttcgttgagtttcaaagaagttgtggtcaaaaaggtttaccaaatcaatttttgtaatttacaagccacaactttttttgaaacacaaccaaatttattgaaattttaaaggcaaatagaggacactcagggctatcaaaagatg

SEQ ID NO: 117050 - DNA, 1003 bp, Heterodera glycines
  misc_feature (11)..(11): n is a, c, g, or t
  Promoter: Source sequence=SeqID_3973; Location=1783..2785; Strand=-; Gene=SeqID_52637
ttaatttcaancataaatacactaaaacccataaataagaaataatttaaatagaaaattataagcataatcatgtaaaagaaataacaaaatttaatcaagcgcagaaagtaccgcttatttgatgcaaattctaactgagaaaataacaattatttaaatagcatttaaaataatttgtaaaaacttgcaaatggtagacgaaagcgctccgtcaaagaaacgagaaaatatattattattacaaaataaattatttaatgaattttaaataactaataaaaaagctaaaataaaaaattttatataaatataataaacatacaatttaagaataatataatttaatcgaaatctaaaaccgcatgaaatacagcctatttgaatataattttttaaaatatgagcatttgaagtaataaaaaaaatttaatttttttaacaactaactcttttaaaaaaagtgcatccactttggcattttataacatgcattccgaggccccaaaaattttcagaattcggaaaacgaaaaccgaggctcaaaaattttacaagaggggtgggggatgtagtccggcggtgccgataggtgccgccgggaaaatttttgaaatgagtaaatttgttaaaagaattttgtccaaaaattgtccacattttgtgattttggagctaatttttaggaaaaattttgggtttttgggaggccggcgatgccgataggcgccgccgggtgaattttgaaatttaagctctattttctaagatatttttactaaaaaatttatgaatttccgataaatttttgttttacttcgatattttgtcaaaaatttcttgaaatattattaattttcatgatttatttagtcatgcaaaattggttttaaatttcaacgaaaggaaaagtttttgaaaatttgggtttaatttgttaacaaattatgcaaagaatggttggaagcgtcggagttcgggtcggggttaaccccgaaaaatg

SEQ ID NO: 117051 - DNA, 1003 bp, Heterodera glycines
  Promoter: Source sequence=SeqID_5260; Location=973..1975; Strand=+; Gene=SeqID_57492
aatttttgggcggaccgtcgtcgtttactccattcttttgcgcacaatgtccaaacagaaaagggactttcccttcctataaaaagggtcgaaagtggaaattgcattcattaattaattaaaccaaaatcattcattaactaatcaatcaattggtcagtccctctcacaatgctcttctccactccaatgccactctttctcgtctcttctgtctttctcttcgtttttcttctcgtcgccatgtttttggccaatccgtccgatgcgcggcctcaatttggctcatttgccgattcgatgaccagcggaacgattttgagtaatatgtggggaaaaaagcgatgagaagcggccaacagcagacggagaaagaaagaaaattaaagaaaactgaagagaacaattggaaataatcaacaattaataaataattgttaattttgtataatcaatcatcaattataaatggttggtaattaaattgattttttattttgctggcggaaacttaaaatcccgaaagggttcccgactgcttattgttcgattaactgatttataattttacgctatttttggggtttgccaatttgtggcattttcgtattgctatttgattattatataattcattttcaaatatcaaatgcatttcgttaataacactgatttttactcttttaaaatggcatttaaatttaattggccaaaaatgtcacttgcttaatcatttacttatgttcaaacataatcttttaatttgtcggaattgaatgaataagccataaaattcactcggaaaccaatgagtaatattcaaaagcatttttttgtcgctcccggcaaatggcaacggtctgagcaatggcggacaaatttggagctatttataagcgaaaaggtgcagaaatgggcatttcttttgttgcatttaaaaattcatttaaaacatttttatgtgtgattaaaaattaatatttcagccaaactcttccaaatg

SEQ ID NO: 117052 - DNA, 178 bp, Heterodera glycines
  Promoter: Source sequence=SeqID_470; Location=1061..1238; Strand=-; Gene=SeqID_53582
ggtaccgcaaacgcacggttttggcgactttaggacaaattttttgttgtctttgtgccaaaaaggggccttcattttcaaatgatttttgcctaaaaccaaattcaggccattttttaggttctttgcttttttttgcaattttatattttaatattttcagcaactgcgcacaatg

SEQ ID NO: 117053 - DNA, 292 bp, Heterodera glycines
  Promoter: Source sequence=SeqID_19724; Location=1..292; Strand=+; Gene=SeqID_84467
gtaaagcattcgtattagcatcgaatattttacgactgatcagtcggatcaccctcacatgctcacaatctgtagtgatcgcattgaccatcttcaaatgccgaactgtacaaattaaagaacggcacgatcgatttatcgatcaatttatatgcatattttcgatatttatcaaaaatcgaacgaatcactttcccagtctctagcacaaaaatataaagcaaatatatgtaaatgacaggtgctaacaaaatttggagcgcggccgcactggggaaaatatttcacaatg

SEQ ID NO: 117054 - DNA, 737 bp, Heterodera glycines
  Promoter: Source sequence=SeqID_5640; Location=1722..2458; Strand=-; Gene=SeqID_58747
ttccgtaaaaagctgctcaatttattgccgtccatgattttgatacaactatggcgcaactctttctagtacggcttcgttccacttgagcagaaatcactcgtacgtttgaatgtttaaatttctccgaattgatcgacgtgatggaaagtgattgcgaacagtgaaaataaattaaatttggccgtcagaccaacagtatggtaagttgagtcccaagctgaatttggcactccacttcctgcactttttcagcctgaaaggggcaagcgcgcccctaattctttttttttgttacccatttctaacctttttacaccgattcagaccgttattattttgagtttggggactatgatatcaatatttacattttgggccacatgtatataaagactgggccgaaaagaagcctatacaaaaaaaaatagaaagtgtagaagaaaattttttactgtttttctcatttgatttttaaatcactttatagcattcaaaaattattttattaactcggcatgtcacgaaatgacaagctaaaaatcaatgtgagattaagaattttctgcttattttttctatacggcgtatatgtatgtcattcaatattaaaatgcaaattcatggatttcgaaatattcataatttttaagaatttattttaataatattattttaattatataataaacagatcaaaagattcaaaagttaatgcaattcattcagtgaaaatg

SEQ ID NO: 117055 - DNA, 212 bp, Heterodera glycines
  misc_feature (66)..(66): n is a, c, g, or t
  Promoter: Source sequence=SeqID_11349; Location=3055..3266; Strand=-; Gene=SeqID_74736
atttggaatgacaaaaaagcattattatacggatgaggaaaaacgtaaaaatgttaaagcaattgnatcaaatatatgcaaaattaaaaacgaaattcaatgaaaaattgaagggaaaaagagaaaaatgccaaaaaataatagcaaaatatttggacataaatattagaagcatttataaatggaagaaagaaataaaagttggaaaaatg

SEQ ID NO: 117056 - DNA, 129 bp, Heterodera glycines
  Promoter: Source sequence=SeqID_23401; Location=131..259; Strand=+; Gene=SeqID_54108
ttttctggtcatttttcttccttcgtgcgacagatggccacactttgtcccctttttcttctcatagccaaaaaaatgaaaatttatttgtccacgaaaatgtcgtaaagccgaaaacagtgccaaatg

SEQ ID NO: 117057 - DNA, 67 bp, Heterodera glycines
  Promoter: Source sequence=SeqID_38516; Location=1..67; Strand=+; Gene= SeqID_67299
ttttgaagcgaccaaacatttgtggcaatgcctctcaactagcagcatttgacagaagtgaaaaatg

SEQ ID NO: 117058 - DNA, 1003 bp, Heterodera glycines
  Promoter: Source sequence=SeqID_8170; Location=1501..2503; Strand=+; Gene=SeqID_67194
tttcagaaacttcctttaataaaattttgtgatattatatggcaaaaaattgttcttcaatcacttggtcgggtttacgggctcaacaagcacctgtcgactaagagtatcaatacagactaacaagtacttgtagccacggttttgtttagcaattcggtcaaaaatagccaaatcggtctgccattcagtgtgtaagccaggtgccaatgttggcaatcgacggtagcgccgcttggcctgacgatgcagtgtgtttgtacgttgggtggctaaataattttggacatcggttagactaatttttggttgagttttcgcgcctctctcagcagcggttcaacgctcgtgaatgcgacaggcaaacataggtccttgtacaagaactcaagcaaacgaagctttttaaaatccataatgatggcttaaatttcattgtggtgtttttataaatgccttttgcagttggctctttgttttgagcacgtttgtccttgttcagcaggtgactaataatgtcataaacactgctggttataaaaagccgcccacccgctctcaagacctgtccttcctcagacactccaagagattgggcgtttttataaattaattttaagatttccgtttgttaaggttgtcgtttatttgaactcgatgcactcccgcatttgttccgctcgtgggacgccgctgtgtacaatgactggcacattgccaattttgccggcgcgctgcagattcatcacatttgtgttcagctcaccatagctataaataacgcgttcaatcaggggtagagatcattttatccacatttcgcaacagacgcattatccactctgacttcccactacctgtgctcccagacacaatcattgtgaatggatgacgaaattgtccatcctcccttttaaattgttggaaggcgtccattttactttttttttatgtaattttctttttatttatagtttttttttattttcacagattttaaatg

SEQ ID NO: 117059 - DNA, 251 bp, Heterodera glycines
  Promoter: Source sequence=SeqID_20566; Location=2243..2493; Strand=-; Gene=SeqID_51118
atcgttcactataaataaaaccaaaactattttaatttggtaaatatttttagaaatttcgtcgctttttaaaaacaccatgccaagtattttaattttttttgttgctctcgacacaatttgctcgagcaagtgctggtcctgtcgccgccattggggctaccgctcgaattttaaattcattgaaaagttttcgagcagcaaaagcacttgtatctggagcaattggcacggcaagtggtgcttccatg

SEQ ID NO: 117060 - DNA, 876 bp, Heterodera glycines
  Promoter: Source sequence=SeqID_2975; Location=1..876; Strand=+; Gene= SeqID_82597
ttcaaatttctttgaaatttccgggctctactaagggctcttgtgaaagcgccgggggcgctttcaacactgagacagcaaggaacacgaagcgcctaacttctatataattatctatataaccttcaaacaatttttacacaactttcaacattcttacaacttttcgcagaaattaaaaaaaaaattttttttgataatttgtgaaaggctaaattttacataattttctgcgcttaattactcactcggccactttgcactaatttatgcttagttgattaatccaaactttttacagttctattttaaaaaaaaattacaaattttctcgtaacaaaaaactcattagctgacggaaaacgagcaaaatcagtgtgaaatcatatttatacatcgagaaattttagaacgatgctaattcgttgggaagtttgtaaaaatatttatgattttttagattcaaggaagaatggtataaaaattaaaaagaaataaattcctagaaaaatttacggatttttttgcaatttaataacttttaggttttcagatttttaacaattaaaatccgcgaattaaaatcaacctattccaaaatcacagacttcaaattaatgaaaatttctttttccatcggtgcaaagttacagttacacgtttaattcccaattggtttgcaattattttgtcactaatttttggatttctttcattggttttgatatattttttcattatatttaatttgtccacatttgaatatttattttttgcttaaataattattaaaaattattatcaaaatttttcttacatttaagatattttggcagcaattcctttttccatttaataaatgttacttgagaaatg

SEQ ID NO: 117061 - DNA, 298 bp, Heterodera glycines
  Promoter: Source sequence=SeqID_3747; Location=2967..3264; Strand=-; Gene=SeqID_51718
tgccgttcctcttggcattgattttcttctaaattttttttgccgaaattacgaacatttaaaagaatttaaatattttcttttttacaaaattttgattaaaattattgcatttaaacaagtatcaacagttttttgcatatcttttacagaattacattttttgattttagcatttttttgggagtgttttagttatatttctgaatttttagacatataaaaacccgtgcccttttggttgtgccgttcatgactgatcggaagaatttttgtttttttttcagaaaaaaagatg

SEQ ID NO: 117062 - DNA, 603 bp, Heterodera glycines
  Promoter: Source sequence=SeqID_10351; Location=1910..2512; Strand=-; Gene=SeqID_73532
tttttggtcataactttgctcaaacttgaccaaattttttgaaatttagatgatcttgtagagaaatgttaggactattgaatgatactaacaatgtctaatttggttgacattggcaaaagttatgggcagttttttgttgaaaatttccatttgatggtttttatataacgactatttttctttgtttttcactgtctttggttcttactctttcttcatcactcaatcattctctctctaaccctcttttctttccctctcgatatttctctctttcatattttctctctctccctcacctctctctctctcctgtttctctttctctctatttccctctctcctcgtttctctcacattctctacctctctttctgctgatttgtcatcattttgctgtttttaaagggatttgtttcaattgatttaattttaaatttcaaaggaaattactataagtaataattgtcctaaaaaatggtccaatacaaattatatatattattttgatgggcgcggtttgggtgaacccatccgcctgttgcttcactatgttgcccaaccgtttgaggacatccgaattaaagactatgaagaatg

SEQ ID NO: 117063 - DNA, 389 bp, Heterodera glycines
  Promoter: Source sequence=SeqID_1653; Location=1..389; Strand=+; Gene= SeqID_75080
cacaaaatcgctacgaaattcctgccgtttcactgggatgttttgaattttacccagaatcgagatcgggaccccaaaaaaccatagagattttttcggcacgagaatggacaaccgaatttttgatagtcagaactcgctagggagggacacgcgagaaaaccaaaacaaattggaaaacaaagaaataatccatgcttattgttagctcagttagtaacagctagtgctgctcgagagtctcggtctcgagtctcgaggcttgtggtcaagtctcggtctcatagtccagtctcgaggtttttattatattaaaaaataggaaagattgtttcaaaagaggcggaatgtgcaattgtgccaataaaaaaaaattccaggatgccatg

SEQ ID NO: 117064 - DNA, 157 bp, Heterodera glycines
  Promoter: Source sequence=SeqID_4888; Location=1714..1870; Strand=-; Gene=SeqID_56099
cgcggaaccgcggagagaagggaccaaaaggtcagactcgttctttgaacataaaaccacaatatttcaggagaggaagggatgcccggccgtgacggactccaaggctcgcggacaatcagtgaaatttcattttgaatttgactttcaggagatg

SEQ ID NO: 117065 - DNA, 1003 bp, Heterodera glycines
  Promoter: Source sequence=SeqID_13829; Location=2855..3857; Strand=-; Gene=SeqID_77767
ttagagattttttggaaaaatgccaaattatgcacaaatatgcaaataaatcgccaaatatgcacaatatacatatggaaagtcatcctagaagcttcaaaacaagctaaaaacatgtttttcgtgcgtttcaagcctcccacagtccaggaaaaaaaatatgcatgtgcatataattccgaaccctactaatatgtattatgcttacgtggcagaaaataaatgttcgatattcatgatcggaaaatgcgtcagtgaatgcgtcagtggaaaatgcgtcaatagaaaatgcgtcggtgatacaactatttgaaaataaaattctatggcattagtattgtaatatagaagtaaacttctataagaacatcgttctgaattcctgaccccggaaccgaattcgaacaaaaagccgaataatcaaaattttcgaaattagggtttttcttaaaaattgtttaaaatacacggaaacaaactgaaagccatcaatccttcaataagagatcatttatgccgttttttggtacttatatgttatctgtgtacagattttcaaaaaaattttttttgaaaataaacttgttttataggttttcggggtcgggaaaaccgattctggcatcttttgaccaattcgaaccccgaacctggattcgaacaaaattcgaaaaaaagtcgaaaatttgttttcaccaaaattcacgttcattgctcaaaattgatttttaagggttaagaaaatttaaagttttgcaaagttttggcgttctgattaataaataaataaataataaacttatttgcactgggagcccaaaattgaatcgccgtgtacgtaagtatcgcctcggatcccttcgaaaaagcttcgtcaacccaccaccccctttcatgtaaatctccaacccaaccccatcccaaaaattgctttctaatagagaccacccattttattcatataaaaactcatttatttaatttttagatatataaaataatg

SEQ ID NO: 117066 - DNA, 1003 bp, Heterodera glycines
  Promoter: Source sequence=SeqID_371; Location=2521..3523; Strand=-; Gene=SeqID_84706
gttgtgaacagggacccccgacacaaggagggctctcattggtgcgccatttacgcgaggggaatggaagcaccagcgctttattttgacagccttgcccagcccatcccgcccagcattacgtcatcttttttgtgcgaatttcgtgagggaacaagaaggaatactcacacttaccagtcccctttactctctacttgtgccgcccattgtattgtttttatttaccacatgtccctgggggattcatttacacaatttctaagtattcttaataattgtgcaagtccggacatgtacgcgattgttttattacgaaaaatgttaaatcaataaatgtataattcttctgttgcttaggtgtcgttaattattcataagtgctcattgcactctcaattcccgagggaattacttcaaaggaaaatttgaaaaagccgcctttcgggatggcgtcgaaaattatcgattgatgggaggagcttgtcgatttctgggaggctttataagcacgccaggacacaattatttccatttcttagtccacattatttattaaatttaaacattttattagttttgctgttaaccagggcggttgctcgatttacagagccccgtttatcctggcagcaatttttaatgtcttttaggccttgaggtaatacaataaacctgtctaattttacgagccgtttaggtgccctgtcgtcttgtgcttcatgggtggcagtgcgctgctcatcaggtcatggttggtttgcaattacaacttttaatggaatcgatttcacatttcccatgcccaatatgatcgctataaattggctcgattgaccattcatttatcattcacactcatttctttcctttaattagattttgaataatgcaaaatcaacctcccaaacggccctctaatttttctattgattatcttctatcaatgcctaataaaaagccgcggcgccgctttctcatcaacgaattattgggagaaatg

SEQ ID NO: 117067 - DNA, 852 bp, Heterodera glycines
  Promoter: Source sequence=SeqID_25964; Location=404..1255; Strand=-; Gene=SeqID_56722
atttgcatgttgtatgagaggaaaatggcatggattttaatgttgggtgcgcaaatggcctggaatttgaatgttgtatgagaggaaaatggcatggattttaatgttgggtgcgcaaatggcctggaatttgaatgttgtatgagaggaaaatggcatggattttaatgttgggtgcgcaaatggcctggaatttgaatgttgtatgagaggaaaatggcatggattttaatgttgggtgcgcaaatggcctggaatttgaatgttgtatgagaggaaaatggcatggattttaatgttgggtgcgcaaatggcctggaatttgaatgttgtatgagaggaaaatggcatggattttaatgttgggtgcgcaaatggcctggaatttgaatgttgtatgagaggaaaatggcatggattttaatgttgggtgcgcaaatggcctggaatttgaatgttgtatgagaggaaaatggcatggattttaatgttgggtgcgcaaatggcctggaatttgaatgttgtatgagaggaaaatggcatggattttaatgttgggtgcgcaaatggcctggaatttgaatgttgtatgagaggaaaatggcatggattttaatgttgggtgcgcaaatggcctggaatttgaatgttgtatgagaggaaaatggcatggattttaatgttgggtgcgcaaatggcctggaatttgaatgttgtatgagaggaaaattgcatggattttaatgttgggtgcgcaaatggcctggaatttgaatgttgtctgggacgataaacaccagcatcatttttcttaatgatgaaacaacctcattatcataaccgggtgtcatg

SEQ ID NO: 117068 - DNA, 1003 bp, Heterodera glycines
  Promoter: Source sequence=SeqID_28130; Location=219..1221; Strand=+; Gene=SeqID_58783
tttagatgaatgattaaaagctgatggatgatgataaacaattgaagaatgatcaagagagggaagattttgaaaaacatagcaaatttgggcattatttatgaatattttttaaattttcttgacgagaatttttgattttaaaaattatgtacaattaacaaagaaattaccatttaagttcattggaaacccaataaaatcagaaataaattaaagatttcacaggaaaaatgcaaaaaagcgaaacacataactttaagaatagttttcactgacaaaagaatgagattattacaaaaaaatcttgaaatgcaatcattgaagctagaatttgataaaaattttgcattttccaaggtttaaatccattttttttggtaaagtccatgttttatgtccattttggtttgtatttttagtccatattaactctaataatgagaaaagtcttcgttgaactgatgagtggttctaactgattgacacttttaaattctcatttattcatttcattttaaacggatatttaaaaatcacataaaatgccaaaaaaagcataaaataaaccaaaaaagtcctgaaaataagcaaaatgtaattaaacccaaaagccgttttgggattcttcggagaacgtaataaaattttatggacgattttcctgtgaaatctttaatttattttgtgctaaaagcttcaaaaaaggtcaaaatatgtgccaaaaattgctcaaaaaataagtgattttatcaaaaaagtcatttgtatagctactgcatgcattggattcgatcctgggaccccccttttgtgacaaactcacagaccactgagacgaaaaatccaactaattttcgcttggagccagaaattgacccgttaatgaggcaaaattcacatattaattcattcactcattaactgtaataatttggataattggttttttcagtttagttcatttctttttcatttttgttattaccaattcataaaaatg

SEQ ID NO: 117069 - DNA, 608 bp, Heterodera glycines
  Promoter: Source sequence=SeqID_157; Location=1..608; Strand=+; Gene =SeqID_75377
ggctggaccccttcgcaaaattgtccgctgaccccccctcgaccccggggacgggacgaaatctcgccgccggaatctcgccggctgaaatctcgccgagacaaaatctcgccgccgaaatctcgccagctgaaatctcgccggccgaaatcttgccgcagaaatttcaaaaaaaaaaattcaaacagaaatttttcaaggaaaaaagtttagaaaattttttttataagaaaattccaaaaaaaaactatttgctaagtttttttcctattctttttttcgccatagaaattctttgaagtggtgacgatagcactcactcactggaaatggttaaaccaatttacgaatttagccaaaaaaaaaaaaattctgttaaaaatcatccccatccaaaaaattttataatatcttacaaagttttaccaaaaacccgaaagaaaagttctaattgtaatacagaaatccgtaattacgtccagccctgatcccctcagcaatgggactgcttgtcccccccccccccctcccctccctcgttccgcctgaaatttctaaaaaaaattttcgcagcgagcatttcaaattttgtttttgattgtcagatg

SEQ ID NO: 117070 - DNA, 246 bp, Heterodera glycines
  Promoter: Source sequence=SeqID_11590; Location=1448..1693; Strand=-; Gene=SeqID_75036
atttaaacacataacagtatcgccttgcagaagggcaccataaatgggtgaactgtaagctcgttaaacattgagcaaatcattgaaaaataattttttctgtggtaataattgatgtattgtaaacagtgaaaaataatgatgatgaaatttggggaacccgcaaaagtcgagccgcaaatgtcagattttggcttgggccgcaaaattcaataaaaaaaattaggccgcaaatatccgaaaatg

SEQ ID NO: 117071 - DNA, 215 bp, Heterodera glycines
  Promoter: Source sequence=SeqID_33828; Location=732..946; Strand=-; Gene=SeqID_63779
atttaaaaacttgaaataattcacgcttgcataacttttggtgctgatcaaaaaagtttcttacaccgatttgatcagatcactccttcctagtgaccgggacacccgaatacactgaaaatcggggaaattttcgaaatccctagggggttattgatcaccataaatgatcaatttatgatcaatgccataactttttatagaagcacccgatg

SEQ ID NO: 117072 - DNA, 1003 bp, Heterodera glycines
  misc_feature (511)..(512): n is a, c, g, or t
  misc_feature (517)..(517): n is a, c, g, or t
  misc_feature (533)..(533): n is a, c, g, or t
  misc_feature (544)..(544): n is a, c, g, or t
  misc_feature (552)..(552): n is a, c, g, or t
  misc_feature (579)..(579): n is a, c, g, or t
  misc_feature (583)..(584): n is a, c, g, or t
  misc_feature (594)..(594): n is a, c, g, or t
  misc_feature (613)..(613): n is a, c, g, or t
  misc_feature (627)..(627): n is a, c, g, or t
  misc_feature (654)..(654): n is a, c, g, or t
  misc_feature (677)..(677): n is a, c, g, or t
  misc_feature (686)..(686): n is a, c, g, or t
  Promoter: Source sequence=SeqID_15921; Location=1732..2734; Strand=-; Gene=SeqID_80266
aacttttttaaaattaataataaaaaataatttgcaaaataatagagaaatctttaagcgttctatgtatttaaagaaaattaaaattggttgggaattaaatatatccatatttttatggtcatacaaaaatgtaaagttgctgaaatgcatgaaaattgttaaacttcaaataattgaaaccaaccttgataggattggaaaacacaaagattttctaatattatttaaatttcaaataaaatttattgagttttaaaatcgagataataatgtttgtgctagttatggatttattaattggcaattacatttaaaattaaattaaattccagtattcctatcatcatagaaataaatattttatatattttaataaaattgtttgtttaaaatcaacggagtggcgattttgcttaaattttaataagagaattatcgaaaatggaaaaactgtaaattactgatcaaaattttatacatcactatttaatataaattagatttggannttganaataatgatttagtgntttagtttttnatggaatnaggtgtaatttattttattttttttantaannttggtttttngtagatgaggtggattttnttggaaaaatattnaaaaaaagaatggagtaaaattgaaanaaaaattgataaaaatttttaantataaaatnaattaaagataattttaataatttatttatttgcaataagaaaaaaattattaaaaatcatttccacaagaattgaatttcattaatgcttagcttttcattttccactctttattttttctatatattaataaaggaataattttttatagaaaacatttgaaaaaatataatttaaaattcaaaatgaatttattcatattattctttttgtgttttattttatttttgatcaccaaaattgatcaaattgaatcagcaaatgaaaaattacaacagaaaacatttgacgaaatatttgaaatttcattgaaatg

SEQ ID NO: 117073 - DNA, 538 bp, Heterodera glycines
  Promoter: Source sequence=SeqID_7894; Location=1387..1924; Strand=+; Gene=SeqID_66309
tttcagtcaaaagttgaaagcaaatgaaagaattctcctaaaatctatttatagcaagaaaataaaaaatggagaatttacaagacttagtcgccattctgacttggatgagaatttttaggaaatacataaatattcggggtgggaccctaggttgtgaaagtttccggaattcatcaggtcccataaaaatccataacccggaaatttttaaatatgcgactgcggtgcgatgcaagtttacaaactgcattaaaaatagtcattttgtgaatttttaaattattaaaaagagaatcatgatttgattagatttaggtaagtccaataaaaacaatgcagaagaattggtacttatcaaaaccgctagtttttaaaataaaattacggttcagaaattttaatcaaagaatccggagttccgccgcggtcctaaaaagatacggggttccgaacccggaatactgtccctctcctaatataaattcatacaagcgaaaaacgatatctgaaaattataaattttattagaaaaatg

SEQ ID NO: 117074 - DNA, 60 bp, Heterodera glycines
  misc_feature (14)..(14): n is a, c, g, or t
  Promoter: Source sequence=SeqID_12334; Location=1987..2046; Strand=-; Gene=SeqID_75935
atgggtaaattaantcgtaaaaaaataattctcagaacattcggcaaagaatggacaatg

SEQ ID NO: 117075 - DNA, 261 bp, Heterodera glycines
  Promoter: Source sequence=SeqID_103; Location=6418..6678; Strand=-; Gene=SeqID_69067
atatttcttctcagcatttttataatttctgtggaataaaaattatattagacacttcatcaccgttttggcataccaatccgtacgcgacctcccgagagaagggtgggtgaaagtgttcgtttattttattgtaactgatttgctcttaaaacaaaggccaggatcagagatcattgtttacaaattagtccaacgatattttaaaaggtggatcgttcgattgatgactccttcgtaattgaacgtacaacaccaatg

SEQ ID NO: 117076 - DNA, 184 bp, Heterodera glycines
  Promoter: Source sequence=SeqID_32715; Location=1..184; Strand=+; Gene=SeqID_62986
aattaaaactcaaataatttttttttgctgtaatttttcgagaatttactagtaaaataattgaaaataattgccgcgcaaatttcgcatttttataaaaatatttttaaatttgaatcaccaattagtcatttacgtatttcttcatcatctttgcaggcctactgtattgaccgtaactatg

SEQ ID NO: 117077 - DNA, 971 bp, Heterodera glycines
  Promoter: Source sequence=SeqID_8744; Location=2501..3471; Strand=-; Gene=SeqID_69079
aaattgttgtattacgctttaaaaatttgaaaaacttttcaataattggggcctacaggcccccaacaattaatctatcgaacacaaaaaactttttttcttatttggatcaaaaaatcaatggaccgacattaatcttaggggattttaatttgaatagcaaatgtataaaatgggataatggaaaaccaaccccactttcaaaaattggacaacactttgtaaatttcttcacaaaaaattttctaagtatgcattgtaccgggcccacccgaggaaatgaaatccttgatctttgcttgacaaatgatgccaggctggtaacagaggttgaaattaaagacagtctaataaattcagaccatgaatctctcttcataaatctatctatttccttacagaaaactaatccaccagtaataagctatagaaaatttgacccaaaaaatattcatcaaataaattccttcttaagcttccatctaaatgactcattgcaatccgagtttgacttagagcataaatataacaggttcactaaagaatccattgatgcaatggatttattttcaccaaaaataaccttcaaaaaggaaccaaaaaatgttaattatcctatttcactccaagcttctataaaggaaaaagcaaaaatctggaaaaagctcaaagaaaacccgaataaatacaaatctttatataattcaattagcctacacataaaaattcagattagaaaatttcaggagcgcgaagaaaaaaaatttcttgacaaaaatcccaaaaatatttacaaatatatcgaaaaagattttcaaagatgggaaaccccattaattctttatgaaaacaaaactatcatagacgacggggaaaaagcagaaatttttgccaaacattttgcacgtgggtgatgttgtttggaattggcattgactttggcactcgtcaaatatttttcacgaaaaatg

SEQ ID NO: 117078 - DNA, 451 bp, Heterodera glycines
  Promoter: Source sequence=SeqID_31823; Location=997..1447; Strand=-; Gene=SeqID_62129
aaattttccctttgctttgtccaatattattttgcatttaaatgatcaataaaataaagatattacaatcaataagtaactgaaaaaatctacaacagattccattccaaaaagaaataggaggctaatatattgggatttccttctttgctttatatctaacaaacgcaaaaaaattaaatttataagcaattttataaatttttcgattaatggagaaagtggcccagcagaattattatttaaccgattcaaaatcatcgtctttggcaagtgctgcccaaaaggagtttgacttcatccatcgtgttttgttgggcccacaacgggacaatttgacagcaattgaatatttagtggcacaaaattttagccaaaattcatcaatgatgcctgcttatggcacggaagggcaaaatgccaaaattggaaatggaaaagcacacaaatg

SEQ ID NO: 117079 - DNA, 191 bp, Heterodera glycines
  Promoter: Source sequence=SeqID_15123; Location=2717..2907; Strand=-; Gene=SeqID_79306
tttagctgctttctgcgcttccctttgaacatgccgctcgtctgcttttactttctaaagcaattgccaaaaattgcgattctctcgtgcaaaaacaaaaaaaagggtggaaggtgaaaagggaaaccttattttttatgattttatttattttttaggtcttttccgaaaattgtatcgacaaaattatg

SEQ ID NO: 117080 - DNA, 102 bp, Heterodera glycines
  Promoter: Source sequence=SeqID_18293; Location=1445..1546; Strand=-; Gene=SeqID_82882
ttcttacccaataaattttaggcgctatttaattttttaaaatgttaattaattcgaccacttttctttcaacaacaattccaccatttttattggagaatg

SEQ ID NO: 117081 - DNA, 1003 bp, Heterodera glycines
  Promoter: Source sequence=SeqID_10997; Location=1097..2099; Strand=+; Gene=SeqID_74306
tgacgggggcttttttcaaaatttgtgggacggtgaatttatacaataaaaaaattgtatagtttctattttagcttgggattaattacttatagtaaaataacattttattttaattccataaccttaaaagcttaaaatttttagcctcagataaattgtgtattagagttgatataatattatgtctccgttttaaagaaatttttaacacgtaacagggggttctaccggagaccctaaaaaacttcctcaatccgaattttagtttttatgcgctattttcaaaatcttttctgatgggtggagggtcagacgccagaaatttttttaatgaatttagttataataagaattcacgtatttttatttcgaattcagcacaaacaatgttcaaatttggattttgatctaataattcgttttcttaattattattttttgctttttgaaccgctctttttgcggcgaatggaacaaagtggtcaagtggtgtcgaaattaaaggcatttcgccaaaataatatttaaatttttcaattttttcgtcaattgaaaatacacccgttcaataataaaaaaaaaagaaaaaaatacagatcacagtgtcggccatcaaaacttaaatgagagagcgattcaaaaaatctttttataattgtttttaatttttttgcccaattttaaagtggcaccacacgaattattccatcctattacttcaattcccacgcaatttttttttgattaattttataaattttattaaataaaaatggaaaaaaaataaaatgaaagtagaataatctaattgagaaatttaatttttaggaaattagaaaaatatacaaaattaataacatcaacaaatcggaaaccaatttgttttccaacgagacaagcaaaagagagcaaatgtatataaatactgtccatatgttaactgaaaatcatccaaatcaacgcggcacagtaataaaatattaaaagatccgaaaaaatg

SEQ ID NO: 117082 - DNA, 762 bp, Heterodera glycines
  Promoter: Source sequence=SeqID_23025; Location=1..762; Strand=+; Gene=SeqID_53727
tggaatttcatatttcaaatattttttattcaatccgaaacaagtcactgaacgttagttcgacaaatttaataaaataaaataagtttttttttttttggttttttaaatgttctcataaataaaatttaaaatttttcaacaaaaatttgtttgaaattttttgtgaatccaaaaatatcaatttcaaatgtttatgctttttcacattttgtccaatttcccgaacacaaatttcgttgaaggcacatgccaacgcaaattatccacaaatccgttaatggacttcctgtactcggcaaaatctaatccaagcaatttaaccatcactaaagagttaatatgtagtggaaaaaacccataacaattttctttaaaactttccaatagaaattttaaaaatctaaaatcgcaccgcaaaaattaatttaattctaaaacattctaaaaagaaataaactaacaaattgcgcgatcgaattgaaatattagacaaattaatcgcaaaattataataaaataaataattaaattttttataatttgaaaagttttccaataaattaaagtaattaaatttttaaatctctaaagagttagagattataaaattaaataattaaatatttttgattggaaaagttttacaataaattaaacaataagattttaaatctattaggaatcattctttaacaagttaactcttttttatcctttttataaataaatttattcattaaaaaaatttttaagaaaatg

SEQ ID NO: 117083 - DNA, 522 bp, Heterodera glycines
  Promoter: Source sequence=SeqID_33682; Location=1..522; Strand=+; Gene=SeqID_63673
atataaaaacgcaaggaaaaactatttttgaaatttttctttataatttttaaaattattcttcttttagagaacccacacttatttgttagtaactatttgaagctaacaagaacataaaatgtcgtaaatttgaattttatttttggttttttgaacatttgcatatttataaaaaaataattacattaaattaaaagaaattaaatgttttaaatctaaacatttaaattattttgtttaatttattaagcaattaatctaaaaatcaaaaatgtcttgaatttttcataaagtgtcctggttttgaaatagtgaataaacaggcgaaaaatttctaattaacgtcatcaaatttatagattaatattatttcaataatatatattcgatattaaacaaattctgccaaactgagtaatttttttttgataaaattattataattcaaaaagaattcatttaattgtataaattttgaaaatattttaaaaccatttagactgtcattgcataaaaatg

SEQ ID NO: 117084 - DNA, 126 bp, Heterodera glycines
  Promoter: Source sequence=SeqID_9153; Location=46..171; Strand=+; Gene=SeqID_70416
gctgcttgcgtagcttttcaatatggtctctccgttgttgctcgtcttcgtcaaatccatctgttgactcatccatatggcgttctgttgcacctttttctctttgttcctgggcttcgtccaatg

SEQ ID NO: 117085 - DNA, 94 bp, Heterodera glycines
  Promoter: Source sequence=SeqID_22103; Location=1..94; Strand=+; Gene= SeqID_52751
ctatttatgaaaataatctaacaattcagatgttaaactttattatgaattccgaaacaataaaaatttgaaaagattcgttccatttaaaatg

SEQ ID NO: 117086 - DNA, 66 bp, Heterodera glycines
  Promoter: Source sequence=SeqID_6729; Location=685..750; Strand=-; Gene=SeqID_62654
atcatttgttttttaaataaaatccttttttattattcattttaaaaataattcgacaaagacatg

SEQ ID NO: 117087 - DNA, 785 bp, Heterodera glycines
  misc_feature (19)..(19): n is a, c, g, or t
  Promoter: Source sequence=SeqID_19399; Location=501..1285; Strand=-; Gene=SeqID_84123
taaaaaatatgcattttanagttttaaaccccattttttggttgtttattgtactttttaggtttatttaagcaaatattaaatatgcaccccttttttgggatttttgggggtttacaacatatattttggcattttttatccatattttggtccatatttggccatttttgccctttttagtccatatttcgggcttttttagtccatatttaatgtccatatttcgcgttttttagtccatataatttacaaccctaattataaccaaataaaattgaaaaatttatttgaaataaaatttaaaaacgggtaacatagatctatttttaaaaataattcttacagttattttctaaatttcatttttctaaaattcaaaaattgtccaagtgtcaaaaaattttgataaaaaaacataaaaatgaattcataactggcttaatgcctctctatctctccattctttttcgttattccatcatctttatttatttattttttgccaaaagctttcacatgcaaatttttttttattatatttcaaatcataaaacggcaaaagtgctgttcaattttacgttttccatattaaaattcaaaaatagtcaaaatgatattggcccgcccatcttattaatccataatttttttatagcaaaggcaataaaacccaataataaatatagaccaaatcgcttttggagtatttaagggtggccaaatctctccaccaatcactttccattccaaacccgatcccaactccaaatccccccaaaatg

SEQ ID NO: 117088 - DNA, 170 bp, Heterodera glycines
  Promoter: Source sequence=SeqID_38111; Location=1..170; Strand=+; Gene=SeqID_67021
ttgatttcgtaaattattagaagtaatgtttttaaatttaaaatggtgcattattgtttttccataaagaataaacaaaaatgaaataaatttttataattttattttaaaatattttctttttttctcaggttgagcctgactggcgtgcctttatcaccagtaacatg

SEQ ID NO: 117089 - DNA, 209 bp, Heterodera glycines
  Promoter: Source sequence=SeqID_7204; Location=922..1130; Strand=+; Gene=SeqID_64135
agtgcaaataaaatccatttaaatgaacttttatattaaaaaacatttaaaaaattttttgattaaatatttttattgtaaataaatgtaaattattccattatctaattatctaattaatttaatttaaatagtttaggaagaaaatgggcaagatggactgaataaaacacgacctctttgtctatgcttttacaatcaacaaaatg

SEQ ID NO: 117090 - DNA, 587 bp, Heterodera glycines
  misc_feature (107)..(107): n is a, c, g, or t
  misc_feature (109)..(109): n is a, c, g, or t
  misc_feature (111)..(111): n is a, c, g, or t
  misc_feature (129)..(129): n is a, c, g, or t
  misc_feature (131)..(134): n is a, c, g, or t
  misc_feature (141)..(141): n is a, c, g, or t
  misc_feature (149)..(149): n is a, c, g, or t
  misc_feature (151)..(151): n is a, c, g, or t
  Promoter: Source sequence=SeqID_30236; Location=1..587; Strand=+; Gene=SeqID_60666
tacgtaaaggaaaacaaagatttatttaaaattacggcccttcaagaggacagtcgaacatgaatttgccgattgaaaacttaattatagagatgttttgttgtatntngnagggaagaaagatgaaanannnnggggtanaaaatttntnaaagctcggttactgaaggatccaacagtaaaagacatggttgataaatcaaaggtcatgtggggacgtggaaggaaaaaggcaataaaatatataaaaacacccggcatagtgcgagagaagaaacccttcaaaccactaatatgggccagactgtagagaaaatttattttaatttaaaatctccggcaagttttgctggaattcaaaaaattttaaatgaggccaaaaagattgacccggaaattacgactgatgacgttaataaattcctagaaaagcagaaaacatacacgattcacaagcccatcaggaaaagattcccgatactaaagacgatatctcgagttccatccaaacccaaataaacacactacgggaaacaaatcctcaaatttaagaagagcctgatataaaagtgtggtttgacaaaatg

SEQ ID NO: 117091 - DNA, 425 bp, Heterodera glycines
  misc_feature (49)..(49): n is a, c, g, or t
  misc_feature (212)..(212): n is a, c, g, or t
  Promoter: Source sequence=SeqID_41700; Location=1..425; Strand=+; Gene=SeqID_69773
gagaaataattcaaaaatattataaaataacgagaaataaagggagaanggaaagaatatttacaaaaagaatgggttaaaatagaaataaaaatgcaaaaaaattggggacaaatcgccaatatatttataaatggattaaagaattagaacttaatcaacgaatacagaaaagctataaatcaacagagtttgccaattaggatcttttntaaggaattagattcatactctactgatcatcaaaattgtaatgaaagtagggaataaaaaaataaatattttctggtcagtagggataaaaatggttatttaaccgtggaatactttagtttttatttcattataatctttttaaaattaattgagagatggatgaaacaatttggcattagccgtaaagaataacggaggaagaaaaaatg

SEQ ID NO: 117092 - DNA, 704 bp, Heterodera glycines
  Promoter: Source sequence=SeqID_5613; Location=918..1621; Strand=+; Gene=SeqID_58653
aacatatgattatatggtacaaaataaagaacatttttatcaattgttttactggtgagataaatatccatcttactaatgcagttgctcatcgatatgcgcttattctacgtctaaacatatttttgtatatgtatacgtcttacattttttgtttcccgcagtggctcaaaaaatgaaattctgtcattacattaaaaagggggtgcaagggatttaaatagatttgaagcattccatgacattttgtgcttatcatttaaaaaatatttaaaaccctattcataattttttttaaacaggatcattgcattgattaatttttttaattttgtaaggaaattaagtcgggtacgtaaaaacaaactagaaaagcctgacatactaaatttgtagaagagttttgtggcgaaagcattttcaagggcctgatgctttatttttatttttttgtctcaagttgcacctatttacgaaggttaatgtccgggagacatcatttgaatatgtgtggcattatgtttttgttattttccccctccactcattcattgttgacccctcatatttttgcataaatacccctccttccttcctccctcgttcacttttcttcactttgttatttatgaaaatttttaactctccatttgtccgttaagcacaggggaatttactttgggttacaaagcttcaacaacatg

SEQ ID NO: 117093 - DNA, 522 bp, Heterodera glycines
  Promoter: Source sequence=SeqID_21006; Location=907..1428; Strand=+; Gene=SeqID_45617
tttttatccgcaaaaaatttctgatggaattaaggaaatatctaaaaattcattagttatatgtatgtatacatataggctctctatagatagcgataaaccaaagggaaagggacagtgcctccattgatttgtaggcacaaaaactttgtttcataaatttttaaaatttaaatgttttggcgttatttactaaaaaattttttatcctcttcgaaaaatagagaaatttaaaattgtcggtgagtgacatccctcgtcaggcagtaaattcagtggcgcttatcggcactttcatgctttgcgaaataatattaggtatagagattaaatatttgctactcttaggaatttgaatctctgtaattctaccccgccattcccgaatcccgactttttcaaaattccgtgcttcagaaataagtctcatgtcaaaagcaattaatgtatcaattttaggaaaaccattgtttaatttaccatttaagacctgttaacttcttttgccttattttgaaaatg

SEQ ID NO: 117094 - DNA, 54 bp, Heterodera glycines
  misc_feature (42)..(42): n is a, c, g, or t
  Promoter: Source sequence=SeqID_37793; Location=888..941; Strand=-; Gene=SeqID_66781
ttaagtcgattgaacatcaccaaacgtattgaccacctgtcncacgctttgatg

SEQ ID NO: 117095 - DNA, 969 bp, Heterodera glycines
  misc_feature (632)..(632): n is a, c, g, or t
  Promoter: Source sequence=SeqID_9404; Location=3231..4199; Strand=-; Gene=SeqID_71294
atttttaggctcaaaaaactgccaaaataggtaggctttaggctctaaaaactgccaaactaggtaggctttaggtcataaaaaaccacgaaaataggcactaaaaatgggaaaatagacactaaaaagcctcaaatttatgtgtgtaaaatgacaaaatatattcaaaaaaataacaacattaagccaaatcagtattaagatacataatttttaaaataaaacttcttgtcaagaaaataaaaaaataaattttgaaaatgaatttttgagaaatttttcattgtaagggtacatttttgaaaatttttcgggttgtatttttcgttttttatttcatttttgttaacaaattgctcatcaaacgccaaaataggcaaaaataggttttctttcaaaatttttaggttttttaggctctaaatataaaatcctagaaaataggcactataactcgaaaagtagcttaacaacaacagaaaaaaaacatatttttcgtgcatttaaggccacggagagctcaggaaaaaataggcaaaaacctaaaatcatagccctagccataatatataagtgatagaaattgaaagaaagactaagatttttttaattccaactcgctttagtgttanatgttatttctagcgaagctccaaaaccgcagaagtgctttatcccagcccggaatcaactttaacccacccgataatttaacagattttccgagtaaaatcagaatttgcttaaacaaaaaaaaaattcataattattgttatgaattaatattttgaaataatcttaatcttaagcaaaatttaataatttgtttttaataatgttttaatactaccaaaatcaataaattggtttttaataatgtataaaaaaaaatttgtgaataatttcttcatagcataatgataatcattttataaaaaattatttattcattttcaaaattggaaaatg

SEQ ID NO: 117096 - DNA, 303 bp, Heterodera glycines
  Promoter: Source sequence=SeqID_1517; Location=1..303; Strand=+; Gene= SeqID_74148
cgctgagttgggacaccacaaaaatcctcaaattttctcaaaagaccacaaaaatccgcaaattctcatttttcataaaaccctcttttaccctctaaaatagggttaagccccgaccccgagcccccgacattttcgggcctattccccgacccgacccccgacatgtcgccccccgaggtccccggccatttgtctcaatgtgtagcctaactacatggagacgggcattttattgtagtttttgtaaaaaatttgaattttttttatttgaaaatttaaacaaatttagtttttggaatg

SEQ ID NO: 117097 - DNA, 154 bp, Heterodera glycines
  Promoter: Source sequence=SeqID_16556; Location=1..154; Strand=+; Gene=SeqID_80963
aaatctcagtccggaaacagagttaattttaaaaatattatttaattttttcttgcaattgaattaattctggctaaagcagacgtaattttgtctaattttgggcataaaattaaattttaaatattttttgttttagttaaatccacaaatg

SEQ ID NO: 117098 - DNA, 760 bp, Heterodera glycines
  misc_feature (26)..(26): n is a, c, g, or t
  misc_feature (163)..(163): n is a, c, g, or t
  misc_feature (188)..(189): n is a, c, g, or t
  Promoter: Source sequence=SeqID_11222; Location=1..760; Strand=+; Gene=SeqID_74581
tttttcatgacttttttgcatttttntgtgacttttgggcattttttatgactttttcgtgacttttgggcgatttttcatgactttttaagtcgactttttgagatttttcgtgacttaaattcccatccctagtaattaatatttaaattaaaataatatntaattatatttttttcaattttttnnagatgtgccaatcgcgcaatgaattgccagaatttccttcccatgctctgagagatgcaaaatttttgttagcatcaaacacaaacccgttgttctgtctctgctttccgttaacatgattttattgattttttcaatcgattttttcctgtactaattgcttttacctaaatggggactcatttcaaaaaattaaatttagaataaaaatagattttctaaataaagttttaaaaaaccgagtcttaaaaattccaaaaaaataattattttttaattgatcatagctgtatcattttgaaaatataatagattttgcctggaagtcctcataaaaaatatttctatttagccattaaatttgtcttattgtaattagagtaccgttattttgtacgaattctcgggttgaattgaataaaggttgtttcatttgtatgaacatttttaataattgaaatcaacaggataggtttaatgaaaattgtttaaaaaattttttaatttgtaaattttataaggttttaaagcatttttaaatggattttttccgcgcgggagagtggaaatg

SEQ ID NO: 117099 - DNA, 430 bp, Heterodera glycines
  Promoter: Source sequence=SeqID_24236; Location=1611..2040; Strand=-; Gene=SeqID_54954
acttcgtcaatgcttagattcttggtatcaaacgaaagatcaaagtctacagaagtttttgtatagctaaattctcggctaaatgcaacagacaaaaaattattcttgaatttactataaaattctgaattccgcatttctcattgctattttctatgtcaagattttgatgttttcttgagtttctaaattccagagactgagaaatcgtttgataccaagaatcaacaatataggcattgaaaatattgtggcccaagaaactaaaacgatagttactgattggacgaataaactgaatagagccgaaaattctgttaacatttgatcaattaatacatatcaaatgcactacagttaattacccttaattgcctaataaatttccttttctaatttgaaatttcatttcaaagtgcatcccaaaatg

SEQ ID NO: 117100 - DNA, 476 bp, Heterodera glycines
  Promoter: Source sequence=SeqID_6868; Location=2605..3080; Strand=-; Gene=SeqID_63159
ttctcatcctcctcacgcctccctcatcctcctcgtccccgttccttcatccccccccccttttcactcatccctcctcctccatctcttcactcctccctgatgctcctccctcatccttccgctaatcctcctctctcatccactttcacctcctcactcctcctttcttctcatccctcctcattattcattcacccgctctccttctttatgcttttctttattaataaaaatgccttattattaaagataaatatgtaaataaggacatttgtcctcataaacaaatgttttttttgtttgtttttttattttttattaattcaacaaaaaaaatattctatctcatcaaattaccacccccctcccttctcccctcctttaatctcttcattcattcattctttcttccatcggttcatgacccacactcttaaatcaaaaaatcacacccttttttttcttcaaaaatg

SEQ ID NO: 117101 - DNA, 563 bp, Heterodera glycines
  Promoter: Source sequence=SeqID_32138; Location=443..1005; Strand=+; Gene=SeqID_62468
agttagaagcatactcacattttttctttttatctataaacttttccgctctctcgtgaatgccttttcttttttctctctgctttcttttcctgcctttcgtctcgcctcactatttctgctccattgctttctctctgttttcttttccctgtcctacacaattacgcactattttttctgtttaattaattacaatataataattatttgattttatttttttgcgcaccaatttcagcaatccgatctgccattctcattcaaaaatggtaccggcgctgtttggcacgtttggaagcgcgaagaagaggtttgaattatggcttatttaaatttatttatttaattttaaccaaaaatatatttaattatttttgaaatttaatttaagtttttttagcaaataatgtgtataatatttattgaaaaaactacaataattataaacaaatttaattgttttttatttaataattgaatttttatttaaatttaatttattttcattttctaacaaagacattttcaataataattaattattttattttagcaacatg

SEQ ID NO: 117102 - DNA, 1003 bp, Heterodera glycines
  Promoter: Source sequence=SeqID_14837; Location=2628..3630; Strand=-; Gene=SeqID_78993
caaaggtcgacgattagccttagtagggataattaataatattttgatccacatttcctgctaaataattgatcagcaattgctaggaaaattccaacactttttcttttattttttcgttttactttgctggcaaatggttgaaatcgttcaggtccaattcgtgttgcgaatgcacgaaataaatgcgttcaatgtcccagatcacttcgtctcgaaaggggtgttccaaccaatcacaatgtgcctgaaaaggcgtgcggataaaaatgccaactttacattttggaatttcgataaatttatatattgtttaatgatgtttgatgaatagggatgcgatttttaggtaagaaaaatcccagaataggtacttaaataggtaaaaaaaaatctcaaaataggtattaaataggtacaaaaattccaaaataggtaccaaaataggtaaataaaaatttttattaacgattttttagtggaaaaaagcaaacaaagagggaaaattttggttctacatatctctttgtaaacgaaaatttaaatatattaatattttcttagataatattgacattttaaattaaaaattttgtcaatagaaaaaataaataaattttgggataaatttttgagaaatttttccaattcttagggtgcatttttgaaaatttttttggtcgattcttatgggtatattttttgattttattgcatttttgttaagaattttttgaaaatccttaaaataggtaaccaaaatgccgaaataggtataaaaataggtacctaataggtagaaaaatcccgaaataggtaaaaataggtattataaaagtgggtgtagaagctccaaaccaagctaaaaactcgttttttatgcttatctcaacgttacaagtgcgcaaaaattttaggtatttacctaaaaatcgaagccctattaataaatagtcaagaaaatccaaaatttaatattcaaatttaaataatttgtagaatg

SEQ ID NO: 117103 - DNA, 77 bp, Heterodera glycines
  Promoter: Source sequence=SeqID_17372; Location=1711..1787; Strand=-; Gene=SeqID_81856
taattatttctcaattagcctctgctaattgccccgtggaggtcactgatgttgaagtggcagtgttcaaagtgatg

SEQ ID NO: 117104 - DNA, 892 bp, Heterodera glycines
  Promoter: Source sequence=SeqID_23373; Location=1..892; Strand=+; Gene=SeqID_54081
attcgtgattgcaggaagagaaatactgtcgagaagaaaaatccaaaggacaaataactaatagggattttgtatatcttcaaataatattggcatttcatgaaaaaaattttctagtaaaagaattattaacatataaaataataaaaagaaaaactgtaaactatttttttattgcatcttaaaaaatttagcgcaatgaacattctacgataaaaatgattaatttataatattaaattatctttaaatataaacactaaacaatttgaaaataaaaaataattccaaaattaaagttaataaaaaaaggtgtaaaaacttgtaaatattaaggtcaatgccagtgctattatctaaattgcgaaagtaggtatgcgagaatgaggaagaacggcatatcataaattttaataaataaaaaatcaaaaagaatatgttacaaacaactacaggcatatttagacctaaaaatcagtggaccattagttatgattaattatgaaattaaatgaattttatcatcttgggtatacatatgacagaagtggaataagaaaactgtattttacaataattttgaaataatttattccgataaaattaattaaataattcaaaaaatatatttactttttgaaggttttcataaatgaaaaattacacaaaaattaaaataatttattttttaaaaaattgaaaataatttgtttaattaaaatgtatcacaaagttctgaagagggttcttcgaaaatcgagagcaaataaaaaatacgtgtaataaaaaatggtgaaatttaaaaaaacacggattaattttaaaaagcaaaataactgagaatgaaaaacataatttgtgataattattttcaggacatactttacaaatg

SEQ ID NO: 117105 - DNA, 165 bp, Heterodera glycines
  Promoter: Source sequence=SeqID_4863; Location=1669..1833; Strand=-; Gene=SeqID_55993
atcccagcacaaattttttgaaattcgaatagattaaattgtttattttattccaatattttatttgggaaacaataaatatgaaataacataaattatttattgtgtattaatttagtattaaaatttatattttaaataaattttagttattttgtggagatg

SEQ ID NO: 117106 - DNA, 120 bp, Heterodera glycines
  Promoter: Source sequence=SeqID_2383; Location=8182..8301; Strand=+; Gene=SeqID_79463
tggtcaattcggtgatcagcaaacgcaacctgttgcacattttgtcgccgtaaccttaacaaatggaatggaatgtgaagatggcacggcaaaaattgtacagaattaatcactcacatg

SEQ ID NO: 117107 - DNA, 545 bp, Heterodera glycines
  Promoter: Source sequence=SeqID_4623; Location=2766..3310; Strand=-; Gene=SeqID_55128
ggaaattttccaaaaaatgccaagtggccaaaatagtgacgaaacgccaaaatagtggcaaaaaactattttagtggccaacttccaaaatagtttttttagtggcaaagctccaaaatagtgaattcctagggataaatagtggcgttaaaccgaagaatttccgagctaaaaatgtgtttttcatgcatttctcgtcgaaataaagctgcagaaaaaatagaaaaaaaccaaaatggaaaattgaattttatactctattcaagacagcaggtggttctattggaggagtacaattatatttctatgttcacctattttgaacggaaaaaaaattattttaaaggaaatgaaatttataaaaaatattttttatgtttcggaaaaactgataaaaatctcaaaaactttcaaaattaacacaaaaatgatatttggctacatcgataaaataaataagctaattgcttcatgcgcgagagcccacggaaggagaagttgtgctaatctcggaagaaaaacttcctcgcaactgttggccaatg

SEQ ID NO: 117108 - DNA, 932 bp, Heterodera glycines
  misc_feature (557)..(557): n is a, c, g, or t
  misc_feature (563)..(564): n is a, c, g, or t
  misc_feature (582)..(582): n is a, c, g, or t
  misc_feature (584)..(584): n is a, c, g, or t
  misc_feature (586)..(586): n is a, c, g, or t
  misc_feature (588)..(588): n is a, c, g, or t
  misc_feature (613)..(615): n is a, c, g, or t
  misc_feature (625)..(626): n is a, c, g, or t
  misc_feature (640)..(641): n is a, c, g, or t
  misc_feature (664)..(664): n is a, c, g, or t
  misc_feature (672)..(673): n is a, c, g, or t
  misc_feature (677)..(677): n is a, c, g, or t
  misc_feature (700)..(700): n is a, c, g, or t
  Promoter: Source sequence=SeqID_32310; Location=1..932; Strand=+; Gene=SeqID_62612
aaaaagtttgaaatagtgacgaatagtgacataatttcagccaaaaattgagcaaaaataatttttattcactgattccattgcaaatgagtagggctgggatttttaagggcaaaaaaacaaaataggtacataaaaaaataattttttaaattaaaattcttgccacgaaaatacctttttgagaaaatttttttcatttcttaggagtgctttttgaaattttttttgtcgattcttaggggtgtattttttggttttattgcatttttgttaaagaattttccaagaaatgtcgaaatagtgacgaaacgccaaaatagtgatttttaactattttagtgacgaagtcgccaaaatagtgatttctagtgaccgataatgacatcagaatcgaaaaatttttatgcggaaatgcgttttttaagctcctttcttcaaaacaattattgctgattataatgtggcgtctttcatttgctgatacaaaaccaatttcggctaaggttatggagggggagggggtccttttgaatagcgacccaattttgggtagncttatnnaatctataaaaagaagantntntntttctttttctcatttcatccactnnnaaccattacnnataaaaacattccnnaaaaatcattaatactttttatnatcattannattnaaatttttaattaatcgaaaaanttatttaccttattattattatattattaaatgtgacaaataagtagcaagaaaaaaaaatcaattttacaatttaatgagtgttgtaatcatgtcaatatttcactttaaaatgtgtagaatttataagagaaaaatataaaattcattttgagaaatatttttatattcttatttatttcgttcttatcaaaaaatattattataatttctaaaaaaaaattctgcaatg

SEQ ID NO: 117109 - DNA, 91 bp, Heterodera glycines; identical to SEQ ID NO: 100405
  Promoter: Source sequence=SeqID_39798; Location=898..988; Strand=-; Gene=SeqID_68280

SEQ ID NO: 117110 - DNA, 130 bp, Heterodera glycines
  Promoter: Source sequence=SeqID_34967; Location=1..130; Strand=+; Gene=SeqID_64647
agaaacagcggtgcaagaagattggcaagcagttgctgaagaagagcagaagcaacaacagaagggggccatcggcgcatttgcgtcgcccgaggggacaaattgctgcagcagcaaaaacccattgatg

SEQ ID NO: 117111 - DNA, 1003 bp, Heterodera glycines
  Promoter: Source sequence=SeqID_24537; Location=1463..2465; Strand=-; Gene=SeqID_55264
accctaaattaatcaggtgaatagtgggattagtttcaacttgtttccatgcccaccaattgacattaaatgtatcgtaaatggaaataaggggcaaacaaaaagctcattcatcattggcactgttaaatttcaaaacaaaatctaaagttccaaatgaatgccacaacgaacaatacggtattcatcaattttattgggataatttcaacaaagttcgtagttgaaagtgtaaaatcaaaatcacaatttttacgttattttatttttgggcttgagataatttctttaaaaggcttaatttttaatgactctgatgggtggaggcgccgtgaaaatttttatgaaaaagtaaaacaaaagtttacgagtcttttatttttcaaattcagaacaaatcaatgtatgaaaatttagcttttgaacctaatttattaaaagccaaaatttgatgtttttttttgctttggttttcgcaaaaattttgcagagcgacaaatttctgggaagaagggggtcggtcaacagtgctagcagacgccaccgagaaaattttatgaagatttagaaatttttaagtattaaaattgaattcttaatcccttaaataattttttttttactcacttttgttcaattcttaaatggacgatttaaagaattttttttattaaaagatattttttattgaaaaatattttgcagcaaaatttagacaataagataaaatttcgacatgaagcaaatagattgataaagtcacacattaaaataaaagctaaataaataaaaaaaattgtcaacgattttcggtttcttttaaaattcacgtgaaagcttataaaaaaatccaccaatttccgcaaaaagattttttgtatgttttagtctaataaaaaccacgtctattaaggaaataaaaaggggggtatttaaacgggcagaaaaacaacaaaataccaaattattcattattaaataaaacaaaatattttttgctatg

SEQ ID NO: 117112 - DNA, 70 bp, Heterodera glycines
  Promoter: Source sequence=SeqID_16785; Location=1..70; Strand=+; Gene= SeqID_81201
catttatgcagctttgaatggagcagcatttttctcgaatctcgacctgagagatgcgtacctccaaatg

SEQ ID NO: 117113 - DNA, 69 bp, Heterodera glycines
  Promoter: Source sequence=SeqID_30551; Location=1..69; Strand=+; Gene= SeqID_60966
tgaaatattgaatttaaaaaatatatattttaaggacatggctcaaacgagccgagtgttggagttatg

SEQ ID NO: 117114 - DNA, 592 bp, Heterodera glycines
  Promoter: Source sequence=SeqID_11334; Location=3127..3718; Strand=-; Gene=SeqID_46950
ttggccatcactgccccccgggggtaaataatcgctttgcatttcatcctttgtcaaatctggaatggaatgggagaaaataaagggtccattacatttccacaagcaccgtttctcccccccccgtattatttcccccgggaattttttcaaaagctaaaaattcatcataagattttaagaaaatcgcttaaaaaatttctttacaaatttctagatttgaaaaaaaaaatttttcggccgtggagttggaaacgaactgctcccgaaaacaaatcccaaatataaaatgagacttaccctagctttattctcaattcccgattttcgctgtgataatggagttaattagtactctaatgaattcttgaataattagcgtcattaatgagtggttattattctggcaatgatgaatgtgaggaggatgagcgggatgttggtcattcaagaaaaaaatgtatcaaaagcagcagcaacggaaatggcggcggcgccgcatttggcaactcatcaaatttatggtttctgagccacattcgaattgcaaaatcggaattagagtcagcaaatggcacccaaaaataaaatg

SEQ ID NO: 117115 - DNA, 348 bp, Heterodera glycines
  Promoter: Source sequence=SeqID_43806; Location=1..348; Strand=+; Gene=SeqID_71391
acatatatcatcattttgacaaaaattgcctaaggacaaaacgccaaaaaaccccactaatttaaaaattttgccgagattttcccttgtaaaaatggaagagccgatctcgagatagaaaagaaactttcagaaaacaaaagagaattcgatagagagggccaaaaaactagcctaggtaaaatttcaagaaaagttacccacaggaaaaaattttttcccatggcaacaaatttacaaaatcacctactttttaaggcaaaaaatggtacttacacgtaaaaaaattgataaattaaaaagaatgagtgattgtgggaatgaagcaaagcgaaagcgcaaggaatg

SEQ ID NO: 117116 - DNA, 101 bp, Heterodera glycines
  Promoter: Source sequence=SeqID_39902; Location=1..101; Strand=+; Gene=SeqID_68362
tggcactatctgatgacagccgcgggttgatgctcgagtgtcacaacaattaccgctctcagctggccaaaggcactgcggcaaatttgaccggcacaatg

SEQ ID NO: 117117 - DNA, 108 bp, Heterodera glycines
  Promoter: Source sequence=SeqID_24559; Location=1..108; Strand=+; Gene=SeqID_55283
ctgctattatgtggtgaccagcgcacaaatgaacgtgccgtgttcaccggtgacacgctgttcatcggcggttgtggtcgcttttttgagggcaccgccgagcaaatg

SEQ ID NO: 117118 - DNA, 982 bp, Heterodera glycines
  Promoter: Source sequence=SeqID_17052; Location=1..982; Strand=+; Gene=SeqID_81478
tttatgataaaagaaataaaaagcacataaaattattattctgtataataaaaaaattaaagctaaaataatataaaattttttgactatttggcataaggcaaaaattgaaaaaccccgacctcgaaccccgacgcttcaaccccgaacgtgaattttccaaccccgacgtcggggttgcaaccctagtctaaatgaaaaaaaaagttttgggccatttgtaaatccaaaaatttttcaaaaaaattctcagaatttttctcaattgaaaaatgtagcagcctatcctccttcgatttgcttaaattaaaaaatcatttgtcattttattttatatatttaatttttttggatttaggatatccatttggctatcggtttttattaatcatcacagtgagcacttttgcttacctcacaatgtttggtttagcatttcttattaaaaaattcatggacattaaatcgaaaaagtaaaaaataatttattttttatttctatttttaataataataattttggtttattgtttaagcattgtttctcctcctctcaaatcaacaaaaggatgattgaaatgaataagcaagtttctcgaaatctcatcattcaggtgttaaagaatcaaccagcgtttagaataattaattttttatgttctttttaaaatacgccaaattgcgttttttcttctacaataataaagaattatttattcatttcgtgctgattttgagccacttcaaatctcataaacctggtctggatttaagaaagcgttgagaaaaaaaaataattaaatttcattcatgaaatattgtttttagtaatttttcaaagataaaaaagaggcttttagagttaccgtatgactccaagaatgtaaaatttggtttttcttacttatgcgcaaagttagacaaaattttgtcgggaaaatgccttcggtaccaaaaatgtctttaaatttaggcttcaatg

SEQ ID NO: 117119 - DNA, 577 bp, Heterodera glycines
  Promoter: Source sequence=SeqID_1534; Location=940..1516; Strand=+; Gene=SeqID_74309
aataaattaataacaatatttaaaatataaaatttcaaatatataaattcgatcagagctttgccattttaaatctttttttagagaaaaatatttttaaaattttcgtaattaaataaataaaaaatttataaatttatttaaataaacgcaaatgagataatttaggtttatatttatatttttttaaattttctttcaaaatctttctaaaaatcggttcaaattctaatttttttttggaatctatgaatcaaaaatttttcaaaaataacaaatgtacttttggaaatttcaaaaataaattaataaatgactaaataaaagtgccataaatttgtgccatttttattttgcatggattgtttagacttttttggcttcatctgaacgcggcggtttcccatcacacaataatattgtgaacaacaacaataacaacagttcttctgcaacaccacaaaatgcaccacaacaaatccgtagccaagtgcttccgccaccattcccagtcaattttgaataattaattaattagttttttaatttattcattatttatttagcctcagtcatg

SEQ ID NO: 117120 - DNA, 308 bp, Heterodera glycines
  Promoter: Source sequence=SeqID_42119; Location=1..308; Strand=+; Gene=SeqID_70085
atgaaattttcatgctaaatttatttcatcaaaggaaacattgccgtaaaattttcaactacaccaattaaaatgtgattcttcaatttataaataaaattactactactgtataccaactttaatttttttaatttcaccaactcagctacagtatactttccaccggtgtcaccaattttgaattcgtaatatgacatgaaaattttgccagcatttttaggtatatcagtccacgagcattgaaattgccaaagagatcgacagtatcaccaccgtaacaaacaaacagtacattcataaccatg

SEQ ID NO: 117121 - DNA, 1003 bp, Heterodera glycines
  Promoter: Source sequence=SeqID_1248; Location=3628..4630; Strand=+; Gene=SeqID_70715
tatttcgtactttaagccaaatattataatataacatatttttaaaattttattgtatttattattcttttttatgaaattgattgtagttatattttattattaaaacaagaaatatccaaaggtatttatttatttatctttaaaataaaaatctaccgtttaaatgcgtacagtaataaattattgaaaaacacagatggaaaaaagtgcaatttaagggaatttagaaaaaaggtgaaaaatcaattgtcatataagcgcaaatttttttctcgttagaaatatccattaatttccgctcattttggtgacaataatataaattgcaaaatatcttaaaaagctgataatgtgaaaatcttagttcactgcagaagatcaataatgcatgtaaaattaaatctactaaaaaatataatataccattatattatcgtagatcataaaaacaaaaataaataaattatatcagataatcaatagaaaataacagtgagatgtaaattgacaaataaatgttaattttagaatgaaaaataaataatttaagtttttcttaattgaaaacgtttattaattccttaaagtacttaaaagtagagatcatactggtcggtattttattcgttttttcattcagaaaaaatagtatttatttatatataatttttttattactttggctaatgttttttttgagttttaaattaaattttagatgagtttttgaaatttatttcgtatatgtaattatttcttcccgcctcttccctcattggtagcaccggatggttctgttgtctgcccattcagataattaatgcagtgttttaatttcttattctcaaaaaattagctgcgataataagatctcttgtgccttatatttaaaatttaatagtcataaactttctagaaacaataatttattataaattttaatttttattacatttatccacaatgtataaaataatttttatagcctttaagattaatg

SEQ ID NO: 117122 - DNA, 75 bp, Heterodera glycines
  Promoter: Source sequence=SeqID_28546; Location=1292..1366; Strand=-; Gene=SeqID_59151
actattaagcattgtcccaactaattaacaattccctccccctggcgcttcaggtagaaaacttagcaaaaaatg

SEQ ID NO: 117123 - DNA, 209 bp, Heterodera glycines
  Promoter: Source sequence=SeqID_4404; Location=975..1183; Strand=+; Gene=SeqID_54331
actcatttcgatccagaattgccgatcgtagtcgctgccgacgcttcgaaagatgaattggcgcgacgataagccacatctttccggacaagagtgagcgcgtcattgaacacgcctcttgtaccttcaacgcggcacaacaaaactacagccaaatcgaaaaggaggcacttggcttggtcttcgcagttcaaaaatttcaccggatg

SEQ ID NO: 117124 - DNA, 492 bp, Heterodera glycines
  Promoter: Source sequence=SeqID_730; Location=580..1071; Strand=-; Gene=SeqID_60012
tttttgggggggggggggtgcaaagttcgaatccggacggtgtaacattatttttctgtgcatttttgggttattttgactgtttttaattaatttgaagatttcttttaaattatttaaatttattttttttaacttaaagaatttcatttttttttttgaatttgtaaaaaaaataatttaatttcaaattaaataaatattcaattaataatttccaacgttgtttttaattaataactaccatttttttcgtgttttcattgttttattcatttaaaatattttttattttattaataataaattacatttttttatttgaattaaatttttataaaattcgagaaattagttcctttcaatttcaataaatattctatattataaatttctaactttatttttaataagtaaaaggattttttaatttgataaatttataatacatccaataatacaattttcttatttatttcattttaatccatg

SEQ ID NO: 117125 - DNA, 500 bp, Heterodera glycines
  Promoter: Source sequence=SeqID_7463; Location=1..500; Strand=+; Gene= SeqID_64900
catttttttcttacatattttaaggattttttactgtttgggaaattctcaaaaaaatccaaaattttggttattgcttatttttcatttttctttatttttgaaatttatagaatggctcgtgaaaaaataaaaattaaccaaaaatcaagttttcaaatacttatctggttctacgcctatttagctaattttatggcattttagcaaaatttgcaattttgagccatttttaattaaacgattttgcacataaaaactttgttaaataaattgaaaattaaaatttttgaattaaaatattcctgttttttgtgttcccatttttacagtagccacaaattgagcacgacatgagaaaatgacaaaaccgatgacaatgattcaattttcatccatgcacaagagggacggacatgaaatgaattcatcgtaaataataaatattaaaattaaattataatattttatgaatttaaaataaaattatagccaaaatg

SEQ ID NO: 117126 - DNA, 1003 bp, Heterodera glycines
  Promoter: Source sequence=SeqID_25545; Location=242..1244; Strand=+; Gene=SeqID_56289
caaatttataaaatcgaagcaaataataaaaagaaaagtcggaggcgatgatgagaaacaaaattatcaaaaccaaaattcacaaaaaaaacaaccagtcccacggacagacaaaatttagaaaagatcaaaaataattaaacagaacgtcaaaattataattatttaaattaataatgaggtcacttatcacaccattttaaacagattttcactgaaaattggccatttttaagtcaattttgcgctttgaaaatcatcatttcaaaaagaacaacaatcatcattgaccctgtgaaaccaccaaaatgatgataaatcattacatctggcagcactgatttaaagcctgatggataaagatttttcactataacactgccaaattaaagtgatcactctcaattgccaattcaataattaactatattcggccccataaaaggctctcttgacagtgtgaagcaataattcccgcatttattcactcttaattaccccctccaattccttcaaatttccttcaaactgttggtataattcgaaagcttaatgtgtttagaagctttttctaagctattgcttcgcgattagacaattaccaaaactgtctgcggcgcaaatgacgcggcgcaagtgtcgactttgcggatcggcgcaaatgtacgttttattcaggttcagttccttgtcatagcagtctttttagaataatttttaagatttttgttgaaaaatgccattttatcataatcaaagctcaaatttttttaaatgaaccaaatggccgccctcactttatttattttgtatgtttccctcgtctcccttattattgcattttttgttaaggaatttcagaaatcctgaacatatacgccgccataaatggcgaaatgggcaaacataggcattataaaagtcatcgtagacacctaaaaccaagctgaagtatttgtgtttgcgtaaaaataggggaaaatttatgaatattaaaaatatg

SEQ ID NO: 117127 - DNA, 529 bp, Heterodera glycines
  misc_feature (25)..(25): n is a, c, g, or t
  Promoter: Source sequence=SeqID_31272; Location=1..529; Strand=+; Gene=SeqID_61642
tttttaacaatgttatttcattaancaggggaaagttttcacaccaggaatttgtatggcaccgggaagttttggcactatcttaaggatttaaaaataaaaatatttaattatctaaaaatgcaaccatctaatttggggtcttggtattttcgggtacaaataagacgggtattcgggcctaaacccaaacagaaactggtacacgtctaaccctacatttagagtgtaagaattgactaaataagattgccaagttcgcaatttaattttttttttaaatccaagaagatataatttttaagcccagggattatttgaggatgaaatcattaatttagtattttttttagtttttcaaattaatatcagtgcccaaacttcatgttgacaattttatttaatcatttcattctcctgtgtttttacagttccttctgatgtgttgtcaaaagatgaagtgattgccgtttatcagttccatacccttccaaatcgtcgtgggatattcaacggatttttcccaatg

SEQ ID NO: 117128 - DNA, 52 bp, Heterodera glycines
  Promoter: Source sequence=SeqID_8934; Location=1..52; Strand=+; Gene =SeqID_69706
aacattttcttccattttatgtttcttatttggtctccgttttttaagtatg

SEQ ID NO: 117129 - DNA, 284 bp, Heterodera glycines
  Promoter: Source sequence=SeqID_13191; Location=757..1040; Strand=-; Gene=SeqID_77014
ttcttattcacaattgatcatttgatttcagctgctcaaacgaattattaattctctaattaaggctttaattcgttgtttaaacctattaatgcatttgttttaatgtcaccataattttctttcaaaaagaataagttttatttgatatacttttccaatcgtttatgcatcgatttggtcaaatataatttattcaaaattccaaattttttgcccagcaaatcccatcgccaccgccgaaattacagcctaaaaacccattcttttagttgcttaaaatg

SEQ ID NO: 117130 - DNA, 440 bp, Heterodera glycines
  Promoter: Source sequence=SeqID_19271; Location=1..440; Strand=+; Gene=SeqID_84013
gacgtataaaataattttttgaattaatgaaaatatgaacagatttcctgagtagttgccttaagttcaatatttgaaatatttcatattttttttgcattggacttcaaaattaaagtgacctaccaccgttaggggcctattcgtaaaactcttattttaaaaatacttgaaaaaaatcaatgaaattttcaaaaaacgctaaaattcagaaatgagaaattccatttttctgctcatttagctgtttagtatttctcaaacaaattatcttcataatgcaaacgcagtgacagtgtatttcccggaatacatttttgagagaacagcgacgaaagtagagaagggcaaacttaaaggaaaactttatttggaatttgagagtaatttttttaaccaaaacgcggatgatcaaaaaacatatttctcttttaaaaatg

SEQ ID NO: 117131 - DNA, 169 bp, Heterodera glycines
  Promoter: Source sequence=SeqID_1848; Location=5927..6095; Strand=-; Gene=SeqID_76347
gctaagggcgggcgcttttggtttaaaaattcaccggatggtatatgaatattttatgacatctaaattgaaaaaaaacttgttaatttggaaaaaatttgggccagtgttgtttaataaattctcattatatttaaatcttttcagcagttggcggcaaacaacaatg

SEQ ID NO: 117132 - DNA, 281 bp, Heterodera glycines
  Promoter: Source sequence=SeqID_13845; Location=2186..2466; Strand=-; Gene=SeqID_77785
gaaacttaaaaaatgaatgaatatatgtaaaaaaaataataaacaagtgtttatcattttaaatattatctatcatcaacgaatttttcttcaaaaaattacatttattcggttcataaattgctaaatcattatttatttatgtgacataaaatgagtatgtaattgaaattgcttattacataatattatttttataagatttactcactttataacatttaaatttaattattttcattataactgatacttttttaggttcgtctcagcacggaatg

SEQ ID NO: 117133 - DNA, 853 bp, Heterodera glycines
  Promoter: Source sequence=SeqID_24706; Location=1..853; Strand=+; Gene=SeqID_55454
agtcggcgatcagcagaagaagaaacgaaatgaaagactgatcaagcaaaggaagagcataccgtaaagagaggaagagcatactgtaaagaaaggaagaaatactgtaaagagaggaagagatactgtaaagaaaggaagacatactgtaaagagaggaagagcatactggaaagaaaggaagacatactgtaaagagaggaagacatactgtaaagagaggaagagcatactgtaaagataggaagagatactgtagcgagaggaagagatagtgtagaggaacgagaaaaatgtaaatgcggaacatttaaaaatatgacatcaaaaaatatttattgaccgaagaaaagttccgattcaatggaaatcacaaatttaatggtcaaagaattaaaaagttcggtgaaaggggtaattaatcagtaattattaaattattattttcaacaacgcttttcttcagctgctccaccaaaagttggcctttttcgcaactttcgtcccacctttaaaagagggaaaagcattttgaaaggctttttcagcgtggtttcaatttgctcgctttttgcgtccttttaataaaattgagcaccatttactccacggggccggcaaattgacggacggacgccgacggagacgcaaaagacggcacacttggcaaatgccgaacagccgttccgcggacggatcggtgaaagagttcaaaggcacgacgacgaaattggcacgccagcgaaaataggcactaagagagaaaaaggagaacgaaattggccatttgaaaggcatcgaacaaatatttatcggtgtttttcatcagtgaggacaaatggtgggccaaatg

SEQ ID NO: 117134 - DNA, 929 bp, Heterodera glycines
  Promoter: Source sequence=SeqID_25477; Location=514..1442; Strand=+; Gene=SeqID_56211
ggaactttatacaaattttaaaaaagtaatattttgtatatgcatttaatcaaatttctactttctttataaatgttagctaattagtcagcgtctatttattttctgtaaaaatttgcctctttatttaaaattaaattatatataatttcatgaaataagacactaaatgtatagagaatgaattaacgtgggcgattggaataaatggacaaaaaagcaaagtcaaagacaaaaccttaaagcactagccgattgaaataaatggacaaaaaagcaaagtcaaagacaaaaccttaaagcactagccgattgaaataaatggacaaaaaagcaaagtcaaagacaaaactttaaagcactagccgattgaaataaatggaaaaaaagcaaagtcaaagacaaaactttaaagcactagccgattggaataaatggaaaaaaagcagtcaaagacaaaactttaaagcactagccgattgaaataaatggacaaaaaagcaaattcaaagacaaaactttaaagcactagccgattgaaataaatggacaaaaaagcaaattcaaagacaaaaccttaaagcactagtcgattggaataaatggaaaaaaagcaaagtcaaagacaaaaccttaaagcactagtcgattggaataaatggaaaaaaagcaaagtcaagaacttatcctacctaatttcatggtgactgacgaggcatttgactcccttaagagagccttcccttctcatgtacttgtacctaaaatgttgttggcacaaaaagtaaagggggaaaaagaagacaaatcatccgatcaagggctaagtctcaacagatcgcagtgtaaaagctgctctactgctaacaaccccctgaccagtagtcaagtcgtatacaagtgattttgcgccccgacgttccaccatg

SEQ ID NO: 117135 - DNA, 595 bp, Heterodera glycines
  Promoter: Source sequence=SeqID_15559; Location=2440..3034; Strand=-; Gene=SeqID_79842
cattaaaatatgcaaaaatgtccataggcttgaaaatatggcagaaagaagaccgaaaaaatgaatgagagggaggggggaccaagtaccccttttatacttgtccttaacatatattcttggccaaacaaaaaaaagattaggaaattactatcataaagaaaatatttaccgatatttcttgatggttatgtttaattaatcagtaaatgatggctatgtatataccagaaatgaaaaggaaaattgtgttgtctgcttacggttgcgttaatccctaaaaatgggtgaaacgaaaaatatttaatccaaaaatgagtgaacaaagttgttaatccctaaaatgggcgaaatgcaaaattattcatccgtaaaacggctgaaatgcaacaaaagtggccgaggtaatagataataagttgcttataggttgctaatccctcaaaaacagctgaaaatgcaaaaaacctgctttattataattttgggcctgaataattgttgtcggtgccaaaaaaagactggaataagggggagaggtaggggggagtgcttatataaagcgtgcctattccaatagcgcatccaacaaatg

SEQ ID NO: 117136 - DNA, 215 bp, Heterodera glycines
  misc_feature (41)..(41): n is a, c, g, or t
  misc_feature (65)..(65): n is a, c, g, or t
  Promoter: Source sequence=SeqID_19738; Location=1..215; Strand=+; Gene=SeqID_84481
tcattaaagtctgacaattacgaaaagtttcgggcactttntaatttcgtaattttatttgacantaattaagaattttgttgtatatcgtaacaaatataggaattcaatgtttttgctaatttgagaaatttaaattgtaggcactgcgttgggctgacgaacggtgccgtcaaaatggcatcgaatgttcgggggaaaatcgtcggaaaatg

SEQ ID NO: 117137 - DNA, 82 bp, Heterodera glycines
  Promoter: Source sequence=SeqID_113; Location=8550..8631; Strand=+; Gene=SeqID_71402
ttaaaaaaagttgtttttcttaaatctaaacatttatatatattctggttcaatttttattgtctaaatggaccaaatcatg

SEQ ID NO: 117138 - DNA, 375 bp, Heterodera glycines
  Promoter: Source sequence=SeqID_18611; Location=647..1021; Strand=-; Gene=SeqID_83263
cctaaaatagtatcaatgtgggcgttcctaaaatagtatcaatgtgggcgatcctaaaaaagtatcaatgtgggcgatcctaaaatagtatcaatggggcgttcctaaaatagtatcaatggggcgttcctaaaaaagtatcaatgtgggcgatcctaaaataatatcaatgataataattaattaaaataattattattcaatgaaacaaatattttgcaagtaataaaaattgttttctacataaaatattattacgtcggaaacgataatcaatgtatgtcaatatttttttgccatataataacaaatttttaatttaaaaatatatttcccttcagtgttaaattcattctttagattgactaaaaaatg

SEQ ID NO: 117139 - DNA, 104 bp, Heterodera glycines
  Promoter: Source sequence=SeqID_29685; Location=1389..1492; Strand=-; Gene=SeqID_60156
tgtaagaaaaaaagagctaaacttaagcaatattctatgggtaaatttaggacgctcgatcagtgcgtgatcaagagcaaattaagcaacgctacagaaacatg

SEQ ID NO: 117140 - DNA, 392 bp, Heterodera glycines
  Promoter: Source sequence=SeqID_37531; Location=1..392; Strand=+; Gene=SeqID_66578
aaattttgaaaatttgattaaaatttgttgacagattttcaccaaaaaatcatcaaattttgtgatttttgtatcatttttctaatgagaaataagagttttggcgcgccgctgagaacagtttttcatcaaattaccaaattttgcgattttgggccattttctaagaaaaataggagttttgggggcgcggcggtgtcgataggcgccgccggggaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatgcgaaaagcgaaatgcgaaacgccaaaaaatg

SEQ ID NO: 117141 - DNA, 454 bp, Heterodera glycines
  Promoter: Source sequence=SeqID_16411; Location=1070..1523; Strand=-; Gene=SeqID_80815
aaaattaaaaaattaaaatttagcaaaaaatgataaaaattattgcaatttatccacaaacctccaaacatttaatgcactgaattctcaaagaattggtgagcattgaaacgaataatttggataaatattgcattaaaattataaaatataaattatttagccaaaggaaaaaggctaaaaattgttcaatcattggaaaataagcgaccaaatttgacgcataaaactcactttgattacatgaatcagttgaagattatgctggcaaacaaatcggaaattgaaaaagtgcgaaacgcaacaattgctgccctcgggggagaatttgaaaaggaaaaagtatcgtaaaacaaaaataataataaattaaaaaactgattaaattccacaggaaaatgatgcttattcaatttgtgcattaaatgaagcattaggaaaagccaaagaaatg

SEQ ID NO: 117142 - DNA, 57 bp, Heterodera glycines
  Promoter: Source sequence=SeqID_14088; Location=1..57; Strand=+; Gene= SeqID_78063
tgtgtaaagccacgctttcttgtggagcagggcgaattccaactgagctcagcaatg

SEQ ID NO: 117143 - DNA, 67 bp, Heterodera glycines
  misc_feature (9)..(11): n is a, c, g, or t
  misc_feature (31)..(32): n is a, c, g, or t
  misc_feature (61)..(61): n is a, c, g, or t
  Promoter: Source sequence=SeqID_23966; Location=1..67; Strand=+; Gene= SeqID_54665
acattttgnnntataaattcagaaatcttgnnttaatgattaataaatgtgattacatatntaaatg

SEQ ID NO: 117144 - DNA, 384 bp, Heterodera glycines
  Promoter: Source sequence=SeqID_8194; Location=1323..1706; Strand=-; Gene=SeqID_67271
attttgggaattgagaatttttattcaaaaataatttcattcatgcctgaggcactctactaaaggaatttccaggctcagcactaaaacttttttttaatgaaatttgttaattctatcaaattggaaaattttttccgcgtttcaaaaacatttagtgaactggggagatacggcggtgccgatttgtaccgccgggaaaatctttttaacttttgatccttctcaaaacctgttccaattttaagataaaaaataagataattaatttaaacgttatttttatgagataatcttatacgaatcgtgtggggatgtgctaaagaggctaatgaaactgaatgttctgcaattagtgcccaagttcgaaagaataccagcatg

SEQ ID NO: 117145 - DNA, 904 bp, Heterodera glycines
  Promoter: Source sequence=SeqID_5683; Location=1..904; Strand=+; Gene= SeqID_58897
aaataaaatctcgaattctcaaaaagcaaacatttaaaatgaatttttttgtcagaaaaacgaaaaattctttaatttttgttttttaaataaacttcagaaatatcaaaaatatatttcaataatgagaaaaaaaaatttattttctagcgaaaaaaattctgattggaaatttgcaaagttttcggtgcacgaattggccaatttactcgcttaacccaaggaaagggaaatgcgcaaatggatactgtatttttaattggtacagtagggccgtaaaattgtttatcggcccaactttgcacttttcgtaaacattcacgcggaaaaacatggactaatgaagcatttaatgattagggttataagttgtgaaatgaagcatttaatgattagggttattagttgtgaaatgaagcatataatgacggttattagttgtgaaatgaagcatttaatgacggttataagttttatactttttttttctttgcatttaaaaagtgattttttgtgtttaaattatttggtttggttaaagtttttgtccgtataaatccattagagctcgacattttgaaaaaagcctggacctggatttcatgaacaaaaacccagaatatttattattattattattattgtttttaaatatatttaatctttttgataacttgccataaaaggggtactcaaaaaaacaaattggaaaatattatccaggaaacccagagttggacttgctttttctggataaaaacccagaaaaatccaggcccaggacaaacccagtttgccgaaaaatagcctggcctggaactaagcctaatacaccgcctaagaattgaattttttgaatttttaaaaatacaaaaataattcgctttcaaggaagtaaaaaatg

SEQ ID NO: 117146 - DNA, 1003 bp, Heterodera glycines
  Promoter: Source sequence=SeqID_8817; Location=206..1208; Strand=+; Gene=SeqID_69307
gggtaatttggggcgctgatcacgaatatgacatttatttttcaaaattccgaatcccgaattcgaacaaaaactcgaaattgattaatcacaaggaaaacatttttctaggggttttcaaggactgacctctaccgtaccacggcattcaatttaaaattgaatcattaggaattattagaattcttttttggcgcaaattttggcatattgtaagagcaaattacgcacaaaattttttaaatttgattctttcaattcttttctatgcctcttgtcatagataagtagcgatgtgaagcattaagcagtagtgatgaagtggtcatttaaatttttgaggggacacgtaaaactgaaataaagcagatttcccgctgcccctacgaatcaagcccgtacccaaaaaaaagtcaggatttttatgtgtaatttttcaaaaattttcagcaccggagccaaaaagcaggcatttatagcggttttatacaaaaaatgacaactttttggcattttggcgtcaaatctatccccctccccccctggggatacgaatataaacaacgattaaaacccgagaccgtaattaccaatatataattttataatgtgttttagaaagatgtcttttgtccaaagtccagaagctaacgttccggtatgccatttttgagagtctaatggaagtgaaggtttttgggtgtgcagaagttcgttaactcatgcaaaaatatgcataaatttcattaactttgagtttagaattttaaaatgtttcaaaaagggacattctgcattcttaaaaacttttactttacaatttgtgtaaaattccaaacgtttttgtttggattcacaagggaaatcaatgggtggggctgtgggaatggacggattcgtgggttttccgcggtgggcgttgcgtctgtgtcccttccataggacgggcagtaaattcattcttcgtccattcacttaccattacaacaaaactttgattatg

SEQ ID NO: 117147 - DNA, 1003 bp, Heterodera glycines
  Promoter: Source sequence=SeqID_20578; Location=681..1683; Strand=-; Gene=SeqID_51133
ttatttttttttgaaagatctaatgaagatcaatttcactaattgatcgcatttttggcaattcttctcaaattggaaccactgcttttaaaatttggaaaaaagaaaaaaaatcgtaaatttttcattatgcaaaccgtgacattgttatgaatagtgcttaaattttttggctttaaaaaccgccaaaataggcactaaaaaccccaaatttaggggggtgtaaaatggcaaatctatcaaataagctaaaaaaaaattaggcctaataaatatttagaaaaataatttttaaaatcaaaaattcctgtcaaaaaataaaataaaaaactttggaaacgaatttttaagaattttcagaaatttttgagcttcttagtggtgtatttttcttttttattgcatttttcttaataattttggtcaaaacgccaaaataggcagaaatatgatttttcaaaattttttacttttttagctcttaataaaaacctaaatagaaaataggccctgataactcgaaaagtaccttttttatttcaaattttattattcataggtccaattcgatttatcatgatgaaaaaaggagcaaaatgaatgattattatgaaatgaataagtaaatccttctttaaatgacaaaaaaattgccggattattgaaaattggaattaccactttaaaaatatgggaaaaagaaaataattcttaaatttttcgtttttcttatttgtgtattgctgttcaactgctgacttttttctaaattttttagtataatttaattttattcgctattttatttgtttcatgtgaaattatgatgaaattcataactttcagttatttaatcttatttactattgatcgcattttttgtcaatgcttctccacaaaaaaattttttctgatgtaattaaatttattttaatacaaatatatttaataaaaaatattcaaaaattattaattaattatttattatatttttttagtgatg

SEQ ID NO: 117148 - DNA, 127 bp, Heterodera glycines
  Promoter: Source sequence=SeqID_34244; Location=398..524; Strand=-; Gene=SeqID_64082
ttttgacatattttctgataatgataaattttattggccaggctcaatttcttatctttgtattcctttagacctgtcaaccccaactccgtcaaacatccacaaattaaccctaagtgaactaatg

SEQ ID NO: 117149 - DNA, 704 bp, Heterodera glycines
  Promoter: Source sequence=SeqID_26057; Location=733..1436; Strand=+; Gene=SeqID_56804
agcgcttttttttgatttattttcaattttattaccttcacaactgagcacattgtaatatttaaaggtgcaaactccgccacaaacggtacatattctgttttttgttgcttttattgtgttcaacaacattttcttcttgaaacatcgttggaatttaatggaatagaaatattaatagagaaaataaaaataaaaaattgcaaaaattaaataatttatgtatgcattacctaactaattggattaagtaaatgaaaaagaattcagtgaaaagaaaaatttatacataaaatggtttctttgattattttttccaaattgggagtttatggtgacccattactcgtcacttttcatttcgtcaccgagaaatttactgtgtttaatgaaaatttttcttacccaaaatttgtagacttaataataattattagagtaaatccgattttttaaattttctgaaagcaaatgttttataataaaaagcatcaaataaattattttttcaaaaataaccaaataataaaatatataaaaatcaacataattacccaaacaaaaaaaaaaaaaagaagaaatttttgaactttccaaatctaataagcatgtgcgcaaacaaatgtgaagcctaaatagatttaatggccaacactgaaaaaatgaaaaagccacgaaaatagagaagaaaaaaaggccaaatg

SEQ ID NO: 117150 - DNA, 230 bp, Heterodera glycines
  Promoter: Source sequence=SeqID_3012; Location=1..230; Strand=+; Gene= SeqID_82766
ttgaacagccaaaatttcagcttggaaccaaaaagaatgtcacaataattgacgtgttggacagtctttgcccaatttgggcattcttttttgattatgattacggcaaaaaatatggaaacaacttggaagctttattcaaagtttcagtgaagccaatgtttatagacaacgaaccgatttggcacaaaattatgaatgtttttcaaaaaattaaaaaatacaacatg

SEQ ID NO: 117151 - DNA, 826 bp, Heterodera glycines
  Promoter: Source sequence=SeqID_10799; Location=1..826; Strand=+; Gene=SeqID_74060
gaaaattattagatacaattttgttatcatttcattttgaaaaagggaatttaggaaaaaatttataagctaacataataatttttttgctaatttcaggcagagcgaccagttgttgttacgttgtgctcgacgtggcgtggccttgtttttttttaattttttttttttgccttatgagttgaaaccgacggtactttcctttttgtcacaccccctgctgaaatattttttaaaacaatttccctatggtaattttcagcgctatacacgaagataactggtccaaatgttcacgtaactcacgccgacgttttggcgccaaaactataataaaaaaaagaaaacacccaaatttaaaaattttgtaaaacaacaaaaaaaacgtatttttcgcgaaggtaatactgccgatggttggttgcccccttttttgaagaaaatttttttgttttcaaaagtcatgaaaacatgcttccaatggttttcagggtcgctgctcacgaaccaggcatccatttcgaccaattcggaacccggagccgaaattcgaacaaaaaatcgaaaataaaaaatttcaaaattctctttttgtttctaaaatagattaaaacaaccaaaacgttttggcgccgacgatttggcgccatgtagggaggaggtagaaatgatgaaatcgttataatttttctgacgaagtctatcaaagagccggattaattcttcatttactctttttcgctttggcttatgttatcttaattttgtatttaggtaatgaatcgtcaaattgatacgaaaaaacaaaagcctaaaataacgcatg

SEQ ID NO: 117152 - DNA, 514 bp, Heterodera glycines
  Promoter: Source sequence=SeqID_22962; Location=432..945; Strand=+; Gene=SeqID_45744
tggccgtacctttgtcggcgctggcacgaccggtgggcgttttctcctgactctccggcaagccaatcaccacgagtgaatgttggcgcctgtcttcctccacagcatcagctgctgcacactgttgttggagaagtgtggtcgtcgaaccgagcagagctgtgagttgtctgatgaacagctttgcatatgccggaatggcgttgtcggcttcgatttcgggaggaatttccagatttgagacgtcgtgaagaagttttttggcggtgactgctgcgataggcgaaaaatgggtcgatggctgcttgcgatatgtgtcgtttgtttgaagtgctccccaacatttttttgtataaatacggccacttttttgactttgccatcattccaattctcatcgtttttttgcattcttcactccctatttttttattccgactattaaaaaataacttcttttatttttagctgtcttttgtttgtcacatacaaattccgtctccgtccaaaaatg

SEQ ID NO: 117153 - DNA, 1003 bp, Heterodera glycines
  Promoter: Source sequence=SeqID_1692; Location=1985..2987; Strand=-; Gene=SeqID_75338
attcagcaattgtataaaaagttataaaaaaaaagtaatagaaattaaaaaaaggttcgacagcgaattgagcaggcaaaggagactgccaaaaacacaaattttgctcctcgcgaaataatcggagaaacgcgggaaaatttggacgaatcagctcttttaaggatgccgacgtacagttcgattcaaaaaacaattcagcgccaaagagtaatcccgggcgctgcaggggttgatcgaagtggaatagaaaatataatccttgaagtacattcgagagtagggggctgacattttagagcgacaggaaatttgatgcctttccgttccgttttttagttattgccattctggttcatttttcttgtatttttatggaatttttagccttttggtagcctatttcgaaaaattttttgccgaaactgccagccctctgagtattcattaagatttaaaattaattttttttaaagggggaatttacgttggacaaaaatggcaacagatttttactatttgattcgcgcattactgaaccggaattagctaaattttttattttttctacagaaaatggattatcaaggttgaaaaaatacaaaaattggtctggtgatgggacatttaaaggtttaaatgatcttaaatttttatctattaaaatatttaagtttgtccggctaatttcttactgttgtatactgtaaatgtgctgattgggcatgtttctgtaccgtcagcatatattttaatggaaaatcgtaattccaacacgtatggacgggctttcactgttttacgcaaccatttggacaattcaataccgttatcctttttaatggattttgaagaaagttataaaaataatttagtaaatttaaaataatttttatgaaaggtgcaaaaaatgggttccaaacagcatttggtcaagaaatgcctataaaacattgcttattccatctttgtcaagcggtgcaccgtaaaattcaaaaagatg

SEQ ID NO: 117154 - DNA, 159 bp, Heterodera glycines
  Promoter: Source sequence=SeqID_43086; Location=840..998; Strand=-; Gene=SeqID_70849
agtaaatgtgagaccctaaatcaatgagagagagttggatagagataaacaactcagtgtatgtgggcgggcatcttgtcaaacccaagacaggagccaacaccaaaagcttctctttactccatccacccaactctctcgagcagtagatactcaatg

SEQ ID NO: 117155 - DNA, 62 bp, Heterodera glycines
  Promoter: Source sequence=SeqID_12825; Location=1..62; Strand=+; Gene= SeqID_47084
gggggcgctatgaggtcgaatacaatgtgttcagttcaacgatacctcgacgtgtaacaatg

SEQ ID NO: 117156 - DNA, 399 bp, Heterodera glycines
  misc_feature (57)..(57): n is a, c, g, or t
  misc_feature (73)..(73): n is a, c, g, or t
  misc_feature (83)..(84): n is a, c, g, or t
  Promoter: Source sequence=SeqID_21767; Location=1..399; Strand=+; Gene=SeqID_52373
agaccgagagtgattagacaaggtgtggtcaatgcttatgctgctggatcacatgangaatgcacaagaaaanccaaacttgnnccctagagtgttagatgtgaattttgtgatgccttgcattttgtagaagagaaagtcaatggtcgcggcaattcttttaaggattgttgccactatggcaaagtttttgttcctgagattcctgagcaggattttcctgaggaattaagggatttgtttatgaaatttgatgcgagacatttgaatttttttaagaacattcgacatttgaatagttctgtatcatttgtttctatgaacccgcttaggtatagatatccgtgtaatcgagggccgtattgcttccgcatttacggtcagatttatcatcgaatg

SEQ ID NO: 117157 - DNA, 112 bp, Heterodera glycines
  Promoter: Source sequence=SeqID_11611; Location=1932..2043; Strand=-; Gene=SeqID_75061
atgaagtcagcaaaatttctctcgtaaaattttattaatttatctccgaattcattcgtcaaacattttatgagaaaaaaaatttttttttttctgaataaacattaaaatg

SEQ ID NO: 117158 - DNA, 119 bp, Heterodera glycines
  Promoter: Source sequence=SeqID_8454; Location=3041..3159; Strand=-; Gene=SeqID_68125
cgatggatgcgcctctactttatgcaagtagggaattacaataaattaaacaaattaattaaatttaattataattattttggagtgaattcaatttgaaggtaattcgtcgtataatg

SEQ ID NO: 117159 - DNA, 67 bp, Heterodera glycines
  Promoter: Source sequence=SeqID_8516; Location=1..67; Strand=+; Gene =SeqID_68358
tggactaactatttgttgttctattttcgaattgaaatatggtaaaagtaataaacttacagaaatg

SEQ ID NO: 117160 - DNA, 123 bp, Heterodera glycines
  Promoter: Source sequence=SeqID_44368; Location=644..766; Strand=-; Gene=SeqID_71865
ttaaagtaagcgcgaaaaagtcggtaaataaagggccttggaactgtgaaaagttcgtcgcactgccaaaacagaaactttccttcctctgtaaggaacgcaacagcagcacagaaaacaatg

SEQ ID NO: 117161 - DNA, 1003 bp, Heterodera glycines
  Promoter: Source sequence=SeqID_15937; Location=413..1415; Strand=+; Gene=SeqID_80287
tgcaaatgcttaaaccccggccaatatatattactgggttttggtattaaaaaataagttgaaaaattcattacttattagcctaaggagaaagaaaaaacaatattcatttaactaatgattggtcatttagaacagaagaagaaattaacaaaagcatcggggagaattcgctaaatattgtcagaatgacaaagctcaatttcaatcttgacaaaggcatgtgcaatatttgtaaaaaagcattaaattttttaaattcaatttaagtagtgatttattagagtccgattagactgtcgcattgggggcaaaaaaaaaaaggtgaaaatctgatataaaaatgaagattccccggatgttaattgatcatatttaatcagaattggattatcctgagagagaagggtccgtagttcgggtgcacccaaaatgtcgctggttggactacactttgttcattgttaatcaaattaagcattcttggtattgttcgtgagctttgtgttatttgccaaatctcaaattccttaagttaaaaaatgttatgaccgaaataaattcaacttgccatgtttttgtacataataataaaaaaaaattaaaattttgctggctaatagagtttttcaagtgctttcaaacaatattaagatgtttaatttggttgagaaagaaaaatttatggtccaaaaatttgcccgttgacttttcggctggcgacgttttgtcctactccaccgtagttcagctggtagaacactgatccgcaaaagccagagacgccggttcaaattaggcccgtcgcaagttttttcctcaaatgcttccccaagtccttcctacataattcaacctaaacaaatgccataataagcttggcacttttaaatggcgcctatcagttttaatacttaatttcgaaaacttttttttaaataattctccataagatttaccgcaaataattcttcctgctcttcttaatgaattggaagaaatg

SEQ ID NO: 117162 - DNA, 551 bp, Heterodera glycines
  Promoter: Source sequence=SeqID_5849; Location=1686..2236; Strand=+; Gene=SeqID_59437
gtgaatgaatgaattgttgagaagtgatcgatcaatatgaattattgaattggaaattgtcgtgctcattaaatattctttttttgtgatcaacatggatttgtaatgcgtatgtcttaaggataaatttaatgatttccttaaaccgaaatccatcggtaaaatcaaagtaaaattgaaaaagtgcactgaaattgtgcagttttgaacgcattggtcaccaccaattttcctaaacaaagcaagccaacaatttcacctatttgagggaatgggtcgtttcggcgccaagccaaaattaaaaaatcatgaatcagtgggaaatttttgagcgatttaaattttcaaaaaattaaaaattttaataaaaattgtagaacaacaacaataaactaacaaaagaaaatttaacaaaaatattcgccttgcgcttatgaatcaacggaaactgtgccatttcaattgatgaacgatcggaccaacgaaaagctgaccttgaagaaaaaaggcgatcatggaaataccggtgttgattggctaatgaagcgatg

SEQ ID NO: 117163 - DNA, 400 bp, Heterodera glycines
  Promoter: Source sequence=SeqID_27826; Location=1..400; Strand=+; Gene=SeqID_58503
tttcatcttttttttcaaaatatccatctcaacgaggccattgaatcccgttaaatcctacacggcctgatgcaaatccccaaaatctcgatcccagatttttcaaaaagtacagtctctaatatcagtgtatgtgtgccgactgccgacgccctcaaaaattttgaaaaccggaattttgagcacaaaatgtcggaaatcggcattccgaatcggaatttccggtccctgacacataaataaaattctcaaaaaaaaaagcgtacgcacttattatttattattatattcattcattatttccacatgttttcaagttgatattccttatttctcccttaaaatttatatatatttttaatgctttagattatttaattgttttaatttggtctaaatg

SEQ ID NO: 117164 - DNA, 238 bp, Heterodera glycines
  misc_feature (57)..(57): n is a, c, g, or t
  misc_feature (78)..(78): n is a, c, g, or t
  misc_feature (100)..(101): n is a, c, g, or t
  misc_feature (109)..(109): n is a, c, g, or t
  misc_feature (113)..(113): n is a, c, g, or t
  Promoter: Source sequence=SeqID_30867; Location=1360..1597; Strand=-; Gene=SeqID_61256
atatttaaatggcttttcatttttcgatttttctaattttttatcgcattagcaatnaaagaaatattctctcatcanttaggtagaaaaaaagaatatnnattatcanttanaagtattattcaaaaaaaaaaattgtgaaattaattttttaactaaagatttaaatgaaaaatttaaatattgagatttatttataatttgaaaattaattaatattttagatcccttttcaatg

SEQ ID NO: 117165 - DNA, 175 bp, Heterodera glycines
  Promoter: Source sequence=SeqID_24812; Location=361..535; Strand=-; Gene=SeqID_55563
ttttgtattcatttaaattaaaaaaatgatgagaaaatacagagacaagtgtttttttctcatgctttcctacattagctcgtccagaattagcaagaaatatcaaattctacaaaatcccggcactaattaatttatttaagcctatcataaatacacactcttttttgtcatg

SEQ ID NO: 117166 - DNA, 55 bp, Heterodera glycines
  Promoter: Source sequence=SeqID_11244; Location=1..55; Strand=+; Gene= SeqID_74604
ctctattcataaatttgaagaactaccctttaaaatattccctttcaaagaaatg

SEQ ID NO: 117167 - DNA, 116 bp, Heterodera glycines
  Promoter: Source sequence=SeqID_22565; Location=1657..1772; Strand=-; Gene=SeqID_53235
ttgcaatttgatttaatacacattttgcattttgtatgatcacttggctggaggcgccccgggccgcccggcgcggatttgcatcgcttgacgatgagcagcagaacaacgaaatg

SEQ ID NO: 117168 - DNA, 692 bp, Heterodera glycines
  misc_feature (29)..(29): n is a, c, g, or t
  Promoter: Source sequence=SeqID_4127; Location=1019..1710; Strand=-; Gene=SeqID_53279
aaaaatagaagagccgatctcgagttaanaacttaagtttcacaaaataaacttgggatcgctagagggggtcaaaatattggtctatgcaaaattttaagaaatttaaaaagctagaaaaattttttgaaagggacgaacatttcaataattttaattcttttttagccaagtcctcgatttaaggccaaaccaaataaaacttacaatattctcaagaattttcccttcaaaatgagcataaaatggttttatttgctctagtattcaccaagttataagctaagaaaatttcataaaattgtcgatgttgtacgtaaccaacgcttttgaatatgattttttgttgacacgaaaacttttattaatgaaaaaataattctgccttcttctgtaaaaaaagaaattgaaattaacacacaacataagaaggactcgaacctgagacccccttttggtgactaacgcacagaccactaagacgaaaaaaccaacttaattgtacaaggagcccaaaatgaatcgccgtgtcaaaatattggttgattgctttttagactaaaaatgatagtatcattgcatgattgcttcaacaaaagcatgttgatgaacctgcttgagcaggacgacgaaaattggacctgaacgtccgagacaaggacggcttcaccccgttgcatcagttcgtgatg

SEQ ID NO: 117169 - DNA, 69 bp, Heterodera glycines
  Promoter: Source sequence=SeqID_19171; Location=638..706; Strand=-; Gene=SeqID_83919
aaagattcggccgccggcggaagcgacgattatgcgcagagtttgggcataaaatatgtgtacactatg

SEQ ID NO: 117170 - DNA, 408 bp, Heterodera glycines
  Promoter: Source sequence=SeqID_3123; Location=1376..1783; Strand=-; Gene=SeqID_83302
ttagggacgaattaggaattagaaataatgccccattcaaaaaaaaatccaggaaaattagtcaaagccaatgttttttttaaatttttaataattttcaatgtgtcccagtttttagtcttacaatttagtcaatacaccacacgaagagaacaagggtgagggttcgagtccgctcgacaacattaatatttttagaaaaatataaattcagtttgtctctattaacggcgatacagaaatagtacgccaaaatgagagatgtttttttctctgcactctttatttattggttcatctctcattttttaggatgttgttgtcaaacattctaaattttgaatgggaattttagcgttttttagaaaattgcacaggtgtggggtagatgggtgatcattaaaaatg

SEQ ID NO: 117171 - DNA, 114 bp, Heterodera glycines
  misc_feature (21)..(21): n is a, c, g, or t
  Promoter: Source sequence=SeqID_11881; Location=1..114; Strand=+; Gene=SeqID_75392
tataaaaaaaacaaaatatantcttctataaataatgttttttaaataaaagaaagtaattttttttaataaaaaacaattaaataaaatataataatatttcttcaggaaatg

SEQ ID NO: 117172 - DNA, 330 bp, Heterodera glycines
  Promoter: Source sequence=SeqID_31834; Location=1..330; Strand=+; Gene=SeqID_62143
tttttgctttttccatgtaggcattgattttttacggcatatttttctcaatttctctttttatatgcctgatttatacaactataatgcgcatacatttattaatttgtataaaattttaataaataaatttagtttctgcttttttgaatttcccattttgggcatcgattttccatggcaaattttctaaagcaaaaaatgcatataaaagtgatggcacagattaagcaaggcattcgcattgaataattttaatttaaaattatataaaaatgcattttctaacttttttctattttaatcttttagagaaaataagtggcaatg

SEQ ID NO: 117173 - DNA, 490 bp, Heterodera glycines
  Promoter: Source sequence=SeqID_18307; Location=132..621; Strand=-; Gene=SeqID_82899
gctgaaattttgaaaattttgcccttattttgtgatacttttgtcgaatttttaaggatttagtccagggttcccaattgaaaattttcgaaatgaacatttgaagtcaaaaatcagcatttttgaaacttattccaaatttaaaaaactaataaaaaattgccatttttgaggattttttccaaaaatcagcataaattagtaaatgttttctaaaaaaaaaaaaaaaatcagatttgacctcatgaaatcagaaaaatgctgataattcagtagagttgggagccctgatttagtcaacaactaatgggcaatattttgcgatttatttctattaatctcatccgattttttatttgtattgttatcgattattatatcaatttttttttttgctgcatttttaatcatttatttttttaaattcattttctttaataattcaatttatttttattaaaaaaaccattattatttgaagataaaaatg

SEQ ID NO: 117174 - DNA, 123 bp, Heterodera glycines
  Promoter: Source sequence=SeqID_37950; Location=1..123; Strand=+; Gene=SeqID_66915
tttctcttttctttgtaattcgcgacatttaacttttttctaaaatgtttttctatttttaaaagccttcgaattcgaatgatttcatgtttgttgaatttcactgtataaatcacaaaaatg

SEQ ID NO: 117175 - DNA, 412 bp, Heterodera glycines
  Promoter: Source sequence=SeqID_5522; Location=1..412; Strand=+; Gene= SeqID_46059
cataaaagaacccaatgtttggttttaaaaaatatctatttctatgtttaatcgccgttttttttgtatttattaaaataaaaaccaaaatttatttatttaatggtttgttaaaaaataattggtaaataataaggatagaccaaaatagaatttacgtattaaaggaaatgcgacgaattccaaaaagcctttctttcgttccccaggaaagtgtctgctttgataagcattaaaatgttcttttcttcaacaatttgactttgaccacttttgataatcgcaatttatttttcagttcgtgactcatccatttaaaaaaacaaaaataaataaattgaaataaataaaaataaataacattttcaacattttcaattccttccccccccccccccctcctcagagaatg

SEQ ID NO: 117176 - DNA, 255 bp, Heterodera glycines
  Promoter: Source sequence=SeqID_23037; Location=999..1253; Strand=-; Gene=SeqID_53742
cctgaaaaatttgaaaaaaaattgttaggattcaaaaaaagattacggccaacattttcataaaaagtagattttttacaaccataaatttttaaatttattttttttatttttttgaattttgctggtcaaaaatattacactatccgaatgaaaaaaaacaaattttaattttaaatgtaacaactttaagattcaaaacggtccgagatgtttacaactatgtggcggaaagggaaatggtgaccgacaatg

SEQ ID NO: 117177 - DNA, 1003 bp, Heterodera glycines
  Promoter: Source sequence=SeqID_29280; Location=534..1536; Strand=-; Gene=SeqID_59801
agtccatttaaaggagcacaaaattccctataaaatctcggccttaaaatgtatttaagttatttctcataattgaactaaattacttgcactttttctctgtcttcgtttcaggctttttttcattcacttttttagcttataaacacacaaaattatcattttagttaaaaaatttcaagtttaaactaaaaaaaaacccaaaataatgatatttttcatacaaattctattaccagagcatgccaaaattttcaagttttctccggcggcgcttcggcacaactctgtcagcaaaggtctttttttgaaaaagcatgccccaaaaaagtcgtttgaattttttttagcagatctcactaaaattaaatggatttcaggaaaataaaacaaattatcccaattttatacaccatgaaatgaaatttttccgaaatttcctcgtctgggatttctgttcctttttttattttatttttcttagaaatttctcggttggctataccggttgaaaatcgaggtcccggtcacggactttctggtcccggaaattcacgggtcctgtgaaattcccgggccctgttttgcccaaaaatttccggtcccatgccacattaatgagaagcattgacaaaaataaaacatcggcgtgagaatattacgccaaaagtcatgctcctaaaataagccttgaaaaaaatatgggaaatttaaaaaaagtatagtaaaatgagtacgataggatgccaattttggaatgatattgacattaggtacatggaattttttattttttattgaagacaatttatgaaatgaaagttttgaatttgctgggaaaattatgtcgccgcacattaaacgtgggatgttttatacgacaaattcgaattggcaaatttaagtacagaaaattggacaaaaatgtaataaaaggaataattatcttcagtttaaacacactaaaatttaacaaattgccacaaaatttgaccataaaatg

SEQ ID NO: 117178 - DNA, 364 bp, Heterodera glycines
  Promoter: Source sequence=SeqID_39809; Location=1..364; Strand=+; Gene=SeqID_68287
ttaaattatgcttaattggcagatctggctttaaaataattcataattatcaaaaagaccaaataaaattattgttaattgtgagtttggctttaaattttattaaatgttatacagaaaaccaagggttagcccgaatggtaataatttcattctattttatattagcaattcttcagtgtttgaattttcctttgcacaatgatttaaatttggctttctataagaagtataaaaaagattttttaaaattttttgaaaaaattaaattttcaaaaatttatttaatcctattctagcacaatatttaaaatcattatttggctaattgttcgacaataatattccaattttcgtcaaaatg

SEQ ID NO: 117179 - DNA, 1003 bp, Heterodera glycines
  Promoter: Source sequence=SeqID_9176; Location=2136..3138; Strand=-; Gene=SeqID_70498
ctttattgtgtgattttatttttggcttggcgccgaaacgtgggcgccgaaatgaccctttcccaggtttgttggatttgaatgacaaagagcgaattaggtaattcaaatattcgcttcaataaaagacgataagtcaaaacaattcaaattttacattttttttgttttcaaacctaaaaataagcacaaaataagcacgtaacgctgaaataagcacaaatcttagaaataagcacacttggaaaccctgttaaacagatcatttccgaaaatttaattattaatttttttgttttaatcatttacgttaatacaaattaaaaatatttaaaaataaacaaaattaataatttaaaaaaaaaatcaaaatttttgtaaaaatttttttaccgttcctggcgggattcccgttaaaattgatgggatttttacgggaacgtgaaaaagacgggaatcccgttcgtgaatcacgccccgttcttttttgtttgtttttaaataattgcaaaaaatttgtattttttctaatttattatttttcaatttttttaatcttaactttatgatatgctaaaacaaaggaaaagtataaaattgggcccgttaaaaaacgatgtccattttcactggctgtacatatttcatacatattttagcattttttatacatattttatttacatatttcgtgatttttcttgcatcaaattcctagtcctaattataatataaacaaaattaaattttatttgactatttgtgtctatttaacatatattttgcgatttttttaaataatccgttatcctgttccaatttacccggatcagaccttattttcaagaatgaatccggagtgaattccacgctaaaattcttgtttccggatcatattgcgttttgattatctaatagtgaatgctttttttgtgtttttttaaattattcaaaaccaaatattgcatttttaaatttagttaagcaaaaaattctaaaaatg

SEQ ID NO: 117180 - DNA, 598 bp, Heterodera glycines
  Promoter: Source sequence=SeqID_353; Location=4558..5155; Strand=-; Gene=SeqID_83881
tgccgtactgaaaagatgccaaattcaaatatttttaaaaagccgaattaattttgcaagctttctttatcactaattgagagagcggggtgttctattggaggaattaaattgtacaaatatggtgaataattaggttaaacattaaattgataattaatgaggcatgttgtcactttgtatcggcgcaagaaataaaataattaaatttgaaaattattaaaaccataggggaccctgatttgaaaacatttttaatacgatttctattcgttgaaaacatattttcggcgtcggtgacaacacgaggcaaaaccaattttgattaccgaattctgaatcccgaacccaaatttgagcaaaaagacaaaattaaaaaattcaacatttttgttcggattttgaatcatgggctcggaattagtcgaaataaatgtcggtgattcgtgatcagcgaccccaaaaatgccatgaacagttcaatcagtgattcttgcctgtgacacgcatgtgagcagaaccaacgccgcttttgtgccgatgagacggtcgcacactcggcccacggcaatgaccaaaaaggtggagatgacaaatg

SEQ ID NO: 117181 - DNA, 374 bp, Heterodera glycines
  Promoter: Source sequence=SeqID_18734; Location=769..1142; Strand=-; Gene=SeqID_83406
gtttgtctagtaccggtaccgccggtaaaaatttgcactggtaagaatgggggtcttctcgagaatagcccaaaaaacttcctaatacatacctaaatttatattttcaaacaaattttcatgttcccattaaagtaaatatattcgactcatcacattacgcacttcacttttagccataatcgtttcacaatgttgattttcccgcacatcaaattttcgacactccttaaacgcgcgactgtcaacagctcctagtaagtatttttactaaatgacaaattgcaaaaatctaatcgaggtcatataaaaataaaagctgtaaattcttgtcgggttatggttttctataatttttgcatttttcagttatg

SEQ ID NO: 117182 - DNA, 302 bp, Heterodera glycines
  Promoter: Source sequence=SeqID_13854; Location=1977..2278; Strand=+; Gene=SeqID_77802
ggtaatcttcaagaaaaaaccaaaataacgatgaaatcatttcatacaaattttccgatttttttaaactgattaaaaaaagagttacttttttttgttgcttttaggcctttggtgtattggagggataggcgacagggaaaagagaaaattttctgtctgtacagacattttttgctgtttttgttttaaaatttcaaaataccaaaacagggcttatcgcttccaaattattatttttttcccatttttcgatcgttgccgccatctccggctcgtgcatgggcggcggcttggagatg

SEQ ID NO: 117183 - DNA, 1003 bp, Heterodera glycines
  Promoter: Source sequence=SeqID_32006; Location=976..1978; Strand=-; Gene=SeqID_62319
ccaatttttaaatattgcatcattatttaatataataaacaaattatattaagtaaaaaatagatttggataatcctactaatgatcaatcccaattttgtaaatatttccacataatttaatataataaacaaattatattaagtaaaaaatagatttggataatcctactaatgatcaatcccaatttttaaatattgcatcattatttaatataataaacaaattaaattaagtaaaaaatagatttggataatcctactaatgatcaatcccaatttttaaatattgcatcattatttaatataataaacaaattatattaagtaaaaaatagatttggataatcctactaatgatcaatcccaatttttaaaattttcaccatttataaggcgatgagatattttattttttatttttaataattactttgctttttatcctatatgaaatagagtaaacttaattttctttaaattttcaaattttaccaaaacccttaattcaaaaaagtattttattttttatatcccttttttaaacactttttagatataagaaattttatttttaagcattaaaaattaaatggttacattacaaagatttttgcagaaaatggaaatatttcaaaaatgcgaaataaaattgtattaatgaatttccgtcttttttttaaattcatataatatgtaatttttattataaataagctttaaatagagatgcaaattccaataagttcatatttctttccctgtttaaacgtgttcaaaaagtagaaaacaatttcgtgtttcagaataaaagttgtatttctattttttaaaatttttttgggttttctgcatattaattatttacgtatttttctaaataaattcaagtaaaaatttcgctatttaatataaaaaagaaattaaaaaataaatagaaatttggatgactcttctaaaaccaatcagttttaattttatatttcagaaagaaagacataatg

SEQ ID NO: 117184 - DNA, 395 bp, Heterodera glycines
  Promoter: Source sequence=SeqID_4549; Location=99..493; Strand=+; Gene=SeqID_54855
tgtgccgctcttgtttagaatttagttttgcaaaagaatttcattttttcttagaatctaagtcatctcttataatcagagttcccaagttttttttttcaaattcatgacaaaaacactaaaattcagattcttttgcaaaataaattgtagcgctaagaaaacctattaaaaaacaatcgatatttttattagcataaaacatagggcttcccaactgaaaatctttttatgtttttatcggagccctcaaaattcaggacaatctgaaaattcaggacctttttgatttttcaaataggtacactccaattcaggaaaattcactttgtaactctgtttataatgaaaaaccgtttttccaaggtgccagatttgtgagcctgccacgaatg

SEQ ID NO: 117185 - DNA, 126 bp, Heterodera glycines
  Promoter: Source sequence=SeqID_37018; Location=343..468; Strand=+; Gene=SeqID_66202
agaaggtgcgtctgcaacttttttagtcctatttgtttgtttttaggcagaaaaggaagatttacggcaacaggaccgggtaaaccctttgcatttttgctgcccgtgaccaattaatgaaggatg

SEQ ID NO: 117186 - DNA, 1003 bp, Heterodera glycines
  Promoter: Source sequence=SeqID_586; Location=4436..5438; Strand=-; Gene=SeqID_56954
gttcgctgttgtacatattatgtgtattgtcatcatctaccagttattgtatatacatatgtgtacatatgatggtgtatcgagcaataaactttgaaattgccttgatcctttccaattatgtatgaattttgggctaatactggagaattagtgtcccggcgaaatataaattaaaaatttaggtcatattcatcgtcagcgaccctgaaaaccccaaaatacatgttttcagttatccttacatgaaaatatatttaggaaaatctcagggtgaccaagtttttttttcaaattcaggccacaaaacactaaattccagatttaaaccccaaaattcagattttattcatttaacatttcatttacatgtaatatttgagtttttaattttacatatttatttaatcacgaaatatttgagcgtatattttgcaataattcaaaaacaaatccagataaagttaattaattttcaagcgtttaggaacagaatctaaaagttatctctcttcttttggtcccaagaaaacttttcaaatatttatgcccttcaaaaaattaataagagagaatcaggcggtgccttggcgccacttggaaaatttggtcgttaatttagcaaaatttgtaatgccaaaaagcggtgccagcgacacattaagtgaccgttatcgtgaatttacgcgcatctctaatagcttaaactaattaaattaatgagtatgtaaaggtgagaaaaattttagaaaatggataaccaaaagttgctacttttttattgtatttttggtaaattatcacttttgtttggcattgtctgcggaaccgcaaacaaacgcaacaaccatcatcaaattgccaatgaatttgttgctctggagcaaataagtgaagcattgtcgcaacaaattaacggtgaaaatagaaaattaataattaaatgcccattaattaaataatcattttatttatcatacaaatacagaggaactgacgaatg

SEQ ID NO: 117187 - DNA, 191 bp, Heterodera glycines
  Promoter: Source sequence=SeqID_40776; Location=1..191; Strand=+; Gene=SeqID_69020
aagagaagaagagatacagaaagtggaagagaaagtgaaagatgtacagaaagtggaagaggaacagaaagtggaagtggaacagaaagtggaagaggaacagagagtggaagaggaacagaaagcggaagagatagtggtagaggaacagaaagtggaagaggaacagaaagcggaagagaaagtggatg

SEQ ID NO: 117188 - DNA, 155 bp, Heterodera glycines
  misc_feature (46)..(46): n is a, c, g, or t
  misc_feature (68)..(68): n is a, c, g, or t
  Promoter: Source sequence=SeqID_35945; Location=1..155; Strand=+; Gene=SeqID_65398
tcctcaaaatacaccgttttctttgcttccgcaatctgtgaatganccgtcgacgagtaccaaaaatntattttccagaataattgtcatatttattagctttgttttggcttctcttggattcaagtcgaatttttgtcgaagatttggaaatg

SEQ ID NO: 117189 - DNA, 56 bp, Heterodera glycines
  Promoter: Source sequence=SeqID_39913; Location=898..953; Strand=-; Gene=SeqID_68371
ggactatttttgtcactcttttaaaaagcggaaaaataattgattctttccagatg

SEQ ID NO: 117190 - DNA, 394 bp, Heterodera glycines
  Promoter: Source sequence=SeqID_11207; Location=961..1354; Strand=-; Gene=SeqID_74566
aattgaataaataattgtgaattattagtagggctgtgaattaagtcaaatgacttttttttaccttaaaatgacttaaaggcaaattttgaattttagcgaagaacatttcgaaaaataatctctgatcggtgaaaatgcaattgaaaacctgcagaaatttttctataaattgttaaaaataagttatttttttcacttttgcctaatttttgaggacttttttccattttctttcgtgctttttttggcgttttttgtttatgacttttttagtcgagtttttgtagattttttgtgacttaattcccagccctaattattacctccgctaaaaaaaataatttaaaatttaaattaaaataattaggaattattattttagcgcaaaatg

SEQ ID NO: 117191 - DNA, 595 bp, Heterodera glycines
  Promoter: Source sequence=SeqID_10731; Location=1200..1794; Strand=+; Gene=SeqID_73981
taatttctgaaaaataatttataatatccgaaattattgaagaaattaaatgatttaatattaaatgcattacattgtaatttaaaaaataaataaaaataattttaaaaagtttaaataaaaaatgtatttataagcaattccatttaaaaggcaattttaatgaaagaattatttgtctaatacataaatgttttaattaaagaaattagaacaagtgatgaataagcttttttcagctttaacaaccttttacaagcgtaatttcgctaattgcttttctattccacaaaaaagaaaaattaatgttaaaaataaaaataattgttgttaaagaaactgataaaaattttttattgctattttatgaaattagaatcataaaggaatttttttttgtctatgattgaaaacatgtgtaaatcctattattgatttttatctgtttggatattccccattttttcataataaatggaattttaaaattgattttattaaatcgcacgtgccagcacttaaagggtcgtcgcgggtcggatcaagaaaattgccgagtcgtgcgtggtttggtcgagacatttcgtaaaaaatg

SEQ ID NO: 117192 - DNA, 1003 bp, Heterodera glycines
  Promoter: Source sequence=SeqID_2577; Location=354..1356; Strand=+; Gene=SeqID_47347
aaattgccgctaatgctttattttagtttgaaaattcacagtttaaaaatagccatttaatgcagggcttccatttgttcttatttataagagatgttctgatttggagggtccaaatcttacaaaataaaaatgttctgattttgggctattattcttatttcttaaaattattcataaatttagaaatttatggcataaatgttcttattttccctagaaattaaaaaaaaaatttccccggcggcgcctatcggcaccgccggacccactcgcctcccccgttctccaaaattccttggaaaaatgcgccgcaaaaaatttgttaaaaatttgtttttttagattaaaaatgcactgaatttgctaatttacttcccaaaatcgttaaatatgataattggaggcgaaaaatacaaaagttgatgctatattaattttataaagtgttatacaagcgatttaagcattttttgttaaatgttcttatttttgaccctaaaatcttattttatggcctggatgttcttattttgaaattttttcgatggaagccctggtttaatgtaatgttttattttagtttgaaagtaacattaagacataaatttaaaaaaaaggaaaatgactaaattatattttgatgatgagtgagataagtgaaagtagtggcaacataaacaaaaactagagtgcccgccctatttagcaaatgacacaaaaaccaagggtacccgtttgattttaaattgggttttcgacttttattagagttcgggattagaaatcaattaaaattgttgtcagattcgtgatcactgatcccccgagaactcatgggaaagtttccacgacttatcacaaaaaaatacaaatcaaagggtcccacaatgattttctgttgtggcattcggcaatagcattgtgttgtcaattaaatctttaacccatttcgctgttttatttgagttattgataataaataacctacaacgcctaaatg

SEQ ID NO: 117193 - DNA, 179 bp, Heterodera glycines
  Promoter: Source sequence=SeqID_29932; Location=851..1029; Strand=-; Gene=SeqID_60409
ttttaacccagaaaggagaagcgtttccccgctgctttttgcatttttagacgcaacggtcgatgactcggacacgcgtttatggcacgttgaccacggcactttgctcaacgaatatgtggcggcaatggcagtgctgcctttttcggtggcttcgcttggcctttcgcccaccgatg

SEQ ID NO: 117194 - DNA, 66 bp, Heterodera glycines
  Promoter: Source sequence=SeqID_43502; Location=1333..1398; Strand=-; Gene=SeqID_71144
agatttgctgcgtagcaaggtggaaaatgattgattgcttttttgacagttcggctcccttcaatg

SEQ ID NO: 117195 - DNA, 538 bp, Heterodera glycines
  Promoter: Source sequence=SeqID_32149; Location=1157..1694; Strand=-; Gene=SeqID_62480
ttttttgcaggccaggggtttgctcaaaaaaaattttaaaaaatacctccttgtagaggacccttaggcggagtgccctttcagcgggcactttttgattcgagttttacaaaaaaagttaggggccgtcaaacgcacgaaaaaatgagaaatcagtccctggtactcagttggcgctcggatcaaaaaacctatagttttcccgaattctcctcaaaaagttgtaagacccttccactactttcagacccgtcccattagccgttaagctcaaattagtttttgaaacgaaactccttgtcaatataacgtatatactagcgggtgcgtgaaccgtcggctatttagctgggaaaaagcgcttcgcgctttgggagcttcgctacctagattagctatcgggttgtgaaaagatttggaatttttaaaaaattatcagcgatttttaggccgcttcgcggcctcagacgggcggctctcgagcccgaagactaatttactgaagagcggtccagtatttactggccggtttgacatg

SEQ ID NO: 117196 - DNA, 647 bp, Heterodera glycines
  Promoter: Source sequence=SeqID_3400; Location=1..647; Strand=+; Gene= SeqID_84527
gttatttcgggcccaactaagccggtattcaggtataagtccaaacagaaactagcacacgtttaattatacgtttaaacaaccgtaagaattgattaaataataagattgccaggttcccatacataaattttttgattttcaagaacatataaattttaagaaaaaagggttgctaaaatttactaaattttaatgatttatataacattttatttatttattttgttttatttttttgaaatcccccctctggtgcccaaacttcccggtgcccaaatttctggtgcccaaacttcctggtgcccaaacttcccggtgcccaaacttcatgtcgcctttgaaattaggtagcaaatcaaaatgccaaaaatcaaatttataaaaatttttctatcttggtatgcaattcgcaaaatttttcgtaaaatctctgacagaaaattccgacttcttgttcgaattcgagtccagaagtcgaagttggtcaagatgaaggttctattcgtgatattctgaaaaccacctcacacatgtttttgtgacattaaagcagaaaaattctttctaaaaaagggaactataggcagtattaccagtttcttgattcaaggtctttagtatttttcttttgaaatcgtataatg

SEQ ID NO: 117197 - DNA, 516 bp, Heterodera glycines
  misc_feature (55)..(55): n is a, c, g, or t
  Promoter: Source sequence=SeqID_23386; Location=777..1292; Strand=-; Gene=SeqID_54093
ggaatgtaaagaagtgtgtaaagctggaaatggatgcaatgatattaatattttnaatataattaaatgtctacggtatatttatttcttcgtttcttcaattccacaaccacgacgccatttttggtaaaatttttttaattattaaatttaaaaacaattcctaaaaattcattaaagacgaaataatttcacaaaaattaattatttgtattttacgaatttaatttattccacaagaaaaattttatacttattttttataaaatggtcatttcgtgatttgagaaaaaaatttatgaaaaaaagattattattttttaactaaaaaccaattaagagctttttttaaaataatttattgaactataaaatcaatgcgaaataatttatttaaaaaataatttccacaaaaattgaattttcattaaagcatttttcattttccactttttattattaataaataatttttattaaggaaacttttgaaaaatatatttaaaattcaaaatg

SEQ ID NO: 117198 - DNA, 418 bp, Heterodera glycines
  Promoter: Source sequence=SeqID_2720; Location=1373..1790; Strand=-; Gene=SeqID_81258
atttagctcaaactttattataattaagcaatcttgaaatctttagcgatagctcctctctatgtgtcctctactatcttattgttttaaaaaatttagcaaaaattttaccaaaacttttaaaaccaaaaattctaaaaatccgactaaataatttgtcccgaatttgttagaaaacttaataataatttttttaattaaaaatcttttgtctatataaacatataaagggtatttgttatttaatttgaagttttggcaattctaaatttaaaaattaaattcaaatattattttcattgatatttcttgttattattcactgggaataaacacagataaatacatatttatggaaaacatttactttttttttttacaaattttgaattttagagaattacaggaattgcacatg

SEQ ID NO: 117199 - DNA, 87 bp, Heterodera glycines
  misc_feature (71)..(71): n is a, c, g, or t
  Promoter: Source sequence=SeqID_17997; Location=1..87; Strand=+; Gene= SeqID_82566
aaaatatatatgaaaaaattaaaaaaaaagtaaaagtaaaaattttaaatataaaaattctaaaataaaanttaaaatggaaaaatg

SEQ ID NO: 117200 - DNA, 89 bp, Heterodera glycines
  Promoter: Source sequence=SeqID_21208; Location=2550..2638; Strand=-; Gene=SeqID_51798
aaagcacagcaagccatccaaggcaacaaacaaagcacagcaagcagtcaatagcaacaagcacagctacagcaacagagcaaacaatg

SEQ ID NO: 117201 - DNA, 622 bp, Heterodera glycines
  misc_feature (71)..(71): n is a, c, g, or t
  Promoter: Source sequence=SeqID_4499; Location=1..622; Strand=+; Gene= SeqID_54677
attaaattcatttaattaggataactatgaaaggaatacttttcaagaaaccgaactggcgcccatttggncggcactcctttaacggttttgactaattgtcaactttcagcagatgtttttctcatattctttgctctcttttcaaatttaaattgatgaaaagataaaattgttaatttcaaattatgtacaaaaaacaattatacatttgtttttgattttcaatcatttgtcatgcccaatgataaatataagcggcgctaaaatttattggcataagcaaagccttaaaaaatgccatcaaaattaggcaaatgccacgccatgccggggcatatccatgacactcggcattccaaccccatatttaatagcatgggctaacatctctgcattttatttaaaaaaatataaaaaaaatattaataataattttgcaattttattcatggatatcatgcatattttttattgaattgatttgtattaattactcttcttctcctcaataataattttatttttttaaatatatttttcaattgaataattttatatttataatttaattaataaaattccaaattattatttaatatgcatagataaaaaaatgatg

SEQ ID NO: 117202 - DNA, 1003 bp, Heterodera glycines
  Promoter: Source sequence=SeqID_873; Location=117..1119; Strand=+; Gene=SeqID_63062
tgaaccaagggaaaaaagaaggaaaagtcaaggatagtagccactaggccatttgcaaaactgtgaatatattaattttttttttaattttttcctttaactccaagtttcgttcctaatttttcactcagccccccattcttaccagtgcttgtttttcccggttgccctaccgggaccgggacctgagcttttcaaaatccgggacctctgaggaccgggaatttccatcccggtcccggcgcactctacttaggggtgtattttttggttatattgcatttttgctaataaattctccgaaaaaatgtcgaatagtgaaaaaatagtaacaaaacgccaaaatagtgatttttagtgaccgatagtgacaacataatcgaaaaatttcaacggagaaatgtgttttttgagttcctttcttcaaaacaatttaaaacctaaaaattgcgaccctaattatgataccgccgggatttacgatttttcataaatatatgtacctaataataaaaaataggcaaaacgccctttcttttaggggtcttatcaacccgcgacttcagaaaaattctaatctttcattaaaaatatattttttccccaaaaattttaatatatgaaaaacttgggtttttaaaatttttactggtgatttctgacactttggcctactatctctttatatttaatagaattaaagttcaatgataccataattgttcagtttaattagggatgaaacgagttatggctgatcatcaaaataagcaatacacaaaacgcccataatttttgaattaacgctcaaaacattgccaatttttaatttttgaattaacgctcagaacatgccaattttggcactgggcttgtgacccattgccattgtgcctagtggaactggcataataattgttgaatttctttatcaccatttatttgtcatttatttagacttaacttttttattcaccgattggctgatcagcaatttattatg

SEQ ID NO: 117203 - DNA, 1003 bp, Heterodera glycines
  Promoter: Source sequence=SeqID_13300; Location=1265..2267; Strand=+; Gene=SeqID_77147
taacagccccactaattacaaccgaaggttgtgagtttcattgattgtctgcctcaaaaaagatggtgtttaatggaaggtgctcaaggttggcacgtgcgaatttagaaaattagcatttttattgcaggcaattcatttagagaagtcattaatttatttgttatgaagttctttcattgaaattagtttaaaaaccctttcttgccgattacattctgttctaaattgtagcaaatgagcctattcttacaacctatttggcatttactataattgtaacctttggcgtttctaattgtaaaattaaaattataagaacagttttttcagtatctgcgcccgctattttctaatgatattttttagccaaagaataatgcttttttgaggtatggggtgccattaaacaattggcaacatctggaatattactcaaaaaggtatccttctactagcttccattaaatctttgaaagaaattttcaattttttcaaactattttcataaaatcctaccgaattcatttttagccggccgattaaattttgactgttatatctgaaatgatagatcattaaatagaaaggaaggaaaacgtttgggctaactcttcgcttcttcagaagaaaatttattgatatcattgtcctatcagataatcgcgggcgtagaatttaaaaaaacaaagtaaaagcataatctattaaatgaactaattaaaagcagaattttttaagaatgtgcctgaatttgtctattaatttgtggcccgttaaacatgttttttcaataaaagcacatcaattttgtaaaaggacctagtgcagaaatgcgtatcgccattgtttttatatagacaatttttacggcgactgcctgaacctttcttgaaatttgagaaatttgttcaattactgacgcctttagatgtacggctattcttaatatatagcaaaatacagaacattttaatagaatagaatattttttaaatagatg

SEQ ID NO: 117204 - DNA, 468 bp, Heterodera glycines
  Promoter: Source sequence=SeqID_28414; Location=249..716; Strand=+; Gene=SeqID_59034
agtttataccaaaaaggatttttttttctgaaaaatgtttagttggttttttaattaaattatattttcggttttttcatggaatagtgtgaattttcatgaacctaggttttcataattcgcttgaggactcatggctgccatataagtgaggcctttgtactcctaaagtttgtattctttatataatttaattagtgcaaaaagataaatattgtgggaatatagtaatgtctcttagcatggcacgggttcgtccttagatgccaaatttttaccgggacttgaaaaattgaccggagcgggtcccgggaacgggctctataaaatatacatttttgatttcaaataaacgcacgtgttttttcaagtagaattagacgggcccgggtgcccgaccgggtcccagacccggacaccctgttttttcaaaacagggacccgattttttaaaatccaataccaatg

SEQ ID NO: 117205 - DNA, 328 bp, Heterodera glycines
  misc_feature (110)..(110): n is a, c, g, or t
  misc_feature (121)..(122): n is a, c, g, or t
  Promoter: Source sequence=SeqID_23230; Location=1455..1782; Strand=-; Gene=SeqID_53944
taaaaagtgcgaaaggcagttattttgtttaattaataaataaatattttaagatttaaataaaaattttctcttgaaaactttaattatcgtaatgtctaatttaactntgaaaacaatnntaaaaatacataaatcaccagtgttttatatctgacaaatgagtgccttatttatttatttttttaaagaaaaaataattaattaaaaaataaatattaaaatgaattgaattaattgataaataataaattaattatctcgcgttttcgtaggcgtccagcagaatgtcgcgcacattgcactgcgggtcaatgtgtccaacatg

SEQ ID NO: 117206 - DNA, 88 bp, Heterodera glycines
  Promoter: Source sequence=SeqID_29458; Location=682..769; Strand=+; Gene=SeqID_59956
atagttagtccttttgttgaatttttagaaattttatccgtcaaatcggcttttggaattttaatgagtaaatcaggaaccgtaaatg

SEQ ID NO: 117207 - DNA, 336 bp, Heterodera glycines
  Promoter: Source sequence=SeqID_41958; Location=1..336; Strand=+; Gene=SeqID_69988
ttatcattttttaatctcctttcttcttccttcactctctcgtgctctctcgaacaatttttaaattagggttacaaaatataaaaatttgatgagacttttttccaattggattcttttctatatctttcgttttgttttataacgaaaattcacggggcaatttacatctcagcctccgccgaaggttaattgcaaaacgggcagaattttcccccgttttttcgatttttctttttagatgaatttagataaggggcatagcctttataaaaaataaatgccgctttttaattatggcaaaacattcaattattctttttaccaaaaacaatg

SEQ ID NO: 117208 - DNA, 433 bp, Heterodera glycines
  Promoter: Source sequence=SeqID_17716; Location=488..920; Strand=-; Gene=SeqID_82248
atttttatttttaaattttcgccgatttcgagagggcccttattaattaacagaaatatatttattattcattttttccttttaattattttgtgttgaatttaataaagaagcaaataaatttgcaaattattcatacaggattaaagtgcttaacaaagatcattatttaaaagatcagctaaaagaacacttaattatgattaattccttttatataatatatgaaaataaaaaatgtagaccaaagaataaagataatattgtaagatttaaattgaatatgaaaaaagaccaaagcttaaaagcactaaatctgtataaaaagcagaataaaattaaatttttacacattcatttcaaaattccacataatttaaaaattattttaattttaaaaattattttaatacatttactcattattttaatg

SEQ ID NO: 117209 - DNA, 223 bp, Heterodera glycines
  Promoter: Source sequence=SeqID_11806; Location=1143..1365; Strand=-; Gene=SeqID_75307
taattatagagcgttaattataaatgagccagtaattactatgtgctctacttaattacaacacattacggaatcccctttctgtgcagttggttgatgaatttttgttcatctttttttagtaaattatttgaaatttcaaatatataaaagttaaataattttttagtattaatttattattaatacttccattttgattatttcaagtgaacaattaatg

SEQ ID NO: 117210 - DNA, 1003 bp, Heterodera glycines
  Promoter: Source sequence=SeqID_21110; Location=2016..3018; Strand=+; Gene=SeqID_51700
ttttttttttttattaaattatcgttgaataacaaaaaaaaatacaattgataaaaggctaatgggttaaaataaaaatgctgattggaacttcaaaatatgaaaataaaacatttaaacgtattgtataacttttttgttttataattaaaaggaatgctaatgatgccttttgccgtaggtcaacaataataaaaattctttgaaataatgcctttttaccacttcaaattaatgaaaagcattggaattgcaccttttattggtcatatgttttgcttctgattacaagaaattttgtaatgtgtccagcggtgttaaaattacaaaaaagtttttttaaaaggtttttttgtattattttgttcctttttccccccaaacctttaaaaaacgttgcgcgggcccccaaattttccctttttcccgggggttttacccccccccccccccccccctttaaaaaaaaaaaatttcacaaagggtttttttttttttttttttccccccccaaaaaaaaaaaaaagggttttctccctccaaaaattttttccccggtcccccccccccccccccttttaaaaaaaattttttttcccccccccctttttttttttttttttttggtggggggggaaagaaaaaaaaaaaaaaaaaaaaaaaaaaatccccccccccccccccccccccccccccccccccccccccccggggggggggccccttcttttttttttgttttttttttgtttctccccccccccaccccccccccccccccccccccccttctcttttgtgttgtgtgggtgtgggtgtgttgtgtgctccccccccccccccgacaccatcacacaaaccaaaaaaacaaaaaaaaaaaaaaaaaaaaaaaaaaaaaaaaaaaaaaaaagaaaaaaaaaaaaaaaaaaaaaaaaaaaaaaaaaaaaaaacggttgtgaggtgtggtgtatgattcatattgggaataaaagccctctgaatg

SEQ ID NO: 117211 - DNA, 550 bp, Heterodera glycines
  misc_feature (40)..(40): n is a, c, g, or t
  misc_feature (65)..(65): n is a, c, g, or t
  Promoter: Source sequence=SeqID_18207; Location=1..550; Strand=+; Gene=SeqID_82803
atttatcaagatttgataggctgcggactgagctaaaatntaaaaaaattgactcaattatcgtntacagacaaaatccagtacttttaaagttttgcctacatctcaaatttaattttgtttaataaattaataaaagggcatacaacagaaagcataatttttttttgtgagtgtggctcagattgtggtgatatatatagccaaaatagtggtgcctaaattcatccctttgctcacctctttttaaactatcaagtgttggaacaaaaatctgttaacagatcttctaatagaattaaatctattttaataaaaaaaagttgcatcgtaattttaaatttccgtgccctatattcgaattttcaaattttagacagccattttttctattttgcatttgaaaattcggtgtgtccacaatatgtgacggagaaattttggaagccatttcgagcgttaactgtgccggttgtgttgcaccgctctgttctcgaaggtgaaggggcactgaattgtgcaaatttttaaaaaaagctaaaatctaatg

SEQ ID NO: 117212 - DNA, 76 bp, Heterodera glycines
  Promoter: Source sequence=SeqID_1500; Location=2072..2147; Strand=-; Gene=SeqID_73997
tcaccggtctaaatgatccgaaaacaaaatttaaattcaaatttaattgcccattttgtgtccacttttcccaatg

SEQ ID NO: 117213 - DNA, 154 bp, Heterodera glycines
  Promoter: Source sequence=SeqID_24570; Location=401..554; Strand=-; Gene=SeqID_55295
ttttgttgtgaaaatgatttatttaccacaaataaattatgcaaaaaattacattcaacagcaaaagcatatttttatccaaaccaaagccaattatttttattattttaaaataaacaaagtaatttgggatttaaatttttagcaaatcatg

SEQ ID NO: 117214 - DNA, 380 bp, Heterodera glycines
  Promoter: Source sequence=SeqID_43998; Location=519..898; Strand=+; Gene=SeqID_71555
aaactgtaaaatttagttcatttaaaaaaattgctaaaattttaatgggaattactaaactttttttgaatttttagttacaaatttcaaatttctccaatgaactctcaactatttcacttggattttcaaaatttgtcaaaaaaaaactccaaaaattaaatgattttcgactatagtatcattttaaaattgttattttttgacaattgctcaaattcggcacgaatctttatttgttttttcaattttggcattctgttttctctctctttttcaaaggcttatgccgatttctgctcggatggtcgccctttctgcgcacgcatctcaacgacgagctaattgatgtcatccaattttactcggactgcacaatg

SEQ ID NO: 117215 - DNA, 192 bp, Heterodera glycines
  Promoter: Source sequence=SeqID_8718; Location=1..192; Strand=+; Gene= SeqID_68948
ctgtgtactcactcatgttctcttacatttttttaaaagaaaagaaacggatggaaaaccgaaggcatcgtcggccgcaacaaaaagcgtcgtcgccccaaattgttttccccatttccatttcccctttctcatcatggcgattgccccaaattttgttgttgttgctgctggcgacgttcctcggccatg

SEQ ID NO: 117216 - DNA, 129 bp, Heterodera glycines
  Promoter: Source sequence=SeqID_42925; Location=1097..1225; Strand=-; Gene=SeqID_70724
aaacaaaattcttaaaataaaaaattttaaaagatgaaaaattttaaatgaaaaaggcactttaaaatttgtaagctgatatttctcgaccagattcacacggtcgatcaatggtatctccacacaatg

SEQ ID NO: 117217 - DNA, 684 bp, Heterodera glycines
  Promoter: Source sequence=SeqID_778; Location=2189..2872; Strand=-; Gene=SeqID_61019
caggcatggaccaaattgaaaaataaaaagcgaaatgcgacaagcgaaatttgcgaaactgaaaaatgcgaaatgaaaaaaaagcgaaatgcgaaaagccaaaatatgcgaaaatgcgaaaagcgaaatgcgaaaagcgaaattttttctacaactttttaatagttaaaatcataaagcaaaaatcattttttaaaattttattccaactttaaaaatcaataaaacgcttttttgaggcgcgctttttccaaaaaaactttttgggaagagggagggggcaggcggcaccggcaggcgtcgccggcaggcgccgccgggaaaatttttgaaaatttgattaaaatttgttgacagattttcaccaaaaaatcatcaaattttgtgatttttgtatcatttttctaatgagaaataagagttttggcgcgccgctgagaacagtttttcatcaaattaccaaattttgcgattttgggccattttctaagaaaaaataggagttttgggggcgcgacggtgccgataggcgccgccggggaaaaattggaaattttgatcatttataaacagtttttcactgaaaattagccaatttataggtaaaattttgaaaaattttttgggaatttaatccaattcttaggggtgtaaaagtcgcatttcgcgccaaaaagcgaaatg

SEQ ID NO: 117218 - DNA, 104 bp, Heterodera glycines
  Promoter: Source sequence=SeqID_14645; Location=738..841; Strand=+; Gene=SeqID_78740
ttttttcacggggcgttcactatagtttacccgagttgagttcaaaattgccgttatattccatcacattactaacttttttagcctcttatttcccaaaaatg

SEQ ID NO: 117219 - DNA, 433 bp, Heterodera glycines
  Promoter: Source sequence=SeqID_12077; Location=4264..4696; Strand=-; Gene=SeqID_75625
gcaaaataggtgctaaaacgccaaaatacgcaaaataggtgctaaaaatttgaaaaatccagtgtctttatgcacaaaaattacaaaaaatgactcatttttgatcaatttcgcctgcacaattgcaacttgtcaagaaaacaaataaataaattttgaagaacgaatttttgggaaaatttttcatttcttagggggtgattttctgaaattttgataaatttttaggggtatattttttaaattttttgggatcgaattttagggggtgtgtttttggtttttattgcatttttgccctgaaatttctggaaaaagaccaaaataggtgctaaaaatcgaaaatgcacaaatatgtgctaacccccaccccgttttaggttttttaggtgctaataagtcgctctaaatcaaaaattattcggataaaatg

SEQ ID NO: 117220 - DNA, 289 bp, Heterodera glycines
  Promoter: Source sequence=SeqID_18441; Location=1269..1557; Strand=-; Gene=SeqID_83037
tttttcattttccattcccctttaattttcttttggtctgtaggatgtttttgtattaatgaatcgagtcaaaaattacatttcgtgttttggggattagaattggtcaaaatggatatgtatctgtttcgcgatcagagacccataaaccatccgggaaaaagtgccattcaacaaaagcccacacatttaaaaaaaagaaacggccgatttcacataatttttcatctttgctaagccaattgaaatctgacgaaaactgtctaaatcatttcccctcaacaaaatg

SEQ ID NO: 117221 - DNA, 136 bp, Heterodera glycines
  Promoter: Source sequence=SeqID_25557; Location=1069..1204; Strand=-; Gene=SeqID_56299
tccgcggaaggaagacagatcaattccaactcattttttctttctctctgttgattcgttttatgtatgtttcttccttacaaattaaaataaaataagaaattctaaaataaatggaatatttctaagtcaaatg

SEQ ID NO: 117222 - DNA, 426 bp, Heterodera glycines
  Promoter: Source sequence=SeqID_33431; Location=1..426; Strand=+; Gene=SeqID_63501
tgaaaaagcgatggaaaatcagtcgaaagaaaaaaaggaggggggggggggtaaaaatataggcccgagttcattatgagcgttcggactaatttgaacaaattcagaaaggtatgggcaaaaaaatctgaaaaactcgaggccctcactaacaataaaaatgtattaaaggattaaaaatgatgaataatgtcattaaaaaaatgatcacctcaaaaaaaggctcgtcaattgggctattgaaataggcactttcgtcgttcggaatgcaactcgttgtgaagttttccaacagcgtaccgataattgggtggaccggaacgcggcactctttgagctgtgctttaatccattcctaaagaacgcaaattggcattgtcggataattatttaaatggcgattgattcaatgaaatccttcaaatg

SEQ ID NO: 117223 - DNA, 362 bp, Heterodera glycines
  misc_feature (13)..(13): n is a, c, g, or t
  Promoter: Source sequence=SeqID_5395; Location=1..362; Strand=+; Gene= SeqID_46033
caaagtgatttgntatcattataaccaaaattgttagcatttacgaatttgatgtttttgtgtgttagagatgtgaaaatagtacgccaacacgagaggaaaagaaatgcatttttactttttgaactctactacaaaaacgggatgtctaacctaaaacatttgatatgttcgatgcagaattttctgctatattttctctgcacagtggagttgacccatagtgttcttgcaaactaaatattgattaaaaatttaaattttttgattctcaaaatgaatttatgaaaagtttagttttttaaatcctaactttgaaattttatcattggttagataaaatttgaagcaattaaaaaatg

SEQ ID NO: 117224 - DNA, 138 bp, Heterodera glycines
  Promoter: Source sequence=SeqID_22417; Location=907..1044; Strand=-; Gene=SeqID_53082
ttctcgtggctaattgttttaaaaaattgtgttttatgtgggcgtttcgccaacaccaccaccgcattaattcgtctcgggtttcccatttattcccatttaatttcaattttcacaagctttccgttgattgaaatg

SEQ ID NO: 117225 - DNA, 142 bp, Heterodera glycines
  Promoter: Source sequence=SeqID_24718; Location=1..142; Strand=+; Gene=SeqID_55463
cgagaatggccccgtcgacgtgtcccttccgcgcgctctctaattttgtgtgccggtggtactcgccgaatttggcaccctatcagcggcaaggcaaacgcaccagtggctagaaaacctacagtctgtgcaaatcaaaatg

SEQ ID NO: 117226 - DNA, 72 bp, Heterodera glycines
  Promoter: Source sequence=SeqID_23829; Location=1742..1813; Strand=-; Gene=SeqID_54527
gagattgaaggggaggaggagaagaggtcatttgttaaggtggaggttcggcggttagagagatgggccatg

SEQ ID NO: 117227 - DNA, 591 bp, Heterodera glycines
  Promoter: Source sequence=SeqID_13330; Location=3533..4123; Strand=-; Gene=SeqID_77195
tttccctttcatcaaacttagccccgtcccatgctctttgttgtgtccccgggtttaaggctttaagccatttcaaattttaagagagaggaatttattaaggaaaagaattacaaaaactatgtgtgagagaccgggaataagttttggtcaacaacaaactcagagcattttgcgtgggtcagtgcactcttaaaagcctttcccaaattctttgttcaatgacctgctttctaattgcatttcagtggacaacattccgtcagttaggcatccatcctcaaagtttcgctcctttgtccattcctacatcggtaggtacaaaggcatgcactgtttcataccgcgtccatttttagaaaattaaacggtccaaattttaaaatatagcaatttttgagtcgttttcaatttgggctttgcatttaaatgtgtgcttacagtgcttgtgttttgtgcttattgatttttgacacgttcgtttaaaactcaaaccctcgcgattcttttatttaaattaattgttgtttgtttaatgttttcagcttaaataattaaacttcaataaattttccatttaatttagccatg

SEQ ID NO: 117228 - DNA, 546 bp, Heterodera glycines
  Promoter: Source sequence=SeqID_15574; Location=2427..2972; Strand=+; Gene=SeqID_79861
gagaaggaagtaattattgattaggtgtatgaccccacgccacttcgccatcttccccctcccattcccctcattcagtttgttattgtgcccaccaattttgacctcccaatttattctctgcatttatttattattttattttcttcggcaaataaacttatttaatttgttatcttcggacataacaaattttggcgcagtcagcaactcaacgacagcgtttattttccaagctttatctcgtgctgatattgcttgtgttgattcatcataaaccgatctttgccatattttacggcacggtttatcaacaatctgtgcaactaaaccgcatctttgccatatcttacggcacggtttatcaacaatttgtgcgacataaaccgaatctttgccgtatctcaaggcacggtttcatcttcgacaagaaccgatttttgccaaatctcgaggcacggttatcgtctatttcaagccaattttacggcacatcatttctccgatttcggcaaattaaagggatttataagccattggaccatg

SEQ ID NO: 117229 - DNA, 1003 bp, Heterodera glycines
  Promoter: Source sequence=SeqID_7000; Location=1011..2013; Strand=+; Gene=SeqID_63541
ataaaattataatttagaaaatgaataagacttttatttttatttttttgttatttcgatttgagtattcgacctctaccaattccggttttgaagaatttataaaaaatcacaaagctatagaacttgtcaaaagctatcaaaataaagaaattaaaacattaaaaaaactccatgaacaaatgcaactaaaaggtattgacttaagtttttgtaccttaagacgctacgtgtcaagactaactattgtttctgcgcatacaaataaatcaaaattacatttacagttcaaaattattatttaaccttattattttattttatcaatcactgagcattttttgtggaacgcccacactgagctttttttgtggaacgcccacactgagctttttgtggaacgcccacactgagcattttttgtggaacgcccacactgagctttttttgtggaacgcccacactgagctttttgtggaacgcccacactgagctttttttgtggaacgcccacactgagctttttttgtggaacgcccacactgagctttttttgtggaacgcccacactgagctttttgtggaacgcccacactgagctttttttgtggaacgcccacactgagctttttttgtggaacgcccacactgagctttttttgtggaacgcccacactgagctttttgtggaacgcccacactgagctttttttgtggaacgcccacactgagctttttgtggaacgcccacactgagctttttttgtggaacgcccacactgagctttttgtggaacgcccacactgagctttttgtggaacgcccacactgagctttttgtggaacgcccacactgagctttttgtggaacgcccacactgagcttttttgtggaacgactcaccacggttcgttgtttgtttgctcttactttgtcaatttcgaaatccacaaaatattaatttggcaaccgacgcagtgattgtgcaaatgccaacaatg

SEQ ID NO: 117230 - DNA, 144 bp, Heterodera glycines
  Promoter: Source sequence=SeqID_21505; Location=848..991; Strand=-; Gene=SeqID_52115
tgtaaggaagagagataaatattattttgaaattgaatttttaagtgcgctgcggtctcggaattatgtgggcgggtgattgagtacgtcgttgggtcatcaaacccattcagcgtccgcaaacgcatcagcttgggcacaatg

SEQ ID NO: 117231 - DNA, 443 bp, Heterodera glycines
  Promoter: Source sequence=SeqID_38366; Location=1..443; Strand=+; Gene=SeqID_67197
gcacgattacgattttgccaaaattggaaactcagcggactccgaattcgaatgcttaacaaaattccaattaaattccgagtgaaggacaacaaaagaatgacatttattgacccaaggacaatgattttgagctccgatgcgagactggcaccatgctcacaataccgcaaagaactcatttttgtacgcggttcgctttacgaaattgatcaaatcgatgcacaagtaaagcaggtaaatgccaaacgcattgaaggttttagcctgaatctgtcgttggcaccgacttatacccgccactcttttttacaccttgccctagtgaatgtgtctgactttattggccaatttttcgacgccaatttggcaagagaaagtgaactcacattccaaattaaaagtgaggacacggttataacaaagactttgtctgagcaatg

SEQ ID NO: 117232 - DNA, 155 bp, Heterodera glycines
  Promoter: Source sequence=SeqID_15451; Location=1..155; Strand=+; Gene=SeqID_79713
tgctgctcagtgaatgcttttgctcggttggcgccatcctccggcggccgaaagtaaaaatgccatttttttttgcaaaattttccattttcacctcccctttttatttcagtgtaacaagtccaagtacgacgggatcaacaggttcaactatg

SEQ ID NO: 117233 - DNA, 90 bp, Heterodera glycines
  Promoter: Source sequence=SeqID_25702; Location=824..913; Strand=-; Gene=SeqID_56447
ttgtcggaattaatggggaaaatggtgcattattaactgatcaatttgctcaggcgaaaacatttgcattcctccgaacttcgaacaatg

SEQ ID NO: 117234 - DNA, 55 bp, Heterodera glycines
  Promoter: Source sequence=SeqID_9298; Location=2480..2534; Strand=-; Gene=SeqID_70902
tttttgtcatcgaattcctcttggtcacagaaatgacccgttcaacgccaaaatg

SEQ ID NO: 117235 - DNA, 890 bp, Heterodera glycines
  Promoter: Source sequence=SeqID_4995; Location=1261..2150; Strand=-; Gene=SeqID_56476
aaaagaattttggcggaggacagcaacagttgccgccaccctcgaggcccggagaatgtcgccaaaagcgacacaaatttcttggaaattttcatttattttttaatccttttcatcgatcaattttgcattcgctcgctcgttaattatgagtcatcttctctcttcctcatatttttatggatttttttccatttgtttgtgcacatttttcacgtgcctggccccgcccccattgatttgtgagggtataaaagcccggcccattctccattttcctcacttcttgcttcttgcttcttacttctcacttcttgattcacttcatcttgtgagatttctacaagcacttctgcttgatcagcattaagtcgggacagttttctgtccaagcatttgcattaaattgtaattgtgcaattgaattgaataaagattaagaaagagtcttagtcttatcattttctgttaaagggacacccaggagccctttaatacagaccattaagccgttgacccccgttgggtcacaaaaggcttatcaaaggaaaggagaaggatttctccttccaaattgtcccttcagtaaaggagaggaatttcctcctttaattcgtccctttggacattcagtgaatttctgtcttttggacagaaattcgctttgcttaaaagactccccccttctgccgggagagtctgcttccccttctgccgggaagtgcaaatttttgtggctttttgcccacaaaattggagccccgtaggggtcggcttccagtcgtaagcctaccctccaaccaaaccaatccaaagcgcggcctgagcgcttggatcaaacacacaacccaaaggggtttattgtgttttcatcaagcgtaagagcaatg

SEQ ID NO: 117236 - DNA, 572 bp, Heterodera glycines
  Promoter: Source sequence=SeqID_22579; Location=714..1285; Strand=-; Gene=SeqID_53244
aaaaaaaaatttgggggaagaatttttgaaaaaatttccaattcttagtggtgtgtttttaaaaattttcgttcgattcttatgggtgtatttttctgaattttttagggccgattcttaggggtttccgttttattgaatttttgttaacaaattttccaaaaaatggcaaaatatgcaaaaaatctgaaaatatgtacaaaaaatcaaaatatgcatgaaatatgcagaaaaaccctaaatatgcaaatatgcacaaaaatcccgaaatatgcaaataaaagtcccaacttttataagcaaataccaaaaagaaggtgtttttcgttctatttggactacgtagaatccaggaaaaaaatatgcatttgcataaaatttacagccctggtcataactcgcttcaattcacctgaaccaaataaatttgatatctattttctattagtgcgcttttttactgtcaagcgaattatttttctagtgggaaaaccagaaaattgttttcattaaagtaggaatagttttttatgattgcctatttagcttattatcgatctttttcaaaaatg

SEQ ID NO: 117237 - DNA, 354 bp, Heterodera glycines
  Promoter: Source sequence=SeqID_18207; Location=1627..1980; Strand=-; Gene=SeqID_82804
ggtgggtagaccacccctgggttgtattgccaaattttttttctagctgcggaataagcttctgtgccgagatatgaggctttaaatatttaataattatattatattaaatttaaaaggagaagcaacaagcgaccggttggcagggtggttgtgtgtcacgatttcatttttgtaatggaaagttcgagtcccccctacgcaaacattttttttattgtttttaataaaattacatatttagataatttaattataatgcaagttaatccccaaaatattatttctttacttcaaaaacatttttcgaataattttaatgattcaactatttcgcctgtcgagattgaaatg

SEQ ID NO: 117238 - DNA, 221 bp, Heterodera glycines
  Promoter: Source sequence=SeqID_5714; Location=1..221; Strand=+; Gene= SeqID_59004
aaatgaccggccaataaatccattagatctcgttaaaaaaagaaaaccttttgatcaaatggtcaaatgctgacggaaattgctgggcccactggtcatcgaacgggcgacatggaaacgagcaaactaaaaaagtggaaattaaaatttgaaattttgatgttatgccaatcacacaacctccgatttgggcggtgacacgcaacagttgaacaacaatg

SEQ ID NO: 117239 - DNA, 632 bp, Heterodera glycines
  Promoter: Source sequence=SeqID_2423; Location=1..632; Strand=+; Gene= SeqID_79640
tcactatttcggactttttgtcactgtttatttactatttcgacattttttggaaaaattccttaacaaaaatgcaataaacgaaaaaatacacccctaagaatcgagctaaaatttttcaaaatatactcctatgaaatgaaaaaaaaattttctcaaaaatttactttcttggcaaaaatttttaattttaaaaacttttttaggtaattattttgggttttttgctcataaaaatcccagtcctactcatttgcaactgcaaatagtgaataaaaattatttttgctcaatttttggctgaaaattatgtcactattcgtcactatttcggactttttgtcactgtttcttcactattttgggatttttactcactattttagttaactatttcggtatttttcgtcactaaaagttgcggccctaataattacgtataaaagaaaaaggattaaccagaggccatcatgccaaaaagcagttgctgatcctaacaaatacaataagtgggattaaataaatgccaaattaaaaattgtagaaaaaataaacaaaatcgaaatgcctatgctttgctaaaaaaatattattttttttcaaaaaaaatatacaataattcagctgaaatg

SEQ ID NO: 117240 - DNA, 83 bp, Heterodera glycines; identical to SEQ ID NO: 108673
  Promoter: Source sequence=SeqID_31598; Location=749..831; Strand=-; Gene=SeqID_61921

SEQ ID NO: 117241 - DNA, 420 bp, Heterodera glycines
  Promoter: Source sequence=SeqID_15675; Location=1085..1504; Strand=-; Gene=SeqID_79982
acgatgaaaatgatggaaaagaaagtcggaagtgacttgctttttctctttttgacaatggctgcaaccaatatttgttttaaattctcacttttatcaatccccgccaataaaaatagagatctataaaacttctcttaaaaaacaaaattttcaaatgaaattgggtgtcatgctttggctgatctctattcctaatctaaatttggtccgactaattgtttgcttgtaatttaatgatttatcctttgacctcttttaataaaattttcatcgaattctctgaatttttacattaagtgccggaagaatccaagtccaatctgtttttatcagttgtttcaaaaaattctgtttttcatttgtcagcgtcaaagttggcctttgttttgactgtccattggcattttgttggacatg

SEQ ID NO: 117242 - DNA, 964 bp, Heterodera glycines
  misc_feature (41)..(41): n is a, c, g, or t
  misc_feature (58)..(58): n is a, c, g, or t
  misc_feature (64)..(64): n is a, c, g, or t
  misc_feature (93)..(93): n is a, c, g, or t
  Promoter: Source sequence=SeqID_3825; Location=749..1712; Strand=-; Gene=SeqID_52023
agtaatgactatgagattctttttcttcaaattcatcatgnatgaataataatgattngatatnttatcgtatatagtcatgtttttatgttntaatgaacctttttttaatccttcaatttgattatatttctgtataattattactttcttgcttcatttttaaaaatttgctccaaaatgatatgtatttattttgtttagatttataactgaatattaaaaaattttaaaaaggaaatttttatttaatttttttacaaaactttaaaaaggaaattattatttttttacaaatttttaaaaagaagttattttttatgaaaaattttgttagcaaatttcatttcactttattttccggcgacatttgttggcatcgccaaaccaaaattccttaatttaaaaaaaaaaaattaaagaaacattttttaataagaatctattaaatgctattttcaacaaaacataaagactgttactaattcatacacataattgtttattgtttttgtatgtcattcgaattttcaattaaaatttacaattatataaatatattttcatcaaatttaatttatttaatgccaaaaaattattccataatattatttttatttttacataggtttaaatagttttataaattttgataaagatgataaacttttaatgtttggaattatttttaaaatgtgtaccgctcaaccctaatttaatttgtattttgatcattttattcgtcgaaataaaaataattattaaatttattttattcgctttattccttgaaaacaattacctcagtaggtgtctaatgaaggcattataataaaataattaaattaatcacagtttaattttaaaaataaaaatttaattaactaattaaaaaattaatattttattttaatcgatttttctcttcgaaaataattaccacacaattcagattcgcataatg

SEQ ID NO: 117243 - DNA, 264 bp, Heterodera glycines
  Promoter: Source sequence=SeqID_5323; Location=3637..3900; Strand=+; Gene=SeqID_57682
ttctttggatgtgttgggactacgccaaaaaacgacacgtcaaaaaaggacgacgacggcgacccattgacgacaaaaaagaaaagtagcaaaaattaataattaattaagtttataattgtttttcagctgcttcatcccccgtggcgattggcggctggcggtctttgcttttcttgcgccttctcagcttggcctcgaaattgcactgctcagccaccgatttgactgtcttgtcgatgaacactttaaaacgagaaaatg

SEQ ID NO: 117244 - DNA, 1003 bp, Heterodera glycines
  Promoter: Source sequence=SeqID_28976; Location=661..1663; Strand=-; Gene=SeqID_59547
attagatattttttaattatataaaatgtatctattgtttagtgctgtttgagactctcggtcttgagtctcgactggggaaaagtctcgggtttttttggtctcagtttcggtctcgggtctcggggacaagtctcagtctcggtctcgagtctccggaaattttcggtctcgaactgcactattattgttcaggtcaatgatgatttttttgagatggtgttttgaaaaaaatcatcaaaaatgggcattttttaacactgctaaccataattccaaatttttcaaatttatagcgaaattttgccttgaaaattctaaaatttttctcggcggcgcttatcggcatcacagacccccaaaattcttttaaatttacaaaatttaactgaaaaattgccaatttttggtgaaaatcattaaatataaattaataatttaaacagaatatatatttaaatttaagaccaaaattgtaatttaaataaaattcgattattaacatgtatcggaagacaaatagaaaaaaaataaaaaactgaatcaaacttggtgtagtgttagtgagttattcaaaccttttttaagtgacaggttcgaattaaaaataaaaacaattcaaacgaaaataataaattattttatgtctaatatcaaaatttaaattaaatataattttttaaaagtttcattaatttatttcaatttaaaacgaaaaagtaataatttttattaaaattaatgatgaaatttgaattaatctaatccaattttcacaatttgagaatttgaataagaaaagtacaagaactaacattgattgttttaaaattttgaaatgtaattaagttcgttttaaagaaactttacaataaaaagtaaataaatgtgtacgaaaatatatgtataaaaataaattcatttaaattattatttaatatggaaattaataatttatgaaaaagagtcagaaatcaactacataaaatgaattttcagcatg

SEQ ID NO: 117245 - DNA, 98 bp, Heterodera glycines
  Promoter: Source sequence=SeqID_6946; Location=4017..4114; Strand=-; Gene=SeqID_63367
tcccgccgtctccgtccccgtgctgttcgccgctgcccccgtcgcctccccgcccctactgcggctccccttctcttccgttccctcaaccccaaatg

SEQ ID NO: 117246 - DNA, 385 bp, Heterodera glycines
  Promoter: Source sequence=SeqID_3630; Location=3351..3735; Strand=-; Gene=SeqID_51202
ttcttggggtggcataaaaaattataaaaatattttaaatcgtctggtaccgtaggatttcgaggacaatcggaaaaaaatctgtatccgaatttatcgtatttagaccagaaaatacatgtatgatccatgccaatcttttgccaaagtgccaaacaaaatctttggattggccatctactgatcagagacaaaattacaccagttggttcatttgatcaatcgtccttacaaattctaggattcaccgcttttgatcaattaaatggcgtttccataattaacaaatttgattgatcacttgcaattttaattttctatagctttttggattaaatcaacaaccgcccaaaattcggcaaatgtttgagtcttggcaataatg

SEQ ID NO: 117247 - DNA, 1003 bp, Heterodera glycines
  misc_feature (382)..(382): n is a, c, g, or t
  misc_feature (421)..(421): n is a, c, g, or t
  misc_feature (427)..(427): n is a, c, g, or t
  Promoter: Source sequence=SeqID_10396; Location=841..1843; Strand=+; Gene=SeqID_73591
aatttttcaaaaaaaatctcatttttacccatttcacaagcacaattctaatcaaaagcatttcaatgctttttgaagcatctttttctcgctttctaagattttaatcattttttggaattttcttctctgaaattaaaattttgccttaaaagtgaaaaaagtaattaaaaaggtcaaaaagtacaacaaaaaaaaagataaaattttgaaacattgttggacattttgccaagaatttaggtgtcagaaagccgctacttttgaaaatttgtcaaaaaatcgacaaaatatgtgctagaaactaccaaacccccaaaatatgtttttattagcaaaaagaccaaaatatgtgaatgttaaatactataactttaagtanattatgtatttgatttttcattttaatacccccttttgngacttngaaaaacgtccgatccaaccctcaaaaatatgtaaattttaattcttctatagctctaagggttttatacatagtagtctgtaaaatattaaaaaaaaatttttaattgcaaatttcaaaaaagttatggccatacaaattcaaaaaacttgatgtttcgaacattttttagcctaatttttttttaaaactgaacaaattttttgaaaatgtccgtccgcaattgtccgtaaaacattttagcatatatattttcttcgataatatgttttaaacgaatacacatattatataataaaagccacgttattatattattgatatgctggggatgttttatattattataggcataaatatttgcataatgattgttgggctgacgtcactatgtgtataataaattttaatgttgaaatatattgtattgattcttcgattttatgaaattattcgctattacatacattcattttaaacaaatacgagcatttaaaatttattcaatttattagttattaaatttttatatttctctattatataaatgattttaataaaaaatatattaagatg

SEQ ID NO: 117248 - DNA, 470 bp, Heterodera glycines
  Promoter: Source sequence=SeqID_45203; Location=1..470; Strand=+; Gene=SeqID_72547
ctatgaatgatttttgtcggggggggggggcgggctcctcctaaattttttattgccatccattaatccaagccaaacctcctcagaccataaataaatataataaattctatcgtatttaaatggtgtttaacgtctttaaatcaatcattttatttttatttttacggaaaatttttttaattgttattttttgttttgacttcgttaccaaagctaaaaattaaaaaatgttaaaataaaataaaggttttattgtgctttttaagctgattgttccggcgcttttgaaatgttttcttaccctgatttatttcaacattaatcaaaaataaaagtataaatttgactgattttcacggcaaaaaaaaatacgaaatggtattttccccttccctcttttttaaccccatttcaaaaattttgcccccaatttaaaaaataaaattatagtcaaggctaaaaaaatg

SEQ ID NO: 117249 - DNA, 516 bp, Heterodera glycines
  misc_feature (21)..(21): n is a, c, g, or t
  Promoter: Source sequence=SeqID_21779; Location=1338..1853; Strand=-; Gene=SeqID_52386
gcaaaattaataaacgaacgngagaaataatggcttcgcaaaatgtgaaaaattaaaacgctaattattacaaatcataaaaaaataatgctaataatgggcgaagaaaatgggattttaaggggaacaaattgggagaaaaattagtgaagcgaaatgttcggatccacccaggagcgccatgacaatgccctatactctggggtctgttgggactcggggacacccaaaatggggcccctcgtcgcagccccgggctggccaaattggcccaaaacaccaaatccccaaattcgctgttcgatgtcccctttatttgttgagtaaaaaccaagccaagcgaaacaaagttgaacaattaacagaatgaatgaacgaacgggccaggggaattgagggtggcagaaaggggaggggcagttggtcaattgaggggacaaaaagtgatgagaggggctgacacaaaggaagggggaggaactccaagcccaagccaaaggggaaccccggccaatg

SEQ ID NO: 117250 - DNA, 72 bp, Heterodera glycines
  Promoter: Source sequence=SeqID_20426; Location=2311..2382; Strand=-; Gene=SeqID_50962
ccttaatcgggcaataaatcccgagaaaaggccccctatgcccccggtgttcgagaatggtatgtaaaaatg

SEQ ID NO: 117251 - DNA, 106 bp, Heterodera glycines
  Promoter: Source sequence=SeqID_3190; Location=2188..2293; Strand=+; Gene=SeqID_83600
cgaggcaattctcggggaattgcctatttttatgtaaaggcattcaaatgcccgattaatcccaattttccgtgccattgccattcccccccccccctcagaaatg

SEQ ID NO: 117252 - DNA, 125 bp, Heterodera glycines
  Promoter: Source sequence=SeqID_33850; Location=802..926; Strand=-; Gene=SeqID_63795
taaactgatttgaccaaaatgctatttcgaaaattgaaatcaaaaatcttgaattttcaaattcttttcgtctttcttcttttctttttttatgatttctccattcagctttgttctatgagatg

SEQ ID NO: 117253 - DNA, 645 bp, Heterodera glycines
  Promoter: Source sequence=SeqID_3286; Location=3409..4053; Strand=-; Gene=SeqID_84070
tattggtcatgaaatttgaatgaatgaatgaagagtgaattaaaatatttttgtgcccggttctcatgggctcattaattattcaatagttaatattgacttcaaaagacatttgaatttgccgacaatagtgaaggagataacttcaaaggaaatttgaatttgccgacaataaggaaggagagttcgagaaaattaattggtattcggatggggacaccccgcccctagacttcataaatactcagtccaaatcacatttcattcacatctgctcatatccttactcactttaataataaaattgtaataaaatttttattttattgctgttaaccagggcggttgctccaattattgggctccgtttatcctggcagcacttgtgtgtcttttagggcttggggttgtgcgcgtgacctttactaattacccgagccgtttaggtgccctgtcgtcttgtgcttcatgggtggcagtgcgctgctcttcagggcatagttggtttaaaatttttaaaattattattattattatccattaatttgcattcacaacgacaatttccatgcctcaaaaatatgtgtcaagattgttcattttatccattcaattcattatttttccctgtaaaattagataatg

SEQ ID NO: 117254 - DNA, 1003 bp, Heterodera glycines
  Promoter: Source sequence=SeqID_8540; Location=707..1709; Strand=+; Gene=SeqID_68447
gacattggacgcatcgaattggacattggacgcatcggacaattgacgcatcgaggaccaattgagtgcactgtcttggtgcacgtctcagcgcgccggccaaccccatctaccaagacgtgccccggacaactggcgaccttttgtgcacaggcgggttcaatttttttcccaaggggaggtctgattaatctggtctcatccagaattaatcagtgctttaatttctgttcccacctcctcccaaaaaaggcaatcaagttcagtctggactgaaattttcgaagtctcatcttcgaacagtcaaacatttaaagtgcccaatttgaatttgcccgaaaaatctcggcatttcatttccatttcacattttttttgtttttgtccaattacatttattcaaaaaatctcgaaatctcattttcgagttcaaagttttgtccaatcctatcatttcatttctatttcacattttttttttttgtttttgtcccaatctcgaaatctcattttcgagttcaaatttttgtccaaacccatactgtccaatttttcgaaattttattttttgagtttaaattttttgtccaatcccatttagtccaaaatttcggaatctcatttccgagggtctaaaattttttttttttttttgtttttgttttgtgttttgttgtgttgtttttgtttttttttgttttgtttttaacccaaattgtccaaactatccgctcttgataaaatcagagtcttagctctgacagtgcgtggtaaaaagggctcacaaatcgtgaatcgtgtacccttccccttttctgggtttttgttcccctctttctgggtttttaattactgattctcaactcagaacgcagttcggttattgattaaattggagtctcagttccaaagttttaaattgttcggtcacagttcggttattgattattgaattggagtcttatctccgaattttcgaatttggtcagtgatttgagcaatg

SEQ ID NO: 117255 - DNA, 62 bp, Heterodera glycines
  Promoter: Source sequence=SeqID_44379; Location=1..62; Strand=+; Gene= SeqID_71875
gataaaataattgaaaaagtttctcaaaatatggagtgactgatcaacaaaatgtgcaaatg

SEQ ID NO: 117256 - DNA, 577 bp, Heterodera glycines
  Promoter: Source sequence=SeqID_3649; Location=1..577; Strand=+; Gene= SeqID_51279
attctgtgaagagtttttctaataaaatatgaaaaaatatctattatttaactaaattcttataaagtaggggagaaaaaaatttaaacctttatttttttttatcttttttttacaaaatattgaaatgagaaaataaattttgtgcctattcttaaacaaaaataatttaaatgtaattcattttcttctcttcgtaattgggtccaaccaaaagtcaatctctctatattttatatgacttttgctatccaattaattaaacaaagttttttgtttgccatgcaaaaatttggtcgcaaattctgccgcctttctcccgggcaaccgaccgaccattccaaaagagcctcgcttcgtttgttggcttttccctcctccctcacccccttctctcatttgtttgcattcactgccatttatcaccttaatgaagagatccacgagcattcaatttgatcacaaatccgccgatcattctcctcccgctccggcgacgatcgccgccggagagagtcgaaacagcggcaacagatcgcctcatcagcctccgcccgcaacggcgcccattccaatg

SEQ ID NO: 117257 - DNA, 559 bp, Heterodera glycines
  Promoter: Source sequence=SeqID_7652; Location=1..559; Strand=+; Gene= SeqID_65516
ttttgagcggttttcaaaatttaaaaaaaatgtgcgtgaaggcactcttttattccaaagaaatggacaatttgcaaaacaagttaattatagttgggattttttgataaaacgaaattatattctaacgtatcagcagggcagtaatttatgactcctggcctttaaattgaaaaaatttgtttttatttgtaagccctaaaataaatcgtcaagaaacaaaatgataatttaacagaaaatatttgacttttgatgaaaccgaaaccttatttatccctccccctaaattttattttttaaattcataccaaattttacatttttttttataaatcctatttttggcttttcaaatcccatatcttacctattttggagtttttctcgctaaaaagattggacaaacttatatgtagagagagcgaagacggctgaacagcgataaaaattgaaaattttgcagattttatctaggccaggagggggggggggggggctgactggccggcaattttaattttaattattttcaagttttttacaaaatgctgagatg

SEQ ID NO: 117258 - DNA, 596 bp, Heterodera glycines
  misc_feature (6)..(7): n is a, c, g, or t
  Promoter: Source sequence=SeqID_30878; Location=609..1204; Strand=-; Gene=SeqID_61262
atatannttttttggaaagttgggtggaattcattaaattttcgatgttttctgtgctcctatcctctgcttttgaaagtgcaactttaataggcgtagaaatttcacaataacccgggccaagagtcgattaaccaatttctgaattaaaacaggggggaaacgaactgctccaaatttgcttgcgcacggggatggaatcgaaagcttaattaaatattttataaactctcgaactttttttaaaattttaggaatttttcaaaaaataaggaaacttataatttcaagaaaataattatacataatttctcacgatttcaaaattttatgatgaattgcaagttttttcgaaaaatattcccaaaaaactgctgaaatttttttgaaaatttcaaatgatatgggtgggggacatccgggggcgggtggaacggtgggatagggggcgaaagattaaaaataatcgtttggtggtttgtcagacacataaggtattaagcttagcgtagcaaaagtcactcctttatcagactacataaggcaatttccgttttccacgtatattttcaataaaacatttcagcaggacgatg

SEQ ID NO: 117259 - DNA, 1003 bp, Heterodera glycines
  Promoter: Source sequence=SeqID_9987; Location=330..1332; Strand=-; Gene=SeqID_73030
gatgaaagggggggggggcaaagattaaagggattaaataaaagcaaagcgaaacaatgggaaaaaagcgaaagcattgctttttattcagccaatcatttcaattcttttccatttcaaattgtcagtttcaaagtgtttcttcttcttcggttcttctcgttttcccatttctcttttcattttcctttttctgtcgttaatttgtcatttttcggtggttattttatttttttttcggccctttcctccgtccccaaattgaaatgattgggacggaaacggccattcgtttcgcgcattgccttcactcaaaccaaaccacgcttctcactaattaattacctattggaaataaataacaatgcacaaacttcgcaattctcttctctctttttcattttccattatttttttttgtcaaattttactcttttttttgcattgtccgttttttcttttttattttttgttcatttttaatggcgctgccttttcaaattactttttttgtcttggcccatttgaccaatcgccgccgttttttcgctctttgcgatgttttggccatacttttgctgttttgatatgataatgataattcccctcctttcaattccattgcaatttcaatcgatcatttccatccatcggtcgtccatttgtcatcccttttttgcctatgtacattaattaactaattaataacttgttgttgtttccttaacggtgctgctaattgcctcggctttccgctgaattggaccaaataaaatgatggaagaatgaaaagctatttccgacttttatatttctatttttggggcttaatattctttttataattttcaattgccaagaaaaaaaatttcataaaattacgcaacaaaatacaaaaaataaaaatataaatgcaaaattaactcttaaatatctctgatattttcaacaaaaatcacttctgtccctttgccagtgatttctttgccctttccatccaatg

SEQ ID NO: 117260 - DNA, 55 bp, Heterodera glycines
  Promoter: Source sequence=SeqID_17400; Location=1946..2000; Strand=-; Gene=SeqID_81879
cttgcggcgccgaaacaattggtcgtgggacagaatcataaagcatcggcaaatg

SEQ ID NO: 117261 - DNA, 52 bp, Heterodera glycines
  Promoter: Source sequence=SeqID_1940; Location=2557..2608; Strand=-; Gene=SeqID_76926
tttttagcaaaatttatttcttctaaataaataaaagaaatttattaaaatg

SEQ ID NO: 117262 - DNA, 787 bp, Heterodera glycines
  Promoter: Source sequence=SeqID_26135; Location=669..1455; Strand=-; Gene=SeqID_56883
tttcgtcgccgaccaaattcaaatttgactctagcgtaccgttttccctctcacctgtcaatcaaatttcaatctttcgggactctatgcgcttcgttttcccttctggcggaagtcatgcaccaaaaaacgtcccctctcggggtgccatccccttcccacctgtcaatcaaatttcgtagcctgccaaaattcaaattttggttctctcgcaagccatccttctctgctggcgttcaaattgcttctttcgccggtcttttcccttctttcaccacacacaccactgaaaatcgatcacacccttccgctaattactccgccccttcgcatttgtgccggaattggcgtcctttcattcactcttctactctctcaaaaaatcagctttttcaaccaaccttctcgcccagctaatttcttttttattgtcttcaatttcctaatttaattcgtcctttttcaattcttcttctctctatctgtttttttgtcctgacatttcgtcttctatttattcccttttcttcaactttttttgctgaaaatgtctcgtttctgccctcgcgttgaaaccaaggaattgggacgcctttccgctccgaaggggaaatttagtgagttcgaaatcactttaaattcagcacaagatttgcaaatctttaacttttgtttaggcctattttactcccttgaattcgcccgaaattaccgattgattggaaaggagataacggaaaacaagtttcgttatctcatgaaaacagagaaaaaacaaagagaaatg

SEQ ID NO: 117263 - DNA, 667 bp, Heterodera glycines
  Promoter: Source sequence=SeqID_30115; Location=1..667; Strand=+; Gene=SeqID_60555
tgtttcttctccttattaattgcctcttcgcgatcggctctcttctgacaatttgtcttaatgttatcaattgcgacatgctttttttctttgttttgcttaattatctctaaaatacgcttcatgaacaacaccgacttcatcacttcctgcaaatgaacaaacaatgaaaattgcatttgcatttaagcgtcactttaaactttaattatattaatcaattatacatttaataaaataaaatgaaaaatcaaataaatcaaaatcttcaaaacgttcattatttattctaaaagcctaaaatgatcagaaaatgagcttggggcgtgcttgccaattttctgaagaaaaaacccggtactgaagtgtccattttcaacgggattcgacgttttttcgtaatcaaatctctcgaatttctttttctcgggttactaatttattgaaaaatgaagcaaatccctaatttgatttgcctttaagtgctcaagttcggtcgcgcttgagaacatcatttgtccgacaatttcgccaatctttttctctaacccttctattgcacttttgtgactggtgaatttcatacaaagtttgccgaacaaacaatcgaaaatgccatggagaatccttttttgttccgccttataaatgggcgaggagggcgatg

SEQ ID NO: 117264 - DNA, 210 bp, Heterodera glycines
  Promoter: Source sequence=SeqID_8224; Location=23..232; Strand=+; Gene=SeqID_67355
cgttttaattgcttaaatcccttcaaatttaatccttttttttctgtttgagtgtacggcgcggacggagaacaacagcggcattttcttcccgattttcacccaattcacaaattttgtattgggtcaaatactttttggtgattcctcctaaatccaaattcatccgttaatccgtcgcttttctgaccaaagtccgttttcccaatg

SEQ ID NO: 117265 - DNA, 194 bp, Heterodera glycines
  Promoter: Source sequence=SeqID_37961; Location=779..972; Strand=-; Gene=SeqID_66922
tctcgaaattaaaaaaaatttacaatcaaaagccggattactgttgaattttcctgactcggactagccgggggctcccggataattagtgttgtatgacaaagtcgctggtggcactgcctgtggttgacccgggctttgcggcgtaggcgataagcacggtgccggcggctgtcgcgtagtcggccaagatg

SEQ ID NO: 117266 - DNA, 544 bp, Heterodera glycines
  Promoter: Source sequence=SeqID_12581; Location=2283..2826; Strand=-; Gene=SeqID_76245
agcattaaatcgtcaagtatcagtaagaggggttttccttgttctttaatcttattcatgtccggaatcccgttaaaactctcgacaccctccccgattaatcctaaaatactatcattcatctcaccgtaacaataaagaattttggtgggcgatggttcaattagattcttatggtgttttaaaaaccgtaatagccaacgggtcttaccactcccggtagcccccgagagaattagagtgaacggaccgcgaaacatttttaattcctcttatttatttgacctatttatattttcataggaacatgtttcgcgcatttggggcatagccagaaattatcaaataatgatgtaccgaaatgcaaaagactgtgctatttacacctgctacaaatctcgtaatgacagggacagtaatgacaacacttaattttatgtgggcagttcatttttcaatttaattttattttgggttgctatttatagaaggggtatataaagggagtgaaaggaccatttgattgatacattgtatcaaaatg

SEQ ID NO: 117267 - DNA, 168 bp, Heterodera glycines
  Promoter: Source sequence=SeqID_3736; Location=4645..4812; Strand=-; Gene=SeqID_51682
tttgttgttttaggacagatccgtgctgtcccggcagtcaaaaagtggtttcacttatgtccaattacgttggcacttttgccaattccatttccaagtcatcgctttgttcggatgcccaaaatgttgcggacgcgttgaaaggccaactgatcggctgctcgaatg

SEQ ID NO: 117268 - DNA, 333 bp, Heterodera glycines
  Promoter: Source sequence=SeqID_23048; Location=1..333; Strand=+; Gene=SeqID_53753
aggtacaacagtgatcagaagaggctcaacagtgaatagaagagtacaacagttaatagtagttacatttactcgcaggttttgtacataatagtttaaaatggttaaatcatggtttcataatcatattattaaggacattgttttatagcaaatataaataacactgaaatgtgttaataatttcttaaacatgataaaataaattaacacgtattgacatgtttttggcagtgaattgttaaaaaaatgttttctttcaaaaatcctgtctatcgccgtttgtaacaacccccaaactcattcaagaattctggaacgtttatcaaaatg

SEQ ID NO: 117269 - DNA, 1003 bp, Heterodera glycines
  Promoter: Source sequence=SeqID_2128; Location=2423..3425; Strand=-; Gene=SeqID_77997
tctcttgctctgtgtatataagttgtagacctatcattcaaaaggcaatcggcagagaattttgtcctctttctgacaggcctactgtctgatcaagtaggtgtaaacgacttttttgatcagcatcaaaaatttagcattcagaatttttttcacaaaaataatttgaattaaaaaccggaaaaagcatttttttggctcacgtgacctttaagcatttcattcatttccggccaataaattaaatatatttgttattaaaaatcggaaaatgcatttttttaggcttgcgtgacctctaaaatctttcaattcatttccgaccattaaattaaatgtgcatatgtataactgtttatttgcagtttatttttttcattttcaaatcgatttgttttataaatttgcattataaaatcacttttcctacttcataaaattcattccaaaatgtttatatttttaaaaatatttttatttgcttccgttaatttggtgacgagctcaccgacgcatgaaggttttagtcaaaacaaaatttattctaataatatttttttagacaaatattaaaaactttaattaaaaaatataaaaagaattttgtgtttttaagttttttctgcaaaaaatttcaatttttcaattaaatttaatattttaatagatttttgtttttgttaaatttttattaaaatatttttattttgtttaatttttaatttgttgttgagagtttttttaaatatttttagtatttacatttatttatttttattttttaaaaaaattaataaaaatttttaattattttttttcgaatcgtccatcgatgtgccggcagaaaaagtgcaccttttggcaaaatatgtgacaaaagcgtataaaaatgagtcggaagcgctggaagtggcgacaaatttggcggaaaatttggtggcggacaaaggcattgtgagaagcgccccgcggggctttgaagcggccaaaattgatcagaatg

SEQ ID NO: 117270 - DNA, 134 bp, Heterodera glycines
  Promoter: Source sequence=SeqID_45518; Location=1215..1348; Strand=-; Gene=SeqID_72796
gacacaatcatggtgaatgggataagaaaattgcccatcctcccttttaaattgttggaaggcgtccattttacttttttatgtaaattttctttttatttatagttttttcattttcacagcttaaaaaaatg

SEQ ID NO: 117271 - DNA, 211 bp, Heterodera glycines
  misc_feature (32)..(32): n is a, c, g, or t
  Promoter: Source sequence=SeqID_9203; Location=2153..2363; Strand=-; Gene=SeqID_70586
gtcaataccaaaattgtttatgcaaaccgacnagaaaaaagggcggaggatcggcaattttattaaaaacattgatcccttatcagacacttttctttgggacaaaattccaatgcgaaattatacacattaaattactttttaaaaaaccaattcaaattataaatatatatcgtccaccgaattgtaaaatgatcctatgtcaaatatg

SEQ ID NO: 117272 - DNA, 260 bp, Heterodera glycines
  Promoter: Source sequence=SeqID_18750; Location=528..787; Strand=+; Gene=SeqID_83424
tttgtccgcatgggtcgcggtttgcacagcgctggtgcgcttttgatcatcgcgcaggtctgttaattttgggcatctacccacgcttccgctaaacccctatttctcaattaagattgtgcgcgccggattcaaagtgcgcaaatttttgaaggaccgcgccttcaaaaagggatgctgcgccgccatcgccagcgtgagtttcgcactatttgaattacatttttagcaaattgtaattaacaatttgtacaggaatg

SEQ ID NO: 117273 - DNA, 183 bp, Heterodera glycines
  Promoter: Source sequence=SeqID_177; Location=1724..1906; Strand=-; Gene=SeqID_76513
ttccacctgaaacaacggcagaaccaaatttcggacatttttcaatgctagaaaagcactggtacgacgagaagctaaataggcggacatatatttccaacatcacacgacgagtgagcagagagatatagccccccccccccccgaacatgtcgcggattattcgattttaagacccgaatg

SEQ ID NO: 117274 - DNA, 484 bp, Heterodera glycines
  Promoter: Source sequence=SeqID_20819; Location=1920..2403; Strand=-; Gene=SeqID_51401
tttagattataggtttaatagtaattactttttgctagtttaagataattggtttctttctttcgcatatataagaagcaatttaaataattgtgaattttttgcgattgtttctttaaaattcatttttatgattcttttaattctctataattgctttttaaattaaaaaaatgtactagttaccttttgtaagtatttaaatataagtgtttaaatatcataataagtatatttaattattaatttttttttgtaaaaaatgaaagaaattatttttttaaatattttttgaatataaagccgcatttatttgactttttgaggtttttgttatttttcgtagatcaaaaaataaaaaaaggaagttataaattccgccacccatgcgcgttttataaatccgccagcacatttttttgcatatatctttaataatattaaaattttatgcaataatttcagctatattttatacaaaatg

SEQ ID NO: 117275 - DNA, 1003 bp, Heterodera glycines
  Promoter: Source sequence=SeqID_12230; Location=1200..2202; Strand=-; Gene=SeqID_75803
ttaatgggatgctaattaacaggtaattaaaaatagtaagagggatgaaacagaagctaattgacataattaaccgtataactaaacgttttttatgaatatttgtgggtgataaacatgccaacaattaatcaagaagataaaagagtaaattatcaagacatgtttgtgacactgtttagtattaattaattcataaatcttacaaattaaaatgaattcaaataaaaaactttttggtaaacttttttaataattccaataaaaataaaaaatttaaataattttttgatgtatttttcatttctaataaaaatcagtaaaaaaaatataaaaaattttcgaaggatttttaatattcttgtaaattacctattcatacaacccaaaaagtcattttaattaatttatttcaagcattttctcattttgaatattaaataaaatatttaaaagtattaatcacatttttccatttgaactctttgcgacaaaattaattaattgcttttacaccaattggcattgaaatgaggtgatacacaacaaaaaaacaacactttgtgctgcagtgcgaaaatttgtttcacttctcccgcccaaaaatggtcgcgtggccataaaaatttgaaacaaaaaaatcattaacaaaaaaaaaacatttacggagagaaagaacggagggcggacgggcgggcggccgagccggccataaaattggacggattgaaaaatgtgaaacaaaaaaattgacatggacaaaaaaagggcgggagaaaatgtgagtgaatggggggctgccccacattttaatgggcaataataataataataataataatggataagtcgggttggttgatgatcatttctcattctgtgctgcttggggcacacttcaaaatttgcaaagcaatttttgccctgggggaaatttaaaaaaaaatttaaaaaaatgaaaattcttttgccctaaggggattgatgcgcaactattagaatg

SEQ ID NO: 117276 - DNA, 780 bp, Heterodera glycines
  Promoter: Source sequence=SeqID_25177; Location=849..1628; Strand=+; Gene=SeqID_55908
tttatttgctccatttattctccgcgcaaatgggccacaccttaagaaatttaaaattccttatctaattcgtcattaatttagcaaaattatgagattttacatattcaaaaatagttctcgatatttttcaaattgaaaaatcggaaattctgtaaaatttctccattagctttttgggattttcccattttttgaattgtcacattggacttttttttgtttttggttttctctgttggctttcggcattcgtttgttttttgtttcgttgtggtgaaattttgtaaaaaaataatcttctttacctgattaattttttttaattaaattaaaatataccaacaatataaacacgcaaaaatattttttaatggattttaacttttgagcttttctttatataaatctgagttgtgttgtgttgtgtttgttctttaatttaattggaaaattcttttaaagaaattcaatattcccttttttcaaatgaaaaaatgagtccattttatttttagagaaaaattatttatttatttattttcaattggcccaaaaagctttttcttaactgttttaaagccaaaagatgcaaaaaatcttttttgtttgatttgtaatttgagttgaatgagtgggcgaattttgtacaacaaaaagtcacaaaaccatcgcaattgtttcaacaatttgggcaattttcttttgccatttgtccaatttttgtcggtataaattaatttttaatgctaatttaatcttcagacagtcataaaaatg

SEQ ID NO: 117277 - DNA, 134 bp, Heterodera glycines
  misc_feature (131)..(131): n is a, c, g, or t
  Promoter: Source sequence=SeqID_38928; Location=971..1104; Strand=-; Gene=SeqID_67622
ataatttaaataatttattctcttcgcctacgtagtagtgatgtgtacagtcatgtactctgctgatgctcgcgtgtcgacgtattaccaaaacgtcggtgcaacagtccgccaaaatgttggtgggcganatg

SEQ ID NO: 117278 - DNA, 125 bp, Heterodera glycines
  Promoter: Source sequence=SeqID_2961; Location=3000..3124; Strand=+; Gene=SeqID_82516
cctaaacattggaaaaagccaagaattagcattaaaatagctaaaaaagaccagggaatgccgcagatggggcatatgcggggaccgccgctgccggcataaagccagcgggggagcgcagaatg

SEQ ID NO: 117279 - DNA, 253 bp, Heterodera glycines
  Promoter: Source sequence=SeqID_12844; Location=1..253; Strand=+; Gene=SeqID_76570
tgtaactgatccatgggccgagatttttgaaatcttatggtcggaattcggagattagccccctcctcttgatattaactgattagctaatataattgtagaacctaatccgaagttttgattcgatctgctgttgatcttgtgatctatataatagcatttttggtataactctctctgttcaattataaaaatgtactattgactgattgatcaattgattgatcccttttttctctgatcagatggcatg

SEQ ID NO: 117280 - DNA, 80 bp, Heterodera glycines
  Promoter: Source sequence=SeqID_40787; Location=1..80; Strand=+; Gene= SeqID_69028
ctttccatacaaaaatgggtgggtttaaatagaaaaataaaagcttttgtttcgggatcactttaatccaaataaatatg

SEQ ID NO: 117281 - DNA, 322 bp, Heterodera glycines
  Promoter: Source sequence=SeqID_15955; Location=814..1135; Strand=-; Gene=SeqID_80307
tttcgaccaattcggaacccgagccgaaattcgaacaaaaaatcgaaaataaaaaatttcaaaattctctttttgtttctaaaatatattttctaaaatatattaaaacaaccaaaacgttttggcgccgacgatttggcggcatgtagagaggaggtagaaatgatgaaatcgttataatttttctgacgaagtctatcaaagagccggatttaattcttcatttactctttttcgctttggcttatgttctcttaattttgtatttaggtaatgaatcgtcaaattgatacgaaaaaacaaaagcctaaaataacgcatg

SEQ ID NO: 117282 - DNA, 58 bp, Heterodera glycines
  Promoter: Source sequence=SeqID_18979; Location=795..852; Strand=+; Gene=SeqID_83716
ggtttcgtttttgaattttaaattttgttttttcaaatattcaaattgccaggcaatg

SEQ ID NO: 117283 - DNA, 501 bp, Heterodera glycines
  Promoter: Source sequence=SeqID_2364; Location=1577..2077; Strand=+; Gene=SeqID_79335
tttttaccatagaattagtttttgggactcagaattttcaaaatgttgctttctgacaaaaaaattcgatgcgattatgaaaggcgaaaacatttcatcaattatattttttctttattaattgaaattggccataaataggcatttttgcctgctaaaataaggatttagaaagagtaaaggcaaaatttgacttaaaaggtaccaactgaatttaaatttggcattttcaatttagaaaatttcattatttctcacttattttgacactcctcacggttttcattcgattgagtccaaagaccggtcacagcatacaattaatggaaccacacattcatcgccgccagatatcttcatcggagaaggccatcacaaaaacgtaaataaacaaaaacatttttaattatggacttaacatttaaacccttttaattatggacttaacatttaataattgattttatttataaattgtgacgataagctagcacaaagatg

SEQ ID NO: 117284 - DNA, 258 bp, Heterodera glycines
  Promoter: Source sequence=SeqID_13955; Location=1114..1371; Strand=-; Gene=SeqID_77916
ttgcggaatatgcgatcttctcacatccccgcatgaaagcattgtttttacatttttttatactaatttggactcgatgatgtcatttcatttaattttttatcactgataaagaacgaatccctggaaaattgttgccaaattaaagaattttcctggttattttaaattttaaaagaaatatgggataagtggaaaataaaaaatattattaaaagtgaaaaatcaaatcaagttttttaaattttaaaagaaatg

SEQ ID NO: 117285 - DNA, 405 bp, Heterodera glycines
  Promoter: Source sequence=SeqID_12270; Location=2652..3056; Strand=-; Gene=SeqID_75860
tggcctccgtgcgcctgtatttcgagacggtgttgggctatgccgacgcgttggccaccacatggcccctggtggtgcagcgcgggcgcgaggacaaactgttcgcgcctggccgagtggtcagtgccatacaattaatgctcactcatcacggttttagggggccaaggcccttggcacacgtgtagttaacatgcttggtcatgactccatcatggcacggatattttgcccaaaaatggaaaaatcgatgtcccccaaaaattttaaaaatcaaaaaaaaatttattggctccatttaccccacccctattttatgtatggtggtgcctccttctccattaatcagttgattaattatttccaatgcttaattggcaattaattatgtaactgattacaatg

SEQ ID NO: 117286 - DNA, 186 bp, Heterodera glycines
  Promoter: Source sequence=SeqID_9518; Location=1..186; Strand=+; Gene= SeqID_71724
cgatgcaaggaaaatcccattcagttgatcaattggatgtgcacttagaaaatacccagagttttttatagaaaaaatgcaactgatcaagaaatcgaagaggcattgttaaaaaattcaaccttaactgcttattttaagttttgcctagaaaatcctgataaagaaattaaatacactgatatg

SEQ ID NO: 117287 - DNA, 215 bp, Heterodera glycines
  Promoter: Source sequence=SeqID_40830; Location=223..437; Strand=+; Gene=SeqID_69078
gatcttatctttaaatgggacgttatagttttaggcaaaataaaattttgttctaggaaatataaatcataatgtggttgacagaatttctggaaggttacggtattcccaagggtattcttggtcatgtcatagtttagatcttatctttaaaaatgggacgttatagttttaggcaaaataaaattttgttctaggaaatataaatcataatg

SEQ ID NO: 117288 - DNA, 185 bp, Heterodera glycines
  Promoter: Source sequence=SeqID_21969; Location=1..185; Strand=+; Gene=SeqID_52601
tgcaattgagggggaaacgtgtggagtgttgggacggcttcagttcgaagtgcatggtcggctttgaaccttcgaaatgaattcgaattccctttggctttgctttttgcagcaatcgttggcttcgcccgactttgtgccggcgatgtgttcgaagtttcggtaaggcacggccaccagcgatg

SEQ ID NO: 117289 - DNA, 580 bp, Heterodera glycines
  Promoter: Source sequence=SeqID_7124; Location=3061..3640; Strand=-; Gene=SeqID_63900
ttggaaatttttaaaaattacaccccacaaaacacgaaacatttgagttttcgtcgtcattttggcattttcaataaatcatttcttttttttaatgagaattttttcgaaatttggcaaacttggaggtgtttttgatacaacgaacaacaataaaaaatatgcatttttaagttttaaaccccattttttggttgtttattgtactttttaggtttatttaagcaaatattaaatatgcacacctttttgggatttttgggggtttacaacatatattttggcattttttatccatattttggtccatatttggccatttttggcctttttagtccatatttaatgtccatatttcgcgttttttagtccatataatttacaaccctatttattagcatgccaaaatttccgtttcggttcaaaaaagttatgacaaaacatgttcgaacaacgagttttgaattcttctggccaagtttttatgaaccttaacaaagtttttcgaaattttgcagattaatatagggcacttagaactatcaaatgataccaagattgttggaattggtcgacaatg

SEQ ID NO: 117290 - DNA, 194 bp, Heterodera glycines
  Promoter: Source sequence=SeqID_24260; Location=1098..1291; Strand=-; Gene=SeqID_54977
tctgctacccggcaatgcttcaacgaggcgatcatttggacacgaacagaaattataaagttaaaagaaaattcatcgttgctgttaatatggtaaaatgctctctctcaccacaatttctggctaattattaagtacataattaaccccctccccagggcaattctattgcagaagaatgtgttaaaaaaatg

SEQ ID NO: 117291 - DNA, 145 bp, Heterodera glycines
  Promoter: Source sequence=SeqID_36923; Location=837..981; Strand=-; Gene=SeqID_66123
caatgcttttaagccccgccgtgcggcggctccccttttgtgcactattttagtttttaaattggttccggactttttggctttttgaaataaattgtgaaaaatatacgaaaattattttagcttttaattacgctgtacaatg

SEQ ID NO: 117292 - DNA, 450 bp, Heterodera glycines
  Promoter: Source sequence=SeqID_23398; Location=283..732; Strand=-; Gene=SeqID_54101
ttttctgagccaatgttaagcattttaaatttaaatttatttaagaattaaatggatttaagagtgttttttaaatagttaatcaatttccaagagtttttttatatgctattttagaatatattaaactaaaataattcattttgaaagacggaaaatcaattagatcttattttacaaattccgataaaaacttactcaaaaatggaatgaaactgagaaagtgtgggttggcaaaaggcaaaaaaaaaattcaaatgcgatcggaattcaatttgctgattgccgaattttttgagagtgtcggcattatccctggtgtataccgaaaaggtgaagcccgtaacattttttacacaaatattatacattaaattaataatggcaaatatttaaattttattgaaggttaattgcattaatttaaaaataattttccaaaaaaaaatg

SEQ ID NO: 117293 - DNA, 967 bp, Heterodera glycines
  Promoter: Source sequence=SeqID_11506; Location=460..1426; Strand=-; Gene=SeqID_74934
ccttaaaaaaggaaataaaagcaaacaaatacataatcattaggacttcaaattatatggaaatccatataattttttttcatggactgtgggaagctaaaacgaacgaaaaacatgtttttagcttggtttatagcttctatgatggatttctatcggaacaggacgaaattttagcttggaaaaaagttattaagaaaaaactttcaaaattttggttttttttgttatttcatgttatacttttttggtaattgtcttatcgctaagcaatagggtagaaaaagcttctaaacatataaagctttcgaatgataccaagattattagatttggtcaacaatgaaaaatgttgtagtccaaaacttgggctggcaccgaaccgtcctctgccggattatatccatattttggcattatacccatattcttatcagatttgtcggcatcaactagtctatgattttatgtctatgatttttaaaataataacttttttttaaagtcatgtaaaacgtctttcttgtggttttcgaggtcgctgatataaatttgacatccattttggtcaatttcgaaccccggacccaaattcgaacattaagtcaaaaattcaaatttttgaatttcgaacttttattctaaaattgattaaaactagcaaaaaaaaatcaaccacaggccattgcaacagcaaaaatgagccattctatgcatgttcgaatataacagtaaaattcgaagaatttgaattttcgacttttgttcgagttcgggttcggggttcgaaattaatgaaaagggataccagattcgtaatcagcgcccttgataacccccgagtacttttcagaattgtaaaaatcgacctttttttgccctttttatgggaccagtaaagttaaccggtttaccgcctattaatttttgaaaaaatcaagtacttgatgacaccatagctaaaatg

SEQ ID NO: 117294 - DNA, 942 bp, Heterodera glycines
  Promoter: Source sequence=SeqID_27429; Location=1..942; Strand=+; Gene=SeqID_58123
agtagcgccttgctaaaagcttcttttttaacaaaaacctttatttttctatgaaattttttctacgtgagcaaaaaagtaaaatttttgaaaaccccaaaaaattaaaatttttataaattatttggttttaaaatttcttagaattttcctcattacaaaagctttttaatttggtttatattgacagggtttctttcacaaaaattttttgttttagtaaattttttgaaaaattttcttcgggggagggggaaggctgaagtgtacctaaattgaggtgtcaatattcacgtaacttcacaggtttcccgttgacttggaatgggacaaactcttcttcgcctcctcctctgatgccattgtccgtctccgttgcaatttctggcagaggcaccgaaaaatgtgtggtggtggtggcccgagtgccgtggtccatccgccgtgcaattactatgccatttttgtgccatcgagcggcgccgttctccacaaatttcctcacaaccatccacaagaaaaagtgcggaagaaaaaaccattcccagtgttggtctccgtttccctagtttttgtccaattttccggattccattttttatcaccccatacatttcgcgcaaaatttaaagttttcttttcaggaaaatacacagaaattggacggcgattgtttcgcagcaaagcattctgatcagcagcatgtggactttgatcggatgctgaattggtggttgcccgacggttggttggtgctcgcccatttgcacaatttgtcggatttggttggtctgtgcctccgtcacacacttcggcacgtacagcccaatgatcaccaccatctccgcttttggcatgcgcttcaatcgttgtcttcaacgccaatggacaacaatttcggctctgattacattgctcacttggaatgcattttcaacaatg

SEQ ID NO: 117295 - DNA, 61 bp, Heterodera glycines
  Promoter: Source sequence=SeqID_44941; Location=1..61; Strand=+; Gene= SeqID_72347
tttattcctgaaatttaaaatattttaaatttattttaagacaaattttcatttaaaaatg

SEQ ID NO: 117296 - DNA, 111 bp, Heterodera glycines
  Promoter: Source sequence=SeqID_15422; Location=539..649; Strand=+; Gene=SeqID_79692
ggcattgtttaaaagggtgggggcaatttcaaaataaatggtgaagaattaaattataaaaaatcaaattaagcgagaattataaattttgtgaattgaattatcaaaatg

SEQ ID NO: 117297 - DNA, 255 bp, Heterodera glycines
  Promoter: Source sequence=SeqID_38139; Location=190..444; Strand=+; Gene=SeqID_46549
ttgtgttgttgttgggcgcactgaagtcgttcgttcgttgattgggtgttgtgtcagcagcaaatgtgcaaatggacaaaaattcgccccttttatatgcattttctgttgcactttttttcagtgggaaatttgaatataaaaaggcgtgaaattgagagaaatttcattctcgtcacattcttaattctattctctgcactattacatctaattgctgctgctcaccgactccatcgacaacgacacgcgatg

SEQ ID NO: 117298 - DNA, 613 bp, Heterodera glycines
  Promoter: Source sequence=SeqID_8340; Location=1..613; Strand=+; Gene= SeqID_67734
aaatccattagctcttaatagcatattggcaaaaagtcattataataaattctattttacattcaaatgatgacgtgaaaagtaattataataacagcttacgcaaatgactaaaaattttcgattggtttttattcacattgttaaaagaattataataaatttatattttcatgtaaataataatttaatacatattttaaaattagttacgttataataaaattatataacaaatatataatttgaaaattaaaaaaatagcttaacattcttcattcgatttagattatggcagtatctgctgtaattgttgtttgttgtgtgatcgcaaagccaagggacaacggcagaaaaaggtaaagcaaacgaatgcttttgcatagcaggtaattatgggcaatttgaccgggttttgtgatgggaaaagcgaaattaatgagcgaaaaaagaggcaaaattggcaaaaattcaaaaataaatttgtttttttattaagctgagctcactttgactttgactcttgaggaaatgttccgttttgaagcggaagtcgtcaaagtgttaagcgataaatttgaaacgaaaaaagaaacaaaaaataaaacaaatg

SEQ ID NO: 117299 - DNA, 1003 bp, Heterodera glycines
  Promoter: Source sequence=SeqID_5855; Location=1678..2680; Strand=-; Gene=SeqID_59448
gacttttcttttgctgactctaaatggtcttaaaatgaattaaaaagtgttctaaactttgtttgaagcttcgaacatgcattttttgtgactttttttaacttttttacactttttgggatttttgtgacttttttgagtttttgcgacttttttcgtgatttttttgactttttgaggcaaaatttgaatttttagcgaagaaaatgccgaaaaataaaatttagatcggtgaaaaggcacggaaagatgaaattgttcgtacttggaagaattacttttttatgcctattttaggtattgatgattatgtgatctaaatgttggactttgccatttacgtgtaacatatatttgatttttacacatgaattcataaaaaaagattggcatttagctgaactatgtacatatagtcaatccccccccccccaaaaaagaaaaaatatcacaaattatacaccattgatttgtctcaaggagttaagcactgaaaaaagggtctccagtagcgggaatgggtttaaacggttttaagtcggttaaaacttcgaaaatggaaagaatttggcacataactttttaattttaatttatcagaccaaatgcgaaaaatctgaagtttcgactttttgttcgagatcggttttccaagccattcccccatctgtttgtgcatcgctcaattaccacgaattaaatggcaatgcgacgaattgcgccgagaattaggccaattagagggatcatttgccctgcgggtaagtgtgatgggcacgggtatggtaaagtgatgtcaattgggctcaaagaggcgaatttcttcaattaattggatggaccgaatgaccaaaacggcaaattgagggccaaacgaaatggcttttcagctgtgaagcggacaaattcctccaaaagaagaaaaaaaggctcaaaaaaattttttggataatattccatttttataaaataaaatatattatttctttttattcagcagatg

SEQ ID NO: 117300 - DNA, 57 bp, Heterodera glycines
  Promoter: Source sequence=SeqID_11376; Location=1141..1197; Strand=+; Gene=SeqID_74767
tttttcagataattttcactgcttttgcatacattcattctcgcgcattacaaaatg

SEQ ID NO: 117301 - DNA, 393 bp, Heterodera glycines
  Promoter: Source sequence=SeqID_11828; Location=597..989; Strand=+; Gene=SeqID_75330
ttcaccgtcaaaaatgcttcccatcgcttgaatgcaacgcattgtgacgacgaaacaaacgaagcggacacaattggctaattagtgtgcaattagcacagcaattacataattaattgttcaatgttcacttcactaaacagtgctttcattttttattgttgttggttcctgtcattttgatccatctttgatcattgttttttgaaaaaaagaattggatagaatttaatttaattagatcataaataggctaatacatctataaagaatagggggactcccagtgattggaatgtcaatgaattgagtccaaatgattgaaaattgcagaagatctaattttattttatagattgagagaaaagacgagaaaactgctaagaaataatg

SEQ ID NO: 117302 - DNA, 369 bp, Heterodera glycines
  Promoter: Source sequence=SeqID_9788; Location=630..998; Strand=-; Gene=SeqID_72682
tctttaatttagacaagggaaatattttgaaatgtcagtgtctaattcactttaaaactatatttatcgttgtaaagcatggtccatttgctattgtaaattatttttttttttgcgctaaccctcaactgatcagaaaaaatggatcaaatgtgaaaatacaaacaaaaattaattaatttatgcgcttttccctcataaatttaatgactattcatcatgggttcgcttccgcatgacagatgatgaattttattttcattttcttaatactgctattccacataacatttatttatgcatttattagttgtccagtgccaaaaaaggcgaaaattggcattaatcaaatttaggtgattaaaaatg

SEQ ID NO: 117303 - DNA, 79 bp, Heterodera glycines
  Promoter: Source sequence=SeqID_1217; Location=815..893; Strand=-; Gene=SeqID_70032
agtcagtcatttcaaaaatgaaattaaaaaaataaataaataaatttgcccccttttttttgcagagtttgccgtgatg

SEQ ID NO: 117304 - DNA, 142 bp, Heterodera glycines
  Promoter: Source sequence=SeqID_29392; Location=1..142; Strand=+; Gene=SeqID_59896
cattctaatttctgtcctttttgaggtgttaaactcttcagctgtgtgccgttactgtcgttttcaagtaaaacatatttgtttacgcattttaattataatattattatgataatcaacaaatgttaagaaatgcataatg

SEQ ID NO: 117305 - DNA, 258 bp, Heterodera glycines
  Promoter: Source sequence=SeqID_26041; Location=1..258; Strand=+; Gene=SeqID_56791
aattgatgacgaaaaaacaaacaaattaattggggtaggcgggaaatgagtggtgttccccttcccccagaaagctatttaaatgccaatttttcacagcagaaccataaagaacggcaaaaaataaatttttaggtattttagcaataaaaaatttatttaaatcaatgcatttaaaaaacaattaaaacattattctgtttttaattattttcagtttttctattattaacaaataataattcattagcaaaaatg

SEQ ID NO: 117306 - DNA, 360 bp, Heterodera glycines
  Promoter: Source sequence=SeqID_42936; Location=780..1139; Strand=-; Gene=SeqID_70728
atgtagcataagggcgtcgaatatagttatatagttttatttttgtgcaacccaagtgctgcaagtataaaaaaattctcagaacatggagagggcctaaataagattcgtttaatggcatttaattaaataataatatattaggttgtcagttcttcgaattttattttcatttgggtttttaatctatatattaatttataatgatgccttgttttttaactgatacatttgttttatgttatacataaaaagacttataaaaattattaatttttctattagtaaattttggtttgattttttattaaaatacattcattaaagtccacaacaaagaattgttgagcctgcggaatg

SEQ ID NO: 117307 - DNA, 120 bp, Heterodera glycines
  Promoter: Source sequence=SeqID_41832; Location=1317..1436; Strand=-; Gene=SeqID_69882
ttttttcgcatgcttttttataataaatattaaatgttcatgttgtttttaaagtgaaggttttgacccaaatatttaatcaattttaatttattatttttggtagaattccagaaaatg

SEQ ID NO: 117308 - DNA, 337 bp, Heterodera glycines
  Promoter: Source sequence=SeqID_16033; Location=1..337; Strand=+; Gene=SeqID_80393
atttatcatttttttcaaaaaacaaatgcttaattttacttctattaatttcgtgcttaattaggagacaatttcttaaaaaagaatcgattaatttattaaccaatcgtccaactaatgcattcaattaattaattactaattacatcattcattattaattattaggtatacacgttgcataaatcaattgctgggcaaatgcggaaatgggtaaaaataatactaattgtttacataatattctcagcttatccatgcgaaaagcagaaaatctttataaatacataaatttacatttgataaatggaaaaagcattttgaatgcttttccatg

SEQ ID NO: 117309 - DNA, 307 bp, Heterodera glycines
  misc_feature (89)..(89): n is a, c, g, or t
  misc_feature (99)..(99): n is a, c, g, or t
  misc_feature (116)..(116): n is a, c, g, or t
  Promoter: Source sequence=SeqID_7513; Location=1..307; Strand=+; Gene= SeqID_65083
cctaaactttatttattatgaaaaaagtatggacacaaaattttttttatattttggtcactttttcgtgtaacaaataaacttttctnaagtttgctngtagataaaaagctaanggtctatgaaaggtaccaagaatgttaattcggtcgatttgacagaagttatgacgatttttttgttttttaaagcagtgcgagttggttttttgccaattcttacccttccaatcagatccagaaattgtcaaacaaaagataggatttctgcaataggtacggtatcaaaaaacgtatttgcacagatg

SEQ ID NO: 117310 - DNA, 275 bp, Heterodera glycines
  Promoter: Source sequence=SeqID_18454; Location=678..952; Strand=-; Gene=SeqID_83051
aatcgaggatcaataaacttttccttggctgattatatttcatttaatttcaatatatttatttttttggaattccataaattattttttaacatttacaaacaggaaagggaaattaaaaatttttaaaatcaactatttaccattaaatataatagattgcaattgattgagattttttaaaaataaatagagattttgcatatattccacttataatataacaaatataagcagaaaaacaaaatttattattttttttgcatcaaaaaatg

SEQ ID NO: 117311 - DNA, 66 bp, Heterodera glycines
  Promoter: Source sequence=SeqID_25568; Location=1..66; Strand=+; Gene= SeqID_56305
ccatttgctctgctaattgccccgtttggcctccccgccctcccttccgcttcttctgccccaatg

SEQ ID NO: 117312 - DNA, 120 bp, Heterodera glycines
  Promoter: Source sequence=SeqID_16872; Location=1968..2087; Strand=-; Gene=SeqID_81300
aaatgtatataattgaaaaatgccaaaaattacgcaaatttgggtccgtaatttcacgcgagcatcgaacaatttggtccgtttcacgctcataaagtgtggcgatcagttcaaggaatg

SEQ ID NO: 117313 - DNA, 409 bp, Heterodera glycines
  Promoter: Source sequence=SeqID_37410; Location=1..409; Strand=+; Gene=SeqID_66490
tgatttttataaaattagacgtaaattggatttgtaatgaaaatgataaaaatatgaattaaaatgaataggtgaaaaatcaaaagaattttgaaatttttgtgcttaatacgaataaattaaatttcaaattaaaaattatttctatcttttgcaaaagtttaactaaaaagcttcgaagaaatgttttgtaaaaaggaaatggagtaaaataaatttaataaatttaaatttaaaaaaaagaaaattgaaatataaataatattactgtctttggaatgttttctcttttttttgcagcattttcttaaaaaaaaatctgaaaatgccaaaaattaataaaagcttaatagtcttaaccaattattccaattccaatgaataaacttttcctgccatttcaggcatg

SEQ ID NO: 117314 - DNA, 82 bp, Heterodera glycines
  Promoter: Source sequence=SeqID_1716; Location=9063..9144; Strand=+; Gene=SeqID_75486
agtctgttgccgtccaccacaatgcacagaacaagaaattgtcaaaacaaaacaaaaaatcagtcgctcgtttgttaagatg

SEQ ID NO: 117315 - DNA, 210 bp, Heterodera glycines
  Promoter: Source sequence=SeqID_3322; Location=6330..6539; Strand=+; Gene=SeqID_84207
ggttgataagatccataaaagaaagggcggatgtgcctcggtagcttaatggtagagctgcccacggaaagggtgcatgagtgggttcgattcccacccgaggtttaacattttgcccatttcttattatatttaaaaatgtgtaaataatgcgccaatttaattgaggtaaattactcaagagcatccatcagactttctcaggcaatg

SEQ ID NO: 117316 - DNA, 787 bp, Heterodera glycines
  Promoter: Source sequence=SeqID_21516; Location=1293..2079; Strand=-; Gene=SeqID_52126
tgtacaagcaattgggttgttgaatgaagagacgttccgttgaattgcgatggaccaccaatgacgatttatttgaccatttatcagtcactttgtttttccgtttgaaggaaacgaaaaatttgttcaattgtttcgctcaattatttcattttgtttaacaataaattagcaaatgccaaaattcctttctatctgtattatcttaatttatctcactgagtaaaatcactaaactgaatggcccgaatcaaatcaagaagcaagttcttaacgtgctgttgtggtcgttaaaaactccattttttcaaatattgtttttaaacgtttcgccaaacattacgtttaatttctttggctaaaataagtgaattggccttttgttcatttgttatgattcgtttgcttacgtttgttttaattttgatttttggcacttaaaattcgctttcatctttcccaccatttagcgaagtttcctttctttttttttctcttctcctcccatttcactctcttatggtggaactttcgccaactttggtttttgtggcgattcttttttccgcccctctgcagttttatctctccgctcggtccacctccgacgcacaattttacctgcacgagtcagcaaattatctttaattttattgcattaaatttaaataccgaaataaaattctaaaattggtttagatttgtgcagcaagtcagagaagtgtatggccgttatttcagcgccattttcggcggatgggaccttttcgaggaggaggacgaaatg

SEQ ID NO: 117317 - DNA, 347 bp, Heterodera glycines
  Promoter: Source sequence=SeqID_911; Location=2660..3006; Strand=-; Gene=SeqID_46367
tcgcctcttcacagagcgtcttcagcgacccgtacgctcattttttgacatttttgcctcttatagcagtacgtccccccacccccgaatcaattcccccaagtattcctttccccccccccccctctcgaaagtttttaaacaaattttttataaaaaaattgaaaaattttctctaagaaaatttcaaaaacaaaaaaaggtgccgtgacaaaaaaatttgtgccgtaatttcattcgtcgtttttttggcctaaattttcacatattttttatactcgctcactctgccatttgacaggaatggacaattcatgcactacagtgcgtcctccatttatctgatg

SEQ ID NO: 117318 - DNA, 294 bp, Heterodera glycines
  Promoter: Source sequence=SeqID_26561; Location=1198..1491; Strand=-; Gene=SeqID_57297
ttttcattttttcaacacttttttaacaaagaggaagctgacgtatgggcaaagtttaacctaaaaaaacttttctttttaagtccggaaattgacttaactaacataaattaaccatttaaagactatgatttattatattttatataatttttatttaattaaaatattttttcctttgtttggctcaaatccgacggaaatggctaccgaccgatcactcccaaataaaattgaaaaactcagcttagcaaattgaaatgcctggggataattaagtgattgatataaatg

SEQ ID NO: 117319 - DNA, 294 bp, Heterodera glycines; identical to SEQ ID NO: 99762
  Promoter: Source sequence=SeqID_38377; Location=471..764; Strand=-; Gene=SeqID_67207

SEQ ID NO: 117320 - DNA, 202 bp, Heterodera glycines
  misc_feature (15)..(15): n is a, c, g, or t
  misc_feature (50)..(50): n is a, c, g, or t
  Promoter: Source sequence=SeqID_14908; Location=1..202; Strand=+; Gene=SeqID_79068
cagagagttatcaantatgggatatacgcctgatctgattatatcagatntaaagatataccaaataaaaattaaaaaaataattttcagagacttttggcttttgtcgcaaaataaattagccgatttacccagaacctttggattaaaatgttcaccaaaattatattttccgcataaatttaattcagaaaaaattatg

SEQ ID NO: 117321 - DNA, 106 bp, Heterodera glycines
  Promoter: Source sequence=SeqID_15468; Location=633..738; Strand=+; Gene=SeqID_79741
tctaaaagggggaagagatatttaaaatgatttaaaaataaataaataattattaggcaattgtccattaattggttattaccagcagaatgagtggcaagggatg

SEQ ID NO: 117322 - DNA, 204 bp, Heterodera glycines
  Promoter: Source sequence=SeqID_5039; Location=5855..6058; Strand=+; Gene=SeqID_56678
taaagtaaccaaaagaaaataaaataataaaattgaacaactttattaaaaattttaagttagttaattgaaacttttttaattatctttcaatccaacttaaacatatgtaattggcaaacttttcggctgtatatagatttgtgtggtaattttgtaagtgtatttataaattaacagattttcatcggaaaaataacaatg

SEQ ID NO: 117323 - DNA, 129 bp, Heterodera glycines
  Promoter: Source sequence=SeqID_345; Location=840..968; Strand=+; Gene=SeqID_83392
ttgattatttttccgtgctaaaaaaaagaaaattatatgattaaatcggggagggataaaatgggtcaaatgtgtgcaacatctctatataaataaacaggaagttgcattaacatatgcataaaaatg

SEQ ID NO: 117324 - DNA, 102 bp, Heterodera glycines
  Promoter: Source sequence=SeqID_3965; Location=2365..2466; Strand=-; Gene=SeqID_52607
aagatgccttgtttttgtgtcttattattaaaattttgcggttgattttagccgttattgcctaattttgttaatctaagtttagttggttagtttaaaatg

SEQ ID NO: 117325 - DNA, 108 bp, Heterodera glycines
  Promoter: Source sequence=SeqID_3012; Location=1973..2080; Strand=-; Gene=SeqID_82767
taataaaatgttttatataccgttttgttaagctaattgttgtctacaaaatagtatattgattttgttcatatctcaatttgcaaattttttatagctaaaaaaatg

SEQ ID NO: 117326 - DNA, 336 bp, Heterodera glycines
  Promoter: Source sequence=SeqID_9319; Location=1143..1478; Strand=-; Gene=SeqID_70985
tggttatcgtgcggtgttccaaaatggggtcacctttaataagcaacattccaaacacacttttgtaattattttgcttagatttttcgaaacattccccaaccgtacgcttatatggtgagcacttggcttctccccaatttgcgcagtgcgcttttcagatgaatgttctttggattcaactgctgctcttcttcatggtctccaccaccacccaattcattttccgctattttctcctctcccggtccattctttggcatttaaatgccatttcaatcatccgttgccaattccgtgccccacagagacggccgaattccggccaaagcgatg

SEQ ID NO: 117327 - DNA, 78 bp, Heterodera glycines
  Promoter: Source sequence=SeqID_35405; Location=304..381; Strand=+; Gene=SeqID_46429
ggtaggcgggggaggaggggcggaaaattggccaattcaatttaaattttttttttcaccacccaggctcacgtgatg

SEQ ID NO: 117328 - DNA, 538 bp, Heterodera glycines
  Promoter: Source sequence=SeqID_15375; Location=1613..2150; Strand=+; Gene=SeqID_79632
tttcaattatttaaaaacataaaaaattatattatttaaatttgggataaaagggtgctaggtcgatccacaaaaaagctcagtgtgggcgttccacaaaaagctcagtgtgggcgttccacaaaaaaagctcagtgtgggcgttccacaaaaagctcagtgtgggcgttccacaaaaaatgctcagtgtgggcgttccacaaaaagctcagtgattgataaaataaaataataaatttaaaataataaatttaattattgtattggtaacatccacgttgaaatcaataaccatcaatacatataattttgggctaccactgaaaatgtaaaattaatacaataaatttttatatgtttaataaaattataatttagaaaatgaataagacttttatttttatttttttgttatttcgatttgagtattcgacctctaccaattccggttttgaagaatttataaaaaatcacaaagctatagaacttgtcaaaagctatcgaaattaaaacattaaaaaaactccatgaacaaatg

SEQ ID NO: 117329 - DNA, 902 bp, Heterodera glycines
  Promoter: Source sequence=SeqID_34581; Location=1..902; Strand=+; Gene=SeqID_64334
gtggtcaaaccttcaccagttcattccccagtccgatccccaccaagccccaagcaaaacacaccattagtcggtcaccgaacgcaaccacaagaacggactgatcaactgcaagaaacagaacaacagacgccggccagcgacatgagatcagggatcgtgattaagattttttaagagggagaagtgttgtattattgtcattctattttcttggcattatgttattgacacgtcaccatcatcccacacaccaagatcgcccataaatactgctctcttccctccttcctcgcttcgggcgtcattcattctcatttatcatttgcatttcaccccacacactttgtctctctcttcacctcactttatttatttgtttattgattatatttcttcttgttgataaacgacacaacaaattggcgcagtcagcataggcttttattttaaaaatacaattcaaaggaaaagactattggctttacaagctgctaagtaggcctctgtgaacacacattaaaggaaaaacgaatttgggaacacgtaagtcaaagcgaccgctgcgtgcagttaaaattcgcaattcctctggccaaaggacacttaaaattactcaacaaatcaccgaattttactgccaattaaaatccaaatcaaaattatcactgacggccaaattctattcactttctcaattcactgtcattcaaatcaatcattctatcaccccggagcaactcaaagccattttggctgatcaacaggaacagttcatgaaattgttgcaaaacattcaactcggcaaagcaccaccgcaacaaaatccgtcacaatccaatgagatggacttttttgcaaattaagtgcacaaatttcggaatttatttacagcccggatg

SEQ ID NO: 117330 - DNA, 113 bp, Heterodera glycines
  Promoter: Source sequence=SeqID_3130; Location=2951..3063; Strand=-; Gene=SeqID_83325
acagtttcctgcacggcggtttgggcggcacatacgaagtgggccgcgatgtgctggccacgcctgcccggccggtattccaacgcgcacaacacgacacgccgttggccatg

SEQ ID NO: 117331 - DNA, 84 bp, Heterodera glycines
  Promoter: Source sequence=SeqID_8247; Location=826..909; Strand=+; Gene=SeqID_67426
cgtgacaaattcctttacaattttcgtaatgcactgaaaaaatttcctaattttccacaattcatcaaagttcgcagggatatg

SEQ ID NO: 117332 - DNA, 1003 bp, Heterodera glycines
  Promoter: Source sequence=SeqID_16975; Location=773..1775; Strand=+; Gene=SeqID_81400
agtcaaaaaattattcgaatttctccaattttgagtagataatattcccaatcaaattatcgattgattttcgatcgataatttgagtgtgtctactttttttctctgacatccccttccacaaattcaaacctattggatggtctcctcgagagagagagagtacattctatgatttctctgactaatgaaatcgactttaatttaatttgtttttttaaatttattaatcgataattttatttgacccccccccccatacctattggatgatctttgatcccttcaaccgaaacctattggatggacttgtgcgcgagaatttaattaatttaaattttaattaattaatttaaacgagcgagagctgcgcgactatttccgataaattgtggaaaatcaaaaacatggtcgcggtctcgaaccgttgagagtggaagcgaggagcttaaccacttggccacaggggcagttgaaaggtatgggataattgttgactttatgatgaaaattccgttaaaatttattaatcgataattttatttgagcccccccccccaaaaaaaaaaggcaaaacatattgtaaggactgtacacaaataatcaataaacccaagcctattgcatatatcatatccgaagcagtaagtaaattagcaaaaaacccttttcttccggctgggctcgaacccataccaacttactgtgctaaccaattggccattttatgccactgggaaagcaaaatccaattcattaaattgtaaaaaaatgacgtcatcatgaaagtaaaaaatactccgccccttttcttgttggtcacgcccattggtttttgttttgctttgctaagaatacgactccaccttttggctttttagtttcttttttccgcctccattttttttgctatttaaccacagtttttctaaataaaaatcattcgtgttccattttttaaaaaattccatcctccttcgttttttccgatcttcctgcaatg

SEQ ID NO: 117333 - DNA, 597 bp, Heterodera glycines
  Promoter: Source sequence=SeqID_20607; Location=394..990; Strand=+; Gene=SeqID_51159
ttcctttatggtattataatagtgaatttttttgaaaatcttcatattataaaacaggaaaaagagccaaattataatatgcggacatggaaatgagctcagacaaaccgaaccaaaaagtaagaaaaaatagaaattatgaatttaatattgtatcttatacatattaaatagaataggaaaatttaaaaatggcagagaataaatccattcagtttttattcgtttttttgtcaacgccaataaattaacggcaaaattatgaccccaaaaagagagatgaacaaatgggagaaatttgaatttaaaaaacggcaaaattatgacttaaaaaagaacaaatggaataaaatttataattttaaaaacggcaaaattatgaccccagaaagatcaaatttggatttaaaatgtaccgaaacagcaaatttttataaataattctttttatccatgtttttgtttaatgtagaacttctaaaaacatttaattctcccattttgataattcatctaatctattcggtttttttaggttagtgtgtcctatctgaagcagtaattcattaatttgttaaattaaattgttggacaatg

SEQ ID NO: 117334 - DNA, 727 bp, Heterodera glycines
  Promoter: Source sequence=SeqID_2464; Location=4356..5082; Strand=-; Gene=SeqID_79844
ggcgctaggacttttcgacagcggacctttcgacagaaggacttttcgacagcggacttttcgactgtaaaggacttttcgacagtgaaggacttttcgacagcggacctttcgacagaaggacttttcgacagcggacttttcgactgtaaaggacttttcgacagtgaaggacttttcgacagcggacctttcgacagaaggacttttcgactgtaaaggacttttcgacagtgaaggacttttcgacagcggacctttcgacagaaggacttttcgacagcggacttttcgactgtaaaggacttttcgacagtgaaggacttttcgacagcggacctttcgacagaaggacttttcgactgtaaaggacttttcgacagtgaaggacttttcgacagtacactaacaaatcaaatttttcattaaaaacaaataatttctaataattaatcttgtttttttattttattatttgtgaaataagaatttttaattaaaaaatatatttttataaattactggtttataaaatatcttaatttagcggggtttaagaaggcattttagtttattgcactgcatttttggagttctcatgaatggttttcttatcaataataaataatttatttgtttgacctccgtttctcgaccggcccaaaaaagagtgaccatgccattcataactattactgaaaatatttttgaattgctgtgaaaaatg

SEQ ID NO: 117335 - DNA, 97 bp, Heterodera glycines
  Promoter: Source sequence=SeqID_25817; Location=1..97; Strand=+; Gene= SeqID_56581
atgccattcccattccccccccaaaaatgccattcatactctcattaactttttcttcattcagttgactttttttgccgctttcatggccatcatg

SEQ ID NO: 117336 - DNA, 237 bp, Heterodera glycines
  Promoter: Source sequence=SeqID_8115; Location=6785..7021; Strand=-; Gene=SeqID_67010
atcgtaacagagaagcatgggcgaaaacttggcacttttacggaaaaagtgccaaagaatttattggactccttagcggaatggcaatttcaatacttgtctattgaacggcttttcattttttgtatcgcattagagaatggaaagcatagaaatatcggtagggattttctgaaaaaaagacggtgacttaataattaattttttatcgatgttttttaaatttatttttagatg

SEQ ID NO: 117337 - DNA, 122 bp, Heterodera glycines
  Promoter: Source sequence=SeqID_16872; Location=1662..1783; Strand=+; Gene=SeqID_81301
tctgaaaatcgattttaattatttcatttatcgcataaaggtcgctatataattgactaaattgcattgagcaacaataggttcttgagtgaattcatgaatatttttattcttaaaaaatg

SEQ ID NO: 117338 - DNA, 172 bp, Heterodera glycines
  Promoter: Source sequence=SeqID_2223; Location=5847..6018; Strand=+; Gene=SeqID_78556
ccactgaaaggggcggaaataaattcgaaaagtgatcggaaggagcaaaaattggaatgatcagagagacaataaaagaagtgataaaaagcaggaggaggagagaaggtgatcaaaaaagagataaggagaaaaggagaaaaaaaggaatgatcagagagggcaaaaaatg

SEQ ID NO: 117339 - DNA, 134 bp, Heterodera glycines
  misc_feature (26)..(26): n is a, c, g, or t
  Promoter: Source sequence=SeqID_19812; Location=2029..2162; Strand=-; Gene=SeqID_84552
ctgctcactgtccgaggatggcactngacagtgggggagagacactcgtaaaaaggcaaccaaaaacaaactcaaccaaaccaccaaacgcaacagactgaggaggtcaaatcaatgccagaaagggacaaatg

SEQ ID NO: 117340 - DNA, 416 bp, Heterodera glycines
  misc_feature (80)..(80): n is a, c, g, or t
  Promoter: Source sequence=SeqID_5425; Location=2518..2933; Strand=-; Gene=SeqID_57981
ccccccccctcgtcattcccaccgaaaattaaaaaaaaacagacttataattagaattttcaacaaaaatcttaaacttngagaatattttttaactttgggggggggggggtgagaacgacggtgggaaatgaagtgcaccatacatttcaatttataaagtggcgaattttcaataatttgggaatttgtgataaaatttggaggggtgcaccaaccattgaaatatctctctttgtttcttattttcataaaatgaaggatttttttaaatcatttaacaataagttcaaaatgaaaataaaacaacaacaaattgagttaaattcgggttaccgccctgggaaaaattttaaatttttagcaaaatcttgaaaaattggttgatttttcaagttcttttctctttcttgatg

SEQ ID NO: 117341 - DNA, 135 bp, Heterodera glycines
  Promoter: Source sequence=SeqID_45214; Location=1..135; Strand=+; Gene=SeqID_72553
attttcagcgaaatcagcaaattgctgcacgaaccgttcagtttccgtttgatggaggcaattaaatttttaatttttaccaatttaattaattatttaaattttttttcccatttttcagattaatagcaaatg

SEQ ID NO: 117342 - DNA, 1003 bp, Heterodera glycines
  Promoter: Source sequence=SeqID_2047; Location=352..1354; Strand=-; Gene=SeqID_77502
ggtccgcttgtaatatgaaattagtacacaaaaagagagataataaatatgtttttaaataataaaaatgccgaatgcaaaaatatatgcaaaaaattggaaaaatcggaatctttatgcataaaattacaactatgttttcgcccgctcaagaacgcgaaattactaaacacgtaagtgcaatttttctacaactttttatagtcaaaaaacataaaacaagataaaaaaaacttttttgcggcgcctttttcaaagaaactttttgaggcgtagtgcgacatttgcggaccgacttttgcgggtcatcatttctggatttaatttaaaaaaatttttttttcttaaattggatgatcatctgaatattgaattttatatgtgatttttcggagttaagcaagttaatgcgaatgaaaatatgaaaaatttataaagtttttccaaaaagttcttttttcaattcctcttggtgctaaaaatttgatcacttcatatcatccttaagtagtgatctgatcaacttgtgcaatgcattagtttataaattcctgatttacaagaattatattgtcattgataatgtgagtaattcatttaattttgctttttaaagatatatatttttatatcttttatttgttcttgatattaattgttaggtatgcctgatcaaaatctaagctctttaaactaaggctagtaggtgaaacacgaaaaattttgcgtgctatatattttgtgatatgatttttgtataaagcattttttaatcaatttgcctaataaactatatgtaataaattcgtttagttgtgggtaaattttccgattaaagaaaaaaaagtatgtcgaaattgacatagcttatttgttagagcaagaagcactattaaattatcatcttcagtcattatttcaatttggtgattacgaaaaattatttgaaaattcattttaaatttttttttctttttttttgataattttttagtcacaaatg

SEQ ID NO: 117343 - DNA, 1003 bp, Heterodera glycines
  Promoter: Source sequence=SeqID_32576; Location=269..1271; Strand=-; Gene=SeqID_62883
ataaattatgtttattaaatattaaaaaataaattgaaaccaattaaaataagatatccatttttaacatttcgcttttcttccaatattaaataatttattttgtgaacctctataatttaatggtaataatttcggaagaaatatctttcctcaatttttttttcacaattatttcttatatgttacaaaatttcaaaaagacgaaaaaattaattagttcattaataaattattatttcttacaaaaattgaacaagatgaaaaaaagatttttaaaataaaagttttcattattcaatttaatattttcattttttattgttactcttttcatttatgtttcgtttatttaattaaatattttgcattcaaaattaagaattcctttcttttattattctttccttaattaattaataattatttttctattatttgattttaaatgaaaaagaatatttaaattatgtgtattaaagtggtaaaataaaattctttatttgtttattttgtataaatttttgctatccattatttattttattccgtgttaacttattaattagaattttttttttgattttaactattgtatttggtcctatttttatattttccaattgatgtctgaagttattttttgttaaatatttatttacagggattccatttttatgtaagagaaaccgcgaaatatgtactaaaatatatattaaaaaatttttaatggttatttttttggaaaaaaattttggataaaaattaaaataataacaaatcagaggatatgcttaataaattttgatgttcttttctatttttctaaatataattgatgttttagtccacttaattctttttttaattttatttttcctttctactttcattttataattttatatcgcttattattttaaatcttttttcttttaaaattattcttattctattaaatcttcatatttaaatatttttatttattttataatttagaatg

SEQ ID NO: 117344 - DNA, 1003 bp, Heterodera glycines
  Promoter: Source sequence=SeqID_25998; Location=635..1637; Strand=-; Gene=SeqID_56750
tcactggttagccactaatcacccaattaaaatcgaactcaattagtcccatttttgcttactcaaatactaaaaattttatgttacacaatcagcaatagttttttgattgtttgtttttggacggtttttgccttccgaatacaatttaatccaaggttcacagttgtgtggctttatcttcattttaggctatttttgcgagtcctacagactaaaaaatgaagctttgagacttttgttgttttcctgaaaaaacccttcaaaaataggcaaaaaatttggtcaaaatctgtttaaaaaaatcgcattaattccataatttttatttttacatgtgattaaaataaaattgataccaaaatcttgctatttatacgcatggatttttatttacaaaatccgtcatctgctgtaattactatgttttttttcaattagggaaattcttttacggggtccaaatcgccgtaattaatccgtaattgcgcccagccctggttaatatccgttatttctgaattaattgctaattgtcactaaacaagcatttaaataatttaattttaaattttatattaaatcaaaatgattgcgaaattatgcaaatattgaattgcagacaaattaatatattgattgaaattttattaaataaattgattacaaaaaatcatttcgttatttacttatttatcagttgccttaaaatatttttaattaattaaacctattattttcattattgaaattttatttaatttctataacaaaatttacttactttttagtgttccaattattaaattattacaatttttacttttattttagtatttatgaaaagagtttaacttatttcctacaaaaataaaaataaatttatacaaagctaaaaattacgaacctaaaatcctcatgcattttctgcgattaactaatgaaaagctaattgactaattaagattaaaaggaacaattagtgtgcacttatgctgcaatg

SEQ ID NO: 117345 - DNA, 307 bp, Heterodera glycines
  Promoter: Source sequence=SeqID_35233; Location=545..851; Strand=-; Gene=SeqID_64831
acgcacaagtgagagcctgagctggaccgaactggttgctggtacgtgtcgcacgcgaccgccaccgacccccagctcgagtcaacacggacccgaaaaccattgcacaattcaaccagagtaaacagcactcccccgatccgggtaccagaccccaaaaggctggcctcaagaccgagctcacgcagctactccgagcatctcagcgcactccgcctgcaaatgccccattcgccactgaacagaaggacagcaaaccccagtctggaggctagcagtacaacgtacagcaacaaacgggtgaatg

SEQ ID NO: 117346 - DNA, 1003 bp, Heterodera glycines
  Promoter: Source sequence=SeqID_3322; Location=3299..4301; Strand=-; Gene=SeqID_84208
atgtaacagccccctcccccatttaattgccgcccacgtaattgccgatcaaaaggcaacaattagcacttagcaactgtttttaatctgttttcgattaaagggcgaacgcctcaaaaatctcactatttaaagccacggcgttcacccttaatttgtcagtccactagtcagtttaccaacccgcccataatcagccaccaatcaccccacaccgcccaaaaaatcatctattcactgtattttttggtgaagcaaataaattggatttggaacggcattttctaatttcttcaaactgaaccaagcggatcccgcccagactgcttgattcatttggggggcaatctgcagctgaaccaggtagaatttgtgcctttttcattcaaaagtcgaaaattggaaatttgaaaaaaaaacggtaaaattgtcaacggttcgaaaggaccagacaaaagtcaaaaaggtcaaaattcagagtgaaagtgaattgtcaattgtgtaaaaagcgcgaaagcgttaacacaaaagtgtcacaaaatatcaaattggtaactgtaaaggtctgaaaagaccagcagaacaaatttggtaaaaaggaaaatctgaatagtctgaaaagactcagataaaactggtaaacacaaaaggtacaaaagtaccaaattggtgaaaggtcgttaaaattttgctaatttgagtccaaataagctgaaaagctagtggggtagggggtaaggctttctccaagcgccaaacatctcaccgccgccacctcaccgccgaccaagacagcgccagccaactcagcgccgccatttcagcgccgccaactcagtaccgccatttcagcgccagccaactaagcgccgccatctgagcgccaagcaaatttgaataccgactaactgagtaccggcgactcaaattttgcaccagaaaaggcatttttttgcgcaaaatcggatagtttcgacagcaaactcctatttcactccaaatg

SEQ ID NO: 117347 - DNA, 58 bp, Heterodera glycines
  Promoter: Source sequence=SeqID_44390; Location=186..243; Strand=+; Gene=SeqID_71881
agtgcgttgacgaaggcagcccttcaaaccaccctaacattcttacttagataaaatg

SEQ ID NO: 117348 - DNA, 388 bp, Heterodera glycines
  Promoter: Source sequence=SeqID_1272; Location=13166..13553; Strand= -; Gene=SeqID_71162
attgcaggtgctagttcgtttcataaaatccgccattttaaagatttttctgacaaaacatggcatatgtttatttaaagcaatcaaattatacattcttggtagcattcgatggcccagctttttctctattagtatggaaaagttaaaaaaacaaatttggtgaactttagaaaatttatatgaaaacaagataagtactattttgatgccataacttatgttaaatttgtaaattttatatgaatttttccaagataatagagtaaaagctgggctatcaaataatacccaacaatgtaaaatttgattgcttttaagcaaacttatgccatttttttgttaaattttcaatgtggccgtgagcaataatgcttaatcaaaaatg

SEQ ID NO: 117349 - DNA, 344 bp, Heterodera glycines
  Promoter: Source sequence=SeqID_6108; Location=1016..1359; Strand=-; Gene=SeqID_60376
ccttttagaaaataatgtttgctcaattaaacctaatcatattttccatttctttatattttcaaatggaaattgtaaattcggaaaagaaaaagtgccgaaatttccaaattagcgaaatgaaaacaatcaaatacaaaagaagaacaaccgaatctgaggaggtattgcaagtgaaaatcgcaataactgaaagaataaattcaggaggctcaggacaagtaaaaattttatatttttttaaaaatataaaatttttgaacaaaaaaattgtaaaaggaaaattcggcatattgagaaaataaaatttaaaaaaagttgttcgtacaaaataccttattatg

SEQ ID NO: 117350 - DNA, 79 bp, Heterodera glycines
  Promoter: Source sequence=SeqID_15971; Location=796..874; Strand=-; Gene=SeqID_80324
caacggcaccaatttggccaacagcaacaacagcggtcgtccgccggcccgttctcgccacccgccacaaaacgtcatg

SEQ ID NO: 117351 - DNA, 59 bp, Heterodera glycines
  Promoter: Source sequence=SeqID_14184; Location=534..592; Strand=+; Gene=SeqID_78199
tttttttcaacgaattatttcttataactgaaaatatttttattttaaactcaaaaatg

SEQ ID NO: 117352 - DNA, 402 bp, Heterodera glycines
  Promoter: Source sequence=SeqID_65; Location=4269..4670; Strand=-; Gene=SeqID_59400
gcttaagtcgtcaggaatcggtatataaactcgccgattttgcctacagatcattccattattcatcaacagaatttctaaacgtccccgctctgaacaaataggcgcgcgcgggctgcttctccactaaatttgaaatttatctgttcgctgtgcgctttgtatgcagcgtgcaatccgctatttgactgacagttacggactgagcaacattgacgagctctacgcttaccttaaggaggagataaaaaattgtccaacaggagacggccagtcattgtttccgaatccgttgcgtgcagtcgactgtgtgcatattgcaaacactgagcacagaaaccaaccagtgtacgtggaagggtcacttgaccttgtcgagggactcgagctttacacaacatg

SEQ ID NO: 117353 - DNA, 306 bp, Heterodera glycines
  misc_feature (59)..(59): n is a, c, g, or t
  misc_feature (61)..(61): n is a, c, g, or t
  misc_feature (71)..(71): n is a, c, g, or t
  Promoter: Source sequence=SeqID_18086; Location=1678..1983; Strand=-; Gene=SeqID_82672
ttgatttatgttttttcaattatgttatgttatttgctcaatttataaaagtattttantnaattcattanctagggatcggatttttaggctctaaaaaatgccaaaataagcactaattttaaaaaagaatttaatttggggacgaaacgacttaaccttataagaatttattttactggttgttttctacataattatgccttctgatattcgtgtttttgggaaataagttgcacagaatttgattttgcaaatcataaatgaattaaaattaacttaatttaccccatctttcagaaaatg

SEQ ID NO: 117354 - DNA, 68 bp, Heterodera glycines
  Promoter: Source sequence=SeqID_12293; Location=1009..1076; Strand=-; Gene=SeqID_75885
cctgaatcagaaaaacaaataattaaatcgcataattgacacacttttctgagtcttcttcccgcatg

SEQ ID NO: 117355 - DNA, 119 bp, Heterodera glycines
  misc_feature (93)..(94): n is a, c, g, or t
  misc_feature (113)..(113): n is a, c, g, or t
  Promoter: Source sequence=SeqID_25713; Location=1228..1346; Strand=-; Gene=SeqID_45951
ggggaaatttactgtgcttttaattcgatcattttgtaaggtatttatttagatagttttggctttccgtttttcaatttaaatttactttcnnccattcatttaatttttanagtatg

SEQ ID NO: 117356 - DNA, 207 bp, Heterodera glycines
  Promoter: Source sequence=SeqID_14553; Location=1..207; Strand=+; Gene=SeqID_78619
ccgtaaatttaaatcgaattttttaaatttttctatgtcgtcctagttgccaaatgtcctgaacaccccccccccgtttcggaacagttaaaaaactaaaataaatttcctgtcaaataaaataataataattaaacaatttttccattgatttttttgtaaataattttaaaaaatagcatagcaaataacactaaagaaaaaatg

SEQ ID NO: 117357 - DNA, 300 bp, Heterodera glycines
  Promoter: Source sequence=SeqID_31437; Location=1176..1475; Strand=-; Gene=SeqID_61781
agccgtcctaataactaagaggaaacctattttttgtccggtatttagtatttttttaactaaaaattttgttgttaaacctaaggcttcatgaaaactaatacatagtcaactcgaacaatggcttagactatgcctgacaataatctttaggtttaatctaggcttagacttttttttattgacggttcgagaaacagtttttgtgacggtaaaatgtcatgggacgcgtaaaatcgactagaaccaaaattttaatgtttttcaggaaatttctttacactgaaactaattacgatg

SEQ ID NO: 117358 - DNA, 713 bp, Heterodera glycines
  misc_feature (17)..(18): n is a, c, g, or t
  Promoter: Source sequence=SeqID_29707; Location=168..880; Strand=-; Gene=SeqID_60178
aaacaaaaaaatcgatnntttttcaagttgtccgtttggggtactcaaacatttatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattccggaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcggggggactgccccgaaaacaaaaaaatcgattttttcaagtgtccgtttggggtactcaaacaattatg

SEQ ID NO: 117359 - DNA, 277 bp, Heterodera glycines
  Promoter: Source sequence=SeqID_26982; Location=549..825; Strand=-; Gene=SeqID_57718
gcgcatttaattaaattttcctattataaaaaatttaaaaaggccgcggatcgcggttgcgcctcacccctgagacctggtcttatggacaaaaaatcaaaaaaaaaactaagcagtttaaaaagtataaaaaattgaagaaaaagataattaagcactcaataagcatcaataaatttaaattaagtatactacagtctgagtgtctttttttgacgagaatcacagagaaaagccaaatagcattattttatttatttttttgataaattgcatg

SEQ ID NO: 117360 - DNA, 1003 bp, Heterodera glycines
  Promoter: Source sequence=SeqID_1872; Location=4700..5702; Strand=+; Gene=SeqID_76483
attttccagtatttttattaacaatattgacaacaatatttttttttaataaaagattattgaacgcatttttaataattcttgagtttaaatataaccaatatcctctccaactttttattaatgatgttaatctatcaccatcttcatcttttttacctcaacgtctctttatagggtttaacaccaacccctcttgaatatattttttatataatctcaaacaacgtattttaattctattgtaaatttgtttttttctatctttttcgataatcattgcaccataatttcattaatctttaagaataaaaccaaatttataaacaccacttttacttattgggtgtctttttaaaaatcctaagtatttacaaaatactgtggttcctacacgtatttctatatcatgaggaaaatataaaacttcaacattttttacatataacctatttattagtggatgtgatttatcacatccaccacaaacaatttctcttttatctcttaaaaaagttatctttttaattattgtttcaatatttttattcctcttattttcgatatttttatttttatcaatattattcatattttttactatttataatatttattatatataaatattattataaaactataataataaaaatattgataaaaatagcatttatatataagaatcagatacattgaaaacaaattagatacaaggttttgggaatataatgacatatttaaaatatggtatgttataatattatgtcattaacattaacaaatcaatgtgtgagatgtgcgtatttccgcagtatgaaatgtaaaattatgagtatttggtgtatatttgagtatatatttggtgtatatttgagtataggatggatatatgtgtgttatctgcaacgcccccgcagggtttcgcattaacactaaatagtgagaatttgtgcgcgcgacacgaagctctttgttgaacaggtgctgagttaccaaaatg

SEQ ID NO: 117361 - DNA, 126 bp, Heterodera glycines
  Promoter: Source sequence=SeqID_17418; Location=2050..2175; Strand=-; Gene=SeqID_81898
ttttctgtttttcaccttgctcattttacgaatattcttgtcttccttctctcttaagatttaacaaaaattaattccaacaattcttttaactccttcgcccgcgggcaagaaacagaaaatatg

SEQ ID NO: 117362 - DNA, 414 bp, Heterodera glycines
  Promoter: Source sequence=SeqID_3477; Location=616..1029; Strand=-; Gene=SeqID_84825
aaatataaataaataaaaatattattatataatgttaaaatgaataacaccaatacaacaaaacccgacatacaaattttgaatcccccagaagagcataatgaaactcttttgcatgtactgcttttttctcattatcttcttgcatttcctgtgtttttgcttttttggttcgttttaattcggtggcttaaaagtcacggtcacctctctcccagcgaagccgaaacagtaatggaagaaatgaaaaatatccctcgacaaccaccaatatttttcgcaacaaaatgatgcaaaattagagaaaactgacaatgaactctctcttcagtatgacaaaatagataatgactcaagctgatggagcattctcaaagctactcattctttttcatcattcattttacaaaaatg

SEQ ID NO: 117363 - DNA, 285 bp, Heterodera glycines
  Promoter: Source sequence=SeqID_18869; Location=2122..2406; Strand=-; Gene=SeqID_83570
tttgttatttctgttataacttttttggtaattgtcttatcgctaagcaataggttagaaaaagcttctaaacatataaagctttcgaatgataccaagattattagatttggttaacaatgaaaaaagttgtagtccaaaacttgggctggcaccgaaccgtcccctaccgcttttcacatccccatcacttttttaatagtcgtcaaataaaatttgttctgattctcaatttcattgccaggaaaaattatcaattttttactctacaaattccaaaatatg

SEQ ID NO: 117364 - DNA, 1003 bp, Heterodera glycines
  Promoter: Source sequence=SeqID_18331; Location=875..1877; Strand=+; Gene=SeqID_82933
agtgaattttattaggcatgagaggacaattaaattaattgcattactcactcacttcccccccccccccccagcaaatgcatcgacggacgtccttgggggccggtgggacgtcattatcaaacgctcgtcctgcttaactggcttggctattgttatttctgccgctgtcccattctctccaaaaaatttcccccccccccctccattacataattgggcaatttaatcggctttcatgctttatgtttaaaaatgggacaggtagaaatttggcagcttaatccgtttaaatgcatacgctgcgcagaattttttcatgcgtgagtgatcggtcacagtgatcggactaatgcgaagagactgatcagacccatgattaaattaattcggaaaactgattagaaaagcaaaattaatgaggaaacattgatcaaataagcaaaaacagattagacaaaccacgaatatggagagactgatcagaacacaactgatctatcacgccactcatggtttaatcactgcgaatgagtatattttggaattttgcttgtaattgtttgccagatcacgagagctactgagaatgaatgatctaagcctgatcaagtgaccaatgcatatcaaacaagttttgcataattttcaagtgatggttacttgatcaggcactgatcaagtgatgcccgcaaatattgccgatttgtgtttgcagaattgcaggcattaatctaacacaatttacaaaatatttctagcattaatcaacacatttattatagatcaacaagtcatttagctgaataattttttgttttgcaaacccagttttttgtaattatgttcatttccaataaccgcatttcttagggttgtcaaaatcacaaaattttcacaaaaaaataaaaatttttattatgacttcaaacatttttcttgcaataaaattagatttaaaattattaattgataaatatttcttagtaaaagaccaaaaatg

SEQ ID NO: 117365 - DNA, 520 bp, Heterodera glycines
  Promoter: Source sequence=SeqID_12602; Location=492..1011; Strand=-; Gene=SeqID_76266
tgttggataattaaatcaattgatcgtgaataaaaagtgattaaaaaccattcattttataatttttaattttaaatattctccaatggacgagacccaagtcatactgtccccgattcgtactatatttcgacaataaaagcgtcacaactttggtcaaaatcgaccaaattaaacatttttgtataattcgacagctttaaggttctttatttcaaaaatttcaaaaaaatttgaccctgtttgaaaaaagttatgaacggaatatatatatatatatatatattttttattaactttttcatccttaattttttattaaacatgataaaattttcttgaagaaccttaagggctatcaaatgataccaaaaatgcttaatttgttcgactttgacaaaaattaggactatttttttcgaaaaaacaatacgggctgaatttttactgtctttaacaatgttttaattaaatttaattttttaaatgcattttcagatatttttaaaaaaataaaatg

SEQ ID NO: 117366 - DNA, 102 bp, Heterodera glycines
  Promoter: Source sequence=SeqID_5155; Location=577..678; Strand=-; Gene=SeqID_57101
ttttgttgacgaagcagccgctttatcatcatcaagatcaacaacagcggctttatcatcaaaatcatggtgtgccggtgccgccgatgtgcaacaacaatg

SEQ ID NO: 117367 - DNA, 246 bp, Heterodera glycines
  Promoter: Source sequence=SeqID_21827; Location=587..832; Strand=+; Gene=SeqID_52463
ttcttcgcaattgttatttatgccgttgatcgacgcaacccaattttggattctcgaactggcaattccttttggttcgatgagctttccctcgtcgtttgtgtccatttcctcttcttaattttcctctctttggtggttaatccttcgaacattgtcagcgagggactccatcagccgtttagcacttgcaaagttacatttttattttttaattcgatcattaaaccttttttcagtctgatg

SEQ ID NO: 117368 - DNA, 250 bp, Heterodera glycines
  Promoter: Source sequence=SeqID_15692; Location=1665..1914; Strand=-; Gene=SeqID_80003
atgaaatttgataattaattagagtaatcgaaattcttaatttagaatcagaaaataacagacgtttaatcatttcgctgagttttattatgtcaatcggtctcatctgctatattggagtaataatattattattttcattatgattatgtttgctaatgaaaaaccctaatttaataataaacttattcacaattactgtacattacagttcccatttaagaatactgtgttcttttattgcataatg

SEQ ID NO: 117369 - DNA, 138 bp, Heterodera glycines
  Promoter: Source sequence=SeqID_6806; Location=257..394; Strand=+; Gene=SeqID_46313
atgctaattgctcagttttatggtcatttctgataggtgacaaaccgtggccccagtgccatttctggcgccgttttggacatcgtttggccctcctattcggagaagggcaaccacttcctgtatttgatcgacatg

SEQ ID NO: 117370 - DNA, 323 bp, Heterodera glycines
  Promoter: Source sequence=SeqID_20831; Location=2527..2849; Strand=-; Gene=SeqID_51418
catccaaaacattaaagatgtaatgttttttcataatttatctaaaagcatgaaatctgagttgaattttcataaaattccttattttaaaatagccaatcacaggaaatgaacgatttgctaagttttgtcataagatttttaagaattttatttatacattaaataaatctataaaacttcgcataataattacaaaatttgtaatatttttcacgaaataattattattaaaaatccagaaaataaataatttcaattgcagagattttgaaatattttctacataaatcttttttagactgagtcattgcataaaaatg

SEQ ID NO: 117371 - DNA, 1003 bp, Heterodera glycines
  Promoter: Source sequence=SeqID_3799; Location=514..1516; Strand=+; Gene=SeqID_45637
cattccaattttttcatttcacttttttttataatttataacctttgttaagcgttgctactttaataatttaattaaaatgatgacctcccggtaatttggcgtatcagtaacggtcggcgattgcagcgatttacattaaaaaacgagttcaaaatataggctgctcaaaattttgaaaatttaagcaaaattaattaattatcatcagtcagctcaatgacccaaagataattcaaatcccatttaaaaaaataataaaattgaaaattctgaatgtatgttgtttaaagtcattcgtagcaatttaaaaataatttttcttgataatttttttgctcccttcacctcttccccataaattgtttttttctgttattcatcattatttttagattttggatttagggaagttaaaaataattatgcgacaggtgaaatgtcctgtggtaagtggtgaagaggtgaaaaaacaatatgcgacaggtgaatgtcctgtggtaagtggtgaaaagaggtgaaaaacatttggaaataggtgaaaacaggtgaaaaaccaatatgcgacatgtgaatgtcctgtggtaagtggtgaaaagaggtgaaaaaacaatatgctgaaatgtcctgtggtaggtggggaaaagaagtgaaaaccaatattcgacaggtgaaaatgtcctgtgttaagtggtgaaaagaggtgaaaaacaattggcaacaggtgattttcagttataagtggtgaaaagatgtgaaaagtctaagaacattgatgaaattctagagaagtgatgaaaagaggtgaaactaaaaatggaaaagtcaaatatttcaagaacagaaaatacaacgaacgacgctgattttcgtgttaagtgatgaaaggcaaaacagaacagtagttgagatagaagctattttaaagtggtaaaaaggcaaagaaatgttcgaatatgtaaaaatataataaaagaatttaagagatttacatttataaatg

SEQ ID NO: 117372 - DNA, 958 bp, Heterodera glycines
  Promoter: Source sequence=SeqID_16341; Location=1782..2739; Strand=-; Gene=SeqID_80728
ttttcttaatagcaaataaaatgataatttattatataaataaactaaaatattatttttaattataaattaattgtattagcggtgatgatatatgctatatttttgtaagagaattaatttatcgatgtaattttgaataaacaatttttatatgaaaaatttataagaattctgtaaaaatcattttttaaagtgatttgtaaataaattgctttataaactcagctaatgcgtggctgtgcttattcaacccaatttcacatgataaatttgactttgtttgtatgtaatgagcaaattaggcctaaaattttcttcattaaaaaaccaaaaaaataaaaataaagaaaatcaggccaataatagaattactggggagggggacagaagcttttcaatttatcgcagacattggcatttattgaaaaaataaaatgccgaaaaatgggaaatttacgtcaattaaagatgctagattaaaatctgaagtattataaaagaataataaaaaaaagaataacctttcctattctttgtacctttttatcattaaattacaagtgatttttagcgtgattttaattattctcagcaaaaaaatatttaaatcaaaaattataaaagttttcaaattaattctgaatcaatttaataacctaattgtcattttccatttgaatagatgttaattttcctcgaatatttggtcacatttaaaatgacaaattgatgaatgttaaattgcaaaaggttgcatttttcgtcatttttgaaagctaaacaaatttaaaaaatcatttttaaaaattaagactcaaaaatttaatcactgcaactaaaattcaatacagaatttctttataaaacctattgagttgttcgcaaaatcattcaagaaaaaataatcataattattttaaacattatctccattttaatttaaataaaataaatg

SEQ ID NO: 117373 - DNA, 282 bp, Heterodera glycines
  misc_feature (35)..(36): n is a, c, g, or t
  Promoter: Source sequence=SeqID_21791; Location=1040..1321; Strand=-; Gene=SeqID_52403
cgagagaattagagtgaacggaccgcgaacatttnntaattcctcttatttatttgacctatttatattttcatagggaacatatttcgcgcatttggggcatagccagaaattatcaaaaaatgatgtaccgaaatgcaaaagactgtgttttttacatctcttacaaatctcgtaatgacagggacagtaatgacaacacttaattttatgcgggcagttcatttttcaatttaattttatttttggctactatttatagaaggggtatataaagggatg

SEQ ID NO: 117374 - DNA, 164 bp, Heterodera glycines
  Promoter: Source sequence=SeqID_6449; Location=3426..3589; Strand=+; Gene=SeqID_61616
aaaaaatccctgatatggtttaaaaatgatgataatgatgaggatcataaaaaaactccgatatataaaccgattattttgtgagtgttttattacccaattaacattatcgcgaaacaaaattttttttttttgaattcctgtaatttgtattcagctaaatg

SEQ ID NO: 117375 - DNA, 345 bp, Heterodera glycines
  Promoter: Source sequence=SeqID_24092; Location=1..345; Strand=+; Gene=SeqID_54792
ctgcaaatgattccaaaattaatcaaataaattggggactccacccggcccgtagaatttcatttcagctccaaatttttgttttaagcatatgagataaatggtatttggagaatgaaacttcactttttatggccaaaaagcctgatcaaacaattaaccaaattaagcttaatgacgtgcgaatatgggtctcttgaaaatttcaaatactgaaattaatcaaatttaaatgatgcaattaaataaaattaaaatgcagtgctcaaactataattgtatagaattttatctaattagcatttcatttatgaggagtatagtttcttaataaacagggatatg

SEQ ID NO: 117376 - DNA, 431 bp, Heterodera glycines
  Promoter: Source sequence=SeqID_30269; Location=793..1223; Strand=-; Gene=SeqID_60687
ttctgaaaaagtaatgcaattcatgtttaatttgtacctacaaatttaaaatcaatatcaaaatgtaaattccaaaaaattgtctaaaatttacattttcatccaatttttttaatggctaaaattaataattcataaaataaaaaattaatcgattatttaggctgtattctgtcctataaataggtgcccataaaattttctttgtcaggcatggatccaattctaataactgtatcaagcaacccaaaactctgtgccgacaatctgacaaagatgaagcgatattgtataataaaaatagccaatctgcaaatgagtgacgaaataatttccactaaattggaaatctcacgagaaacgctgataaggtggaagaaacaatattctaccactaatagatcagtgattttatatgatcgatcattatg

SEQ ID NO: 117377 - DNA, 109 bp, Heterodera glycines
  Promoter: Source sequence=SeqID_11661; Location=2105..2213; Strand=-; Gene=SeqID_75123
aacatttgacaatattgacacaatttagaaaatctatgatttcaaaatcaatgatagaatcaatgatttttgcaaatctgatatcatattctgattttagataaaaatg

SEQ ID NO: 117378 - DNA, 125 bp, Heterodera glycines
  Promoter: Source sequence=SeqID_25153; Location=624..748; Strand=-; Gene=SeqID_55877
atgacgcagtaatggcacttatttgttcggcatcattgcctctctcttttgttgaagaccaagccttgaaaaatttattgtcaattttagctccaatgtacaaaataaggtctaaaacaaaaatg

SEQ ID NO: 117379 - DNA, 123 bp, Heterodera glycines
  Promoter: Source sequence=SeqID_6680; Location=50..172; Strand=+; Gene=SeqID_46284
ggtgagaaagaagtgaaaagcgattggacttggcacggctttgccttttccttctgctaaatcggcacgtgcccacccctctccctccccccccccctttagcaattcttcaaccaccacatg

SEQ ID NO: 117380 - DNA, 349 bp, Heterodera glycines
  misc_feature (122)..(122): n is a, c, g, or t
  Promoter: Source sequence=SeqID_39111; Location=1..349; Strand=+; Gene=SeqID_67753
tgatgagaattaaatttaaataaaaaaatttatggtaaaaagaaaatgatggaaaatttaactcctgaaaatgtacaaccgttaattgagcggaaaaatggaaaactttgcaagaaaatgtntagtgaaattggcgtcaacaaattagcaggcaataatttttcttattcgtttttttaaattttttattttgtttctatttataagattttaattttaaataattttttattagaaagatagatgttaaatttaattttttttttaatttttagatttgctggatgaatcaattttcaaaaagatttttgaaaattttttggaaaaacattgggaaccccaaagcatg

SEQ ID NO: 117381 - DNA, 1003 bp, Heterodera glycines
  Promoter: Source sequence=SeqID_7325; Location=1784..2786; Strand=+; Gene=SeqID_64482
tattttccgcttatcccaactcatccctcaaaagcaaattttccattttttgctttacttttgccaatttctgttttgccaattgcgtcgtttatgtcatttccaaatttataataaaattttatccaaaaatacaaaataaatgtttggatgaagggacattatgctaattgataattaatttccctaaaatcatttaaattaaaacatgtttaacccttgcgaatgttctcacagttcgacctgcacttgaacaacaaccaacaaccggtcttccgtctgtctttttctgctgactctgagatggtccccctttttccccatttccccccattttccccctcagtcaataaaatgcgtacaaacattccccaattacacttcacaattagacagccatcacattctcaatcaacacaaatgcttaactaataaaaaataaatcttctttttggtccattgccatagccaacgcttcatctcccaaattccatcggcggtgccattctccgtccgtctccccccccccccctccggtgctgcttttcctctgctcttccgctgatctcactccctccccaccgtttggtcctcaattatttctcattagtgccattttatgcttattccttcttctctccgcttcatcatccgctgtcattcttcagctgctgctgagtgttttttgccttcgttttcgtcccttttacaattgtataattctttcaattgagcaactttggcattatttcctcctccttgtttgttagcatttgaattagccgaggttcactcggttctcagccagcagaatggccaactccagtggccatgacccaatcgcgcggtggctcactcggctaaggcctcgttcgcgcatcgctttggtcattttcggcgctgtgatgatccacctcagcatcggcacttaccacaccttcggtttgattggaaagcatcttacaaacgcaatttgcagaaatgaatttggataggcaatatg

SEQ ID NO: 117382 - DNA, 672 bp, Heterodera glycines
  Promoter: Source sequence=SeqID_11136; Location=1542..2213; Strand=+; Gene=SeqID_74482
tcttgaaattttacgctataaaatgtaattaacccactaaaagcaacgtaatgattatgaaaaaaggcaggagtccgtacgtttttttgtgaatctctattttcgaaaaattaatttaaaaaatttacattttttcatatgaataatgaatgattaattcgcaaaaatgcacatagcagaaaggtggatttcgaaaatttataaaagtagaagcaccgcaaaactcatgtcaaacaaaacctcataaaatctgttaaatacagtcaggtgcacttctgaccaattgttgaacaacaattaagcgcttttataaaatggagttaaaatgaaattatagcttaattgtttatgaagcgggaaaactggacggaaaattaatttaatttgctttacgctttagctaatggaaatgtccttataaaatttgattaaaaatatttgttaatatttgcgcattgggccaaatcaaagtttaatcagtataaataaaaaattgtcaacaatggccattgaccactgaaatgaaagttttttaatttaaacaagctgatattgtaaaacaaataaagaaatttagaaaaaaaattaaatatgattttggtgaataaataatttgcagcaatgttaagaaaacttaatttacgtattgtatatgaaatatttgcaggaatg

SEQ ID NO: 117383 - DNA, 698 bp, Heterodera glycines
  Promoter: Source sequence=SeqID_32171; Location=206..903; Strand=-; Gene=SeqID_62495
taattcaaaaccgcaaatattaaaatgtgttatactcagccatcgtccaattgaagaataattgtctatcagcagcaatcgattccttttccttcatcagacgttagccaaatttatttccgtggtttttcctctcaaattctcagtttgttttgcttttcctcttccactgctgcgcttttcgttcctcgcccacccatcgctaattattcttcagattagcattcgttcggggaatggctgaacattcctcgtcaccccatgcgctttttcattccgatcactgatcaaaatccccccccccccatttgatccaattattccctctgttgcttattgttagaggtcactttcctcgcttacccttcaaacaataaacattcgttttgcctctctctccccgtctctctttctgttcacttttccccttctttctttcctccttaatccatcaattaaattttgcatttcttagaacatttttctttttctgtcgatttattaaatcaattaaacaatttttaaacgaaaaattcattcatggcattctgccatggcattctgttcgtttttacatattcatattcgcttttgcgtgattattttttgccaatggtttaattttgccttagggtattccaccgaatttgtttctttctcagccgccctctcctttcccctcttctcttctcgagatg

SEQ ID NO: 117384 - DNA, 658 bp, Heterodera glycines
  Promoter: Source sequence=SeqID_42700; Location=635..1292; Strand=-; Gene=SeqID_70523
cctgaaaatgctgttggccttctttcgttggcggagtaacattttaatttattttttaagaatttaaaaaatttggcgctggttaaaaagtggccttttttgaaaattttttcacttttttttggtcaaatttttttttgttgtttgttttgatacagaatttgttttttttaaccgatggaactaatgacgaaaaatcaacaaaaaaagtgaaagattttgaattttattaagaaaccaaaggggtggaagacccttttgtttttctaaaatttattgaaataaataatggaggatactacatatgtatcgctactaaatttggtgagccgctgatcaattacaaattatttatggacgatcaaattttttgaaatttttttaagtgcaaaagtggtgggtgtctgcaaaaaattttcaccgggtttaaaaaatctaggaaaattagtaagcatttgtagtgctccgatacgtatctctgcaaaatttggtgagccgctgatcaattacaaattatttatggacgatcaaattttttgaaatttttttaagtgcaaaagtggtgggtgtcttacagcttaacaaggcccaattaagcttatttccagaaaatctcgcatgaattctcatttttaaattttttatagatttttaaatg

SEQ ID NO: 117385 - DNA, 88 bp, Heterodera glycines
  Promoter: Source sequence=SeqID_13411; Location=285..372; Strand=+; Gene=SeqID_47126
ggtcctttttctttatccgttcttttacctcatacttttttgaattatattcctcaaaaacttattttcaatttcgtgtcttaaaatg

SEQ ID NO: 117386 - DNA, 882 bp, Heterodera glycines
  Promoter: Source sequence=SeqID_469; Location=4807..5688; Strand=-; Gene=SeqID_53581
ataattcttagagtaccccaaacgaacacttgaaaaaattgattttttcattttcggggcagtcccctacgaacttatgcaatcagatttatattgaggccgaatccttccggaatagctttcctataactatttctttaattatgcgttggatatatgctcctccataattgtttcagtaccccaagcggacgcttgaaaaaatcgaattttttattttccgggcagtcccaacgagctaatgccaacatatttattttgagattcagtggtcaccaaattgacacttttggcattttccgaaaatttaacgaaaccgtgcgtatgcggcaccattagactcagttcggcgagctgagtaaaacggtaccgaatacgcgcagaaccgttcactttaagacaaatagcaagtgtcaaaaattttttttgaaaaattcagtggtcaccaaatttacagtttcggcatttgccgaaaatttaacaaaaccgtgcgtatgcggtaccattagactcagctcgctgagctgagtctaacggtaccgaatacgcgcaaaactgttcactttaagacaaatagcaagtgtcaatttttttttgaaaaaatcactggtcaccgaaatttacgctttcggcatttgtcgaagagtgaacggttctgcgcgtataaggcaccgttttactcagctcagcgagctgaatctaatggtaccgcaaacgcacggttttggcgactttaggacaaattttttgttgtctttgtgccaaaaaggggccttcattttcaaatgatttttgcctaaaaccaaattcaggccattttttaggttctttgcttttttttgcaattttatattttaatattttcagcaactgcgcacaatg

SEQ ID NO: 117387 - DNA, 175 bp, Heterodera glycines
  Promoter: Source sequence=SeqID_28264; Location=1..175; Strand=+; Gene=SeqID_58898
acaccgcaacagcaggtgagaaattggtacctcggacctttaactctaaaatgccatgaaattcacttaaattgccatcggcaaaggatttcggcaattattggtcaaccaacgcccatttcagagaccaatggacactcatcaaacagaagggcatttactgaaattaaaaatg

SEQ ID NO: 117388 - DNA, 457 bp, Heterodera glycines
  Promoter: Source sequence=SeqID_15549; Location=258..714; Strand=-; Gene=SeqID_79831
cctgtgggacctttttcaaattttgaccactttcatttatactcttgtagttttttgttagcacaaagcatttagttttgctacaacttaacgcatccaatcaaccattaaaatttgtaatttcatattttctaacctagaatttaaaattttttttggcactattgctgttttgggggcccccgaaaaaaacccaaagaaaggaaacttttgttttgtttttttttttgtcctaagtcgtgaaaactttttcacggggttttcgggataactaatcaagcatcgacaacaaaaattcattccaaaatatgtttttttttttgaaaattacataaatcacaccctgacagaaattttggcaattaaaacgcaaaaaaaaaaaaaaacagatttgtgccaccaactgcaaaagtacatggattcgtttttttctttgcataccaatgaagacataatg

SEQ ID NO: 117389 - DNA, 97 bp, Heterodera glycines
  Promoter: Source sequence=SeqID_38793; Location=611..707; Strand=-; Gene=SeqID_67512
tccgtggatgtaaggaatttgaaggctgtttatgttcaggctcgtactgtatcttaacccgtacggtagctaaatgttacaacatattgtacaaatg

SEQ ID NO: 117390 - DNA, 919 bp, Heterodera glycines
  Promoter: Source sequence=SeqID_3412; Location=963..1881; Strand=+; Gene=SeqID_84570
agcaactttttaattaattattgacgaaggtaaataaaaaataattgattgatttgtaattaaaattgcaaaattttcatattttttttactaaaataataaatttcatttgaatgaagggggtttattctatgttgtaattaattatttagaatgaagcaaccaatcctatctttagccttgttcgtccaattagcgctaattagcactcagtgccggcttttggcgtttttcgaggttgcagtacacttaacactaatcatctaacacttatttatttatttttttattaatttggaatttttgactttttccatcaattattattatttttttatcaattttcttgaattttcataatccatttaaaaaaataataattaaatttttgttttaaaataatgaattaacagatggttatcagtaaatatttattcgaattttaccaaaatgaggtttgtaatttgctaaaaatttatgagacgcccaattaaccggaataaattacgcgtcatttaatatttgagcaatttttaattaattattaatgaatgtaattaaacagataattatttgttatttgaaattgcaaaattttcattttttactaaaataataaacttgaatttccgtgatggaaggtttttattttatcctgtaattaattattctcatcataaaattgaataatgaaataagaaacaaaatttcgttgtgctgatcaacgtataggaatgtaatttgttgaattgggttaaaaaattaaattttttatccattcattttgtccatttggcttttttgctctaattaattagtagttaattggccgcaaatctttctatttaaaagcaaatgattgtgtttaattgggaatctttcaaatatttttttagcagcaaatttcacactgaaaatg

SEQ ID NO: 117391 - DNA, 73 bp, Heterodera glycines
  Promoter: Source sequence=SeqID_33962; Location=1154..1226; Strand=-; Gene=SeqID_46370
caattttccccaacttttcgccttctttttcagttacacttttttggtccaatatgccaagggctttcgcatg

SEQ ID NO: 117392 - DNA, 294 bp, Heterodera glycines
  Promoter: Source sequence=SeqID_18030; Location=723..1016; Strand=-; Gene=SeqID_82608
tctacaagaacgtatggaaagaaaaaatagttatttctgggactttttcagaaatcagaattaattctccaatgtggcccaaattttaggcccccagccacagccccttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 117393 - DNA, 108 bp, Heterodera glycines
  Promoter: Source sequence=SeqID_14212; Location=1..108; Strand=+; Gene=SeqID_78225
tacttatcccaaatgacttttcaatttattttaactgtttgcatttgcctttagactcatcgtctcgaccatcacagggagtgtttagcggagcacgaaaaacaaatg

SEQ ID NO: 117394 - DNA, 160 bp, Heterodera glycines
  Promoter: Source sequence=SeqID_12261; Location=2872..3031; Strand=-; Gene=SeqID_75849
aataataaaaattaatattaaagtgtattaatattaatttatacatatataattattaattaaaattattatcaataaatgtttgactttttctgttccaaatgaccacaaaaatgtggtgccgatcagtgatgtgccggccgaagcgttcaaagcgatg

SEQ ID NO: 117395 - DNA, 97 bp, Heterodera glycines
  Promoter: Source sequence=SeqID_4566; Location=561..657; Strand=+; Gene=SeqID_54915
tatcccggaatccgatcccgattttttcaaaattctcggctctaagaccaactgaacatttaatttttttaaatttctaatttaaggtgacagaatg

SEQ ID NO: 117396 - DNA, 379 bp, Heterodera glycines
  misc_feature (32)..(32): n is a, c, g, or t
  Promoter: Source sequence=SeqID_11483; Location=528..906; Strand=-; Gene=SeqID_74894
gcatcgacgaaaggataaaacccatagaagtnttgtatacttaagcaaattctgaatgtaaaatttgacttagttcgaaatgttttggaaagaaaaccaaaattttagaaaacaaaaattttcaaagaaaaatcaagtacttgatgaaaaatcattgacgaaaacaatgattttgcaaaacccgaactcggattcgtgatcagctcattttttttaacctaacaaaagtgattttgtaagaaaatttatttgtttttttcggtcgggataccaattccgaaggattacccatttttgtgctggtaaatactgttcatatgtaactaaactaattaataatctgcatgtttaagaaacaattatataatttataaaaatg

SEQ ID NO: 117397 - DNA, 317 bp, Heterodera glycines
  Promoter: Source sequence=SeqID_37654; Location=34..350; Strand=+; Gene=SeqID_66670
cattttttgcagatggattgattttattagagaatggcattgggtaattaaaactttttaattgtatcatttgggttgatttgagggtgatttcttaacagattttcactaaaatgatcaattttgtgattttaagccaatttaagaaaaaattttggaatttttaatgcatttttattaagaaatttgttcaaattttcatcaattgaccgaaatttgagttggtcattagtttattactataaattgcccctttttatttaaatgaaatttggcacaaatttgggcaggttgagccaacccgtcgccgattgatg

SEQ ID NO: 117398 - DNA, 611 bp, Heterodera glycines
  Promoter: Source sequence=SeqID_1257; Location=861..1471; Strand=-; Gene=SeqID_70874
cgtttcgagtacatgccgaagcaagtgaacccgaacattgcggcccatttgatcgccgagctggcgcccgtgcccagcgaggagcgcgtggtgcgctgtgacgggggccaccgcgagttgggccacccgcgcgtttacatcaacttggtgagagcggacagtgccagggggagggggtatttactactaattaacccattgaaaccggaacgaaattttctactctaaaagcctcttaagtcattgaaattgcaattttggtaaataaaattaaataattcggtttatctttttttatgtccagaatccgctcattccgaacaaaaagagtccggaaacttggaatgctgggacataacgctgccgcagaacaaaaaaaaatcgaattaggctggctgaaattttttgatattttttcttaattttatgtataaattttttttgcggcgccgttttgtccctcctaacaataaattaagatttttggatggcactcaaatcattccaaaaagttatacattgctaaataatcattttgggtgctttttaaggacaagccgggcacgcatgcttgtggttactgtggccaacgcttttacaatgtgcacatg

SEQ ID NO: 117399 - DNA, 71 bp, Heterodera glycines
  Promoter: Source sequence=SeqID_44634; Location=153..223; Strand=+; Gene=SeqID_72100
attcgtctaaagatttaagagttcaattcaactcttaaaaagtaaccaatttttagtcggtctaagcaatg

SEQ ID NO: 117400 - DNA, 171 bp, Heterodera glycines
  Promoter: Source sequence=SeqID_938; Location=2575..2745; Strand=-; Gene=SeqID_64517
atccgccgatcagcagtgatcagtaaatgatctgatcacccttgcattgcctcccggcgccgagtgggcagttcccccccctcccggctcctttgaatggccctgacattagacaaagggaaagcggcggaaaaagccttttttattcttttccaaaaaaggcacaaaatg

SEQ ID NO: 117401 - DNA, 175 bp, Heterodera glycines
  Promoter: Source sequence=SeqID_12573; Location=2700..2874; Strand=+; Gene=SeqID_76234
accggggtttttcatagttgaacctatttttgaggtttttaggacctaatcctattttgacagttttaagacctaaagatagccctagttcggaccgctttttaccgggactacccggcccattactcaaactcatattattattattattactattaagacaaaaaaagaaatg

SEQ ID NO: 117402 - DNA, 220 bp, Heterodera glycines
  Promoter: Source sequence=SeqID_7104; Location=1..220; Strand=+; Gene= SeqID_63850
aagcgcttaaagtgctattttttgcggcagaatttaaattcattttttaattttccatttactaatgctttttttttgtcttacttaattatttacattgggagaacaattttttaaagtgcactaaagggcgaaaatttcaatcaaaaaaaaacttaataagtcaattaaaattagcgctttagcccatttttgtgagcaacagcagtaaaaaaaaatg

SEQ ID NO: 117403 - DNA, 369 bp, Heterodera glycines
  Promoter: Source sequence=SeqID_5112; Location=2167..2535; Strand=-; Gene=SeqID_56949
aaatgcaaatttcactgcttttcttgggagttctgtttttgtgcttcttcctttgtttgcctcaacacatttgccgtgatggtcagccggggctttcccggtaaagaaaaaaatataaataaaattggaattttaattttgaaaggtgccagggaaatccgccaatttgcacggacacgagggcattgggctgcgagttggacacgcgagacggacggtcgtactgttgcgcggcgtattgtgacgacgcggtgccaacgcgggtggcacttggcacccaaaatggaaggtgaaaaatctgtctaagcacagtgctgctaccgagccttcgggcaagaaagtcgggatcggagagaagggtgacaaatg

SEQ ID NO: 117404 - DNA, 161 bp, Heterodera glycines
  Promoter: Source sequence=SeqID_19255; Location=1844..2004; Strand=+; Gene=SeqID_83999
actgaaattcaaaaaatcattatgccattttaaaatttaaattttttgccctttcaaaaataaaaacatatagattctgacacttcctaaactcaaactcaaatatccaatatacttttttaaatttttagctggtgcttcttttaatgtctgaaaacatg

SEQ ID NO: 117405 - DNA, 209 bp, Heterodera glycines
  Promoter: Source sequence=SeqID_3163; Location=1174..1382; Strand=-; Gene=SeqID_83486
taaattcgaaaccatttggatagtcgcgccccagtggataaattaaaattttcttgaaatccttaaaaaattgtttttacagttttttctaaaatttgggcctcttcaaaataaggacacaattcttagaaataagaacatatgggaactcaaaaaaaaattaaaaatttattataaaatgaatttattgttttatttattgcagaatg

SEQ ID NO: 117406 - DNA, 410 bp, Heterodera glycines
  Promoter: Source sequence=SeqID_13595; Location=1022..1431; Strand=-; Gene=SeqID_77496
acgtattacactaaccgcattgtctatataaagacatgaatgtagaaaaaatccaaaatgtatcaatttagtccttacgttagggaaaatacagatttttttaaaaagcttgcggccactaggtctgataaacgaaaaaacgagctactacagggagcatcagcagaccaaatacttgcccttgtggaaatttgcgcaaatattttaaaatttaattttcgtttaaattcaagccagaagcgacggttgtcacaatacgcggactattacagggccatagcacgcgctcgcagtgagaactcagctcggcaaaaacttcaacaagggagcggaattgcccttggtgctattcttgtgcctgttctcagtgtcttagcccaacatttgcttgaaaaaataacagcataatg

SEQ ID NO: 117407 - DNA, 81 bp, Heterodera glycines
  Promoter: Source sequence=SeqID_370; Location=3462..3542; Strand=-; Gene=SeqID_84704
agaggggacgctgagaaggaagaacaatttgtacgagagtgtgctgagcagtttggcatcaacattgatcctgcaaaaatg

SEQ ID NO: 117408 - DNA, 1003 bp, Heterodera glycines
  Promoter: Source sequence=SeqID_156; Location=529..1531; Strand=+; Gene=SeqID_75376
tgctgggcagtgaatggacgggcccacggaaattccacaaatttgccatcaatgccaggggtgttattttacctggtaaacccggcatttgccgggtttttggggtccgtgccgggtttttgccgggtttttgaaattgccgggtttttgccgggttttggttttttgaccgggtttcctgttctatactcatttatttgaattttattaaacatttcaccaaaattaagagccaactatagctaacgttcattattagggttgtaaattatatggattaacatattttttctgcgcatatgctatgaagaaaggggcttaaaaatagcatttctgcgttaaaattttttgatttggtgaaggtttttagtccatataaatccatattttgggggttttctggaataaatccatatttcgccatttttgggtttttagtccatattttggccattttttggaaattttcacaagaaaaatgaaaaaaaaacgaaaaatacacccctaaagatcaactttttggaaatttttaaaaattacaccccacaaaacacgaaaaatttgagttttcgtcgtcattttggcattttcaataaatattttcgtcatttttttgcgaacatttctttttttttaatgagaattttttcgaaatttggcaaacttggaggtgtttttgatacaacgaacaacaataaaaaatatgcatttttaagttttaaaccccattttttggttgtttattgtactttttaggtttatttaagcaaatattaaatatgcacaccttttttgggatttttgggggtttacaacatatattttggcattttttatccatattttggtccatatttggccatttttggcctttttagtccatatttcgggcttttttagtccatatttaatgtccatatttcgcgttttttagtccatataatttacaaccctattcattattctattttaatcgatctctagtctctagcttagcagaatg

SEQ ID NO: 117409 - DNA, 654 bp, Heterodera glycines
  Promoter: Source sequence=SeqID_11589; Location=1309..1962; Strand=+; Gene=SeqID_75035
tttctgagaaaattaatttttttgttaatttataactttttttctttttttttaaactactaactagagttgtacgggaccgggaatttttgccaaaaccgggaccgggacttgccgggacctgagaagccgggactgggaccaaccgggaaatttcccaaaaaaaaatacaaaaaaaaattaattttttgtttggttttttattttataaaacccaaaagttaacgcaaaactaaattataatatatttaatcaatatttcaaaccaaatttatttcaattatttcaaacaataatcatttttggactaaattatcgaataatattagaaattcagatttgcttttcacatcactttttcggcgcgctctttgcaaaaaactttttgggaaataaaagcgttccggtggtgccgataggcgccgccggaggaaattttgaaaatttgagtgtgatttgttaacagattttcaacaaaaaaacactgatttttgagattgctagcttaatttgcacggattttcttttaaaatgataaaatatgtgtcaattcaaaagaaaaaaatgaggaatcatattttgtcgataggaaaaccatgagtataaggggtgtaggagaaggagatttttaccgggaaccgagaccgagaaatg

SEQ ID NO: 117410 - DNA, 367 bp, Heterodera glycines
  Promoter: Source sequence=SeqID_6642; Location=1..367; Strand=+; Gene= SeqID_62306
ttttccctgctttaatagtaggaaaattttttttacatattttatgaattacagatattgcgattgagaaataattttttttaaatgtaccctaaaaattggtttttcaaaaaaaagatataccaaaattaatttttacaatagaaatacatgaaaaccattaaaaagccataaattcatttcaacaaattttaatttagatggttcaaatcgtttcgcatttttcactgataaaaagggtaatctctattggaatttcaagaaacatattcacaccaataaattaatcagaaaccgatatataaaccataatttacatgaaaaaattaccattctggtggagaaagggtccgataagcgaattatg

SEQ ID NO: 117411 - DNA, 236 bp, Heterodera glycines
  Promoter: Source sequence=SeqID_14683; Location=1..236; Strand=+; Gene=SeqID_78792
agtacccaaaacaataagaaaattcaaattttaaactttggctcacaacgcatgaaattattataaattaattaattatctagcgaatattttaaattatgaatttaattaaaataattcgttttttcgcttttattttgatcactttgtacttttcgttcttcgctcagcacgctcataaacatatgaataattttttgtcaaaaattttctatttgatggttttttgagtaatg

SEQ ID NO: 117412 - DNA, 657 bp, Heterodera glycines
  misc_feature (39)..(39): n is a, c, g, or t
  misc_feature (102)..(102): n is a, c, g, or t
  misc_feature (163)..(163): n is a, c, g, or t
  misc_feature (186)..(186): n is a, c, g, or t
  Promoter: Source sequence=SeqID_22957; Location=1..657; Strand=+; Gene=SeqID_53655
cagtagaggcatcatttgatgtcccaattccaaaaaacncaatgatgtgccaaactcaattgaaaggaacagtttgtctcttccatcacctactcaatgtcncactctcttttcaatcaaccgcagggctcacgaaaacaaaccatttggcttgcatcatttntaattaaataataataaattatntaagtaaaaaatagattgggataattccactgatgatcaatcgcgatttttaaatattgcatcataatttaataataataatatatacaaattatatgaagaaaatttataaagtaaaaaattgacttggataattctactgatgattcaattccaatttttaaaaatatataaattatattaagcaaacaaattttgctacgtttataaggctgtatgatttccatctccgttgttcatatttattaaaaacatttttaaattcacttctacgtaaataaattgaaaaaataattaatgggctttaattttatttaagaaaaataatgttttattctttttccataatttcttttattattattatgaatcattttttaattcacattacaactgcaaatccatcggttagataatcaatcagggtaattaattttgtctaatcattttaattagggagacgataaaatg

SEQ ID NO: 117413 - DNA, 554 bp, Heterodera glycines
  Promoter: Source sequence=SeqID_21326; Location=402..955; Strand=-; Gene=SeqID_51921
cctaaaaaatttgtattcagatcagttctgatcaaaaagaatttttaccaaaaactcaaaggggattgccatgggggtgtacccaaaattagtgcaacaaacccgtaaaaatatggaaaaatacaagacccggaagaagctattttagtatcagttttttatgctcttttcaattaaaaaaagagtttttttaaatatgcaaataaaaaaatttattatcaaaataatattaattaattttagtaaaaacactgaccgaaaattgtaaatctacagggaatttgatttttattgtagactgttgtttttaattttcaatcatctaatatgtaagtaacctcatgtaaatagaaagggatcgtgccgggccgaaaatagggcttttcccgaatttgggttccccgggataattgtgattttcccccaatcttcccattccattttaattgtccaattccctttaaattaattctccactctttacactcccacatccttttctttggcttctccattatccaattaacttgatcgatttatttattttaaaaatg

SEQ ID NO: 117414 - DNA, 937 bp, Heterodera glycines
  Promoter: Source sequence=SeqID_4905; Location=1..937; Strand=+; Gene= SeqID_56152
ttaattaaattttaaaaagtcgtaaaaaaactcaaaatttgtttctcctgatatttaataactcattcgaaaactcttttttggcagagttttttacgatcgaaaaactatgtaccattgccaaaaacagaaaaatttcaaacatttttaaggttttgctcagcgccattcgtttgagtctcaattcggtccatttgattttgaattttgacgagattttgttcagaatttgccattattccatcaacagaagtgaaatttcgaatcgaagtaatcagtaaatctgtagaacctgccaaagggaaattcggataaaggataaagccaattgtaaaaatgtaaaagacgacccgaagtttgttgaatgcttgtcatggcattgccaatgtcgatcacgagttccttaaaagaaagaaaatcatcacgtgggatttaatttttgtaaattcgagttgacctgcactctctgcgggagtcgagttctgccctccagcgttacttttttagttgatttttgagtggacatttcttaattcaaaaaacacatttttgcagtttaggtagtttcctttttttctttgaaaaaagctgggggaactctttcatttttttgaatattaaaaaaaaatttgtaattgaccaaaatttaaaaaattgtaaaccattagggccccctatggcttttcattgtcaccaccaaggtacctaaactaaaatgccaaaaaaggtagtaactccgttgggtatttctgcagtttagatagtgattgttatttttctgtcttttattatattcgagtttttggggaaaaaaatcgagaagactggttttgagtataccaatatatatatgtatatgaaggatctacatataattgtgacagataaaaacattctacaattttaaaattttgttttcccattagataaataaatg

SEQ ID NO: 117415 - DNA, 1003 bp, Heterodera glycines
  Promoter: Source sequence=SeqID_9938; Location=1757..2759; Strand=-; Gene=SeqID_72977
cccggcggcgcctatcggcaccaccggacccatttctccgaaaagtctttagaaaaagcgcaacgcgaaaaaaaagatgttttaaatacaaaaaaaaagataataagaaatttttgatcgttttgaataaaatccactatttctatttatataatttattttttgaaaggtaatttctcaaaaaatttcctttttgccacaataatactttaattaatagaataaattttttaattattaaaggaaaaaataaacagtaattttcaaaaaaagcaatatgcgttttataattatttctatacaaaaatctacgataaaaaagaaataaaaaattaaagcaaataaaattattattatgaaaattaatcgatccttacatttgtctcacaatcaccagaggaattttttggaaaaaatttcgccttttcggtttttcgctttttttggacatttcgctttcgcctttttgctttcgctttttatttttctctttgcaacattcctggttcttatacaatattgacttttgtactacaatactaattctacagaagcttttttcataatactgtattactgacgcatttgcggctaattattctccgattagtctcgacccaattccaatggcattccccgttctcgactccaacctccgaataataattgtgccaacaacagccccaatgagtcatcgccacagcctccgcaagtggcggtgcaatgaatgcgccgaaaaaggggggaaatcagagaaaaaggggaaaatggaaatggcaaagtaaggccaatacatgcaaagagagaaaggcggaagttggcagtaggacaaaaacaacggacagttgagggcattgtcacggcacaaagccaattggagggagggaaggccgggccgaccggtgccgagcagaagtgccaacagaagacggggcagagaggcgctggaaaaaagaatgccaaaaataaataagtgccaaaattaaatgcaaaaaagagaatg

SEQ ID NO: 117416 - DNA, 528 bp, Heterodera glycines
  Promoter: Source sequence=SeqID_1382; Location=1..528; Strand=+; Gene= SeqID_73174
tgaaatttggggaaaagatagattgtgatgtggatgaatttgaaaattttaatgagattattttatttaaaagaggtgtaggagggagaaaattttgtaaattttttgttattttttaataggaattttgggtttggggttaaattatgaaatttaaatgaaatttttgaaaggttaaaatttgtttaataaaattttgtttttattttaatgaattggtattggtgataaatattttataataatgtggagaaatgttttgtaaatatagggaggattgtttggaatttcttggggtgttatgggaagaggggtggatgataaagaattaaaagaatagagagatgaaaataggtgtataaaaaaaatatggttaatgttggagtttgataattatataagttagttttttatattaaaaagtttatatgtattttatggaataattagagagggattatgccaacagaatgtttgaaataaattgcatacatatatttttaatttcacggctccgtccgaaccatg

SEQ ID NO: 117417 - DNA, 231 bp, Heterodera glycines
  Promoter: Source sequence=SeqID_7595; Location=1940..2170; Strand=-; Gene=SeqID_65337
cgccgcaatgcaacaaaacgtaattatgtaagagttaacctttaattttgctttgtagaacataaaagattacactagcccattgggacttgaactcacggcatttccaaccgtggaatgctctaagcaactgagcaatgggcactccctttagaggttccaaacagttttgtccatatttttaaaaaacttaaacggcacccctataaaaataaaagttgtccaagaatg

SEQ ID NO: 117418 - DNA, 482 bp, Heterodera glycines
  Promoter: Source sequence=SeqID_43119; Location=454..935; Strand=-; Gene=SeqID_70870
tgtcatgcttttgataaaacattagtggtttgttctgtgactttagtgtgacacaataatgtgtcttatgtttttgataaaacaatagtgtttgttctatgaatttagtgtgacacaataatgtgtcttatgtttttgataaaacaatagtgtttgttctgtgactttagtgtgacacaataatgtgtgtcatttttttgataaacattagagtttgttctatgacttcattatgaaatttctttgcaatatgttaaaattaaccaaatataattatttaagcaatgaagtgtgtactgactgggctgaccattggatctcttcaaaagaataatgattttgttattggttaactgatcgtaaatagtaaaattttaaataaataataaattttatgttatgaattttattcatctgattttcatttcaaatatcttcaactttttttattttaaattaatttttaggtatttattattatg

SEQ ID NO: 117419 - DNA, 530 bp, Heterodera glycines
  Promoter: Source sequence=SeqID_15225; Location=1..530; Strand=+; Gene=SeqID_79429
agatgaaaccctaaaaatggacaaatatagaacaataaataatatgacagtgaacttaaaaagtggtatttaccaagagcactgagcgaaaacttgaattttccaaaattgatgccaatacgaagccactaaaaagtaaaaattatgtagaaaaaacatccaaatttaaacatttaccaaaaggaaaaggatgataagcggcgaagcacacaaaacagaaaacatgtcagaaactagaacagatggtcggggttcagggctgcggaaggtgtgagaaatttccggcagaagatcgtaattgacatgagacgattttggcgacatcgaagcaacaaaaataaatgtacgacctaaaaatgccaaaaatcacacaagccttattctgacagaaacactaacaaaaaagtacctaagtccaagccaaaccccaaaaaactacgtaggttttattttcagcctttcgcagatttaaataaaaatacataatgccacattaaacttggcatttaaaagaagcactaattcaaatg

SEQ ID NO: 117420 - DNA, 1003 bp, Heterodera glycines
  Promoter: Source sequence=SeqID_2079; Location=1268..2270; Strand=-; Gene=SeqID_77737
attttttataataaatattaattggaaatgttttttttaaaaattggtttctgcaaaccaaactattgattcaatcctaatgagaagacgatgacatcttatttgaagatgtctgtggctgatgatacaggaattttggaaactgtggcattttttgggatgcgtggaaagcagaatgggatggtaacgaatttttaaaattcgcatatacattttaatttaggaagaggtggaaagtttgtcgggcgccgtgtgcactatgaaaattggggcaagggtgaaagaattcggagggaagaaggggatttattactctttgatcgatattgtcagcctttaaatctataaataaacttgttaatttttttaaataaaatgtttttcttaaaattatttttcctctttatcatagtgaacgcggcagaaagttgctgctgcatttcaaaagaagaaaaagagtaattaggcaataaccgacgaacaattgaggccgtacttgaagatataattagattaacaaaagaggccaaagatttttctttatcggcacataataccatggttgaagctcaaaaaataaaagacaaaaatcctagtgctcatggggtaaaattttggcatgaaaagcttttaaatggggtgagaaaaatccatgttctatttgataaaataaaaaatgaagagaataacattaaaaatataaaaaaaggtatggaaaaatgccttgacagaaaagatgctgaaatgtgccaagaactagcggatgaggcaaagaaatcaatagaattagcaaaaaactatagacaggaaattgggcaaacatatcggactgcttactcgcagcccgatttaggcattggagacttggccaataaattaaaagaaacaatgcgagaaaagcaaatagatttggaaaggccgagacctcaaacagaatttagagacgaatttattgcatataaaatataaaagaaaaatttaataaatgaaaaataaaaaaatg

SEQ ID NO: 117421 - DNA, 296 bp, Heterodera glycines
  Promoter: Source sequence=SeqID_35244; Location=1..296; Strand=+; Gene=SeqID_64844
attaagcggcgaaaaaagccaaaaggggaggaatttgaatggaacgcgcagactctgtgacggcctctgcaaattgggagggaaagtttttgagggcattggcaaacggaaaagcgtaaagagagggagggataaacgcactattttaaaatttaggggatgaaaatggcaaatgttgaggggggggggggttaatggagtgggagaggcgccggacggagcgacgatgacagtccgacctccccccccccaccccaccaatgccatctttttttacgccggtggcaccaaaaatg

SEQ ID NO: 117422 - DNA, 920 bp, Heterodera glycines
  Promoter: Source sequence=SeqID_943; Location=1183..2102; Strand=-; Gene=SeqID_64679
taatatttttcttctctaattatgtgccgtttcccttgcctctgactgccttttattcttttaattcaattctctaattatatgttattttccttttgtttttctctctaatttattcctatttttctcaatcgatattcctttgcttttcttctcccttgtgctttcctttattcattctatttggtgttcacaaaatttggacctcagacttttctcctctaaatattttgtgtgtggactcttaattttcgtcgtcttcgcattgaatttaaattaaataaattgaactgtccccgactatttcgccgtccttaattaataagcattggccccgtttgtcctttctgtgctaattaattatttggcccgagaagaggaaaagccgaacgaagcaaagcaaaagagacgagcccctccgacaaattggactccaatttttgcacgtggcgctcctggtcaactgagtaagcggtgccgggaatttttggtttttcggaaaagggcgagctcgggaacaaaattggaagggagaaatttgtggttcacgggaattcaacaaaagtgaagtagtccgtctgtcggagctttacttagttgttcatcaaagcgaatagcccgtttgccggggttcgttatctcgccggttattgcttgcctgtctgccaggggcaataaagcaacaaagtgaggacgaggagcaagggacatttcagaaaaacgcatagctgcgattctgaataaataacgcattgttgcgcttttcttcgagttgaatttgtgtcccacaaataacgcattgttgcgataagtgtggacatcgacaaatcaccgacaaatcgggccgtttttcgaggatcgccgtttaactttgtttttgttttgttgagtagtacctctgcggtagctcaaacaaaatg

SEQ ID NO: 117423 - DNA, 93 bp, Heterodera glycines
  Promoter: Source sequence=SeqID_19783; Location=1..93; Strand=+; Gene= SeqID_84521
tttctcatattacctagggatagcgagagtctcggttcccggtctcgggattttagtctcggaaaacgagaaatttttacactgttaaggatg

SEQ ID NO: 117424 - DNA, 54 bp, Heterodera glycines
  Promoter: Source sequence=SeqID_32272; Location=1..54; Strand=+; Gene= SeqID_62587
atcaatttcggctacgcatgtgccatttattttttggacgacccgccagaaatg

SEQ ID NO: 117425 - DNA, 160 bp, Heterodera glycines
  misc_feature (64)..(64): n is a, c, g, or t
  Promoter: Source sequence=SeqID_38388; Location=1..160; Strand=+; Gene=SeqID_67215
catttatttgttgctcaaaggctatgtatatgttggaagaaaggaggccaaaaatagtatctcntgtgaacaaattttttgaattgtgaaagtttttggtgcttttgtggatttttgagaataattcatatttaattatttttaaaatatagaaaaaatg

SEQ ID NO: 117426 - DNA, 183 bp, Heterodera glycines
  Promoter: Source sequence=SeqID_7876; Location=2956..3138; Strand=-; Gene=SeqID_66249
tgtgaatgactgctggaaaaaactttggacgaaattcagcggagaaattttttacttggattttattgagagggaaaggataagactgacagaagaaactgaggtcaaatgaggacgaatagaatggattagaaaaaaattcaggaaaaattgaacgaattggcaaatgccaacgacgaaatg

SEQ ID NO: 117427 - DNA, 110 bp, Heterodera glycines
  misc_feature (39)..(39): n is a, c, g, or t
  Promoter: Source sequence=SeqID_15484; Location=1289..1398; Strand=-; Gene=SeqID_79758
ccgacgccgcggctgccactgccgcttcgaaaacgccgnccaccggcacaaccctcgcagcgaagccatcaaacataacagtgcttgacacgtccggcgggactgaaatg

SEQ ID NO: 117428 - DNA, 62 bp, Heterodera glycines
  Promoter: Source sequence=SeqID_6266; Location=2562..2623; Strand=-; Gene=SeqID_60948
ttgcaagcaattgggttggcgaaagggcaacgtcatagtcagcggaaccgcttgatgagatg

SEQ ID NO: 117429 - DNA, 596 bp, Heterodera glycines
  misc_feature (14)..(14): n is a, c, g, or t
  misc_feature (22)..(23): n is a, c, g, or t
  misc_feature (56)..(56): n is a, c, g, or t
  Promoter: Source sequence=SeqID_1887; Location=1..596; Strand=+; Gene= SeqID_76575
taagtaaatgatanaataaatnnatcggaataagataaagaaataattaaaaattntaatgtatatttttattaaaatattaaatgtttatatatttactaaacaatctaatatcggtttgtgcaagaaaaataatggccaaaaccaaaatcctcattcttaaagtatctcggacaaatgtatcttgaaaaataatatattaaaataatttaaattaatatctttatcgtttaattaaattttcatacaaatttcccagtttacgagatggaagaaattttattcaaattaattaaatcattaacaaaaattaaccaaaaataattgaataacagaatctatatgtataattgaacttatataaaccaaaataaataatagaaaaaataatctatattctaaatgaaatttttatattcacaaaataaatttgctttttaattcaaagataaattttttgtatttatttaacgtcacattcattaaaaaaagaatattcaataaaaatttaatttttattttagtgtttgaaatttgggttttatttatcaaagatgataaattaaaatgtaatttaaaaaacttaattaaaaatg

SEQ ID NO: 117430 - DNA, 307 bp, Heterodera glycines
  Promoter: Source sequence=SeqID_26505; Location=976..1282; Strand=+; Gene=SeqID_57235
ttttgtgtgaccatgaaatttcaggaaaattttttagccaaaaattttttatttgatgtttacatttaatgagttgaaacattcattttacttttagcaatccgaaaacaaacctaaaaagccagaaacataataaatttgtggaaaaatggtcattttttgggttgtctggctaggcaaatgtctcagaatttatgattttcatttttttttctccacaaagttttctgattttctaggcttccatcgtatggcccaatgtgcacggccgtgaggttgagcagtttcgccaatttcgtgaacaatg

SEQ ID NO: 117431 - DNA, 482 bp, Heterodera glycines
  Promoter: Source sequence=SeqID_41114; Location=138..619; Strand=-; Gene=SeqID_69311
ttttcctaccctttgtagatggagggatggggtggtaattttaaaaaatccaaaaatttcctaacgaatttagcctttttggatgtgcttcttaccaacagagggaatccataaatgaaaaaagcttagaaaaaactaaactgtaaattgtactaattttataaatggagagaataaataattaagtggttaatgctaagtcgggaattggaagtcaggaaaagagatgagtgaggaaagaatgagtcatcaaaatcgagtccctgagagaatcatcccgagtggggaaatttctttaaattatggctctaaatttcgaaaataatttggctttttatgtacgtaaatggattaatggcatttgcctccctttttaggcattttccgttcacaatgccaattttggtctgtcgctcgccgtcatcgccaccatttacgtgtcctttttttctgccaaaatcatcaaaatttggctcaaaatg

SEQ ID NO: 117432 - DNA, 716 bp, Heterodera glycines
  Promoter: Source sequence=SeqID_28826; Location=409..1124; Strand=+; Gene=SeqID_59409
tcgtccgtcttcggtaattgtcgtcccatcattttccatttgcttcatttgtcccatttccgttaacatttccttcgttttgcttttccttttcctcttaatgctttccgtccttttccgcttttccccattcgttcgcttaagcatcattccgttccgctgatgccttccgccgactccgagctcagtcggctggcttattgggtgggttatggcacttcgcactgcaaattccctttcccccaccgcttttcccccattaaccctttgatccttcccccaaaagttggcgttggatgagccgagcggtgcgcgagacgatgaagagagtgtggcgggagaggaggacgaggaacaaaaagaggagggagagagtgtgggagagagagggggagagggcgtaagtgacgggagagaagggccgtgtaggaagcggagctcagttagcgcttcttttcttctttttttttgctagtgatactcgggaacggactctcgacaaaagcggagggattctcgagactcgggactgaaattgccccccccccccgagacgaccctttttcgagaatgagttccttcccgagtatcactattttccttttcgtttgcgcttttcttttcttttttaaattaatttttggaccaaatttaattcaaaaattaattaattaacaaattcaatgctttttaactgcaaaatgcttttcaaaatg

SEQ ID NO: 117433 - DNA, 82 bp, Heterodera glycines
  Promoter: Source sequence=SeqID_22803; Location=1294..1375; Strand=-; Gene=SeqID_53505
tttttatttgatgacttttttctgatcagtttggcgaccgtagccaaaaaagccgaaaatttacaatagcaaatcgaccatg

SEQ ID NO: 117434 - DNA, 407 bp, Heterodera glycines
  Promoter: Source sequence=SeqID_16993; Location=1..407; Strand=+; Gene=SeqID_81417
tccgccttttttgcttttagtttcttttgtcccgccccttttttttgctatttaatcacagtttttctacataaaaaaatcattcgtccattttaaaaaaattccatccacgttcgttttttctgttcttcctgcaatgaattctctaaacgctttcaactcccggagcaagggacacgacagcaagaggagttggattccgttgaaccaaaaaacatcagcgatgtggtcaacttcaattcggccggcgttttttatgttttgggaaaagtgacaaatatgcagtaccgtgtttacaaagtccaaattaaattaattaattaaattattaattttttctagtttaggcatgcccatttcgttccaaggggctcatttgccgccgaaaattgtccgatgataacatg

SEQ ID NO: 117435 - DNA, 699 bp, Heterodera glycines
  Promoter: Source sequence=SeqID_5776; Location=1..699; Strand=+; Gene= SeqID_59189
cccccccccctccttttgttttcggcattttttgcttggtgtgtgacccccccccccctctaatttattatttatacattctgcttttctttcctctctccactgacctaagttttgttgttaaaactcctttcctccatttgaacaaaacacccaccgcttcaccccccccccccttaacatctgatagtgagaaaggctaatgagtgcttttctttcccaacagcactttgtagaaaggcgtcaactaaggtcagaaaacaacgataatggcatgtccaattttgatagatgaaccagaaggattattatgtgttttaggaccgcaagtcaagtggaactaatttaacaaatagcacaaaggaattggtgaattttcggtgatatataatattaataaatcatccatcctaattatttgttttatttttaattttacaaaatacaattttttaatatctccgcttatttgaggaatgaatgtgttgtttgtttatgtttagcgttgattgggaattaaaggaaaagtcagcgcggcgtcgaaaattgaagcaaaaaattattaaattgtgccaatttgatgatcgcacataaattatgccattcgctcagtcattaatttcacttgggaaagtccgaggggctgcccatttggcagcataattgtgctttcccttaaaaagtttgtttgtcccaatg

SEQ ID NO: 117436 - DNA, 1003 bp, Heterodera glycines
  Promoter: Source sequence=SeqID_5552; Location=1979..2981; Strand=+; Gene=SeqID_58429
ttcatttttatgttcattctgtacagaatgaccttttttgatcttgcaaatctttgtgactaaacctagcttgtttgaatcaatttagaaacaaaagtgagaatttttaggtttcaaatttttgttcaagcccgggtccgcgattcgaaattgctcaaaattaatgtcatattcgtgataagcaaccctaaaacccccgtaagcatgttttcacgagttttagaacaaaaaaaaatttcaaaaagggcgggggagggggggggggaccatcggcagtgttactgaattttcgtttgttgtactgtttcacaactcttcggttttgcttgaccgtttcagtgatagttagcgtgtatcacactcaaattttagctaatttcactttaacgccaaaacaatgaccatcctcagcttcttttgcaagagaaattttttaaaaattcccgagataaatggacactcctaagtcgttggattgcctaaagtgcgacagagtcaaaattgtcaacacaatgaaatgtgtccaacggtcaaatggaaattttttgagctttagattttttaaaactaaatggagggatttttagcgggacattctcaaaaaaaaaattttaccaatgcaacctagccagaaattaccttcaaaaaaaaatttttgttttttttcactttttctgcaaattgctttggaaacaatctgagtgatcgttgccgtttttggtcactgtcgatcagccttttgataattttcatttaacttggaaagttcaatgagtgttcctttaaattcctatgttatacggagtacaagcagtgaattctgatcagtgttccattgaaaataggtagctaaatgtcacggtcaagttcgccatcgctgtcggattcttctggctcgttgaagccgaatacggctattcactctggctggaataattgctacccatgccagcatttctcatcattcaaagctttcaaaattaagcgcatgtcacacaaaatg

SEQ ID NO: 117437 - DNA, 292 bp, Heterodera glycines
  Promoter: Source sequence=SeqID_31620; Location=1188..1479; Strand=-; Gene=SeqID_61938
aaaaaaaaatgtttttttgattttattaatgatttaaaaatatgaaaatggtcgaaaacgatcaccgaaagttttaatttttgtctttaactcgaagtgaatgcctgaaatagattctacggacctaaaaaccattaaaataactttacattggaaaatttttgaaaatttatcatggacacgtatttatttgtaatttatgattttcgtttttggttcaaaaatttattttttgtttttctttaaaataattatctaatacacccatacccattagtgggtgccgataatg

SEQ ID NO: 117438 - DNA, 128 bp, Heterodera glycines
  Promoter: Source sequence=SeqID_18477; Location=2594..2721; Strand=-; Gene=SeqID_83088
gcaaaagtattggcaggccaattgtgtcaacttgacgaagtcatcgtgaaaattgcagaaaccccagcggaaaaggcatttttaattcgtttaaaaaattttaattaaaatttctatttcagaaaatg

SEQ ID NO: 117439 - DNA, 153 bp, Heterodera glycines
  Promoter: Source sequence=SeqID_11346; Location=2720..2872; Strand=-; Gene=SeqID_74730
cccccccgtacccaaaaaagaaaaatttcagtaaatttttttgaaattataagcattttcttaacaatttgcataaaaatactaaaaaacaattttcccggcggcgcctattagcactgccggacctccatttgaccatatttttgaaaaatg

SEQ ID NO: 117440 - DNA, 93 bp, Heterodera glycines
  Promoter: Source sequence=SeqID_8136; Location=4663..4755; Strand=+; Gene=SeqID_67093
taaatgaaactaattacctaaataattaaaggtttttttttatttaacacgggtcattactatttcattttttcatttctacatttgctgatg

SEQ ID NO: 117441 - DNA, 451 bp, Heterodera glycines
  Promoter: Source sequence=SeqID_7540; Location=2771..3221; Strand=-; Gene=SeqID_65163
aattgaaagggaagcattggcattagtgtatgcggttaaggaattctcgccatatatagttgggtctggggttacaaaagtaatcacggataatattaatgaaaatttgattgccaaaaatgatgaaattttgaatgaaaatccgagaataaccttaaaaacagtgattgaggcacaaacaaaggtaaaggaattggccaaaattttctacattttaaaaaccggaaagtgtccaagtgatgttctgaaatggaaaagagttgtttctgattatagcttgataaatggagccatttatttcgtaaaaggcaaagaaaacatggagaaacctaaattaataatccctcattctttaagacaaaaactttttcttattttccattcagagggccattttggattcgaaaaaacttggcacgaaattaaagaacgattttattggatcggaatg

SEQ ID NO: 117442 - DNA, 1003 bp, Heterodera glycines
  Promoter: Source sequence=SeqID_23671; Location=263..1265; Strand=+; Gene=SeqID_54367
aaaatttaagtacattaaattcacagtaaaaattgcttataactatgctctaaagcagccgagtttttaattcttgatatcattcgatagcaagtgttctctatttgcttgcacaatttcaaaaattagttaatattcaaaaaagttatgacgaaaattttcaaaaaagaaggaaatttttttgaaattttgcagactgatagagaagaagagttagtgctatcaaatgtcagtcattaaaaacaaaactattattctaaatgctgaacatcagctgtactaaaatccgattcccgagatttttgggcatcagatttccgatttcctttttgaaaatttttggggcctcaaatgctttccctgctgatgaaaagtagagcaagacttatgtgtcttgggttcttctccatcccgaacaaaaggaaaagaaaattcagggggcgactcagaatttttcctaaagataaaaatagcactctcaccgaatttgagtgtaacaggcgacattcacacatccccgatcttaaggaccaattttactttaatcacttaaaataccagtagtgaaattagtttcttacaaatgtaaaaataagatgttaggcctaaaagaccaaaaacaaagttttatttagttttcagtcccattccatattttcagaaatttttaaaaatttctttacgaaattttttttattttttcccgaaattgtccgcaaatgtccgtccgcaaatgtcccactgcggattttacgcatttttaattgaaacagcgcagacgatttttcacttgattatcgtctaatccagacaatcttggtatcaaacgaaagctcttaacatgctctattagccttaccaaatcgaaaggattttcaagcctagaaaaaattttattaagaaaaaacttcaaaaatttcgactttttgcaattttcagtgtataacttttttggtaattgtctaatcgtgaagcagtagcttagaaaaagcttctaaacatg

SEQ ID NO: 117443 - DNA, 160 bp, Heterodera glycines
  Promoter: Source sequence=SeqID_15710; Location=2494..2653; Strand=-; Gene=SeqID_80024
tttcggaggtcgctttgacaacattatgctgtttcggcagttcttcctctacggattttgcccgtagatgatccgacgtggtaacaaattatacgaaatgaaaattgcgaggggcgaaaaaaatccggaaatcatcgtaagagacagctggaaccttatg

SEQ ID NO: 117444 - DNA, 322 bp, Heterodera glycines
  Promoter: Source sequence=SeqID_1382; Location=2907..3228; Strand=-; Gene=SeqID_73175
tttttaggccattaattttccctgtctggtgctattaatcgaaagcttaaaagctcaaactttttaaacacaaacaaaaacggtcagtttttgcaaattgatacaaagagtaattcgaatttgatcttccaagtacacttttctttttaccttacaaattaatgccagaatatggctaaaaaatctaagttttgattgataacaataagttttgattgataacaaaggtaggattagccattttctattttaaaaaatagttatggcttgaagggaggtggtggtactaaaaattggttggacgcgtataaaaagcgatatg

SEQ ID NO: 117445 - DNA, 500 bp, Heterodera glycines
  Promoter: Source sequence=SeqID_13915; Location=1645..2144; Strand=-; Gene=SeqID_77867
tacctgcaattagcgctacctagaagatgtatattaatgtctaattgaaaaaaataaatgctaaagtgcgggagaggaatgtaaaacgttatgaatttatacgaagtcaagttgtccatccagttgtaagtgtattaggctgcgagatcgcgaaaatgttaatgagcaacaaataaatgagcggatttgaagacggaatgaaaaatttctatgtgacttcatttctctctaccccttcgttaattttactacacactactcgattggtaaaccaatgtacatgtgctgaatgaataagtcgaatggaaatacccggaagataaccactaccccttgacaatactcaaagttttggatgatttctttagaaaatttgatattctgttttgcccgtcaaagtgaatggtaggctctgattctctttatttatgaagtgcaccaaaaacaatcaaaaaggcaggatagacgtaaatacatatgcaaacacaaacaatgagatg

SEQ ID NO: 117446 - DNA, 449 bp, Heterodera glycines
  Promoter: Source sequence=SeqID_22716; Location=1..449; Strand=+; Gene=SeqID_53403
atttttaacccccgcggcacgcacaattcagtcgaatttttgttgaaataaatcataaatttatgtgtcattttccaattatgttttatttgccattccgtcaataaaacagtttcttctctgctcgaggcaatgacttgtcaaatgacttgcccctctccgttcccctttcaattttctctcaattaaatgcgttcccacgccccccgggggagtgtcttttcttagtctttcctttccttttcccttcgtccgtccgcccctctttttttgctcattcatttattagccccgtttctccctccgttcctcatttggcagtccgcccccttttttccaaattgaatttgtctctcctttcattccattcatttcctcctcctcctttcccttccttcactcattctttctcccccttttttcttttcttttttcagtcccttaaaatg

SEQ ID NO: 117447 - DNA, 237 bp, Heterodera glycines
  Promoter: Source sequence=SeqID_44401; Location=1..237; Strand=+; Gene=SeqID_71888
attttctattcaattccattcttctgttgccgaccccctttatcaactgtggctttaaatgcacaaatgtttcaaattcgcaaaattatggctgttctgcggagggaaatgttttgcgcttttttgtcatcggtgacatcggtggggaggagtatacggtagagggcaaacagcagcagtgtacggtggaaggacacggtaagttgaagagggagaacaaaataacattttaaaatg

SEQ ID NO: 117448 - DNA, 392 bp, Heterodera glycines
  Promoter: Source sequence=SeqID_6534; Location=1..392; Strand=+; Gene= SeqID_61925
ccgcttaattatggcaaattcattcagagaaagaaaaaaaattgaagtgaatatttcgacgacttaattacaccaataattaatttaattcttcttcataaatatgctgcactttccttcctttcgtctgatcattttatttttattttttggtataatgccaattattcaaaattcggactcagacagagaaaatgagaagcaaaatctttggaatttgcgggggaatggagcaaaagtgaatataaaataatgacagaatattttgggaatattcttgacagaatcctttcgtgccgggcatttttcaacggaaaacgataaattcgttgatgaacagaaaattgaacattttccgagaacgatggacaaatggtggagaaagaaaaatg

SEQ ID NO: 117449 - DNA, 58 bp, Heterodera glycines
  Promoter: Source sequence=SeqID_1302; Location=6183..6240; Strand=+; Gene=SeqID_72089
gtgatcaatcgggatcgggccttaaaagtaaacaacgaaaatttgtaatcaaaaaatg

SEQ ID NO: 117450 - DNA, 1003 bp, Heterodera glycines
  Promoter: Source sequence=SeqID_29965; Location=224..1226; Strand=+; Gene=SeqID_46186
agtatctatttatcttttttttattatttctctctctctctctctcacacacacacaccctctctctctctcccactctctttctctctctcacacactctctctctctcctctctcaatctctctctctctcacacaactctctctctctcaatctctctctttctcactttctttctctttttctttttactttcattctttcatacataatattttgattcattatttgtttaaaaaaattaagcttttctctcaaaaattttaataaaaaaaacaaaacaatataataattaaaaaatgtacaatttgaattaaagtttgtggattagaattttaatgttaaatagtagtatttaattaatttaatttgaaaaagataaaagtaaataaataaaaagaaaaaagtgatgaaaaatctcaaattttattattgcataattttcttaaatttatttacaaaaagtttttattggcattatgtttattttcgcgttaatttgaatcgatattttttgtgacggaatgacacgacccaaatagtatatttagatttgaagaaatttagagacattacacccttaatttggaaaatttatatgcatatttttcactttttatgtgcatattttgccatttttggtgcatattttatgcgcatatttttggatgccctagttatgattagaaaagtcaaactctctttttgtaaggcaatttcatcatagtgatactaaaagaaacgggtaacgggtagccaaacccgcagctgcgggtgagcccagcgagaacccggtaacattcatttagtacgggctgagggtgagttaaccgggttaagttataacattacctcgttcttttggtacgggccccgccggacgctgtgtataagattaaaaaggaacacaaaaacccacgaagacttttgtttttgttgcattctttttgcaaaaactattcatttattttacctatttatttttcagtttattttgaaatg

SEQ ID NO: 117451 - DNA, 262 bp, Heterodera glycines
  Promoter: Source sequence=SeqID_33554; Location=1..262; Strand=+; Gene=SeqID_63583
taagcctaaagtttttcgctcgtttaaaaagcaattaaaaatttttagatttttattcatctccctttttgatagtgaaagcatctgagtgcctaaactaacctgtaaataaagttttgtgtgtttcagagcacgttctaaaaaatatttatgaattaattttgcaaaataataaataattaatgaaaaagtcagaatttcgaaaaattttaaaaacaacaagcgttggcattttttcaggttaagttagtcctttacaatg

SEQ ID NO: 117452 - DNA, 291 bp, Heterodera glycines
  Promoter: Source sequence=SeqID_9343; Location=1..291; Strand=+; Gene= SeqID_71062
aatgggtttgtagaaattatgaaatagaatattgaattcatttccatagtttgtagattcgccgaatatttgctctgccttttctccgtaaagaagaaatttcaaaaatgtggccacatttgccaaaattcagaaatgattttgaaggaattcttagagaagatatggattcttttgtagattatatgaataatcaatggatcaaaaaagttggactaagcggggaggggttccagacggaccgcgcgatgcaatgaaataactaaccgcttacaaatacgattgacaatg

SEQ ID NO: 117453 - DNA, 62 bp, Heterodera glycines
  Promoter: Source sequence=SeqID_34839; Location=1015..1076; Strand=-; Gene=SeqID_64535
tggattttgctaaaataaaaattgtgcgctcttattccttaatattaaatttaattaaaatg

SEQ ID NO: 117454 - DNA, 1003 bp, Heterodera glycines
  Promoter: Source sequence=SeqID_321; Location=4532..5534; Strand=-; Gene=SeqID_82140
aaaaagtgatcggaatgtacaaaaatgcatatacctacttgctttaagataaaaatatttatataaaaattctttattaaaggaggatttttaggtcctaaaaatcgagaaatatgtgactaaatagttgctaaaaactgaaaaatgccaaaaaacgtgaaaaaaatgccaacaaatgtgtgatgtttccaaaattgccttattctttttccatttcggttgcacaattgtaaatgaaacataatttcaagattttcaagcgaaaaagttttcgattgtccgccaaatcatggccaggatatcaattcttagggggatgtattttttgaaagatttttaggccggttcgcaggttgaatttttattttttaaatacatttttcatcagaaaattttttgttctcaaacaagaatagttgaaaaatagtttttaaaaaatttcacaagccaaaagagttggcaattaacaaaaagcccaaaatagttaacactgttgctactaaaaattataattcaaaaaattgttggagaaaatgtgatgattttcgtgcttctctcatcaaatgctatccgcaaagatcctagccctaattattaattaaaattttatttcctacatcgccttctttaaaatgggaatttgtttatttttaattagccagggataacgcagttttaaaaatattctatgtcgagaatggaaccaggcttctgtttttttaattagccaagaatgacgaatttttagaaatattttatgcgaaaattgaacacggaatcttgtctttgttatttttgcttccatcctccatatcctaacccgggtattgtttgataatatatcccgaaaaaaccacgatttcaaaaaactctgaatgggtgcgtttcctgaatccaaatccatttggttttgcttcaccgaaattttaatcgacaagaaattgtccaattaagtgatagtccgattaagatcgcaaaaaatattattttctaattcgacatg

SEQ ID NO: 117455 - DNA, 776 bp, Heterodera glycines
  Promoter: Source sequence=SeqID_17435; Location=822..1597; Strand=-; Gene=SeqID_81917
ataaaaaataaataaaaaagaaaataatattaattgtggaccccggaaatctggaaagttttggacaaatccctgaaaagtgacacctccaaattttttatttataccaatgcctcccgttatttcgggctcccaacagttccccatcaaagtgaccccgacttttcatttcaccctaatctttaatacttgtggactctaaaaccgaaaattttagaccaatcctttcggaaaatttttgataatccctgagaacttacacctccaaatcgcctcgaatatctcggaccccccatttttcccatcaatcttatgcgagcacaaatcttaatctttcttcctaaattaacaaattttttgcaattttattaaattttcataaaaaaaacccccagaccaacgcccgattgttcgccaaacattgtggcttgttcgtcatgctgaacggcttgacaacatatctaattaggggcaataatttaaatgaattggaccaacaagacacacctttgtccaaaagaggcattgaacaagcgaaagaacttggaaaacggtaaaaaatttaatttatctaattttttttgcggattttatgtgacaaaaataaattttaattttttttttaactttagagtgggttttatataacagattagtttagtgaatttcataatcttttgcatctttgtgagcgatttttttttctaaattaaaatttgtacaatttctgtactttttcataaacattttttaaatttctctaggtattaaaaatg

SEQ ID NO: 117456 - DNA, 357 bp, Heterodera glycines
  Promoter: Source sequence=SeqID_6405; Location=887..1243; Strand=-; Gene=SeqID_61437
ttgctcatcatttgctttttaaattcatctctcttctgactctatgccaatttttttctcttcaaaaacactgaaaaaagaaatgaaaatgtttcatttcgttttgtttcgttttgcttcgcaatttcgcaattttctgcgtctctttctcaattatgtgtatgaccattttgtttctttctctcatgcaatttcttatttaaaaaaatgcatgagccaaattatgtaaatctttttttaaatcaaatgacttatctgctggctcgaagggcgcatttacgaacttaaatttccatttttatccctcttaaaggattttattgtattaattcacttttacgaaagcttaaaaagatg

SEQ ID NO: 117457 - DNA, 156 bp, Heterodera glycines
  Promoter: Source sequence=SeqID_21372; Location=1379..1534; Strand=-; Gene=SeqID_51978
tttctctattgcacacattcaagaaataaattgataaattaaaaccctaatcgaccgtttttctatctgcaaaaaatgctgcaattcgaagaggtttgtcctaatgtcgtcggtgattcgccatgaaatctgttcgaaactttcatgcaggcaatg

SEQ ID NO: 117458 - DNA, 86 bp, Heterodera glycines
  Promoter: Source sequence=SeqID_31867; Location=1375..1460; Strand=-; Gene=SeqID_62178
ttttggggaaaaagtcggaatgtgtggaaaatggcagtgtaaagggaatgcagaatgagactcaaaggggaataatacaaaaaatg

SEQ ID NO: 117459 - DNA, 612 bp, Heterodera glycines
  misc_feature (71)..(71): n is a, c, g, or t
  misc_feature (77)..(77): n is a, c, g, or t
  misc_feature (170)..(170): n is a, c, g, or t
  misc_feature (184)..(184): n is a, c, g, or t
  Promoter: Source sequence=SeqID_3038; Location=8519..9130; Strand=-; Gene=SeqID_82892
attttcgataattttaaaatttttatgaataccacaccgtatcatatgccacatatgatttttgggtgatntattcnaacagaaattttgcgtatactatgacggctacccgacttttgggggtttgcaacttggggaccgacatttgggaatccgacttttggagattntaataaacattttntaatcccccggaaacaagcagcagttgacctttctctattcattttattcaatttttacagttccgtccggcctgttaacagcggacgaagtggtcggcgtggaacaataccgaaaccatccgaatgcaacgatgccctttggcatactgtacccctaccgaaaccatccgaatgcaacgatgccctttggcatactgtaccccatgcaatttccgataaatgagcgaatttggaagacaaagggaacacttattatggagattgacaattttttggaatttgcaccagaaaaattgggggattgcaaattcagcgaaacaacgcacatcagcaggtttttcagccatttgctttgcttaaattcaagaaattcatacaaaatatctttagaaaaaggataataatgaatagggatgtcaaaaatatg

SEQ ID NO: 117460 - DNA, 59 bp, Heterodera glycines
  Promoter: Source sequence=SeqID_23071; Location=1..59; Strand=+; Gene= SeqID_53773
tgccgagtaccaacaacaacagcggcacggtggcagcaattctagtgccgaaaacaatg

SEQ ID NO: 117461 - DNA, 339 bp, Heterodera glycines
  Promoter: Source sequence=SeqID_5189; Location=282..620; Strand=+; Gene=SeqID_57215
ggttagttgccaaaaatggaattagcttgaaaatttcgagttcggaattttgtaaatagggaacggggactgaactgattttggacagtgagaagaaacccagttttaccgggggccccgccgaaatcggggatttacaataatcaataacatggtcaaaattgaaccagcgttttttaagtgattgagaaaaacgaggaaataatacgatggtttttcttttttccgaaattaagttttttcaattggattttcaactttacaaagaataatttctcaggtagagttctttcgtcctttcgcgatccgaccaatttgcaagcgaatacccaaagcatg

SEQ ID NO: 117462 - DNA, 496 bp, Heterodera glycines
  Promoter: Source sequence=SeqID_40637; Location=384..879; Strand=-; Gene=SeqID_68905
ttgcgacgtcattatgcccaatgccatggcattttatgcgcttttcaaccaaataaaagtattatcaatttttaaatctaattttttttgcaccattcccccccccctaaattttaggcactgttcaagaatgtgccgctgttctgctccgtcgtgattgggccaacactggttttgatcgggaattgttccagcaaattaattcaagtattttttttttgttttgttttgcatttacgagttatattaaaattagcattttctccttatttaatgccattttcggcctccaaaaagtcaaaaaacgccaaatttagctcattttttgaaatcaaactcactcatttgacatcatttattttagtaaaaattggcattttcagccccccccccaaaaaaaaaaatcaaaaaatgccgaaattttgctctattaaaaaaaacaaccactcatttgactcgctttcctcctacaataggccaaccgcctcaatgcatg

SEQ ID NO: 117463 - DNA, 162 bp, Heterodera glycines
  Promoter: Source sequence=SeqID_18781; Location=2319..2480; Strand=-; Gene=SeqID_83456
gctcagagtgatgccgagactaagccaagaaagacgcagaagagaaggctgaaaaaggatgccgaggctacagccaagtaagacgcagaggagaagactaaaaaggatgccgaggctacagccaagaaagacgcagaagcaaagaaaaaggaggaagaaatg

SEQ ID NO: 117464 - DNA, 821 bp, Heterodera glycines
  Promoter: Source sequence=SeqID_6094; Location=965..1785; Strand=-; Gene=SeqID_60313
tggcatccgctttgatcgtgatctatattgttaatacattctttcccaaaattagaatacagattttttttgctaattctaatacttcctatggtcgcatcgggctggacatttaccaagcctacgagcccaaattaaaaaaaattaatttatttaaaaatatagattctattttaaataaaatattgcttcaaaacttctgttaaaaatgataagtagggttcgaagttgtatacactaaaaaatgccaaatacatgaatttatataaataaatttttttcaaaaatttcttactaaaagttaaaaaattttcggtttttaagggtttattttttgaaaaattcccaaaaaagtcgatatagagaattttggccaaactcttcgttgatggagatcattcaacacgagattttttacattggtaagaatgggggagtgggctgtgagaaaatattttttttaattggttaagaggaaaatttagttgagaaaaaataataaactatattaatatagtcaagcggttaaacctccagtctttcacttgtttttgtcttacaaattagttcgatccccacacataataaaattattattttttattagtaagtaaaataaggatgttttcaaatttttaattttttaaatttaatcaaaaaccagcagaaaagtgatcattttgtagcttagtggctatattgatcattttttttagggaaagctgttacatttttcactcaaatttttccaagcggcgcctataggcaccgcttgacccctctactcaacaaaattattacaagaaaatgtttcagaaatg

SEQ ID NO: 117465 - DNA, 70 bp, Heterodera glycines
  Promoter: Source sequence=SeqID_14315; Location=428..497; Strand=+; Gene=SeqID_78345
ggtcggtattggcaaaaaatgcgaaatggggagaaaccgacgactgaaaaattgtcctctttagacaatg

SEQ ID NO: 117466 - DNA, 719 bp, Heterodera glycines
  Promoter: Source sequence=SeqID_24103; Location=1..719; Strand=+; Gene=SeqID_54807
gcagttaaagttcagatggttcccttgataagtgccgtacttcatttgccattttgaaaacatttaatggattttaaatgtatagcaaaaggaagtaaaaaagttttacagacgggatttgttcgaaagataaaagccgacaaagggagcaataaagcaatgctcatacgaagaaacactttaaatttctcatgccagcctaattctacggaaatttagaaatttaaaaacagtaaaaatgttctctcagctttaattattttggccgacaatttgatttcgttgattatgaagatagttctccaaagtgcatgttgataaactatttctttcaggcccaaaaaaaactttttgccctttccccagcagcagtgtcaatcatcgccttatttgtcatttatggccattttaatcattttgtgtttaaccgagtgattttcgccatcataaatactaaagtgccgtttaatttgacacagtgttaataaaatcttttttgacaattaggtgttaattataagaaacttatatttttccgtagactgactgtagaaggcctgaaattcatgaaaatatattagcttagtttgaagcttatagggtggacttttattattttgcgattttatatacaaataatcacagatatatgtactaataaatcaaaataaaaattaaattaaattaaaatttttttatttgtagctttaaaaaatatg

SEQ ID NO: 117467 - DNA, 670 bp, Heterodera glycines
  Promoter: Source sequence=SeqID_7662; Location=1..670; Strand=+; Gene= SeqID_65546
caactgctggccaagctttgaccaaatggttacacactccgagcaaagatggacaaccgaagcgattgcatcgcaataatttgttggtccacagaatctcgaatcggtcaacaacttcaaagaggtgtgtttggtcagattctcataaaatttggctaatacttataaatggtattccctttttcgaaaaatattttaaatgagtcaatatttcaaagagatggccactttttcattaaacgactgactaattggttgatttttttggtattttaggcaacattttcaaacttattttttctttataaatcttcaaaatatgtaaaaaaaaatgaaaatgtgtacaaaaatatttgccgaaattttggattttttttgcggatttccaaaaatttccttaaaaaatactcaaaatatgtaaaaaaatgaaaatatatatgaaaaaaatccaaaatatgtacaaatatgtaagaaaatcccgaaatatgtaaaaatatttaaataaaagtcccaacttttgttcacaaacacaaaaaagaaagtgcttttcctactattaaaagcatggagaatccaggaaaaaatatgtatttacacaaaattggcagccctatttatgggtatataaagaggccaaaaagactttttgaatgcataatatcacaaaatg

SEQ ID NO: 117468 - DNA, 315 bp, Heterodera glycines
  Promoter: Source sequence=SeqID_14629; Location=2370..2684; Strand=+; Gene=SeqID_78717
tagaaataaacattaaaattctaaaaattaaatttttatttttatattattttattgtaattcataaacaaaaaaaaaatggagaaagaaagaaagtgaagactgaatgaatgaatgcatcaaatgaaaacaacaaccatttattactcctaagccaatattttttgatttccgcataggaaatccggggggaattaatcaatttcacaataaatcactaaacatttgcgtagcaatttataaattatataatattttatatgtttaagtctctgagaaaataatttggaaaaacaatcaaaaattttagcaatg

SEQ ID NO: 117469 - DNA, 403 bp, Heterodera glycines
  Promoter: Source sequence=SeqID_14215; Location=1734..2136; Strand=+; Gene=SeqID_78234
tcctttaataatagacaggtcatcttttcttcgtctgagcagttggacagtctcagtttcctgcttcacttttatgccaatttgatctgacgaactttatcgccgtttgaattgatacgtcctgtttaggcaatgcgtcaaattgacaaatttgataggcaacttttccaaaattaaattaaaaatggatgtcagagtactttcaacaaagacgatcacttttttctcttcgcattcattctttttgcgatgatttctacaaaaatgcttgctgtttctgcaagaaggtgcacaaattcagggcgatggcgaatttgtagttttatgtaataaaaggaataattatcttcagtttaaacacactaaaatttaacaaattgccacaaaatttgaccataaaatg

SEQ ID NO: 117470 - DNA, 457 bp, Heterodera glycines
  misc_feature (59)..(59): n is a, c, g, or t
  misc_feature (66)..(66): n is a, c, g, or t
  Promoter: Source sequence=SeqID_42539; Location=1..457; Strand=+; Gene=SeqID_70409
cgccggacttgccgagatgaacaatcactacaagggcatttttaaagggaacagaaagngaattgncggccgccggagtgtctctaatttcatccttagcgacgaaaatttaaaattttatgattcatctgtttaaaataattttacgccaaattcataacctttgtgattttaagccttttgttatattagtcagcatttttacatttaattttctgttcgcctatgtaaaatttgccgtatttaaaccattgcaaaatcaccattttttatcgttcaatcgttcattaataaatatatttgttcgatcaaaattcactaataaagtgtgaaatataattgaagtattgggaaatccaataaaataaatttaatttaaataaattaaatatttaaattaattcttattgactatctgaaaaaaggagtcaataaagtggtgccacgaccaaacatg

SEQ ID NO: 117471 - DNA, 198 bp, Heterodera glycines
  Promoter: Source sequence=SeqID_18533; Location=346..543; Strand=+; Gene=SeqID_83159
ggtaaaacaaaggggagggggctaattaattaattagggggataaaaattaaatgaatcatttatttaattaattagggatgcattgggagaagggatttttcaaaagcaacaataaaattgcattgattggctaatcagttgttcactggaccattctctgatcagtgaggtgacctacgagaaggagggaataatg

SEQ ID NO: 117472 - DNA, 1003 bp, Heterodera glycines
  Promoter: Source sequence=SeqID_1557; Location=852..1854; Strand=+; Gene=SeqID_74446
tcaaattttgtggacgttgttcaaaaattagtactactctacataccagcagtttgggtcctggttttatgtcaacatttttctctccttaatttacaaaatttgctcaaaatcgcaaaatttggtcatttttcggacaaaatctgttaacaaatcgcattgaaaattataaattttttcccggcggcgcctatcggcaccgccggccccacttgcgcccaaaagttttttgggaaaagcgccgcaaaaaaatcaacttcgtttttcatgttcagaatcccaaaaaatgcttatttctaacaaaaaaatgctcaaattgatcatggacgatcaaaaataccacaattgaacattttaaacgtgttttgaataaatttgtgaaaatgaggtttttttttgcatgccaaatgaggcttttgaaaattttcatctgcgagtcagttttttgaggttttttggccataacttttttgtgtgtcaattaaattttttgaaattttgcaggctattagggactatcaagcgctttaaaatgatatcaagcttatttaatttgaatgagaaataaaaatgttatagcgtttggcgccaaaatggctggcgccaaagtggccggttcccaaaaagaatacttcttactgtcttatgcgatgcaactctgggtacttccgtgttttgctacccccccccccccccctcgaaaaatttttaaaaaaatcatatcttggagttttcaaggtcactctgactatgaaaatggtgtttgtttttcgggcctatctatgacatctagtcatcgatttaataaaaatatctatgattttttgaaattaaatatccaactctgctagctttaaagctattaagatagtaaaacaatagccattttcccgttctagcaaaaaaatgtattcaccccccccccccctatttccattaacaattagactgaattaagctttatcaatcaaatttctcattttaaatttcgtactaaataatg

SEQ ID NO: 117473 - DNA, 510 bp, Heterodera glycines
  Promoter: Source sequence=SeqID_11268; Location=1727..2236; Strand=-; Gene=SeqID_74637
tttttttagatttttaattaattattaagaattaatattattgtaaaatccgaatctatgtttgtatgtgtttatttaattccttttatacacctttaatttgatggcctgaaaagatgccaacataatttatttgcttcatttcgacttcctttaattacatcatcatcattttttgccaattatttattttattatgcctctataatgttaaattttttattaaaaaaatataattaaaaaataaataacattaaattactaggtgccattctcttttttgtcggatatcattcaaaacaattatgttggcaaacataaagatgatgaaattcattaacatcgatagacgaaatattataaatttgcaatgacattgcaacgaaatttggttggcaccatttccgctaccgatttatggcatatttaagcagcaaacaattaataataaaagtaaaataatttaaaatatatttttatctaatttaaattatttatccaataaaaatg

SEQ ID NO: 117474 - DNA, 1003 bp, Heterodera glycines
  Promoter: Source sequence=SeqID_5591; Location=325..1327; Strand=+; Gene=SeqID_58575
gaatacgtcaaagatggattcaaaattgtaaaatattttaactatttttccaaaacttggccaaatttaatttgaaaaatcaatctttggcactgcgtgaaacgaaagaatggaacggaatggttaagaattttgggaaaaaataagaaaaaattttccttttttagagaagcctctcccatattaccaggctttgctattgtaatagcgccaattaaattatcatttccaattaattttttaccaactcacagatcactattttctcggaccgcgaatttgaacaaacgacgagttacggaccggcaggcatttttctgatatttttgccaaacacggaacgatgggccaaggaatcgttcgccttttgggcacaaattgaaaggaacgaattggcagaaaaaactggcggtaaaattcggcaattttcgcttaaactgcaatgcctttgttttggtgcagttcacctcatttcgggatattgccaatccaatgacaaagggtggatcgaagagcatgtgatttttaattatgccaattagccttaatttgtttttactaacgcatttattgaggctgatttaatgtccgacattgtgtatgactggaaatggttgaccgatcaccaattgggctcactattcgtcaaaccgtacaggtggtctcattttacacatctcattttaccagggaacctggctttgttcagcagggtgaccagggtattatattatttttctgtgctagagaagagttggaatgtcgcttttcgttatccaatttctgacatttttcagcagtcgaaattcctattgccaattgccggattatttttagccatcggaatgccaatttccgtacttttttgaggtagtcggcacacatccctggtctatgccatattttaccgcatatttaaaaaaatattaatttggcatttctataacttgcgtcctactccatattgccccctccaagctttacgcctcatttttcagctatg

SEQ ID NO: 117475 - DNA, 844 bp, Heterodera glycines
  Promoter: Source sequence=SeqID_3453; Location=709..1552; Strand=-; Gene=SeqID_84738
atgtcattttatacggatgcaaaatttagaaaagatttttaaaatatgaaatataaaataaaatcacttttattagaattaaaatgccatggtcccaagactcgagaccgagacttgaccccgagaccccaaaaacccgagacttttttcaaaaatttttcttatttgcttaaaaatctctttaaaatcgttgaatttttttgagaccaatttttggtttttttgattttgattcaatttccaaaaatccaaaaaatgagcacaacccactggaccacgcaggtgctaacgaaattgaacaaaaaagtacctaaaatttataaaaatataagtttaccaaaagccaatcattttctaatcatcatttcatatttcattgtgcaaatcatcattcctcatgtattcataattgaccattgccgtgcaacagaaagtacaaattttttcatcttttattcactctcaacatttctttcattacatttgaattgtatttcaaccttttatttgcgtgggaatattttttattgtacataaaaagtattatgaaaactaaaatcttaattaaacaaatagtattattttatttaacagccgaagtccttttccgcaatttaacttaaaatttgaattaaattttgaatgactgaggcaacaacaattaatgaagtttttgtttttattttatgtgctttttctattacggtaacaaataaataaacataaaacttaataattttttaaaattcatttagggaaacaaaaagtattttaatttatgcactgtttctgcccatctttggtctaatcaatgtaatttatatttattcacaaatttgtgatg

SEQ ID NO: 117476 - DNA, 488 bp, Heterodera glycines
  Promoter: Source sequence=SeqID_44579; Location=746..1233; Strand=+; Gene=SeqID_72053
agaaaaaatcagttaataaaaattaaattaaaaaaaaattaatgtcatttagaaacccttcgaatatataattttaaattcggaattgagacaacaaatttaataaataacaaatatccctcaacttttttgaaaaaaaaacctgtaaaattaagaccctcgtatatcatgactaacttaattcaaaaaagagaaaaaaaatctaattatgtttaaaataatatctagtattttaaaaattaatttcaatatttcgtttattgaagaaaaaatgtctcaaaagcccaaaaatatattaaaaaaaaatgaaaaaatctgcacgaaaaaaaacatttgatttaaattaattaatttatttaatgaattcctaattaccatacccttaattaatttatttaatgaaaccctaattaccatatcccctccccccatacagtaactccgtgaaaagcctgttggccaagctgaatgtgcggcttgcggacatg

SEQ ID NO: 117477 - DNA, 749 bp, Heterodera glycines
  Promoter: Source sequence=SeqID_6976; Location=886..1634; Strand=+; Gene=SeqID_63459
aaacggtcagataagaaaaactctatcataaaatctcagccgaagaattatgattaaattaattcttcataacgatgttttatatcgtcaaaaaaaagtcaaattctccaggcgaaaacctaaccactgctcagggttaaaccaaaaaaagcaaacaattacaaatggacggactacgaaacaaatggataggatttattgctcatattttattttattagcttcatcaatgaaaaataaattaaaaaaatgatttctcgccttgtctgatgtaaatgttgtccttgcttttgtattcgctaaatgccatcaccggcagcggttttgaaatgcgttcgccatgttgccaaagcggtgaaatttgggcacaccttgaaaaaaaaactttaaaaaaattgaaaatgccatgcaaaaaaaagtgccaaaaatgttacgcgtttgctcacctttcagtcaatgaaaggagtcgcgcatgcaattgttggatgtattcactttaaagtataaaataaaatttaaaagattaaaatgtaatcgcggtttggattttggcatttttagtatagccagcttaagaggatttaaagcagaaagattgttttttatcaattttggagcggttcggaagaaacaaagccaaaggcttgttaggattttgtatgaatttgttattttaatcaacaaaagaaaattcaaaaaaagtttcaaaataaaccccaaaaaacagttaattaaattgaatgaatatg

SEQ ID NO: 117478 - DNA, 104 bp, Heterodera glycines
  Promoter: Source sequence=SeqID_36945; Location=1..104; Strand=+; Gene=SeqID_66140
ttaaaagaggtacaacagtgattagaagaggtgcaacagtgattagaagaaatacaacagtgattagaagagttacaacagtgattagaagaggtacaacaatg

SEQ ID NO: 117479 - DNA, 124 bp, Heterodera glycines
  Promoter: Source sequence=SeqID_5726; Location=2318..2441; Strand=-; Gene=SeqID_59044
agaatttccttcctctaccaccccctctccgtctgatgttttctttttagaatgcggcagtgcgtctgtttgtaccgtctgtcagcgtcaaaatattaaattgatcaaggtcaacaaccaaatg

SEQ ID NO: 117480 - DNA, 1003 bp, Heterodera glycines
  misc_feature (478)..(478): n is a, c, g, or t
  Promoter: Source sequence=SeqID_13062; Location=105..1107; Strand=+; Gene=SeqID_76848
cacattaattaactccattaaaattgctgcataaaaaagtatgtgttttgtcacgaatttgtcccttttggcaacaccttggaaacaaaaacgcaccccgacaaaacgtgtacgtgcacaaatcggcatttaaaattgtcatttttttttggcgtaatgatttctttcgtgacttttttttgttcctccgccgtccttcccgctctctcctgcaattcattaagccattatctaatatggcatttcaaatctatattgtccatttttcttttcaatttcttgaattgggaagcgggttctccattcattcacctcattcaaaagggcgcgagcgaccaaaacaaaacaacacgtcaaacaaaacgccacagatttttgaatgggcacagcggaaggaattttgggggagagaggggggggggacaaaagggtgaaagaatttggggggtcaaagaatgaatgaatgagtgggaggggnggggggcagacaatgggccccgaaatgatcaatacattgggcggttctgctgatgttttgtgccctttgtgtggcctaaaagttgccaagaaaatggtcaataattgagagttacataaatggcaaaatgtggattttccggaaaatttaaaaaaaaccatttttaatgcattttttggtttgccctgaggggactcaattggtggcattgtttccaaattaaggtgccaattattacgcaaatttattgtgttgaggacaaaaagcgttacatcatttgaaaaatagggctgctgttcctcgtccccgacaattttttcgtttttgttattttcggggaatccctggaattttcaagaaaacaatcctaattagaaagcattacgaccttttgtataccgtattttttatctctttttcttgtcctttctttatcaccgtaatttccaattatactaccgtaaatttggcaaaatgtcatttcaaaatttccaaatttttcagcatttcaatttgatggcaatg

SEQ ID NO: 117481 - DNA, 615 bp, Heterodera glycines
  Promoter: Source sequence=SeqID_12635; Location=4181..4795; Strand=-; Gene=SeqID_76309
attttagtacgttgaggaatggaaggcctctttaaacaattagcaggcgataatgagccgtcaattggcgttgaacgacttgaaattgctctaagggaatacggtaggtatttgtcactgatattattatttcagatgttagtttataggctaccgattttctgccgacgtttattgtgaattgttgcgcaagtatgatcgcacaatttcgggtaaaagaccagagctgctgtttttaaaataatcttgtatttaaattaagctcggttgcactttgacgattttatacatctttgtattgtactgcagcaattgactacaccctttcgtgatcgggactttggccaaaaaggacggaatagtgttggtaagtattattcatcaaaaaataatttttcgaatttttctttaaggctttggaaactacatcgctatgtttttatccacaatattataagatttgctcccatctgtatttttattgttcattggcgtgacattacgcatcattatttactctcggttcagtgtcgctataatcgactttgagctcattttcagcataccagtccgcttttccctgtcgctattctttccactcagtgtacgaagatg

SEQ ID NO: 117482 - DNA, 396 bp, Heterodera glycines
  Promoter: Source sequence=SeqID_3449; Location=3853..4248; Strand=-; Gene=SeqID_84719
ttattttccaaatttccccatttcttcgctggaaattccacaaaaatttattttatgtattgattttttcgtgaaattttttttttaataaaaaaatatatattttgcatgatctattgaaataattttttgacgcgccaatgggttttccgttttcggcattaggaaaatcataatttttttttgatcacaaaatttcaaaaataatctttgacgaaaatttttctctgtttaattgttatttaacaaaattttttttattatatttgataaattaaataatacatacctttatttattttaaaaaattgttttaataatctttaatttttaaattttataaatattttaattttagattttaattgctataaggaattttatatttttaagatg

SEQ ID NO: 117483 - DNA, 644 bp, Heterodera glycines
  misc_feature (70)..(70): n is a, c, g, or t
  misc_feature (74)..(74): n is a, c, g, or t
  misc_feature (82)..(82): n is a, c, g, or t
  misc_feature (84)..(84): n is a, c, g, or t
  misc_feature (86)..(87): n is a, c, g, or t
  misc_feature (112)..(114): n is a, c, g, or t
  misc_feature (117)..(117): n is a, c, g, or t
  misc_feature (121)..(121): n is a, c, g, or t
  misc_feature (127)..(127): n is a, c, g, or t
  misc_feature (153)..(153): n is a, c, g, or t
  misc_feature (167)..(167): n is a, c, g, or t
  misc_feature (182)..(182): n is a, c, g, or t
  misc_feature (191)..(191): n is a, c, g, or t
  misc_feature (193)..(196): n is a, c, g, or t
  misc_feature (205)..(205): n is a, c, g, or t
  misc_feature (207)..(207): n is a, c, g, or t
  misc_feature (209)..(209): n is a, c, g, or t
  misc_feature (217)..(217): n is a, c, g, or t
  misc_feature (222)..(223): n is a, c, g, or t
  misc_feature (227)..(228): n is a, c, g, or t
  misc_feature (231)..(231): n is a, c, g, or t
  misc_feature (248)..(248): n is a, c, g, or t
  misc_feature (253)..(253): n is a, c, g, or t
  misc_feature (256)..(256): n is a, c, g, or t
  misc_feature (259)..(259): n is a, c, g, or t
  misc_feature (277)..(277): n is a, c, g, or t
  misc_feature (288)..(288): n is a, c, g, or t
  misc_feature (294)..(295): n is a, c, g, or t
  misc_feature (297)..(298): n is a, c, g, or t
  misc_feature (304)..(305): n is a, c, g, or t
  misc_feature (307)..(307): n is a, c, g, or t
  misc_feature (314)..(315): n is a, c, g, or t
  misc_feature (321)..(322): n is a, c, g, or t
  misc_feature (324)..(326): n is a, c, g, or t
  misc_feature (330)..(331): n is a, c, g, or t
  misc_feature (336)..(336): n is a, c, g, or t
  misc_feature (339)..(339): n is a, c, g, or t
  misc_feature (341)..(341): n is a, c, g, or t
  misc_feature (345)..(345): n is a, c, g, or t
  misc_feature (353)..(353): n is a, c, g, or t
  misc_feature (359)..(359): n is a, c, g, or t
  misc_feature (367)..(367): n is a, c, g, or t
  misc_feature (371)..(371): n is a, c, g, or t
  misc_feature (373)..(373): n is a, c, g, or t
  misc_feature (375)..(376): n is a, c, g, or t
  misc_feature (381)..(382): n is a, c, g, or t
  misc_feature (384)..(384): n is a, c, g, or t
  misc_feature (387)..(387): n is a, c, g, or t
  misc_feature (395)..(396): n is a, c, g, or t
  misc_feature (408)..(408): n is a, c, g, or t
  misc_feature (411)..(411): n is a, c, g, or t
  misc_feature (417)..(418): n is a, c, g, or t
  misc_feature (423)..(424): n is a, c, g, or t
  misc_feature (430)..(430): n is a, c, g, or t
  misc_feature (439)..(439): n is a, c, g, or t
  misc_feature (447)..(447): n is a, c, g, or t
  misc_feature (458)..(460): n is a, c, g, or t
  misc_feature (462)..(462): n is a, c, g, or t
  misc_feature (470)..(472): n is a, c, g, or t
  misc_feature (474)..(475): n is a, c, g, or t
  misc_feature (477)..(477): n is a, c, g, or t
  misc_feature (480)..(484): n is a, c, g, or t
  Promoter: Source sequence=SeqID_20928; Location=1..644; Strand=+; Gene=SeqID_51513
ccggggacctctagagtctcataattttgcgttgattgatggtttgttgtactttctttaagagaaaaangagnccattcgncngnncgaggccgaccctttcagaaaagannnganaagncaacgncacgaaggaaaaggcgcagggcaccnaagaggcaaaaagncacggagacagcccncagaaaganannnncggccaaanangncgagggancgcgnnaaanncgngacgagccgcagaaccngcgcncanacncgcaaaccacgagggaangaaccacccangcaaanngnnaaaagnncngaaccgnnggaacnngnnngccnngacanccncncaancggaccancggaancacaaaancgcnananncccgnnancanagaccacnngaccaaagaggnggncacggnnccggnnccaaanaaaaacagngaaacagncgcaagggcannngncaacgagnnngnncnaannnnnggcactccaaaacgcatccacagcgaccgaggaggcgaatttgtaacgaaacattgacagaaattacaaaaatgcttggcgtgaaaagacggtaacgtcaggttacgaccctcaagcaaatggcgtaaatgaaagggcgaaccaaacaattttgaacatg

SEQ ID NO: 117484 - DNA, 372 bp, Heterodera glycines
  Promoter: Source sequence=SeqID_27451; Location=965..1336; Strand=-; Gene=SeqID_58146
gccgggaaaaattttgaaaatttgaatataattttttaacagattttcactaaaaaaattaccaaattttgcgtttttgtgtcattttactattaaaaataggagattttggggcgcggctgtgccgataagggccgccgggggagaaattggaaattttgaccatttttaaacatgttttcactgaaaattagtcaatttatttatcaaattctgaaaattttagggcaactcatccctcattcttaggggtgtaatattcgcgtttcgtgccaaaatgtgaaacgcgaaagcgaaagtacaaaaaaaaaagcgaaatatgcgaaagcgaaacgcgaaagcccatccctggtgtggaggagctaaaacatg

SEQ ID NO: 117485 - DNA, 482 bp, Heterodera glycines
  Promoter: Source sequence=SeqID_4599; Location=1157..1638; Strand=-; Gene=SeqID_55042
tcgattgaagcggtctcacatcatccggatagtctgtcgcagggatcgggagtcgtaacccgtgatcgtcgagtcaaaggggtccgacaagcccttccccaatcctagtcggtggtgccgttaagcaagcagcgatttgctgcacaattctctcaagcaccaatccaaatttgtcacccctcccccctcccattctcgtccccctttggcgctgatcggatcggtcagcagcatcagacccatcagaacgaacggcaaaaaagggtgcgcttccctttacgacaagcgaacggagtgagcagagagagaaagggacgagagcggtgaagaggagcgggaaccaatcccgcctcagcttggcccaccccaaccccaagcgcgcggcggaaataaaaagattggcgacaaactggtgccgttagcagggggtctccagcgaaacatttcggtcgacgaacagaacaggcggaaacgaaaaaatg

SEQ ID NO: 117486 - DNA, 464 bp, Heterodera glycines
  Promoter: Source sequence=SeqID_989; Location=2039..2502; Strand=-; Gene=SeqID_65526
agtaaatagcagaaaattgttggttttttgttcgaattttggcagaggaattttggcacgctttggagcaaatgtagccattgatggtacctttaaggtaagaatgcaaataggtactgatcatgggcgtagccagggggccgaggccccccccccccgaaaccaaaattttaaaaaattaaaataaatattttgtaaaatttgttaaataatattatcaattttaaaagaaatcccatagaaatcggctttttaaaaaacgaaaaatattcccctaaaaatcgactttttgagttgccccccccctcgaaaccaaaataaatatgttggaaaatttgcatttggtcatatccctggaatcttagacttgtccggcaagttttcaacaagtttacacaattaacccaatcgttgatcatgttgccattcccgctgtttatgctttgctaccatcaaaagaaatg

SEQ ID NO: 117487 - DNA, 398 bp, Heterodera glycines
  Promoter: Source sequence=SeqID_8389; Location=576..973; Strand=-; Gene=SeqID_67897
ttgtattttcgggtgtaaaataattagtgtcgagagtgagtcgaaaatagcaaatcccaccgttgtattctgccaaaattcggtgacgactgactaaaatcgccaatgaatgaatgacctttttccgggccgctgcacagtttaattatgcacagttttgccaagttttgtgagccaacacagagggcacctgtgggcgaattgtggcatttttgttgacgaatgacattttggggaaggcacagtaaaactacagtaatttctgttaaaaaaaaccatcctttatgagagtttatgtttatagaaagctgaggcccaaattgcataaaaataaattagttaaatagaatttcaaaaaatatatataaaatttaaatttattttttagatttaaaatg

SEQ ID NO: 117488 - DNA, 88 bp, Heterodera glycines
  Promoter: Source sequence=SeqID_2881; Location=376..463; Strand=+; Gene=SeqID_82161
cggaataattaccccatggggtgtttatcaaatgctaaaattgccttttggcctgtgcaacgcaccaagcatttttcaaagaacgatg

SEQ ID NO: 117489 - DNA, 544 bp, Heterodera glycines
  misc_feature (177)..(177): n is a, c, g, or t
  misc_feature (215)..(215): n is a, c, g, or t
  misc_feature (289)..(289): n is a, c, g, or t
  Promoter: Source sequence=SeqID_11870; Location=1..544; Strand=+; Gene=SeqID_75368
gctcgctctcttccctattcccccattcggtccctcctgctgctttgttgtggcgcgtttccgtcccatagtgacggtccgtcgcgccaaagtgccgagaaggtgtcaaccccccccccccccccccccccctccaccctgtgcacgcccagccccataacttccgtaaatctcgtnccctcctgctctttggtccgggattggcaccacatttnctagtccataagcaaagcacacaaaaagtgttgctgctctcgtatatttcgaaaccctttccatctactacctnactgcaggctgaaaaattaattataattttcgtatttcttcggggctcaatttgtcaccccctctctgagaaaggaacatttccactagcttggtactgcctgaaaaataaataataataatttacgctcccaagggttctattttcacaccccgccccactcgaaaggtgcgagcgtgggctctaatagaaggataaggaggcttcattaaaagaaatacggtaaatttggggttttttagccaaaagaaaatg

SEQ ID NO: 117490 - DNA, 957 bp, Heterodera glycines
  misc_feature (13)..(13): n is a, c, g, or t
  Promoter: Source sequence=SeqID_38084; Location=1..957; Strand=+; Gene=SeqID_67004
gtaaaaatcaccnatttgacacacaaaaaagaagactcttctgataggcgccagcagggaaatgaaaattgagaggcacttattatcccaaaaatgatcaaactcacgatttttaagcaaatttattaaaatgaaggaaaaaattaaaagaaaaaatgtgaaaaccatggaacacagggaattgaactaataacgaacggcatacacaaaaaattacagaaaattttagcagttgaaattgtacaaatttccaaaaatgctttgagttaaaaacatgcataataaatagtaaattttcaaatttatggcatttttgatgctgaactgcggggtcttgccggtctagtacgaaatcggcgcaagagtatcatctgtcggaggtttggtcctattgtgcgccaccggaaataattttgaaatttagtgtatttaattaatggcagtatttgttccaaagtggtgtttgataaattgtttgatcaacaattcactcattgaccccatctgttgccctgatcatgaatggttttcgccaaattgtgtgcaattaaccgaaggcggttgttatttttagaatcaaatgtggctgattttttcataactctttttaaacgactgttgtttgtttcattggtgtttaatgaacagagtgggagaaagattcaatttgatcgagtacaattaattaattaaccaattagtaattgagtaaaaaaataaataatttccatttgtatcgctcactcatcaactgctgattgaatcctttcagtttttagcgaacatttacctaataagtttttttcgtacgtcaatcatcgtcatgaactgctgctctttatgaacaataaattggccacttttttcactattattttacgctatttaagcactaaatttgcagagggagcgatcacttttcatttttccaattaaatttaatcagtgacaaaaatg

SEQ ID NO: 117491 - DNA, 481 bp, Heterodera glycines
  Promoter: Source sequence=SeqID_981; Location=2404..2884; Strand=-; Gene=SeqID_65380
aaaaaaggacggagagagggaccaatgccaatccaatgccaaagacaaagaaatgccaaaatgcgcgaaatttctctactcgatcgatctgctttcgtaaagacggcatccccagaaaaaaataaattttattcaatcacctaaattgtaataaacggtaaaaaattgtcacaataaattgatttatgtataataaataaataattattcgtaatttgatgacatcttcgatcactcttcattcactttcatttctctcccctttcactcttttttctttgccccattcttttggctgtcaaattattggcatttgccgcgttggcaattccaccaatgcttcttctcatctcgcccactttgccttccaaatttcctttttcattttatttctctaattttctcatttcttcctttttacttttcctttattttaaactcaatttctaagtgtttttttctttttacaaaaattaaaatg

SEQ ID NO: 117492 - DNA, 1002 bp, Heterodera glycines
  Promoter: Source sequence=SeqID_7135; Location=1255..2256; Strand=-; Gene=SeqID_63939
attagccaattaaagtttttcacaattaaaattttaattatatgtattagtgacagaaactagaccgggctaggcgagatttttaactaggtatccggaatctggctttttaatcgaataattttataaaaattttgaaaatcaatgagtcaggccggcggattttttatttctattctagcattacgccaagttgcggtcgaattacgccaaaatgcacaatttgaattgccctcaggccaacaatcatttaatcctgacaattttaagcaaaaagtgaaaaacaaattcgactttgtgataagaacattgaaagaaatggagaacacagaaaattatgagcaaatttggaattggtctgagatttttgagcaaaaattttctggtaaaatgtgccaagggcaatttcatcccctttttggcaaaatttttcaatttttaattgtgaaaaatatattaacctaaaaatttaaatttaaattttcgaaaaaatgagaaaacttaaaaatatgtgtatgtatttcaaaaaatggtatctaaaaaataaataattcaattttacgaaaaaaatgtgaattaaaccagggctcgcattcgtccttgaatgacaaggatgcccttaaatttggttctctcatttgaaaatatccttgaatataaaatatccttgaaataagcattcaaaaaaacactcaaaattttacaattttttaaaattttacaccatattttgtattaattattggcattatttggtacaaaatctattgacacaaattgcttcaaaaattcattcatttgacaggcgaaaatgcaaaccatttgaatattgtccattgcatatgacaaactttttaagtgtccttgaatttaaaaagttaaaaaagagatacgttgaatataattttcccgttttgttgtccttggaaatctcctttgaaatgcttccaatgcgagccctgaattaagcaaagcataaaatttttcaaaaaagtggcgatg

SEQ ID NO: 117493 - DNA, 411 bp, Heterodera glycines
  Promoter: Source sequence=SeqID_18257; Location=1979..2389; Strand=-; Gene=SeqID_82848
ttgaattacgttgttgttagcggcggcgatgaagaaaatttgggcagaaaatggcgaggaataaaaaggattgaatagcaaatttattgggcaaatgattcgcattcgtgaaaaattgtccttttatacaaaattttctttcccctcccacatttttcgcaaattttttttttatttatgaaaatcatactaaaacatgttttccgaggttttcaggctcgctaatcaaaaatatgacatgtatttcggccaattctgaaccccgaacccgaattcgaacaaaaagctttttaatccgttatttttcaaaaattgcttttgctaaatctcttttttctccgctataaaagcgccttcgtctcccccatttttttgcattaacattcattcattcacatttctcccactatg

SEQ ID NO: 117494 - DNA, 546 bp, Heterodera glycines
  Promoter: Source sequence=SeqID_31144; Location=547..1092; Strand=-; Gene=SeqID_61521
gggctttaacgatttcgaaagcgatttctgattaaagattgtttattagcacgctaaaatacccgttaaaaatattttcagctaatttaagtgaaaaaatttttcccactcaaaaaccatgtggtccctcccccctttggtcccaaattctaaaatcaaattttctatttttaaagctttattctaattaaattgaaccactttaaaatgagttatgaatttcaaaataggtaatagcccaaattcccgagggccaaatgaaaaattttcaaaatttaaaaaattcaaaaattccctatataagaagtttctacccatgatccaagcataaaaatgaaaatctcgtgtctttttgagagttacggggcgggagtggtgtcattcaatagggttttggcctgcctataagggaaaaatacgggttttctaaaacgttcagaactgttcgaactgcgttcggaaaacgagtcaaaatttgcagtttttttggttgtcctatttttgaacgctttttgcatgccttaaaagtggtcaaatcaaaaaatg

SEQ ID NO: 117495 - DNA, 359 bp, Heterodera glycines
  Promoter: Source sequence=SeqID_2255; Location=1796..2154; Strand=-; Gene=SeqID_78755
attgttcagtgatatgtgggtgaagaaggactcggtttttgattcgagaactttttatttatctgtctcacttccttagcctaagaaattttttcaattgtcatgaatcaaattttcaaattctttaaaaaattctcactcaaggaaaagcaatttacaagaattttatttaaaaaatcaaaaaaaataaaccttaaataatttttcgcttaaaaaatcatattttttgattagctcgtcctgccgtgcctcgtccgccaccaccgccgcttccacccaaaccatcttctacttttggtgttgccattgcatcatcatctgccgaacaatcggcaccatccttaaatattggcaaaatg

SEQ ID NO: 117496 - DNA, 640 bp, Heterodera glycines
  Promoter: Source sequence=SeqID_41673; Location=173..812; Strand=-; Gene=SeqID_69748
ttggcgcattgttcacttttattttcattaacttttaatagtgtctaactcttacagtgtctgttgtttcttcgcaagtcttgttttttaattttcgtttcaataatcatttttttttataatgttaggcattttttgtcaaattgatgatatatgagcctgtgaagttggattcatttctctgtcctattcaaaacgaacgaagaagtgaaacagagagagagaacgcagagacagacaacgaaaggaaaggcgagagaatgcagagagtgccgttccagtggaggaaaagcgagaacagagaagcaaagacaaggagtgttcacgtgagaagtaaaagggaaaaagcgcgacactgcggcagacacacaaacaaaacccctccggggacgacgaaaagcgaccgataaagaaaaatgaaagagagatagagagggtaggagagagaaagagagacctaaaggcaatagatagagatcgtagaagaaagtaaaggaaatgcaagtggccatttcttctgcttaaacgagcaaaacaaaatccagtgccggtgcgacgggcggcgtcctttgactgacgttgaactaactacctaattaaccccaaatcacaaaattctcccttgcttctcccaacaatg

SEQ ID NO: 117497 - DNA, 167 bp, Heterodera glycines
  misc_feature (89)..(90): n is a, c, g, or t
  Promoter: Source sequence=SeqID_8074; Location=2460..2626; Strand=-; Gene=SeqID_66899
ttttgggaaaacgccgcaaaaaatcaacttcgtttttcatgtcaggatcccaaaaaatgcttattctacaaaaaaaaaatgctcaatgnnatcattagggagtccaaaaatatggatataaaattgcaaaatatggactaaaaatcgcaaaatatggacataaaatg

SEQ ID NO: 117498 - DNA, 225 bp, Heterodera glycines
  Promoter: Source sequence=SeqID_19085; Location=388..612; Strand=+; Gene=SeqID_83829
ggtgggagtccccggggggttgttatggaaactgaaaaggcaaaataaaaacaaaaataaaatattaaaaaatgttaaagcaaaatgcctataaagattcaattctaaatcggaatttttttcggtcgttttcgagttaatagcaactattttctagttttttatttttagcacgtaaaaaatttatgaaaaaactattttttaactaaaaaagcccgaaatatg

SEQ ID NO: 117499 - DNA, 113 bp, Heterodera glycines
  Promoter: Source sequence=SeqID_35233; Location=1200..1312; Strand=-; Gene=SeqID_64832
gttaaggacattttcgtccccaagtcctctaatcattcgctttaccgagtataactgcttaacgagctccagctatcctgggggaaacttcggagggaaccagctactagatg

SEQ ID NO: 117500 - DNA, 221 bp, Heterodera glycines
  Promoter: Source sequence=SeqID_725; Location=2833..3053; Strand=-; Gene=SeqID_59829
cgtcaagaaatttaaattttcaattcaaaaattaaaaattcaaacatcttggtttttttttaaagaacgaaaggcctatacatctgatttttaaatgcttcatgttaagtctcggaatttgaaagcatttaatgccgaattatacttatttccatgtcgattaatttaattgcttgccattgagatgggctctttgtccctccccgcttcgtttggtcatg

SEQ ID NO: 117501 - DNA, 1003 bp, Heterodera glycines
  Promoter: Source sequence=SeqID_7565; Location=1354..2356; Strand=-; Gene=SeqID_65241
tactccattctttttttggatattttcttcctttttgctttttttttcttttattctataattttttcaattatttctctttttttgagttcatttcgtttttcttcttctttttcctcccatttttctccaaatatttcctcaaatgttttttgttgtaattttttattttccgttccaccaatttgatcaattagagtaatcaaaaataaaaataataaaatacagaatttcattttcaagattttattttatttttcttcaattaaatggcaattcattttttgaggcatttaaatgatttttttctgattaaaaaactgaataaatcattattttacttaataaaataaggaaatcctgtttaatttcaaagaaataataataataattttatcttaatgacaaaataattgccaattgttaaattaatgattaaataaaattttattactttcttctggagctcattcgaaaataataaacatattttcaataaaaataaaataaattcacaatgtaaagagattttagaaaaattaatgcaattttcgaattaattttactccattcttttgctgaatattttcttcctttttgcttgattttctcttttattttataaaattttgcaattatttctctttttttgagttcattcttctttttcttcccaattttctccaaaaaaattgggtaatcctgtattttattggtcccataaaaaaagagattaaaaagggttctttatgcaattcggagtagtacccgggggttttcggggtcgctgatcacgaatatgatatcaattttgacctatttcgaatccggaacacgaattcgaacatttttttaataaaatattttttttaattgttaaaacgcctttcttaggggtttttcggggtcgctaattaattttccttatccgaccgacccataaacgcaaaattttttgattattttaacttccacatgaaaattttctaatttttaggagatg

SEQ ID NO: 117502 - DNA, 483 bp, Heterodera glycines
  Promoter: Source sequence=SeqID_1429; Location=1166..1648; Strand=+; Gene=SeqID_73510
tgatcacactcagcgaaagcatcagacgccgtccattttcagaaactgaatttgcacactcaattagtaccactaattactgaactaaatactaattgggagcagtgccactcactctgcgctttgcgccaccaactgatcagccaaatcagcacatagcagcatagcagcaaaactcgccgaaatacatgcccaaattcaatgcattgaagtagtaattgttctccgggtgtcgtgccgggttgccgagacggcacattacaggcctagaagggaaggggaggccaattagggtccggtcagattatccaaaatcagcaatgatcgcacatttcccattgctttggcatccacaagtaaaagttgcacacatcgaccgccgccaaaaggcaacaaagtgccaacaacaatttaaaaacgatatacttgccccggcctttgtacctgcgaacgaaacgaaatgccaaacgaaaactcaaaatg

SEQ ID NO: 117503 - DNA, 70 bp, Heterodera glycines
  Promoter: Source sequence=SeqID_10890; Location=1353..1422; Strand=-; Gene=SeqID_74170
attaattaactatttaattttaaaattaatcttttaaatgaatccgcagaaaactttggacgaagaaatg

SEQ ID NO: 117504 - DNA, 191 bp, Heterodera glycines
  Promoter: Source sequence=SeqID_15240; Location=1..191; Strand=+; Gene=SeqID_79451
acaaatactccgtctgttttttgccaaaaaatgtgatgaatttatttctgtttcaaaattgtttttgcgttctttttgctctctcatttttcccaactctctctttttaagttacataacaacagagttttgccttgccttttttgacacaccaatcaattggaaaaagggaaaattgagccacaaaaatg

SEQ ID NO: 117505 - DNA, 526 bp, Heterodera glycines
  Promoter: Source sequence=SeqID_5870; Location=1..526; Strand=+; Gene= SeqID_59493
gcgtttgatgtgtcagcaattgctgaaccaattgttgctgttgcgtcaatgtgtcaatcaattgttgaattgtcgcgttttggttggccattttcgtcgaataaccgctcctggcgaaacctcaaccgcctaggtttcttggtttttgtgtcgaataaaaccgcgcctggcggaaaccgcaaccgtattggtatctgggtttttttgtagaaattccacgattaaccgcggctggcggattaatcggatcgacgaatttggcttgttgaaaataaaggtgcctcctggccgaccttttttttttgcagacaaattcaataaattgcactcagcaatttattcaaataggcgctgagctcaaatgtagggcgtcgccaatttgttcggtcctcgaaatgtcgaatggacgaacaaataaataatttattgatgacaaattaaaataacaaataaataagtcggaggacggcggaggagagcaatttgggaaatgtgaacacaaatatcaaactgcatgaatgaaatg

SEQ ID NO: 117506 - DNA, 314 bp, Heterodera glycines
  Promoter: Source sequence=SeqID_29557; Location=1..314; Strand=+; Gene=SeqID_60040
ggactcaccccaccagcatttcaaagtcatcccaatctctgggactcaatccaccagcatttcaatctctgggactcaacacaccagcatttcaatgtctgggactcaaatctccggcattccagacactgggactcaacccaccaacattcaatggcattgcaatctctgggactcaacccaccagcattccaatctctgagacaacccaccagcatttcaatctctgggactcaacacaccagcatttcaatctctgggactcaaatctccggcattccaaacactgggactcaacccaacaactttcaatg

SEQ ID NO: 117507 - DNA, 141 bp, Heterodera glycines
  Promoter: Source sequence=SeqID_4379; Location=1390..1530; Strand=-; Gene=SeqID_54220
ggtgagtaaaaatgttgtggcatttccatatttaaaaatcaattttggcacatttttttgtaataggtgggactcaaacgacgacgacagaaacatcgcccattccgatcattgaagagccgtcggatgatgatgaaaatg

SEQ ID NO: 117508 - DNA, 242 bp, Heterodera glycines
  misc_feature (69)..(69): n is a, c, g, or t
  misc_feature (93)..(93): n is a, c, g, or t
  Promoter: Source sequence=SeqID_16219; Location=1..242; Strand=+; Gene=SeqID_80591
cggcgttggtgtggcgttgtgtggtggtgggagaaagatgactgacgtgcaaattttcctgccccgtcnccctgaggggacaaaaaaaaatcnggttttggtgcgattgtgtttggcattctgtcagccgccgccgctttccctgcccccacccctcgggggatgaaccgcgcgactgtgcgtccgtaaatgcaaaattgcaccagccaacgacgacgacgacgaagaggaagaccacgatg

SEQ ID NO: 117509 - DNA, 139 bp, Heterodera glycines
  Promoter: Source sequence=SeqID_13872; Location=1076..1214; Strand=-; Gene=SeqID_77815
tgagattaaagttgttaactttgccaaatgcgtagacaataatttgttaattttgcaaatcatgacatttatttttattatttgacaacctaaatttactgcattttgcaatttattccttaaagtatttggcaaaatg

SEQ ID NO: 117510 - DNA, 1003 bp, Heterodera glycines
  Promoter: Source sequence=SeqID_9797; Location=1986..2988; Strand=-; Gene=SeqID_72731
ttgttttttgtcaacttttatggctactgaaatcctaacaaagcgtggaagaaaaaaattattgcatgaaggttttttgtatgtcttcgaaaaaccaaacgcacgcggtgacgtcaagttctggaaatgtgaatttttcggaaccaaagacatcaaatgcaaaagtcgtttgcacacagatatgaatgacaatgttttggaggtgcaactattcaataataatgttaaatatgtcaatttttaggcaatcggtgtgcacaattgtttataggattcttatttttgggagagcgtcacacagtgaatgggcggcacaaattactgatgttttcgtagatggcacggcacgttcgtcattgctccaccgttgttttaccaagtttacgctgttttggcaagttggagttagcagtattccgtcaaacttaataaattatcgcacttatttcggcgtagagaacgatgggtctttccacgttgtatatgcactacttacgaacaaaagtgaggggacgtattccaggatgtgggccgtactaaaagaagcctggcctgaattttcaccccggacgttttcagtcgactttgagatggctgcaatcaattcaattcgtaacaattttccggaagccgaaactcgtggatgtttatttcatctagtgaaaaatatgaagaaaaaactcacagaaaataatctttcgcaggtctctcacgaatgaatgtgatttaataatcaatatgtttttatcgttatcaaactgatccaattttcgcaactcagtcacgctggatcacatcaatgacatttatgccaatcggagacttaacgtacgctctaatcgcactggaaatgcatctgttacctgagcttcgaccaattctcttttgattattttttgttatagattgaagtcgacatatttataggttcgccacaaactacactggacgtgttcggcgtgctgacgggactcgaacgtaccaatgttttcccccaattatg

SEQ ID NO: 117511 - DNA, 232 bp, Heterodera glycines
  Promoter: Source sequence=SeqID_692; Location=1..232; Strand=+; Gene =SeqID_46109
aaaattgatataaaagggcggaaaatgcccaaaattctcacttattccatttccttcaattcacgcctattattttcgacacgcctcgcgcctaattactgaggtgttcaccatctcccgttttcccctcaccccctccatttgcacatcactaattttttttccccttttacagtgatcaacaacgctctgccgcgcatttcaacctcaacgcacacagcaaacgcggatg

SEQ ID NO: 117512 - DNA, 312 bp, Heterodera glycines
  Promoter: Source sequence=SeqID_23800; Location=1506..1817; Strand=+; Gene=SeqID_54501
ttgggcaggactaaattggaagcataatgatgtaagagttatattggcggggagatggaaagctgtggaggggaggagaatatgctgagtggagtgaagatgagatagtgtgatagagagaaaagagagacggagggggggggggggtaatgctcgtcgctcattatataaaaaaaatgctggcccatcgattgtgatgaccaccgaacgagtcgttggtcatctccccaaccccattttatttatatatattttgttgttcattttttttattgtaataatattttttttccaatttagcaaaaaaaaatg

SEQ ID NO: 117513 - DNA, 100 bp, Heterodera glycines
  Promoter: Source sequence=SeqID_27870; Location=1..100; Strand=+; Gene=SeqID_58541
atttcgggaataaatggagtaatgtacgaaataaaccgcttctccaaaaattttcataagtgaaaaggaaaattatgacgaccaaaacgagttcagaatg

SEQ ID NO: 117514 - DNA, 473 bp, Heterodera glycines
  Promoter: Source sequence=SeqID_2116; Location=4490..4962; Strand=+; Gene=SeqID_77920
tagcagtttttcgaatatctgtaatttgtttttcatatattatgggttatttggaaatagtttaattatcaaaaaactatcataaaaagttatggtccaaaaaatcccggcgactcttcgacaagcgaccttttggggtgcatcgcaagaaccgaccttcgatatttaaaaaaaaatttttaatttagttttttgtcattttgttgacttgtagtagaattgaatgaagtaagacactaacgctaataaaaaaaacaaactttttatgtgcatagattatttctagttgaaattgacccggtgcgggattggatcccgcaagggattttgcgggattccagtccgcagattgcgggatttatccctgctggatccctattttgctggtttttttgaaattgaaaatgaacccacaaaaataagcacttcgaattcatatttcagggaggcgaattaaatttgtgctaataatg

SEQ ID NO: 117515 - DNA, 260 bp, Heterodera glycines
  Promoter: Source sequence=SeqID_44097; Location=770..1029; Strand=-; Gene=SeqID_71632
aatgagaattttctggatttttgactaaaaccctcatactcaaattatagtagaattttcaaattttgaggtcggactttgttttaataattcaaaattaaattaataaacggtaaaaaatacaaatatatttaaggactcatgctcaatggtctaaaaccaatttaaaaagactttgaaattactaaaaaatctcattaaagaaaattcattaacaacggactaagttacaaaaatattttacagaaggtgtggacatg

SEQ ID NO: 117516 - DNA, 117 bp, Heterodera glycines
  Promoter: Source sequence=SeqID_23532; Location=611..727; Strand=+; Gene=SeqID_54221
tcgcaacggcgcacagcacgacgaaaatgtgcaggacggggatggtcccgtcgcttcaacgaacgaagagcaacaaaaattgccagagtaaacgaagcaacgagaggaagcaacatg

SEQ ID NO: 117517 - DNA, 86 bp, Heterodera glycines
  Promoter: Source sequence=SeqID_1925; Location=445..530; Strand=-; Gene=SeqID_76827
gctgtaagaaaaaggccagtttttgatgccacacccacacacccagcagaattagccttttaattaattacccttttcacaaaatg

SEQ ID NO: 117518 - DNA, 219 bp, Heterodera glycines
  Promoter: Source sequence=SeqID_30524; Location=267..485; Strand=+; Gene=SeqID_60943
ggtaagcgcaaaagaaatgcacgccaaaattacgccgccaaatttcttagtgatttttttgaaaaattctagaaaaaacggtaatcgttcacatcattggtcccataaaaaaaaggaaaaaaagggtcgttttttgcgattctgagaactaccagggggttatctagggcgctgatcactagggcgtgtaattatatggatataaaatcgcgaaatatg

SEQ ID NO: 117519 - DNA, 660 bp, Heterodera glycines
  Promoter: Source sequence=SeqID_6294; Location=1..660; Strand=+; Gene= SeqID_61050
acaattatttgtaggagagagagagaataagaccatagagtgaaagaagcaaaaataccaaaaaaaagtcctggtagcaaacgaataaggaccaatttataaaaatatctgaacgattgagaagcaaaaaaaaaagagagagagagagagaagaagtgagacagaaaaaatagaacaattttttttgagcagagcaaaaaggcccgggctgataaccaatcaaaggggcactattttagctaattaaaaagagggaccaataaaaaaaagaaaattaggccctatcattttgcttacagtatgagatacagtttttacaaattccaaagttcattttatctctttgttttctctcagttttcacgccataagaatattcacgtaatcacgtgccgccgcatttttcattgggcgagatcattcactttaaacatttttgcggcgcctgagaattgttaattgttcttgttaggcgaagtttaaacggagatggagcagataagcccattcctggaaggcgttcgcatccattcgattacccgctatcattcattaatttttttttctctctcaattaatgcataatgggattaccaaataatttttttttttttagcaaaataaaacaaaatcttattacgaactgaacgacttcgaatg

SEQ ID NO: 117520 - DNA, 1003 bp, Heterodera glycines
  Promoter: Source sequence=SeqID_3144; Location=1252..2254; Strand=-; Gene=SeqID_83396
cggcactcgggctcattccgcaaaaaataaaatcacttttcttaagaacccatgggtgctctatccactgaccaaatttcattctgaaatcccacggacaccctaggaccttcctttgtgaatgctatcaacaccacctcacatctaattactgtaccaaatcgaaaaagtgcaagaagtgcggtgtcttgtgggactttgaacggaatacccgtgacggaagaaagggacacgtatgcgaggagaaattctgttggacttgccgcaattaccatgacaaggggcggggttgtttcatcaagaaactcaagccgaagcatcccaaggcattccgtctcatcgccttcgactgcgaaacaacgcaaacaccattattggcccaaacaaacgtgcacacatcgtcaactttgtctcagcccacgtggcctgttcaatttgcatcaaaggaaacacttggcgtcaatcactgtccggccgtacggcatgcaaaatttgcggtgaattccgcaccatcacgttctcacaccgtgccttcaacaacactcaagtggactcaatgcgtgtgtgcgaatcacagatgacagaatttgcgcagtggcttctctcgggatttgataaaaagtgattaagattttcctaactaatttttaataatttgctaattaaatcaggtatccatcgtctattttctcgcactttggtggcagattcgataacgtcatccttttccgcgaattcttcaacttcggaatatgtccagaaatggtcagaaaaggcaacaaaatgtacgaaatgaagattgggcgcacgacaaacagcccggaaatttccatccgcgatagcttcaacctcatgccagtggcgctcggcagtttacccggggcattcggactacaagtacaagacaaggagttctttccgcatcttttcaacaccgtgcaaaactacaacaacactctgccccatctgccccccaaaagaggactacatatacaatggaatg

SEQ ID NO: 117521 - DNA, 94 bp, Heterodera glycines
  misc_feature (3)..(3): n is a, c, g, or t
  Promoter: Source sequence=SeqID_17662; Location=1928..2021; Strand=-; Gene=SeqID_82193
aanatagttttttttaaataattaaaattgcactaatttttattaaaattacaaaactaaagtttttttttctgattatcggcctttttagatg

SEQ ID NO: 117522 - DNA, 1003 bp, Heterodera glycines
  Promoter: Source sequence=SeqID_22616; Location=471..1473; Strand=-; Gene=SeqID_53287
aaatattaattacaattaatgatttacatattatttttatataaaatatcaataattaagagtatataataaaaattatttttttcctcgcgtgtggttgaaatatattaatatttatctaacataatgccaaataccagcttaattatattttatgtgagcaatttactgagtttaatttacgattaattgattgttttgttttacaaatgcttgaagaaacagagattaaaagataaaagagttaaaaagataataatttaacttacaaaaaataataagtttaaaataggaaaataaataattattaaacaaatataattttttaaattttattattaattacgcatttaaaacaattgaaaagcaaatattgtaatagttttaaaaaataattgatttgaacttgatggcggataaacgtctgatagtcatgagattaatggaaaagcacaaaatattctgttgttgaacaaaaatataaacaaaatcaaacgacaaattaaaaaaatcatttgataatttgtgtacagatttttctttgaaaataaataaacaaaatccaatctttattataaatttaataaaattaatttacttttatttttttaatttatgcaaaacctttacaataatattttcaaattaaaatgaaatacaataaaataatctttagtcaatattataatcaaattagtaaaataattttaaaaaagaaaattaatattacataatgatttaatagcaaaaaaacataatttaaaaacctttatgtttctacaaaaaaagaataatataaaacataatagaaaagttcattatttaatttgagcaactttcagcaatgtcataataaaaatgaaatccatcggaaaattctatgtaaatccaaagattataaatctattaaaaatgtataaaaaatattattaaatccattaaataaatgtcgctgcactcagttttttcaatttcttttgggctcccggacatttgcacaatg

SEQ ID NO: 117523 - DNA, 419 bp, Heterodera glycines
  Promoter: Source sequence=SeqID_28837; Location=291..709; Strand=-; Gene=SeqID_59419
tttggttctgatgtgcttaaattagcatcaacattccacaaatttcgaatggccattgagagttaacccaactgactttggcgggagcggcaccggcgagtgttagcgatcaaagcggtgattaatttgcctgccaatggcatcatttcgttataattttgcctttccgttttccttttaaattcctccaacctttgcttggaatttgcgttcgtttttccttttgcttctctttttggccatcggcagaagagtcggaagtgactgtcagcagtcgaatgagctgttcttgttcttcttcttcttgttcccgctgatgttgatgattcagttgggactgatcagagacattttgggccgaatttgtgggaaaaagtgaagcgcaagaaaaagaaggacgggacgaaggggaggaaatg

SEQ ID NO: 117524 - DNA, 60 bp, Heterodera glycines
  Promoter: Source sequence=SeqID_22814; Location=2459..2518; Strand=-; Gene=SeqID_53521
agtgagttttttttaaaaatttaaccaaccaataaaaatttcaaacaattttaaggaatg

SEQ ID NO: 117525 - DNA, 243 bp, Heterodera glycines
  Promoter: Source sequence=SeqID_4548; Location=2743..2985; Strand=-; Gene=SeqID_54854
ttaaattccgtctataactatctaattaatttttttaaattatggatattgaattagggctttattaattgtgcctattaatggttaattaatggttcctcctaatcaactgattttggaataatggatagccagcattcattttgttcagccttttatatggcattttcgactttgtgtgctcgtgacgtgcaaacccccccccccccctccactcatttacttaatgagtggaaaattatg

SEQ ID NO: 117526 - DNA, 1003 bp, Heterodera glycines
  Promoter: Source sequence=SeqID_10106; Location=3112..4114; Strand=+; Gene=SeqID_73187
tgtatttttcgttttattgcatttttgttaacaaattttgggcaaaacgccaaaataggcaaaaaaataggctaattcaaaattttttaggctttttaggtgctaaaaataaaagcctagaaaataggcactaataactcgaaaagtagcttaacaacagcccaaaaaaacatgtttttcgtgcgtttcaggccacggggagcacaggaaaaaataggcttttgcttaaaaattgcatccctagttgtcactacaacaaattgtaaatattttgcttggcatcatgtgtttttttgttgtcttttcaatgaataaaatattataatattattaaatttaaaattcgaaagcattaaaacaaaaagttattaaaaatttacaattaaatgaaaaaacatttaaaaaaattttttttttattaccattggtatgagaagaattatttatttttttaatattaaaaaaataattttttttttgtaactaattttttaatttaatttaattttgattaaaaataataaattccttttgcatttacttttttttgttttccttgaaattttagtttaaaagaaagaccgcacaactcgtctcattaaattctctgctgatggaaagaggtcaaccaacatacgcaagaaagtgcaatcaaatcatttcgcgcactattaattagttaaattgggtattttccacttttaatgtcttatattatttgaacaaaattaagaaatgtttaaacaaatttctaatcaaattaattattcactcgtatttaaaatatgttaattaataaattattaatttattaaactctaattagcatcatgcacagtaatttgtcggtatagaattaaatgagtccataaaataatcaaaaaatttcttggtgccagcctcaatgctatttcatttaaaatttgatagattttgaaattttaatatattaaaaaaaataatttaaaaaatttataattttagcgtggaaaattttaaaatg

SEQ ID NO: 117527 - DNA, 794 bp, Heterodera glycines
  Promoter: Source sequence=SeqID_17010; Location=297..1090; Strand=-; Gene=SeqID_81432
ttttatttatgggcgatacctttaataaaataatgtttttttttaacaaatttaggtccttttttaacagatatttaccatcaaaatgactaattttgggcaaatttttttttttaataattatgtcgcattgtgtgattattattatagcactttttggcattaaacacaaattcagacgttaaatgagataaaacattatcgcttcctgtccggttgccaaataatccgagtgtcgaaaaatttgaatcagaagccagctgtttaggcctgggcatcgtattaggcctcaacttaggctggcttagcattgggattacgaaattttaaatcaggacccgattgacttattagacattcgaacattttttattatttgaattattaaggggagaagatagaaagagacagagaaaagagtgaggaatatgagtgtcaaaaaggataaaagagaaatatgaaaagttttaaaatttcagaaactgcacaataaatttgtctttttaggaaatttctatttatttatttattaaaaaattttggtgccgaaactttggagccgaaacgatgccggcccattctaactctaggttggtagccgtactcatattttgtgtatcatcgtgctgaattaagatttaatttgaaaaatattcaaaataggaaactcgcacattttggcgcactgcaactgcacacaatgcaaaaaaaaacgtccaaaatgtgtataaaagtcgctgttgtgatgcatttttctcatattttactaacgggcgtaacacaacgagaagatg

SEQ ID NO: 117528 - DNA, 123 bp, Heterodera glycines
  Promoter: Source sequence=SeqID_7577; Location=3150..3272; Strand=-; Gene=SeqID_65293
atcgaagtcaacggctgccactggaacgcgcacgaccatccccgtcaccgttttcagccccaaacagtgatggcgaacggcaaaatggcgcagcggatacggtaggacgatgcgcgacggatg

SEQ ID NO: 117529 - DNA, 1003 bp, Heterodera glycines
  Promoter: Source sequence=SeqID_30696; Location=919..1921; Strand=-; Gene=SeqID_61101
acctaaaaaatgagcgaaccctcttcggttctgcgtattatgccaaagtctgctcggacaaagtcatttgagtcgggctgccacacaaagtaacgaggtcgaaaaaatgaaaaataaagttataattagagaccgaatttgagggcatatgccaatttctgcgcattagttccgatatattgagcataaaaaacacattttccacttggtttgaagcttttacgttgacttttattattcttctttttttttttgcctttttcgagattttcgttaaatgccttttttggcattttgccgttttggtgttgttggataagggaccacaccgattattgattatattttccctttcactccctctcttattgtctctcgccccgccccttgaccagccccataaatatgtctccctttcccccactccgggcattctcccattcattccaccatttcattattttatttatttattccctgctgtcctccattaataaattatttatttatttatttgacaacatttgttttggtcgaagaccaaacatttttattgttgtagtaaatacacaataatttggcgcagtcagcaaaggacctgctctacatcttcgggtgagaaaaaggcatcaaattttgttttaaggaataaaagccgagacggcaaacaaattcaccgaaaagccgggattggctgtgaattgttttaaagcctaattgacacattcctcaaaaagcagtcaaagaaactgctagacgtctaaagccgagtcggctcatcaaatttgacaaaagccggtcggctcatcaaaattcgtcaaaagccgggtcggctcagcaaaaattcgacaaaagccgggtggctcgtcaatttcgtcataacgcagtgaaaagaaactgcttattcttctaaagccgggactgctctcaacaaaatacaacaaaagccgagtcggcttgacaaattcgacaaaagccggttggctaatcaccaaatttgatg

SEQ ID NO: 117530 - DNA, 887 bp, Heterodera glycines
  misc_feature (787)..(787): n is a, c, g, or t
  Promoter: Source sequence=SeqID_20813; Location=916..1802; Strand=-; Gene=SeqID_51393
ctttttctttataatttctctcactttggcgtactatctctttattttaatgtgtgtaaaaacaacactcacttcatcctgtttaacttttttttctgtttgttaaatccacaccaaattttgcaaatcgatagagaaaaaaattctgcatcggttaataggtcaattaatattaaaataggtcgaattgaaaagttatggaataataaaagttttgcatttttttcctctctttttggcgtactattttcatgtctctaacacattaaaaatcatgaaattcgcaaattctattaatttttgttgatacggtacaaaatctgttggacatttagaatcaatagaaaaatgattactttccgcattttggttgaaatcagcagtttaagacttgagttataacgtaataaagatttgaaactcccacaacttttttctaaaaaatcaaattgcttagttttcgcttagaaaaagattctccttttcaaaaactttttttaggtaacaaatttgttcagtttagttgggaatgaagtgagttacgtctgattaaaataaacaatacaaaaaaggcttttaccagtgtaaattttgaattaacgcgcaaaaatttacgccaaatgcgctatttggcgttatgagcaattttgtctgccttcttctttaaaagaagaaattgaaattaacacacaacatagggaggacttgaacctgggacccctcttttggtgactaactcacagaccactaagacgaaaaatccagcatagttgtacttggagcccanaattgggccgctgtgttaaaaacccaaattcaaattaaatgattgtcagatcatcatttcaaaaaaaatcctcattgacctatcaaaaagccacaaaatg

SEQ ID NO: 117531 - DNA, 1003 bp, Heterodera glycines
  Promoter: Source sequence=SeqID_9046; Location=2568..3570; Strand=-; Gene=SeqID_70095
cgtcccagcaccattcaaacaaagggagaaaaagagtcgagcaaaatggcgcggagaaaagtccacatgttttgtcaaatgtgccacaagtcgaaaataagttcttcaaaaatcttctctgcgttgcctatcggcactgccggatctggccaaatctttttaatttgctattaaaagcgcttcaaatggttggattattgactatcaaaatttttggaataaaaatttgttattgaaattttttcattaaccgcaatagccgaaaaaccgaaaccgtggggtccaaaacatgcataactgaaaaccatgggtaagctcgtgaacaaccctaatataaacaattaaaaacaaaattaaaaaatacaataatccgccggaaacgatagacaccgataaaaatttcaatgatccgctgaggacgaccataagggatattatgctttatcctcgggatatttttgtattggatttttgattgggaattggcattgacagtgtgagtattggttggcttgaaagggccgatgtggttaacgatgaatgacgattgattttcggggctttgttggtgaatggcaccggactcattagatcagattttaatctttttttatgatggcttggtaatggaggatatggaaatatgtaataatttaataatatttacatctatggcacttccattgcaaatggaaaagcaatttgctttactttaatcgattaaaacaaaaaacccaaaaacatgtttgaccgattttggaattcggttcactgtttttaatctttgtttgaaaagtaattaatactcttgaaaatatccaaaaaaaacattttatctattgttatcagtaggtagcagggatggcacggaattccgatttccagcttccaatttacgacgtttttgggatcggaattccgatttccaattccaatttccgaaaaatttttgacccccggaattccggttctgattaccgaaaatttttggggcctcggaatg

SEQ ID NO: 117532 - DNA, 843 bp, Heterodera glycines
  Promoter: Source sequence=SeqID_4322; Location=2679..3521; Strand=-; Gene=SeqID_54056
attaagactttttttctattaaatttcaaaattatgggtcagagattgaccattgtattttttagcacttaaatgttgggtggacagcggcagcaagaatttgtttaacaagaacaaaactgtatgccgagcagggttcaacttttgctacagggccaactgcttgagaaaaggtagtgtttttgtataatgcacatttcgccaaaaaatttaaagcatttttaaagctcgtaaatagggatgcgatttttaggtttttacctatttttttgctgagctctccgtggcctgaaacgcacgaaaaacatgtttttttgggctgttgttaagctagttttcgagttattagcacctattttctaggtttttattttagcacctaaaaaacctaaaattttttttttaaaatttattttcacctattctggcgttttgccgaaataaaaacaaaaaatgcacccctaagaattgatcttgatcctaaacttttaaaatatacccctaagaattaaaaatatctcaaaaaatcatctcaaaaatttttatagttattttcttgatgagaatttttgattttacacccctaaattcggactttttggccctattttcccatttttagggtgagttttttagaacctaaaacctaactattttggcattttttagcacctataaatcgcattcctactcgtaagataaaataaatttcaataataattttaaaaaaagaatgctcgtcgaagaaaaatttgcatttttgttcgcaaagtttcatgaataatttcacctcggattctcattcttaccagtgcaaatttttaccggctattattggtaatg

SEQ ID NO: 117533 - DNA, 58 bp, Heterodera glycines
  Promoter: Source sequence=SeqID_26; Location=9557..9614; Strand=+; Gene=SeqID_82134
ggtcaaattttggcacagaaaaaatgtcgatatttatcgcattttcaggtacaatatg

SEQ ID NO: 117534 - DNA, 86 bp, Heterodera glycines
  Promoter: Source sequence=SeqID_617; Location=124..209; Strand=+; Gene=SeqID_57571
ttgcgaaccgaattttcaaaggtggacagattcaaatttttgttaaaatttgaaaaagctagttggctagcaaaaattttaaaatg

SEQ ID NO: 117535 - DNA, 914 bp, Heterodera glycines
  Promoter: Source sequence=SeqID_2119; Location=1038..1951; Strand=-; Gene=SeqID_77954
atagtaattaagatatcgattgataccaagtaagaaaaaagttatggcataagaaactaaggattcattcatgggacgcataatatttgatgggacgcataatatggcatgggacgcataaaactgactagaaccctaatttttgtcatcattggtgttacatttttaaaaatttagataaatgaaataaccaattctgcgatacagtaattgcatagttttatcgtattttcagaaaatcatcataatcattttgtcaatgtttgctgggtttagtgcgttcgacgtgtcatatgcggcggtggatgatgcagaggcggtaattaatggattttgtttgaaaaaaaaatctcttttgtccacattaaaaaaagtcaataggcgcatctgatcatttgctgggttaacaaaacgcataaaaatgcaacaaaaaaaaaatctcgtgtgttttgggttttttgaaattcattttttcaaattcaagtgaaggaattcttgaagggagcagctcttttcctccccgccggttacctccccgagaaattttaaaaaattttttttattaacttagaaaattttcaagaaaaaagcttagaaagtttttaataaggaaattctatgaaaaaaaaattttttgagaaaattcagcgcttttttggaaaattttttaaaaatcttagtttaaccacaaaaatttttgtttagaattttcctatgaaaaaactttctaagatttttattcaaaaatttctaatttagtattttttaaagaaatttctcggggggggggaacgatgcggggggggggggacgtagtgcacccttcttgaaggggtaacataggcaaaacagaaaatatcagttatattttttctttaaagctttgggtaaacagtgattttgaattaagaatg

SEQ ID NO: 117536 - DNA, 552 bp, Heterodera glycines
  misc_feature (141)..(141): n is a, c, g, or t
  Promoter: Source sequence=SeqID_21814; Location=1532..2083; Strand=-; Gene=SeqID_52442
ttagcatttcaaaattttctttattatttctgtgccgaaaatagcctaatcaattcttcattaatcgtcaccggatttcgaactttattgctggtacttactcaactgatggaaaaaagtttatccccaaacacctccaanatgtatttgatttgtaattgtgcggacgaaaacgataaagaatgaatttcttggatttttatgcataaatacacttagtttttccaattttgagcatatattttggctttttttgggttttggtacatatttcagcatttttagcacataaaaaccccagacctaattattatcttttaaattttatcattagaattcattcttttaatatttaagggtgaaggaattagattttaaaaatttacaggatcttacttatgtatcaataaatcaatgacgcattttccgctagcgtatttccggtcacatttgtgaaattatttttcaatcattttttgtcatttaataatttgtttatattcaaatcattaaagaaaaaatttcaatattttctattttaaattaaaaatg

SEQ ID NO: 117537 - DNA, 209 bp, Heterodera glycines
  misc_feature (24)..(24): n is a, c, g, or t
  Promoter: Source sequence=SeqID_26832; Location=642..850; Strand=-; Gene=SeqID_57587
ttaagataagatgacttaaatttnttaaatcctcatttcgaattttcattttcaataaatggtcctattctaatacttatacttaaattggaggctgtttaatcaaaaaggaagttgctatgtaatcaaaataatttcttctttctaaatgtagaagctggcaatattacaattcaagccagccattgtcaacactcgttgatcaaatg

SEQ ID NO: 117538 - DNA, 138 bp, Heterodera glycines
  Promoter: Source sequence=SeqID_17210; Location=2630..2767; Strand=-; Gene=SeqID_81677
ggttccaaaaggccgcgacagtcaaatgaattcggatttgatgattatttattttagcatggaattagagagctgaactctctcctgcagaaccatgacattttgaacataaagccggagggagcggacatccggatg

SEQ ID NO: 117539 - DNA, 598 bp, Heterodera glycines
  Promoter: Source sequence=SeqID_12715; Location=602..1199; Strand=-; Gene=SeqID_76409
tttccacccaccgacaaaattgttcaccaaattcaatcgctcaaaaaacaataccctcatcttttcaacaaatagttctaccagacctccaacaatttcttcaaataaaatatccctcaaactttctctaaaaattttactcaaaaaaaatttaaaaaatttttcctcttctaaaacccctaaaaatgcctttcttttggttatttttatttttttttgaataaatgaattttcttaaatttataaatacagcagtgttggtgcatttctttaactgaactgataaacttatattttttaattaaattagaacgtaagttttgtttgtcaaacaaaacttcttcttatgttttgacagattgagccttaaaatgatcaattatataataaaatcaattctctatcttgaaaaccttagttcttaaactaattaaacaataaaaggaaaaagtgcgcttgtttttctcccatttgattcagtcgattagtctcgtttttatttaatgcattttcatacggaattttattcaaaaattttgagacctgtgaaaattatattcaagagattaaattaaattaaaaattttcagaaatcatg

SEQ ID NO: 117540 - DNA, 362 bp, Heterodera glycines
  Promoter: Source sequence=SeqID_11579; Location=4873..5234; Strand=+; Gene=SeqID_75018
agtgtgtcaaatattatttaattttatattgtaagtaagtctctcacattatttctatgcatgaaattccgttttttattgggatgtcatatatttaaaaaaaatttcataatttttaaaaaatttttcaccggatgcccctgtcagcatcacgccaccaccaaaatttaagggtatttaaacaaaacaaaacaaaaattctttcgtgacaaatcgtagttatattatttatataatgggtttttcactttatttaaaaaaataaaataaaacatgaagccttattaaaaaacaaatattattattctttatttaaattaaaaatatttgtaaattttaaagatcatgttattgcacaaatg

SEQ ID NO: 117541 - DNA, 374 bp, Heterodera glycines
  Promoter: Source sequence=SeqID_29976; Location=276..649; Strand=+; Gene=SeqID_60441
attacctattttataacagactaataattttgctaaatagttcattgcatttaatcaccatttcatattgttctaataaatttaaatattaatccgtgtgtcttaattttttgcatcccctttggtgtttgaatatacccgtaaatgtgacaagcgcatcgccggttagcggcatgatgcattagtttctcttttgtgccgatgcagaaatgccgcacatccctttgttatttgaatttgaccccgttcgcatcggtcaccgcagcgtcggaccttggctacacagatggccacgatcccgcctcatacaaaagggcccatgggaaagtcgccctctttttttcaccattcatttaccctgcaaaccaaaaatg

SEQ ID NO: 117542 - DNA, 365 bp, Heterodera glycines
  Promoter: Source sequence=SeqID_16740; Location=965..1329; Strand=-; Gene=SeqID_81151
ggaaaatttttgaaaatttgattaaaaatttgttgacagattttcactaaaaaatgatcaaattttgtgatttttatcatttttctaatgagaaataagagttttggcgcgccgctgagaacagtttttcatcaaattaccaaattttgcgattttgggccattttctaagaaaaaataggagttttgggggcgcggcggtgccgataggcgccgccggggaaaaaattggaaattttgatcatttataaacagtttttcactgaaaattagccaatttataggtaaaattttgaaaaattttatgggaatttaatccaattcttaggtgtgtaaaagtcgcatttcgcgccaaaaagcgaaatg

SEQ ID NO: 117543 - DNA, 326 bp, Heterodera glycines
  misc_feature (76)..(76): n is a, c, g, or t
  Promoter: Source sequence=SeqID_22889; Location=1..326; Strand=+; Gene=SeqID_53597
tagaatccgaacagaattcaggtccgggcttcggaattggtcgaaatgggtatcagattcgtgatcagcgaccccngaaaatccccccctagaaatttttatatgtatgatttataatattttttttgtggtctgtaaacggcgtaagtacccgaatatgacaattatttgggcctattccgaacaccgaaaccaaattcgaacaaaaagttgaaaattcgaatttttgaaaatttgcttttatgttagaatctgaataaaaaggatcattttttggtgtttcaatgatttgtgacttctttcagctctttttaatcaattttatg

SEQ ID NO: 117544 - DNA, 516 bp, Heterodera glycines
  misc_feature (21)..(21): n is a, c, g, or t
  Promoter: Source sequence=SeqID_164; Location=1..516; Strand=+; Gene =SeqID_75595
gaaaagcctcaaaataatttntggaaatttatagaatcttctaatgcggttgcaaattgaacaaaaaaaattttgaaaacagtctcgtgtttttgggattttcagtctcggtctcgaggtcatctcttgaagtctcgagaaattttcggtctcgaacagcactacttcgttcgaacgattggccaagccaactttctccgtgattgtgccaccgaaccttttacagccccctcccccttctcgcgggcacattaattgaaaaagctccatctttcaaatttatgatttagtagtcataaatttagaccccatcgccccaaacattgtagcacttggccaaacaacgtttccatcctccactccgggttttggcaccacaccgctcgtcccatcgcagcagcaacagcagcagtgtgtgctcggcatcggcgggttggcattcaacggacgaatacagtactccaacggggcactgttcggaccgtacccgccgggcacaaccgccacattgacatg

SEQ ID NO: 117545 - DNA, 214 bp, Heterodera glycines
  Promoter: Source sequence=SeqID_10748; Location=140..353; Strand=+; Gene=SeqID_73996
agtaaattttgggaaattgcccggggcaattcacacaaattgaacatccgaaagttctcctgctttggtcaacggactgcgaagcaaatcgttgcattaaattagctcaatttgttgtagcaattcctccaaaagtgcaattgaaattttcgggggggggggaaagatcaaagaatacaaacaaattgaattttaaaaaattgttttaagaatg

SEQ ID NO: 117546 - DNA, 640 bp, Heterodera glycines
  Promoter: Source sequence=SeqID_6432; Location=1752..2391; Strand=-; Gene=SeqID_61549
aacaactcagcgcagagaaattttattggccgacgggttcgagtatagcttttaagctttgagccgaattgcagatggttagtctgatgtattttattggcatattacattgcattttacgctccaatagagcattttggcgtccatgatcaccctctatttctatgactagggatgcaatttatagttttttagaacctaaaaactaacgattttggcggttttagttactgtaaatcgcatccatacttatggcataactaagtttacttttgattggacacctcaaaatgcatttggccagtaaaatgcagtagcgccgcgttttgatcataggcattgaaatttatcgctgcatacaccgtccgccttattgtcctggtcgaatacatgtacgtgctgctgtacatcacgacaacactggacgcccatacaaaattaggggaggtctgcaagtttccgacaggaaatgtggaatatgagtgaaaggtgaaagtggaaatagaattttaagaaacaaaaatttagagttaagcaaaatttaatgaggacaaataacagcatcgaggggtggcatcgctctttcaatagccaattccgcttccttcatccgccattaagttattttgtcaaaaaaatg

SEQ ID NO: 117547 - DNA, 344 bp, Heterodera glycines
  Promoter: Source sequence=SeqID_26168; Location=1..344; Strand=+; Gene=SeqID_56917
attggagtccaataatccgtataaaaaaaattgctattttgctttttagttaattataattttgaaatatttaaagtaacaaaatttgtcttttcaaataatttttgaatatttttataaatttttaaatttttttaaaattataatgtttccgtggtgtttaaaaaatattgcttagaaaataattatttttttattttaatatttttcaatctcttctatcttctcttcattcatttttaaatttagaattttattttaattttgatgaaaaattattttaattaatttttaattaaactagtggataaattaatcatttaaaatatgtttttatttagatg

SEQ ID NO: 117548 - DNA, 519 bp, Heterodera glycines
  Promoter: Source sequence=SeqID_36709; Location=1..519; Strand=+; Gene=SeqID_65959
acatatagaggactgaatgatgtcgaaaaagattgtgtatttacatttaaattcttctgggtacgaataacaaaatactttttgtgggtacgaatttttgtttattgatataattgatgtgtgtatgagtaaatgtgatatatactatacacttaatgttaccgttgccaagtcaaactaatattaaaaaatcattttttgctataaaaagcatagtgaattatagctaagtaaattatgtcacgtgctgatgaaataaaaaaaaatgccgagagcttcaccgttttcgtcttgtgggtacgcagcgtgctggatgttggcactgcggggatgaccatttgtgttaagaaaaataagtttaaatttattttcttagagggttcgaaagcatgctggaattgcggcaagaaaggccacctagaaactagctgtcaccacacgccgtttcggtttaatagaatattaaaccaaatcatattgtttgtttagttatgtccctgtgggttcgtatccaaaatg

SEQ ID NO: 117549 - DNA, 459 bp, Heterodera glycines
  Promoter: Source sequence=SeqID_39366; Location=1..459; Strand=+; Gene=SeqID_67947
atagacaaaagaaaatgacgaaatagtacaaaaaatgggagagaacggcagacggacagggagttgaaggatgggaaatcaatcagtggataatccgtcagtaatggacggacaatcaccagcaaaatttattttacgactctttttatcatatgattttgtttcatagactttgtctatgactgtatcatatgattttgtctatcatttcgcagaaatgccttaaaaagcaaaaaaaaattttgaaaattcttaaaaactcgacttcgagtgtccggcaaaggatctcgccgcttttgaaatgggttggaaagatagaattaggggcgcgcttgcccttttccataatgtgaagagatcaaagtgcttcgaccaggtcttttgctagtatggtgatggatgtattaatagaacaggatttaggttcgattttattggtctatgctgaccgagataatg

SEQ ID NO: 117550 - DNA, 190 bp, Heterodera glycines
  Promoter: Source sequence=SeqID_33499; Location=1236..1425; Strand=-; Gene=SeqID_63545
tccattttcagggctagttgattcggcaggtgagttgttacacactccttagcggattccgacttccatggccaccgtcctgctgtctatatcaaccaacaccttttatggggtctaatgagcgggcactttggcaccttaactccacgtttggttcatcccacatcgccagttctgcttaccaaaaatg

SEQ ID NO: 117551 - DNA, 849 bp, Heterodera glycines
  Promoter: Source sequence=SeqID_929; Location=2823..3671; Strand=+; Gene=SeqID_64291
tttgctgcctcacttcgcttggtttcgcccccgcttaacaattgtttagtgtgcaaaaaacctcctgacaattaattcaggaaaattattgtgacataaattaatgataattattgcaaaccttataaaccaacgcgttggcaaacacggcgcctcgcgccacaaacgaattggcaaagttgcgcttgtttatgcgcttaaattttttttccaaaaattatggttaatacctgaaaatataaataaattaaacatattttaaaatatggtataaacatttaaaaataaaaacaattctacaaatttattaatcatagtattgatattttttagccgggcaaaaaatagcacaattaatttatttttaatggctaccgatttttctctatttctctaacacaattcttttcattttttctctctctctctctctcacttttctatttttctatcgcacactctcctccctcactattttctctctttatctaactaccgtatttgatctaattatcccccatgggggattattttttaacctcctcatagactggggataattggagactgtgtgattatgatagagagattatttttcaaacgcctcctagactgggggataattagagactgagggattaatggagattggtgggataattagagcaaatacagaattttctctttctcaaccccatccaataggtttgggtttgtggaaggggatgtcagagaaaaaaatctccaatcaaattatcgggcgaaaatcaatcgataatttgattgggaatattatctactactaaccaaaaatttttccaaatccctcacctaattgacttgaaaatg

SEQ ID NO: 117552 - DNA, 146 bp, Heterodera glycines
  Promoter: Source sequence=SeqID_22087; Location=890..1035; Strand=-; Gene=SeqID_52730
atatttggatcttctaaaggggacgcccgtaactcatcagtccgttatatcattccatagattggaaagaccttacttttcaaattgaattgaatgattataattctgattttaaatttaaaaagcaattaattattatctaaatg

SEQ ID NO: 117553 - DNA, 93 bp, Heterodera glycines
  misc_feature (22)..(22): n is a, c, g, or t
  Promoter: Source sequence=SeqID_15094; Location=2213..2305; Strand=-; Gene=SeqID_79271
catttgaagtaaaaatattacncattttctttaattactgttttttaaccgttaaagtcatgcccgcggggatttgctcagttgtacacaatg

SEQ ID NO: 117554 - DNA, 67 bp, Heterodera glycines
  Promoter: Source sequence=SeqID_15728; Location=1893..1959; Strand=-; Gene=SeqID_80053
ggacaaatgcgaggaggaccaaacaaattttgcatatttccaatcgaatgaggacactaacggcatg

SEQ ID NO: 117555 - DNA, 337 bp, Heterodera glycines
  Promoter: Source sequence=SeqID_10965; Location=1..337; Strand=+; Gene=SeqID_74273
ttttacaggaaaaaataaataagataacaaaatacaatattaaaatgatgaataatttattttatgcaagataaatattaataaacaattcttaaataataagtaaatgttgttatcatattacttagcaaaacatacattttttgaaacgaacgagcaatgcactgatatacatttgggctcgagataaatataaaatatttaatacgtaaatatttatttacaaaaataacaaaaaatatatggaacattttgtttgaatatattttcagaaaactgtaaattcattaatacgtttgaaaaaattgtgtgaattctgaaggcgagttcgcgcatg

SEQ ID NO: 117556 - DNA, 1003 bp, Heterodera glycines
  misc_feature (189)..(189): n is a, c, g, or t
  misc_feature (203)..(203): n is a, c, g, or t
  misc_feature (244)..(244): n is a, c, g, or t
  Promoter: Source sequence=SeqID_8717; Location=2259..3261; Strand=+; Gene=SeqID_68946
aaaacaaaatagaattcgatagagggggtcaaactatgggcctatgcaaaatttgaagaaaatttgaacatagggaaaaatttttcaactaggtgaaattttcaataattttaattcttttttagccaagtccacaatttaagggccaaaccaaataaaatttacaatattctccagaattttcccttncaaatgagcataanatggttttatttgctctagtattcaccaagttataagctanaaaaattccataaaattgtcgatgctgtacgtaactaactcttattgaaaataattttttttgacacgaaaacttttattaataaaaaatatttctgcattcttctttaaaagaagaaattgaaattaacacttgcacttggagatcaaaaccaaatcgaaagtgattgttttttatttgtgtgcatgttttagtgaaaaatacctacctaaattgttttttcatgagtgaaaggggatgagatttgaattttgttaaaagtcgaattgatgatataacaaatattttgatttttcatttgtttattctatttgcaagaaaggtaaaattttgtgattttgcttcttaaatacggaaaattaattttctccctgctaaagggttttatggatcaattaatgaaattttagcaatttttagggggtgtcgtaaacatatgaccatgactatccatgagggttttaatgaagtgaaacaaggcccgaagcagccgagaaccccccccccccccaaaaaagacaaggaactctaataaataagaaagaaatgctgtaccaatagaaaacgctaaatattttgaaatagaaagacgattaaaatgataaaacacaaccgtccgctagtaataaaaaaaggaggtgattttgttttaaaaaaattttgtgtcaattcaaggtgcaaatcgtacaaattttcaaaaatttcactgtgctgcttgttggcaaaattgcaataaaagtgttaattaattatcgaatg

SEQ ID NO: 117557 - DNA, 1003 bp, Heterodera glycines
  Promoter: Source sequence=SeqID_330; Location=3483..4485; Strand=+; Gene=SeqID_82635
tttcgaggacccttgccatttaaggacgaatgggagacctcacatactacctatttaccgcaagtctttggtaatagacggtagtagccagtccccctctccaatttttcgaaatttttttttttcataaatcagaaagaattttgagactgacacagattttaacccactgaacattaagggtgtcgggaacggcaaatgaacattggcattgcacaggcatttctcaacaaagtgaaggtcggtttctgtaccgccagttccgtcccaggcatgtttaaaacatcataacttttttcacagttggccaaattttataaatttggcatcattcggaagctctacatatttaaaagcagtgataagctatttctaagcgattgaacaacttttaaaaaggttgcaacatgaattctgcaaaattcgattttgcatatttttatttacaacttttttacatgtaggtatatagttgtgatttttggaaaccaatagagcttgttaaaagctctcgaatgatcccaagttttttgaatttggtcaacaaagaaaaaagttatggtgctttaaacttttaatctttctgtctattttcataaaatatacttttgaaaattaaaaaaagacgaaataaaatacaatccgagcccctgataaagtaacaaaaattttaaattagatacctaaatggaattataaacagtgacttttcgcttttatacccaaatttatatgtgccgacaaattttccgataattcattttcctttttctgtgaaaatcacactcaaaaagtgtataaatatggccacttttcggctcaaaaatcattccttccaatatttttttttcattttaatttctatcgtcaattcgtcaatttttcttctaataatttcacccattcatttcatttagcgttcacacattttgccatctgtcaaccaatcatcatcatcgtcaacatcgtccgtcaacagttcaacaacaaaacgttcaaaatg

SEQ ID NO: 117558 - DNA, 332 bp, Heterodera glycines
  Promoter: Source sequence=SeqID_27147; Location=1..332; Strand=+; Gene=SeqID_57849
atatttccaacctattaagccattatttatttgctttacttgagagaatttatgctgggcatcacttcatttttgggccgattcgatgcctcgccaaattaaataaattcagagcaaagtggtctttgcacaccaataacatttagcggcccattatttgggacaatccatcccgattattatacatatgtttttaattaggatggattaatggctttttgatcaatccgtaaaaatgagaaatttgtttagccatgaaaacatttattttgttaactttaatttttctgaatttcattctgaactgctgtgccgcaaggcaattaaaaatg

SEQ ID NO: 117559 - DNA, 328 bp, Heterodera glycines
  Promoter: Source sequence=SeqID_3697; Location=3231..3558; Strand=-; Gene=SeqID_51506
tccgccacaaaagatccgacgaatggtgggacgtgctgttcactagtgatgctcgagagtctcggtctcgagtctcgactcgagaaaagtctcggggttttttggtctcggtctcgggttttaaagtctcggtctcgattttcgagactcgagaccgagacttttttacacccctaatgattgggcttttcataataaaaaaatgagcttatgaatatgaatttaatattgacattatgccaattttaaaataaagatgaaatattttattcgtttcatatacatattatatttgtagtccttaattttgaacttttttagagtaatg

SEQ ID NO: 117560 - DNA, 823 bp, Heterodera glycines
  Promoter: Source sequence=SeqID_16374; Location=1022..1844; Strand=-; Gene=SeqID_80763
tttcggataattcggcgctctttaaagttgcaacttattggtcattattttatttatttacattgaaattgaaattaaataaactgtcgacagttttcatataatttatttttgaataaaaaacggttttttttgacacgatcattttttttttgtgtcgattttccaaatttttgaatcttctgagccttttatgaattttttttatggcaccaaattttatcttgcattatcattcgaaagcccatagaaatgctatcaaatagtgtgcttttttggtgaaagtgaaaataaaaacaattttattcgcttggcattcccatgccgctttttctcttcccgtcgcttttcacacttcaaattgccattgcaggtccaacgtatacaattaaaaatgcggcgatcaaaaagcattgagcattttcaaaatgtttctctttttgccccattcgctttctgtccgtcggctttcacaccgctcaccaaaatcaaagacaactgaaaaagtgtttgtattttcgttttgtccattcttttgcgtatgacaacgccaacaaattcaacacaaaattccccgtcgcttccctcgaatttcttttctgcgccgggcggcgcgtctgctgcacttcccgacagtctgttgcggaactgtcccattccgcttcgattgaacaaccgaataatttgcaacccaataattgggcaaggggagaacgaacggcgaacatccatagcagcagaggatgaaaatctgcagagcattctgaatggcagtgcagctgagcaattggaattggttgacgaagtgacggaggaagaaatg

SEQ ID NO: 117561 - DNA, 290 bp, Heterodera glycines
  Promoter: Source sequence=SeqID_82; Location=2620..2909; Strand=+; Gene=SeqID_63764
tttttagcggcgggcagagaagagaaaaatagtaaggaaatttgagagaaaaacttctctcaatttaacttgatatttccaaattgggtttaaaagcggaaattatcgcatcgattttttccataatgttccttttttcatttatttttattctcaatcgagccaattttttttaatactttattttcattcaaatttagaattttgcctgccattgtttattttacattgacgaaaatgccgacactttgatcgaatcggagggatttttgcaaattgaccaaaaaatg

SEQ ID NO: 117562 - DNA, 333 bp, Heterodera glycines
  Promoter: Source sequence=SeqID_35989; Location=376..708; Strand=-; Gene=SeqID_65434
ttcaattacagccccgactcacctgattacagctcataaagcatgtaattggacgaacggagatcgtaattaaataatgaaaaattcggtaaaattaaaacgttgaaaatatcagatcgaatctaaagaaatctttctccgactgaatgtagtatcgaagttccaattaattaatcttttaaattggtattattggaacccttagatattaaaaactgtttttgatatgattgataaatttaaaaataaccccttatcatttcaattttgtagccaaacagtcaattatttttcgtttgattataattataatttaaactttgtagcccaatg

SEQ ID NO: 117563 - DNA, 676 bp, Heterodera glycines
  Promoter: Source sequence=SeqID_11290; Location=1..676; Strand=+; Gene=SeqID_74663
atctaattttaaaattaatcttagtatttaaaaaaatacttttcaataatttcaaattctttatgatggttatttttcaaatatttttcagtaggaaataatctcggtttcgattaaaaaaataattttttttttataatttttgaattctacgaaattaattgagttttaaattctcattctgttggatagtgaataatttgaatttatggcgatctgacttattgactttatttgttatttctatgtccatccgccccctccctcgtccataaaagtggacacctcctcccactttttgttcttccctttcatcattcatttatttatatttccaatttgccctccgaccgaatcaataaaattatttatttatttctttttctttgtgtgttctaagtggaagaacacaacaaattggcgcagtcagcagccattcttcatcactgaggacaaggacagctgcaaattcaacaaaaaccaatagcacccaggtggtgtgaggtctgctaagaagcagtttaactcaacaaaaaaaccaatagacctaagaagggtgaggttccgcaagaagcggtttttcaacaaattcgtcagcttagcaccaagacggtgtaagcatccaccaggtgtggattttgtggaatttttcaacaatttcaattgacggacaatg

SEQ ID NO: 117564 - DNA, 213 bp, Heterodera glycines
  Promoter: Source sequence=SeqID_20086; Location=1151..1363; Strand=-; Gene=SeqID_84873
ttaccctcagctgattcgatcaaccatcgcgtttttcgttcacttttttgtatcatcacagtgaatattggaggctatttgatctgtgttttttttattgcgctgatcaagcatttcattccgtctccgatcactgcttggtttgttcatgagatcaccgcaattttattgaacattggcgcggcatcaaatggacccattctatacattatg

SEQ ID NO: 117565 - DNA, 527 bp, Heterodera glycines
  misc_feature (53)..(53): n is a, c, g, or t
  Promoter: Source sequence=SeqID_27319; Location=1..527; Strand=+; Gene=SeqID_58001
atttcgattttgaattaattaatttttattaaaattttacaattgaaattatntttttcaaaaagttccatttatccccccgggggataaatggagacggggcgataattagagataattcagtatgcctcctaaatagtcagcttgtttttctttttcgtgtccaatttgaacttggtcttcgtatttgacccattacgcatgagcaaagggcgtctcaggccaacgtcccatataccaaattttcatacgtgggtccaagtttttctctggccactttatatattttttgcttttcacatcattgctttttcaaaaaaaaacttgttaatgaggcatagagggataagcgctgcctggaaaattcattgaaattttagtgcaatttgtcgataaattatttgactggaacattactgttttgggcaaaaccccaggcctggctggatccacgcataatcagttccacgttgatctcttatatagtaatttgctgattcagtatcttcgctgggaaacacaacatg

SEQ ID NO: 117566 - DNA, 429 bp, Heterodera glycines
  Promoter: Source sequence=SeqID_33017; Location=1..429; Strand=+; Gene=SeqID_63208
ctttcatttttatgtatattgccaaaacggacaaaatgatcacgacaaaatccgacatgataaaagtaaactgctgggccataaaaacaaaatttaaaaataatgattaagggtttatttcaattttccaatccacgtgaatttatggcaatattcaataatttgtgatttttcatttttcaataacaaaattttgtcctttttgccgtctcgcagaattatgggtaattattgcattcattaaaatttcaatttgtttcaagacggcgcctgttgagtattacggccgtactcaaaattttttaattttgaccaaaaaaaaccacaaacatatttatggaaaccgtcgatttcatttaaaattaatttttaatggtaaaataatttttttttttaatcatttttgcagcttcatgttgtccctagatg

SEQ ID NO: 117567 - DNA, 1003 bp, Heterodera glycines
  Promoter: Source sequence=SeqID_2299; Location=1278..2280; Strand=+; Gene=SeqID_78988
tgaccggaaaattctgaaattttgcccgattttttaaacaaatttttcaaaaatgtgattttggatcaattttgaaaatgttaaggaaattttgggccagaatgtgccgaaaggcgcagccgggggaattttgagatttttaatgaaatttcttaagaaaatagtataattttttggaaaattttcccattttaattaaaaaagctacagaattaatatacaaaaccatattaaaaattattgaaatgcgaaaaatatttatttacctatatatttgttgttaaatttgttgttaaaaaaattaaatgcaagccgcaggattcgaacctgcgccctccgaagaggactgcgacctgaacgcagcgccttagaccactcggccagacttgctgatgaaaattacgaattacccttcattaaaaggcaattatttaattcatcaagataattaaatcagcagagcataatgaatgaataatgataaataagaagcatataaagaaaacaacttaatttgccaattagtggaagaaaaattgtaccagaatttagtaaggcataatttcctgggaataatgttttaaattttttataaaattttaaaatctcagaaagtttaaaaaatactcggaccatcggacaaatcggacatcccttaagaaaaagaatctaaattttttattatttttgatgattttgcataaattagaaaattaaaattattttaaattgtaattttttatggtacacaacaagaatttttaaatatttctcaattaggtaagttgtttaattataaataatagaaaagtatttaaataaattttggcagaaaatgaaaaaaattgattttccaaagcaaatcccgataatcccgagtttttaaattgtcaaaacaacaaaaaataaaattcgttcacagaaaaaaaagtggctcaagtacagtttatgcgtccattcaattttttatgcgtccaatcaaaatttttatcaggtggctatg

SEQ ID NO: 117568 - DNA, 238 bp, Heterodera glycines
  Promoter: Source sequence=SeqID_17820; Location=1..238; Strand=+; Gene=SeqID_82350
aaaaaccatgacaaaatgttttcgggatactctccgattaaatagtgaagcccgagattttgctgctgcttctcatagggcaattacggaggccgaaaaaattaagactcgtcatcctgaggcaccgggtatgaaaacgtggttcggtaggctattagaaggggtgagaaaggtacaaggaatttccgaaaaaattaacgaagaaagacagaaaatagggcacattagaaaagaaatg

SEQ ID NO: 117569 - DNA, 249 bp, Heterodera glycines
  Promoter: Source sequence=SeqID_16166; Location=2644..2892; Strand=-; Gene=SeqID_80532
tttacccaaattttagtaaaaaaaaaattttttttccattccttgagcgggattcccgttaattgccatcggtctgtgccttccgccattttcgtcattttttccaaattttcgaaaatttataggcctcgtttcttccgcgaagtattggcatttttgttgggcgctcttcagctgtgcaaaaatgaggcgaaagaagtgccatttccgtcgatgaatttcccaatttcgctgccccatcgccaaatg

SEQ ID NO: 117570 - DNA, 704 bp, Heterodera glycines
  Promoter: Source sequence=SeqID_20292; Location=152..855; Strand=+; Gene=SeqID_85095
tcgttcattctgtcatttattcctcccattgcacttcccttcgcttgaccatttatttattatatttgtgctccaaataaatatttgtcttttcttcatatctgttgttctcggacacaacagattttggcgcagtcagcagagcagaagcgaactgaagctgagcggcgaaagagctgagaagcagcaaaatttggattgctaattccgagttggaatagctgtttccaaaatcgtcaaaaaggagaggaagctaattccgatttggaatagctgttcacccaggtggtggcactctcaatttatggtgttaatccgggacggataacagccagcgacgaatcgccgaatttggaggaattgaattgtaatccgggaaggataacaatttcaattactgatcgaggccgaacagagcaagagaaaaatttgattggaaggtaagactggaaactgagtggcattgttaatccgagttggataacattggccttcatcgattttgattgttaatccggacggataacaattaattctcactgttaattcgagttgaataacagttgaccagccagcaccaattttcattgttaatccggtttggataacaattgacatcactgtaaatccaagtcggattacagttaatcagcagcatcttgaatttgatccgagtgggacaaattaagaaaagtgaaagaatg

SEQ ID NO: 117571 - DNA, 657 bp, Heterodera glycines
  Promoter: Source sequence=SeqID_42407; Location=1..657; Strand=+; Gene=SeqID_70304
aaaaatgtctatctctcttttctcttggggagttgaccgcaaacatggtgccaacactttccttctctagtctggctctcccaaacactctcacgatatatgaaatgctaacgaaaaaaattctcgcccaaaaaatggctatctcttttttctcttggggatttgaccgcaaacttggtaccaccactttccttctctagtctggctctaccaaacactcacacgatatttgaaatgctaacgaaaaaaattctcgccgaaaaaatggctatctcttttttctcttggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacatttgccttctctagtctggctctaccaaacactcacacgatatttgaaatgctaacgaaaaaaattcttgccgaaaaaatggctatctcttttttctcctggggatttgaccgcaaacttggtaccaacattttccttctctagtctggctctaccaaacactcacacgatatttgaaatgctaacgaaaaaaattcttgcccaaaaaatg

SEQ ID NO: 117572 - DNA, 384 bp, Heterodera glycines
  Promoter: Source sequence=SeqID_31637; Location=151..534; Strand=+; Gene=SeqID_61955
ttcattggagggttttagcccccccccccccccttagcctagtctccctcctctccctggatacacctttgtttcggtgtcggtcagaagtgagttgttaggttttcagatggaagttttggtcgggcgcgagaatggccgcgtcgaccatttcaattctttgactgaccaattcaatgcgctttttgctttaccacagccttccgaactcaaaggaattcatcgcatcgacgggtttcgatttcggacagcatttaaaacttgtggtaattaagtgatcggattctgactgctcaagaatgtggcactttggctgtttggagcgcttctggagaacggcaaacgaccgaaaattggacggcgggagaaaatttgttgacgatg

SEQ ID NO: 117573 - DNA, 122 bp, Heterodera glycines
  Promoter: Source sequence=SeqID_17715; Location=1345..1466; Strand=-; Gene=SeqID_82247
ctgatgggcgattgcacataaaagtcaagggacaagccaatgtgaatggcggtttaatgcttaagggcactgtgaagtggttgagttttgctatgttctttcttttggtgtgtcaaacaatg

SEQ ID NO: 117574 - DNA, 60 bp, Heterodera glycines
  Promoter: Source sequence=SeqID_44513; Location=680..739; Strand=-; Gene=SeqID_71994
actgaattaaatatgataacggtttgataaagcatataaaaattaacaaaagatacgatg

SEQ ID NO: 117575 - DNA, 463 bp, Heterodera glycines
  Promoter: Source sequence=SeqID_11562; Location=1..463; Strand=+; Gene=SeqID_75003
tttttcttcgacttttctatgaaaaaatttttctaagatttttttttgaaaaatttctaagttagaaaattttttccccggtggagttatgtctcggcggagtttcggctggcggagttttggggtgcaccggttgaagcatgcgtgtgttcatccctttacataatcggaaaacccctattaattcgccaaaaaaaaacgaaaaattaggcttttactttgcgtgaaggacacaattttggctgaacaaaggcggcgccaaactgaaagtttccagcttctgcttgttttgccttgtctttattacctgattaggctgttcatttgtatttgtagctaaataatgtagatttttagaaaacaaagggtcccactttggttttaaacagtaaaagtatcgaatttgataattcaataataaaattgtcttaaaattcttatcttcagcgctcgctaaagcatg

SEQ ID NO: 117576 - DNA, 331 bp, Heterodera glycines
  Promoter: Source sequence=SeqID_41830; Location=1..331; Strand=+; Gene=SeqID_69878
aaatatactttgtttttcaatttgagtctgttggcgttttgttttacgccaatcattttttggcaatttttttccttttttcccctccatgggccccatcgacaaaattacaaattataaaagccaaaagttttttgaattgaaacatttaattacccattcgaataccttatgcaatgcataaattttgtgtcggcttttactttatgaatatacattttaactcatccgcatatttatgaaattgacataaacaatttgtcttctcctccccattatttttattgtagatagagaaccaaatcccactcactgtaaacggttaataatg

SEQ ID NO: 117577 - DNA, 1003 bp, Heterodera glycines
  Promoter: Source sequence=SeqID_20943; Location=358..1360; Strand=+; Gene=SeqID_51524
ttattttaagggcgaagatgtaaaataaagatttttaagggcgaacacccaaaataaggatttctaaggtcgaacgaataagggcgttaaaacgcaaaattttcgaattttgttcgaattcggttcctgtgttcgaaattgatcgaaatggggtacttatggttttcaggggcgctgaacacgattataacatctatttagaccaatttcgaaccccggaaacggattcgacctaaagtcgaaatcccccaaaagtcgaaaattcaaactttttcaacaatataatccttttctggagttcgaaattggtctaaatatgtatatgttataattagggccgcaacttttagtgaaaaaactttttttttgctcaattgttttgaagaaaggagctcaaaaaacgcatttctgcattaaaattttttcatttggacgtcacttttcgtcactagaaatcactattttggcgacttcgtcactaaaatagttaaaaatcactattttggcgttttgtcactattttttcactatttcgacattttttgaaaaattccttaacaaaaatgcaataaaaccaaaaaatacacccctaagaatctacctaaaaaaatttcaaaaaaatacacccctaagaatcgagctaaaatttttcaaaactcctatgaaatgaaaaaaaattttctcaaaaatttacttggcaaaaatttttaattttaaaaaatttttaggtaactattttgggttttttggtcttaaaaatcccagtcctactcatttgcaactgcaatcagtgaataaaaattatttttgctcaatttttggctgaaaattatgtcactattcgtcactatttcggactttttgtcactgtttcttcactattttgggatttttactcactattttagttaactatttcgggatttttcgtcactaaaagttgcggccctaataatgagtagggagtgtaattaattatatggatataaaatcgcgaaatatg

SEQ ID NO: 117578 - DNA, 577 bp, Heterodera glycines
  Promoter: Source sequence=SeqID_19135; Location=776..1352; Strand=-; Gene=SeqID_83890
ggtgagtgtgttcaacggggaacgaacgaagtcaggccccgtagccaccatagcgaaatgaaaaaatttaaaatattttttttttgaaaaccacacggaaaaaattaaattgcggcataattgattctttgaatttcacgtatttcttgtaaatgatgtcggatcaaaaaatgccgtatttcttttcagtggttaaaataagtcagaaaaaatattaaaaaaaaattccggtacttgtgtagtttacctgatacttttagcatacattttttaaatgcctataaatgtattcatttacatagcttttttaagcatttcaacataattaaaaacagaattataatatttgttctcgaaattttataaatagatgcaacttgagaccaaaagtgataaaaaacatcgggccttggaatcgctttcgccataaaaattcttccacatgcgaattcaataagcttctgtgtgttccatatctttttttgtgttctgccttggtcacgaatattaaattcttttaataattccatgctaaaaaaacaatgtaaatgaatacatttataggcatttaaaaatg

SEQ ID NO: 117579 - DNA, 145 bp, Heterodera glycines
  Promoter: Source sequence=SeqID_1785; Location=988..1132; Strand=-; Gene=SeqID_75955
tatttggagatttttagcatgtaaaatcctttcctttttcaaaatgcactttcttttttctctgcctcattgttttctttttttctgcttaataaatgatttttaattaatttccaaagacaggcaaacacaaagtaaataaatg

SEQ ID NO: 117580 - DNA, 268 bp, Heterodera glycines
  misc_feature (54)..(54): n is a, c, g, or t
  misc_feature (60)..(63): n is a, c, g, or t
  misc_feature (65)..(65): n is a, c, g, or t
  misc_feature (69)..(69): n is a, c, g, or t
  misc_feature (74)..(74): n is a, c, g, or t
  misc_feature (90)..(90): n is a, c, g, or t
  misc_feature (95)..(96): n is a, c, g, or t
  misc_feature (106)..(107): n is a, c, g, or t
  misc_feature (109)..(110): n is a, c, g, or t
  misc_feature (119)..(119): n is a, c, g, or t
  misc_feature (135)..(137): n is a, c, g, or t
  misc_feature (145)..(148): n is a, c, g, or t
  misc_feature (158)..(158): n is a, c, g, or t
  misc_feature (163)..(163): n is a, c, g, or t
  misc_feature (169)..(171): n is a, c, g, or t
  misc_feature (176)..(176): n is a, c, g, or t
  misc_feature (193)..(195): n is a, c, g, or t
  misc_feature (208)..(208): n is a, c, g, or t
  misc_feature (210)..(210): n is a, c, g, or t
  misc_feature (212)..(212): n is a, c, g, or t
  misc_feature (219)..(221): n is a, c, g, or t
  misc_feature (226)..(227): n is a, c, g, or t
  misc_feature (230)..(231): n is a, c, g, or t
  misc_feature (234)..(234): n is a, c, g, or t
  misc_feature (237)..(237): n is a, c, g, or t
  misc_feature (254)..(255): n is a, c, g, or t
  Promoter: Source sequence=SeqID_8414; Location=1..268; Strand=+; Gene= SeqID_67981
cttttgctcggcatacaaaatgacaatttgtgggcaaccctaaagaggcgcacncaaaannnngnaacncccgngaaagctttatagcanccagnngcaaaaaagnnanngccagaaangcacaaaaaagcgacnnnggaaaacnnnnacggacaagnggaanccggannnccagnggggaaagaaagagcannnagggggagcgaananancaagagnnncaaannggnnggngangaaaaaagagacacggnnaaaagtcaaaatg

SEQ ID NO: 117581 - DNA, 284 bp, Heterodera glycines
  Promoter: Source sequence=SeqID_29253; Location=1..284; Strand=+; Gene=SeqID_59782
cttgcaaaaccatttttcatgcaaaaatattttccaattggcgcttattagcaccgtctttttgtttcagtttcttcccaattttggactttggtaagccttcggcatcgtccaacgccattgtcaaagtgggcaatgacggcaagcacaaattttacgtcaacaaagaagtatgctttttttgtgggaaatggaggggaatgaatttaaatttaaacaacaacaaaaaaaaatttccacttaaatcccgttttaaatgctcttttttgcagttgctctcaatg

SEQ ID NO: 117582 - DNA, 1003 bp, Heterodera glycines
  Promoter: Source sequence=SeqID_13326; Location=139..1141; Strand=+; Gene=SeqID_77191
tttggaaaattggctatctcattttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgggaaaaatttggaaaattggctatctctttttctgctcaacagtaataggaattccaaccgcattctcagaataattacgccgatactaattgttctggaatttgtttctcggcgcgtttgtttgtgaaaaatttggaaaattggctatctctttttctgctcaacagtaataggaattccaaccgcattctcagaataattacgccgttctggaattttgtcctgtgctcaaagctcatcaagagctatggaattataccatatttgttcggattaaatcctttaaaatcccccgtatttcaaaaatggaaaaaccgatctgtcggcacatgcaaatctgggcttttaggttcacccccttcaaaaaattcagctcttttaaattattttttttttctgtcagacatttgttaaaatattacaaaaaaatggacacggttgaccaactgtccgcttctggcaccgcagcacaaagtgttgttgacccacatgcagccgctcttcaagaaggcaagcgattttcaattaatttgcggcgcgctttaacaaaaacggggaattggggactgctgaacaggctggtggcttagctgccgccatgggatgggaaaatcggaatcttttggccatattttgaataaaatactaatttttggttagataattggtcttgaatgaagcgatgaaattaggccctatggggaaagatttggaaatttaccgaaatcgttaagataattagtacattttcaggaaatg

SEQ ID NO: 117583 - DNA, 140 bp, Heterodera glycines
  Promoter: Source sequence=SeqID_12147; Location=1..140; Strand=+; Gene=SeqID_75724
gccgcgacatttgcccgttccagggaaaaaaggcatttgcgcctctgattaaaattaaatttatgtgctttattggataagaattgatagatattcattattaattcctttttcgaagcctgtcatgtcaattccatatg

SEQ ID NO: 117584 - DNA, 138 bp, Heterodera glycines
  Promoter: Source sequence=SeqID_44656; Location=1..138; Strand=+; Gene=SeqID_72116
cccctcccccctcacattcatcccattttctgcgtccgttcactcaaaattcaaacgaagaaacaattggaaggagggaaaacgactgataactcatcaaaagtgattgataagtgataagagaagggacggcgaatg

SEQ ID NO: 117585 - DNA, 324 bp, Heterodera glycines
  Promoter: Source sequence=SeqID_25425; Location=289..612; Strand=+; Gene=SeqID_56164
ttccgtgttgctccgtctgttcggaaccgtccaatggcactttttatttttacttttttacctttgagtgtattcaatttaaactgaaattattttccattttggatagttgatttttatattaataaatttattaattttggcattttagctgacactttgcactaattactctttcccatatgcagtcttcttcctcttctttctcctcctcctcttcttcctctttctcctcgtcactcttctttctgcccaataatacccaatcatcccattatgataatgggtcgagccaacaaatgatcattagtgcttttgaccatg

SEQ ID NO: 117586 - DNA, 51 bp, Heterodera glycines
  Promoter: Source sequence=SeqID_10548; Location=1..51; Strand=+; Gene= SeqID_73783
atcaaatattttcctttaaatgtttttagaattaaaatcgaaaataaaatg

SEQ ID NO: 117587 - DNA, 476 bp, Heterodera glycines
  Promoter: Source sequence=SeqID_1735; Location=1676..2151; Strand=+; Gene=SeqID_75574
aacggattcgttgcgaaagattttcaaaattaataattttaaaatgtgagcaatacgtttttgtctagttagtgatcttctctttgtatgtcgcagtgtattattatattatgtatattattattatgtatttagttaaaattacttttaaaatttgataattaatatacattcccttttgttaccattttgatgctaattaaatctttgaaaaatgcatgtatttattacacgaaagttagagatgcttacaaattgattaattgctttgataatgcgaagattgagcattaataaataattatttggtgttgagcctgatgagaaaaaccagatcaaaaaaagacgattgataggtgcgtcagcgatataaaagcaattatgctatcaattaactgtcactttttcacagagcaattactcaccagtgaatttcagctttatacattcccgcatccaaactaacagcaaatatg

SEQ ID NO: 117588 - DNA, 1003 bp, Heterodera glycines
  Promoter: Source sequence=SeqID_5034; Location=738..1740; Strand=-; Gene=SeqID_56658
tttttgtggacaaatctgttaacaaattgcaatcaaattttagatttttcctccggcggcggttacaggcaccgcctgactccaaaaatttatccttttcattaaaatttggcaaattcgcaaaatttgccatttttatacaaaatctgtgcacatattgcactcaaatttttaaaaattcgacgcccctgctggacaccctatttccaaatttttggaaaattttaccacaaaaaaaaacagtgtaaaaacaaaaaattcgccgacaggaaaaaatttaactcaaaaaattcacggtcacggtcacgaaaaccgtgaattttacgggttttttggatcacggtcacgattcacggtaccaattcacgatcacggtcacggttcacggtaccaattcacgatcacggtcacggttcacggggtcaattcacggtcacggtcacgattcacggttcacgggttttttcagtcacggcgcatctctaccaaacacagaacagccagtgaaccctttcgtgcaatatgactgtgcagattacaaaacgtgtgctggtactgttaattctctaattacttagtaatttaaattgctatttaatcatttagacagacatacaaattgtaagcaattatctctaattacttattaattcaaattgtatgcgcttatctctaattatttactaatccaattgtatacattatttaataaattcaaatttgaatctaattattccgtaatcgttttatcattgtaaaataaagattttctttgcatgtgctcttttgtatggccaaatatgaaaaaaatcaactaattaatcaatttattaaacaatgtaattaattagtgtttagtgcttttttaacttttaaaatttattgataattaaaacctttccgattacaattaattaattaattaaacaaaaatttaactattattacatgaatgaaaatgctccatttaaatttttatttaaattactcccaaatgtaaatg

SEQ ID NO: 117589 - DNA, 53 bp, Heterodera glycines
  Promoter: Source sequence=SeqID_12033; Location=3525..3577; Strand=-; Gene=SeqID_75561
ggtaacacaaccaaaatgccatgatcacttgatttttcaaccccccccccatg

SEQ ID NO: 117590 - DNA, 1003 bp, Heterodera glycines
  Promoter: Source sequence=SeqID_11638; Location=2414..3416; Strand=+; Gene=SeqID_75087
tcatttccaaggacgtccttggcatccaaggacgaatgggagcctgcagtatttttgacgaaaattttcaattttacttattgatatcccctccaaaactcccctcacccaatttcccaaaaaattctttacattttccaaaaacagttgaaaattgttaaaaaatggtaaaatttcaaaaatttccccagcagcgcctgtcggcaccgccggaatcctcctgctccccaaaaattaacaaaaaaaagcgtgtcgcagaaaaggagtgaaaagcaaaaaaaaaaaaaaggtcgtccgtcaccagtggcggtgccccctcgaagccctaggccgaaattccctgggcggtcagtagggctgggaatttaagtcaaataatttttttttgttgcctttaaatgaccttaaaatgactcaaaagtgttctacactttgtttgaagcttcttcattttttggtgactttttttttgacttttttaaactttttgggttttttatgattgaagaaaattccgaaaaatgagtctatcttcgggaagttactgaaatttcttataccattaggattcaaataaagggattgaaaaataaaataaaaatctggcggtgtaacaattttgaaatatttttatttcgctaaaactaattggttttaaattacttttttgtgttactttttggctatttttccatttgtgccatccctttttccctccaattgttcccattgtgtcgtctctatttttccccttcggggggtttaattacccaagtttgagcctaatgataaattggattatttctgcgcactgctccttgggtctttatttcaacaacttgctctgaatactctgatatcctctcgccccgacccccaacaaaaaaccatttagtaataggtaaaatctttcctaaactgttaagcttttaaatgatataatatgcgaaaaaaatacctatatttatttttacaattttagcaaaaaaaattctctaaaatg

SEQ ID NO: 117591 - DNA, 62 bp, Heterodera glycines
  Promoter: Source sequence=SeqID_258; Location=2263..2324; Strand=-; Gene=SeqID_79952
aatattatgtttattttaacaaattaattattttaaatattttaaggcaataaattgcgatg

SEQ ID NO: 117592 - DNA, 428 bp, Heterodera glycines
  misc_feature (47)..(47): n is a, c, g, or t
  misc_feature (81)..(81): n is a, c, g, or t
  misc_feature (93)..(93): n is a, c, g, or t
  misc_feature (103)..(104): n is a, c, g, or t
  misc_feature (109)..(109): n is a, c, g, or t
  misc_feature (121)..(121): n is a, c, g, or t
  Promoter: Source sequence=SeqID_13528; Location=3104..3531; Strand=-; Gene=SeqID_77427
aaaaaggctccccttagtttttataaaaatcaaaatctgtcgatttnaactcgcgccattatttcttaatgccctgcaganttgtcagtgatntagacaacgnnattanaatttcaaaatntaaatttttattcattttttccatttgacaatttttattgcttattcacgtgtattttatgcagaatttcggccatataatttaatgtgatggaattgttgaccatgcatgtaaattgcgttaaaccaattagttcaaagattttgtgttacatattttgatgaacaaacaaattggaagatgcatagcaaagttgtgttggaattagttgcacacaataaatgatggtcaaaaatggcagtaatatttgtcataattcaaaaattgtatttattcaaaaaattattattattcaaaaattctcatg

SEQ ID NO: 117593 - DNA, 379 bp, Heterodera glycines
  misc_feature (6)..(7): n is a, c, g, or t
  Promoter: Source sequence=SeqID_21356; Location=1..379; Strand=+; Gene=SeqID_51956
ctgcannggtcctttttccagaaattttcagcggatacccccctccccccccccaaaaaaaatttttgtacatttttgtggtctcacttaattaataaattttgtacagagagagtacaattttatttaattacgttcattagatgtagtaattaattgcgacaatatgttattttacaagcgtttttttatcaattggagaaaaaaaacatgcaaaaataaaaatgggttgtatattttaaaatggtcttatcaatttacaataaaatgggaatgaaatcccattaatttttggtcactattctgacaaaataaattcgtaatttgccaaattaaaaaaaaattcaaaaataatttttcagccgtgccttcctcgatg

SEQ ID NO: 117594 - DNA, 895 bp, Heterodera glycines
  Promoter: Source sequence=SeqID_19581; Location=581..1475; Strand=-; Gene=SeqID_84319
ctagggcgttgaattatatgaaaatccatatttttttcctggactgtgggaggcctgaaacgcacgaaaaacatatttttagcttggtttggagcttctaggatggatttctatatccatattttccatatttgtccatattttggcattttccagaaaacctctattagaacggcccccaacagctaaattgacctttttgaccccaaagaccggaaaatttttcaaaaaatcaattttttagcaaacatttttcgagaatttgaatacatttaaattttcttaaaaattggtaaatttatgtcaaaaataaggaaaataaaactgaataaattttagctttacgtgtttttttttcttctaaaatgattattaacaatgtatttagcccattttaaagacttttactttagaaattttgagaaagtaaatccttaattttgaaaaatttatgtatgtccatattttgccattttatgtccatatttcgcgattttatatccgtataattaaacgccctaattattaccatacatgaacaaggggtgcgccggcgcaccccccccccccccccccctcgttcgtcgtaaggggggcggctgtaaaggaggggggggggggtcgtcgtggtgggggtcgtaacgaagggggaaaaagttaacatttgaacaatttccgtagccgaaacccatagaaaattcaaaaaattttcctggcggcgcctatcggcaccgccgggaccgctccacccctttccacaaagttttttggaaaaaaacgcgccgcaaataaaggtggtttgaatagcaaaaaaaaaataggggccgacgtatgaaaaattggtcctggcgctaattagtattaaccaattcgtttttttttagatgaattcatg

SEQ ID NO: 117595 - DNA, 702 bp, Heterodera glycines
  Promoter: Source sequence=SeqID_10913; Location=922..1623; Strand=+; Gene=SeqID_74193
attctgtttctgtgtttacatcattccctctccttctcctttaattatttaggccgttttcggaattgctcaatcattttttgttgttccttttacataatctttttcggcattataattttttcgtttccctattttctgtgttgcctttctgattctttctcgaatattgtttcttttcactaaaaatttttttgatctttacttttcggtgttatgacactcgtacaataatttttaccattttttaaatttttctaaaaaattaaatgaatattttaaaagttttttattagaaaaattatatgacttgccattgtacgagttgctctatttacccttgcttctcatcccatttcttctctgattaataaatttgtgtaattgttctttcttttcggcacttgtcctaacaaccgaccaaaacaccccacaaaagtcccatttgaccaaactccacgagtctatccgaggcaacagctgcaaaacgaaagccaagacctaaacaaccgctgataatccatcccatcatcacacggctgaaaccctcactaaaattacccgtggggatggtttttagaagaaatcgttgggaagtgatcaatgaaagtgtccacctaatgggactaattattagggagggattctcaagttgatttatggggcctttcttaaattgcaattttcgagaaaagccaaatg

SEQ ID NO: 117596 - DNA, 120 bp, Heterodera glycines
  Promoter: Source sequence=SeqID_38238; Location=1..120; Strand=+; Gene=SeqID_67119
acaacataaaattattacttctaatgccataaaacaatccctaaacagcttaaaaaattgagggtcacattaacattaaacccttttggcgttctgttaattgttttccaaattcagatg

SEQ ID NO: 117597 - DNA, 73 bp, Heterodera glycines
  Promoter: Source sequence=SeqID_1540; Location=3085..3157; Strand=-; Gene=SeqID_74336
cgttcgttttaaataataaccattttttcttcctaaccctaaacttgaattttaaaaaatatatacaagaatg

SEQ ID NO: 117598 - DNA, 286 bp, Heterodera glycines
  Promoter: Source sequence=SeqID_2160; Location=50..335; Strand=+; Gene=SeqID_78182
ttttcgagatcaacgtccctaaaaccccaataacatgttttcaaaacctttttttccaaaaaggggtggggaccatctgcagtattaccagatcagaaatcctctaacgtcgtctaaaatctgtgaaaattggataaaaaattcctatgctttttttaatgcgcgattcgcgtactgctaccgcggcacccttaaccttcactaaatgaacggatggatgaaatggataagatattccttttttttctaaaattcatatttatagaaaatttgttttgtcaaaatg

SEQ ID NO: 117599 - DNA, 75 bp, Heterodera glycines
  Promoter: Source sequence=SeqID_5894; Location=1171..1245; Strand=-; Gene=SeqID_59602
ttagaaaacaattacatgctagggaatattgagacttgtgcaattaaattaattacccatattataagaaaaatg

SEQ ID NO: 117600 - DNA, 915 bp, Heterodera glycines
  Promoter: Source sequence=SeqID_8987; Location=1..915; Strand=+; Gene= SeqID_69919
ggatcagaaagtggaagaggaatagaaaaggaaacagaaagtggaagagaaagtggaagaggaccagaaagtggaagagaaagtggaagaggaacagaaagtggaagagaaagtggaagaggaacagaaagtggaagagaaagtggaagaggaacagaaagtggaagagaaagtggaagaggatcagaaagtggaagagaaacagaaagtggaagagaaactggaagaggaacagaaagtggaagaagaagtggaagaggaacagaaagtggaagaggaatagaaagtggaagagaaagtggatgaggaagataaagttaaatagcgaagctatttcaattaaaaaaataaattaaaatcaatttaaataaaaatatcgcatttaaattaaatttaaaacaatatcgtttttaaattaattatttgttcatttccaaattctcatattcctaaactatgaggatcgcttagcggccaatagatgctttttgcacgccccaaattatatctcccactagagccagcgttgaaagcgcccccggcgctttcacagggcccgcagggccctggttatgaaaaggaataaaatttaccagtaaatttttttattgccaaattcttcaaaccctatttaattctgcctcatttactcaaaaaatatcaaattattattttttatttagggatttttcatttgcatacaacccttgccgcttgatagttaaagacattggcaatgcaactttgccggatgtgccattggcacaaattattgtgtgggcatgggacgcgcaaggggcacaagtgatcaaagaagtgacaattcaatcaatgcctatgcctaccaatgatttttatcggaaaaatgaattctagacaaaaatattgaacacgggcggcacactaacatttatg

SEQ ID NO: 117601 - DNA, 217 bp, Heterodera glycines
  Promoter: Source sequence=SeqID_4631; Location=1538..1754; Strand=-; Gene=SeqID_55165
ttgttgcggttctacactttcgcgttgcatcgaacagaacaaacgcattgttgcggttctgtggtctaacgcattgttgcgactcaccgattttgccccacaattaacgcattgctgcgaaagtgtgggctcgccgcttcatcaaataacgcattgctgcgatttgaaaagttttgttcgacggaacgacgaaatttgaaacaactcatttgtaatg

SEQ ID NO: 117602 - DNA, 1003 bp, Heterodera glycines
  Promoter: Source sequence=SeqID_3436; Location=3222..4224; Strand=+; Gene=SeqID_84676
agtattttcgagaaaatttgaatttcgctgatgcactactgcctttggcccagtacttttcacatgactggatgtacatattttctatataatttgctttttcacattttttcaaaatatttgaaattcctgaggctaagaaaaatttttcataaatgtcaaaataaaaccaaagtttcattcgggtccaatttaggaattagtcgaaatggacaccagaatcatgaccagcgaccagaaagccctttgaaatatattttcagattttttaaattaaaaaatatttatttcaaaaaagtggggtaacaacggtagtattaccgaaatttgttatgcttgcaaaatcatacttacccatccaccagttttaaatgtattttttatggctcaaaaaattataaaactttgaaggtattccaataaaagaaaagtaggagaatcaccaattatgcaagtacatatacaatacagtacatttaaatggaattgatcacattatgtaaaaaaaaagatgtcagaagaagaaccaaatgtggaaagaattagtttaggaatgaaattttgaaaaaggtaattaaaataaattgtatatttgccctcacccaatttttcaaaaagcaaatttttccgggatctctgtgatcaggaatattgtgataatttcgattcaatttatttctaaaagcccgacattttatttacttttaaaactacacatccatatgataaatttatcgaaaggccaattttgcagaacggaatgtctgtgaaagaatgtccgtttttcatggacatatcgccaacaaaatccgtttttgaaagaaattttcagcaattcattacgaaaaatgggcattgacaaactttcctataaaaacagaaaaagtgatgatgatcaaaatgataaattgtctgtggaatcatttccgatcaatgtggataacgaatgtgtgaatgaacgtcgtcggcaaatgccaatccgctgatcggccatcagccaatg

SEQ ID NO: 117603 - DNA, 370 bp, Heterodera glycines
  Promoter: Source sequence=SeqID_2158; Location=227..596; Strand=+; Gene=SeqID_78145
atcacgaatctgacgttaatttaggcctatcccgaacccccggacccgaactcggacaaaaaggtcgcacaaactcgacataaaatcgatttctaaaaattcgaatttgcgacttgtttgggttcgggtccgggattcgaaataggcaaaaatggatgccatattcgtgatcagcaaccccaaaaaaccattggtatatatattacctgttcgttttcacatcatgtgaattttcacctaactcgctggaaacatgttatagctaaaaataaacgtcagattcgtgatcagcacattaattcagcttagaaaaattaaaaaaaaaatttcagggggggggggtgacaaaacctacaagtaccgcaaaatg

SEQ ID NO: 117604 - DNA, 280 bp, Heterodera glycines
  Promoter: Source sequence=SeqID_5371; Location=1320..1599; Strand=+; Gene=SeqID_57805
cgtatggttattaatattttgggaaatatattatattttaatatggattctggtggtttaaaaaaaaaataaattttataattttctaaaaaatctcatcaatttttggaccaggaaattgaagtgaataaatgaatttttaattttttttagataattacagaaattttggtgccgaaaaaaaataaattttaaaggaaatattttgcggaaatttccggtttttatttttttttgttaattcgccgattacttttggttatatttttttagttgcatg

SEQ ID NO: 117605 - DNA, 110 bp, Heterodera glycines; identical to SEQ ID NO: 101859
  Promoter: Source sequence=SeqID_26534; Location=689..798; Strand=+; Gene=SeqID_57274

SEQ ID NO: 117606 - DNA, 965 bp, Heterodera glycines
  Promoter: Source sequence=SeqID_16758; Location=1..965; Strand=+; Gene=SeqID_81167
tacatttcgaagtgtttgtgggtaaaattgtctttttttgataaatcatttctataaattgaaagttccagcagagaacttcgaaatccaatgacgaattaatgaattcgagatttcattagtttctacaatcgaagaaaaaattttttaatttgaaaattatgttaataattaggaaaaaagtcgatttttaggggtgtatttttcaattttcttgtatttttattgcaatttttctcaaaaatgccaaaatatgtgcaaaatatgtgccaaaccccaaaatatgtgctaacatattttatgtgacaaaacgccaaaatatgtgtttttatgtttttataagtcgctctaaatcaaaaattgttcggagaaaatgctatttttgggcttctctcgccataactaagccgcaaaaaaaatatgttaaaacataaaaatcctagccctaataatgaatgactagggagtccaaaaatatgcaccaaaaatggcaaaatatgcacataaaaagtgaaaaatatgcacaaatatgcaaaatatgcacatggaaatccatcctagaagcttcaaaccaagctaaaaacatatttttcgtgcgtttcaggcctcccacagtccaggaaaaaatatggatttccatataattggactccctaataatgacaataattaaacgacataataaataacaaaatttaataaaataacaatttatttaaattcggatggtaaactctcccctattaattcaaatgtttattattgaataaatacacaaaaaacaaaatatgcaaaatttgtcaagaataaatccgaggggcttaaaagaaataaaagttaaaacagacaaaaacatttgtaaataatttgtttaaatatttttttcaacaggaaaaactcaaaccaattttgaatcgcgtgaagaaattgacgaattaggccttttgtcaagaattgacggaatg

SEQ ID NO: 117607 - DNA, 701 bp, Heterodera glycines
  Promoter: Source sequence=SeqID_6325; Location=936..1636; Strand=-; Gene=SeqID_61146
agtgacaacaaaagacgaagcagcagcagaagactaattagagttaattaaccgacaaattaagacggattttgggcatttgcaacagcaaatgaatttgccattcaaattaattgcgcaacgaatccgccagcatagagacaaaaaagggacgaaatgggccgaatcggaggacggtaatttaaaaattaaatgagaaaaaacgaataaaacaacgaaaattaattaattttaaaaagcagtaacgaatcgattcgatgtgctgatggaggaaaatgagcagaacatcgaattggaatttttgaggcttttcaaatccgcgcgagcattggcacgaattagtggcacaaatagtaaaaaaaaataataaatattcaaaataaatttataaaatgcttaaaaaactttttccaaggcgaattaacggacaaaggcaaaacggaaagcaatttgggtaaaatcgggcattttgaactgaaatattttccaataaattcagtgccgcccttttgcgttgacttttcttttccctcacaaattgcggagacactccgtcctcagcagagacaggcgaatcaaagtgattttttgatttttgcgcattttatgaggcgaatcgcaccttaaatcatttttcattttttggcactttcccctgccaaaatcagaagggaatgtgcgaaaattcacctctaaaaatg

SEQ ID NO: 117608 - DNA, 567 bp, Heterodera glycines
  Promoter: Source sequence=SeqID_34127; Location=651..1217; Strand=-; Gene=SeqID_64005
tttggtcgttgcaaatcaatgcaaatgatggtactttgttaaaagtttctttagctaaaatttataaaatgaaaattaaaatcatgacactaaaaaactcataaataggtaaattatatttgtcaaatagaaagatcggcaagaaagaaagaaaatcacggtatgttgccgataagagaaggaggaggtaatgctaaccagagaccgagatttcaaaatgccggacttgactgattttttcagaagcaaccggtttccgaacccggtctctcaaaatctgtaatccaaaaaaccggtcaatccaaatttttccaaaaatcgctggactggcttccggatccagtaaaaaccggtaccggtcctatccgtctctaatgctaacgaaaagaatttaaatttttatgccttggcattttttaaaaatcattaagccaaatagcggttaataatttatttgaaatacaatatgtattaggtgttctggtctctaaaaatctgacgttttgctgataatcaactttgtcattcatttgatttttgtaaaattccgttatttgattacaaatg

SEQ ID NO: 117609 - DNA, 654 bp, Heterodera glycines
  Promoter: Source sequence=SeqID_12147; Location=1372..2025; Strand=-; Gene=SeqID_75725
actagaggccgagatttccaaatctgccggaacggaccggactggtattttcaaaaagtaccggattctggatccggtatctcagaatccggtcaatccgacaatcccgtcaatccagattttcaaattgccggatccgtaaccggattccggattggtaaaaattaaaattttcacatgttagtttgggaaaaaacccgcaaaatatgaatatcatcaattatatgtatagattcggtgcaccagaaatgtcgcggtcgaaaagataaccgtaaaaaaaataaaatttcaatttctcaagaaaaaattttaaagtttttatttttgaaaacctatgttttaataaaaaaaaaataataatcttttttcgcggcgccctttttccagaaaaaaaaactttttgggaaaggggccggcggtgccagtaggcgccgccgggaaaaattttgaaaattttaggcaatttgttaacagattttcactaaaaatgaccaatttttcgcgattttgagccaattttttaagaaaaaataagttttggaggcccggcggtgccgatatgcgccgccgagggaagaaattcgaaattttgaccatttaaagttaaaaacattatgccaaagagatatttttcaaaggaaaacgaacaaaatg

SEQ ID NO: 117610 - DNA, 484 bp, Heterodera glycines
  Promoter: Source sequence=SeqID_6778; Location=3535..4018; Strand=+; Gene=SeqID_62872
aaataaataaaattttcacttttcatgtttttcattttttggaattgttgatatcttcaatgaattaaatcacaattgaacacagtaattgagggaattaccgtatttgctctttttatttgcccgggtatattatttttcaaccccctcagaaagggggagataattagatacgggggataaaggggagggggggattatttttcgacagatttatttagtggaaaatttttcaaatttatttttaatatgtctccagaaaatgtcatcgcgtcaaaaaaaaaaagcatttttattgcatttttgttaaaaaatttctgaattttacatgaaatattcgaaaaatgccaaaatatttacacaaaattgataaaaccccaaaatattgaaataggaatatgaatgaaccttatttgcgtttcagaaatttggaattttttaattttaaaaattttttcatttttttgagcccgggaaatttatg

SEQ ID NO: 117611 - DNA, 288 bp, Heterodera glycines
  Promoter: Source sequence=SeqID_825; Location=2263..2550; Strand=-; Gene=SeqID_62123
tagggagaggagggattgtaaatcaattaaattgagtaaagacagaaacgggtttattcctcggcatataaaaatattaacatttaattaattaaatttttatttagcattagaatgattatgttttttcactttgtcctcttcattgtctactcggcaaaaacgcattgtgtcaaacaggtttatacattttgtattaaaatatgcaaaaagggggtgtgataaagaaaattaaatatggatttgttttactgaccctgtctaaatcgggtttcccttttcaagatg

SEQ ID NO: 117612 - DNA, 228 bp, Heterodera glycines
  Promoter: Source sequence=SeqID_16455; Location=900..1127; Strand=-; Gene=SeqID_80856
tgaagcagcagcgttcaaagtgatgctgagcttcatttacacggaagatttgagttaattgaacggattcaatgcaatggcagtggttttcgccggtgaaattaatttaattgacaaaaaaaaaacaattaaattatttaattagccaaaaagtataacatccctggcctgttgaccggtctttgcaaattccaatctccaaattgcgcaaagttttcttggcttatg

SEQ ID NO: 117613 - DNA, 138 bp, Heterodera glycines
  misc_feature (69)..(69): n is a, c, g, or t
  misc_feature (128)..(128): n is a, c, g, or t
  Promoter: Source sequence=SeqID_39377; Location=1..138; Strand=+; Gene=SeqID_67956
ccttttcatgactataaaatcttttgtttccgctttgactctcattaaaaaaataagctttccacgaanttattattctgttcttttgtttgacatcattcggaactcgtccaaaattgtgctaatgncaaaaaaatg

SEQ ID NO: 117614 - DNA, 1003 bp, Heterodera glycines
  Promoter: Source sequence=SeqID_10129; Location=703..1705; Strand=+; Gene=SeqID_73221
ccaaaccaattttgggcggatgttgtgacctgctggggcaaaacctttgggctattttttggtgcggttaaaaaagtacagaaaacaggatgatacccttcactatttatctttatttatttatttatttttataatttcattaaaattctcttcaaattccatactatttcttccataatatttttgttgaaaaatagttataaaatttaaacgatttgattcaaaatttcagcgatcaaaatttcagcgattacattttttcggcgttttttggcctagggctcttttgttaacaaaatgaagtttttctttagtttgctaattcatttgatcgcttattttgggcggaggtggggggcgagaggaaaatgttgctattgcaatgtctccaagcagctgatcaccgattggaacggagaaggggcgccattgtaggtacaaaaaatgctcatttatttgatcgccgattttgggaggggggcgagtggcaatgttgctaaagcaatggtcccaagcagctgatcaccgatcggaacagagaagggcggaattgctaaaaaatcttccttaatttgtttccaaattcatttaatagatttttcggcgattttttggccgggggctctttgctagcaaataaaggttttttgtattttgctcatttatttgatcgctaattttgggaggggcggggggagcgaaaggcaatgctgctaaagcaatcgccccaagcagctgatcaccgatcggaacggagaaggtcaccatttgcacgtacaaaaaatggctaataaaatagagtggaatgcgatcattttgtcattttcaccccgggattgagccaattttcgccaattttattactatgtgacttccttatttaattcaatttaatttaattatttttaaattattttaattcattttaaattataattattttaatttaattcaactattttttactgtgaataatattttattatttcagttccaaaatg

SEQ ID NO: 117615 - DNA, 216 bp, Heterodera glycines
  Promoter: Source sequence=SeqID_22271; Location=950..1165; Strand=-; Gene=SeqID_45707
tgtactacagtaattatcgtggttcaaaaacccgtaccggtactgtactcatagggaacactggcaaatataccagtacaatatgcgtaaggtactgtgggaaacatatcgtttagtatgcatacggaactgtgggaaatgatcgtagaaaccaggttgtttgtactacagtaattaacaacggctgacatacagtacacaaaaaacacacagatg

SEQ ID NO: 117616 - DNA, 352 bp, Heterodera glycines
  Promoter: Source sequence=SeqID_28601; Location=550..901; Strand=-; Gene=SeqID_59195
aggcgaatttttttgcaattttttgacaaattaataatttttgatttaattattatttttagcacaaatatcacgccgattgcatcacacgatggtttgttgaaaaattgttttttttgataactaatttatttgaatattttaggatcgaaagtaaacaaatgctgcggtgccctttgtgtttgaccgacccaaaattaattattgtaataagaaatttaattgccatgccattaatgcttctcgtgtcttttccctacaaaaggtggccgattttgcgccaattttcttcgactcgtcccaaatttatcacaaaatgtacgtcaatccaaccgcgcaactgtttaaaatg

SEQ ID NO: 117617 - DNA, 473 bp, Heterodera glycines
  misc_feature (185)..(185): n is a, c, g, or t
  Promoter: Source sequence=SeqID_32437; Location=836..1308; Strand=-; Gene=SeqID_62743
ttttaatgattaataaattaggctttctatccatattctaaaaatattaagctgcttatttaggattcttaatatgcccaaaatctaaaatccagctctatacgtattggaaccaaaatttataaaaatatattcatcctcttttagaatatgcgcctgaaatttggaatcccgacatacaaaanaagatataaataaactaaaaagatgccaaaaatattttacaaaaattcctttatttaaatgcagacttccttacataccttacaaacaaagacttgatttattcaaacttcaaactttagaagaaaggagaaaaacaattgatttagttcaggcattcaaaatcattaatggtcttacacatcttaaaaggaaatatttcctcaattttctggtcgaatcccctacaatcttagacgtaaagttgtgttaaaatcacaatccactaaaattcttttatcaacagaatg

SEQ ID NO: 117618 - DNA, 731 bp, Heterodera glycines
  Promoter: Source sequence=SeqID_11389; Location=1..731; Strand=+; Gene=SeqID_74780
tatttgttgatcgcctcgatactatttcttttgacataaattgcacagatttcgactaaaaagtaaccaaaatttaggggttggggtcatttccctaccgccaattccctaccagccatttccctaccggccacttccctaccagccatttccctaccgccatttccctactaaggcatttgggccatttccctaccaaaaatttggcgctatattaaaagtgggtctttttgaaacaaaaggggggacccttttgttttgcaaaatttttttaagataaaaaaccatgataattttttatccggagttttaaaggtcgctaatcacgaatctgacatgtattttgactaatttctaatccctaacccgaactcgaatacaaatcggaattttgaatttttcaaattatgattttttgttcaaatttagattaggaaatcggaattgatcaaaataattgaaagattcgtgatcggggaccccaaaaacttttaatatagcgccaaaaatttttttgaaattttttggcaaaatttcaaaaatagaaagggtattttcaacattttgatgtttctcgtgaattataagacaataagttttttgtttaagttatagattagaaaatgcaggcaattctaacacaaaagaaccgtacaaagcttcaaaaaaaaaaaaaatcgaattttcgaaaattttagcgctatcaaaatgacccgacattcgcagaaatg

SEQ ID NO: 117619 - DNA, 157 bp, Heterodera glycines
  Promoter: Source sequence=SeqID_3648; Location=1300..1456; Strand=+; Gene=SeqID_51277
ggtaattaggcagcaaatgaatgggtgagccaggggcaatgaagctaacaataatatatttttaaactccttgcaatttaaaaggtatttgtgtttgacccaagtgctcgtcctccgcgacatttccatccaagtccgaaagcgttttccaaacatg

SEQ ID NO: 117620 - DNA, 218 bp, Heterodera glycines
  Promoter: Source sequence=SeqID_23694; Location=1980..2197; Strand=-; Gene=SeqID_54387
ttattattactttttacccgaaaatttttattatatgcatataattatttttctttaaaagaagtaaactaatgaaataatccttatttttaataaattcaatagaactcctaatttaattaaaacttgagaaaataattttaacgaaaaaaatctaataaatattattaatgtatatattttaacaaaaataaaatattaaattttgcaggaatatg

SEQ ID NO: 117621 - DNA, 159 bp, Heterodera glycines
  Promoter: Source sequence=SeqID_14092; Location=351..509; Strand=+; Gene=SeqID_78067
ggtaagaaaagcggtcaatggccatgaactgagacgcatggattaatgacgtgggtggggggactttaccggtgctctttattcgagtaaaatataatgttacttttttacacttcatagggaatcttccaactgtacgtgttgaagctgctgaagatg

SEQ ID NO: 117622 - DNA, 89 bp, Heterodera glycines
  Promoter: Source sequence=SeqID_9986; Location=1282..1370; Strand=-; Gene=SeqID_46833
ggtaggggcgaaggcaccggcactttttttaaacgtttcggatttcatggcatttttactttttcgcaactgattcagacggcgtcatg

SEQ ID NO: 117623 - DNA, 354 bp, Heterodera glycines
  misc_feature (52)..(52): n is a, c, g, or t
  misc_feature (54)..(54): n is a, c, g, or t
  misc_feature (69)..(69): n is a, c, g, or t
  misc_feature (76)..(76): n is a, c, g, or t
  Promoter: Source sequence=SeqID_43147; Location=742..1095; Strand=-; Gene=SeqID_70890
aacaaagatgctgttttgaacgaataaagggcataggcttctttgaagaagngncaaagaacatgcagnaataagnctgccttatctaataagtggaaaatacatgagtatagaatttatttaagaaagtgtccacagacttttggaaaaatatatttgcaatttatcaacaattttgagaagtgagttagaaatgataaacttcacgattcaaaccaattttcgttgctctaattaaccgcgataaaaacattcgaatcaattaaatagcttctgagataataatgtttatcataaaatttcatttaaaaataaaccctcaattattggtatgaacgatactttccaaacatg

SEQ ID NO: 117624 - DNA, 1003 bp, Heterodera glycines
  Promoter: Source sequence=SeqID_4359; Location=845..1847; Strand=+; Gene=SeqID_54169
agaccgatgtttttaggcattttttaatttgtggactatgatcaatgttttcccaattttcttcaaaatatttttagctttgttgtttttttaattttaattttaattttttgctatttttaagagattttctttaaatttaatgaatttaaaaaattgaaaaatttatatgcatatttttcaccttttaagtgcatattttactattttagtgcgtattttgcgattttatatgcatataatttttggaaaaggcgggatttgctggattaatcccgatggatccggacccgaaaattttttaaaattccaatccagcagagggatccacaaatttggtttttttctgcgaaatcccgccgaatccgcattgcattttttgaaaatctcaaagacggaatgccaaatattttccaaataattttatgcatgaaaaacaacattttgtccaggaaggctcccggacatttcgacaatgaccgtttcgccaatacctttcgacaatgccgtctcgacaataaaattaaatatatatttttaaataaaattcaaatttctctaaatgatatgagatagtgctggtatgggatcaatataaaatagttttttttcgtttttgttcaaaattgcattatgagaatggctttagttttcgaacctaaaaatcactaatttaatttttttttcgccacttacaaataagataattaggccattatttttaattatctaattatttttggatttttcgccactaaaaatacccaccctaatacataaaactgctattctttgcaaaatataataattatttgcaaatccaatatccctttgcgatcaatattattattttattattactattcataataatggaaaagatttttagatttcgagaaaattctagaaaatcaaatgaaataaaatttgttttatttaacatttattgaaaattcgtagcatttaattaatttattcttaaaaattattttctcgctgaatg

SEQ ID NO: 117625 - DNA, 1003 bp, Heterodera glycines
  Promoter: Source sequence=SeqID_16723; Location=128..1130; Strand=-; Gene=SeqID_81121
tcagcagagagccaccatcgttttgattttgatggcactatttgtcaacaaaattatggcaaaaaatcgaagaaaaaatttataattaccaaaacagcggccgtggaacaaacaccgaccgaagcaaaagcaccgccgaggaaaagcaaacgatggcgaaacataggcaaatagcgcagaaaggcggacattatttatataaatgtataatggaaatgggaggctaaaattgaaaaatcggtgcctctttacagtgttattattgatagctcctaattaggttcacatgtatgggggtaggccgagtcgggacagggtccaattcgagacttatggactcggtcttcaaattgtctgaaaattcacaaattccttagcataggacctctctctatttgcaaaattttaatagttttttgttcggttctggaagattttataaaaatcctcatacattcgtcaaaacttaaaatgctaaattattttcagaccctcccccatttaatgtgtatttataattagctggaattagaagtgcagaatctatctccataattacgaatgtttaaagacgaaaaatgaaaaaaagaactttatgtattattattatcccaaaagaaatgaggaaatcattttttaaacaattctacgagacaaatactggacctcctatcagttagacaaaatatgaacgtttgttgtccaattgagagcgctttcggaaatgataattgcttgaacaggtaataatgagaatgtcattttttaaacaattctacgagacaaatactggacctcctatcagttagacaaaatatgaacgtttgttgtccaattgagagcgctttcggaaataattgcttgaaccggtaataatgagaatgtcattttttaaacaattctacgagacaaatactggcctcctatcagttagacaaaatatgaacgtttgttgtccaattgagagcgctttcggaaataattgcttgaaccggtaataatg

SEQ ID NO: 117626 - DNA, 616 bp, Heterodera glycines
  misc_feature (270)..(270): n is a, c, g, or t
  Promoter: Source sequence=SeqID_10474; Location=1..616; Strand=+; Gene=SeqID_73681
aaaattaaaaaatgtagcgggggcaaagtcctcatcaggaaatcgaaaaagactttaatcacttaagagaccagcagcatcttactttgaccattgaaatgaatattagaagttggaagatttttgctcatataaaaaagggaaatgacggaataaaaaattatacgtgaaggaattattaaaaatgaaagttcaaagttcaaagacgggaggcataataaatgaatttgaaaatataatctgtgactgaaattatatgtaaatggcatntaatctatcactctgctggccaatgaagagttgaaatttgattttgagtgctgaaaaaggcacaaaatacttttgtaaggaacatttgttaattctccaatcaatgactaatttttttcgagtaataagaataatttttttttgttccctttagcccagaatttaagtaaacaaaaacttatatagactttaagcttccatacagttaatgctagagaaatttttgttttatgcgtgtctttttcctagtcttgggaaagtcctccgatttaaaaatttttccgtttttaaattttaaatttttttagaaaattaacaccttttaacaccctttttttaaacgatg

SEQ ID NO: 117627 - DNA, 501 bp, Heterodera glycines
  Promoter: Source sequence=SeqID_634; Location=3840..4340; Strand=+; Gene=SeqID_57829
tagtgggagaaatgtgaatgaatgaatgttaatgcacaaaaatgggggagacgaaggcgcttttatagcggagaaaaaagggatttagcaaaagcaatttttgaaaaataacggattaaaaagctttttgttcgaattcgggttcggggttcagaattggccgaaatacatgtcatatttttgattagcgagcctgaaaacctcggaaaacatgttttagtatgattttcataaacaaaaaaaaaatttgcgaaaaatgtgggaggggaaagaaaattttgtataaaaggacaatttttcacgaatgcgaatcatttgcccaataaatttgctattcaatcctttttattcctcgccattttctgcccaaattttcttcatcgccgccgctaacaacaacgtaattcaatgtcttcgtcaacaaataatgatggagcccaaaacaacgccaaccccaacaacacgcattcgcctgggcgttcatgcaactcgcacaccatg

SEQ ID NO: 117628 - DNA, 514 bp, Heterodera glycines
  misc_feature (32)..(32): n is a, c, g, or t
  Promoter: Source sequence=SeqID_21825; Location=1..514; Strand=+; Gene=SeqID_52454
catgtcaaagaaagaaagtaattctttaaagnaaacaaaaacactttttaaaaattatttaagtgatgtggagatggtactgtatttattagagctcgacaatttgaaaaaacctggacttgagctggattcaatgttggacctgattttcatgcacaaaaatgcaggtccaggaaaaatccaggcttggacctggattttttttaatcttaaagcaaaccacatgtttgaaaaaaataaattaattgcttaataggaacatctaaaagtatctaatagacaataaaatgcgtttacccagcaaaagccaggcctggaccaagtccatgtcgagttttagtttttatgtaatttacaatttctgctcaaatcactttaaaagcacttttattgtatgagcataatttcgttttgcttttataaattttgggttttttgggtacggtgccaaaagtgatcagaaaaaaaaccgataaggggtcaatttttcatttatacaaaaatatttaaaatg

SEQ ID NO: 117629 - DNA, 727 bp, Heterodera glycines
  Promoter: Source sequence=SeqID_5462; Location=1977..2703; Strand=-; Gene=SeqID_58138
ccggcaaactgactgctcaatgaacaagggcatgcgggtcgcttgtggggccgggtaatttaaatttttagggatttttcattttggtaattgaatttgcttcattaagattataggaaatttcgctctgggctaaataatcgtcgaaacggtcatcttaaacaatgctttgatcataaaattcattatttgaaattaacaccggaaatcctcgaaatatatttgatttgcaattttgagaaatgattttcgttttttaaagactaggttggaataaaagattttgactttaaaactttttttaaaaatgtacgtttaaaaaattttaaatgcctattttcatgccttttcgattgccttttttgcaatttttggtgcctattatagtgccttttcctcgattattggtgtctttttagtcggtctaaaaataatttataaataaataatattttttagtttaatcaaaattttttatcatgataattttactcaaatcgcatcaaaatttatccttttttgtgcctgccacttggcccccacgccccccctccccgccgcgcattttacgaagggcgttttgcgccacccccacccccgccctcctcccgtgtgtaccagaattatcaaaaacattctgacgtttaccagaattttcagaacaattcagatgtttaccagaatttacagaaccattctgacgtttaccagaattttcagaacaatg

SEQ ID NO: 117630 - DNA, 419 bp, Heterodera glycines
  Promoter: Source sequence=SeqID_22432; Location=1..419; Strand=+; Gene=SeqID_53102
gcattttttgaacaggtttaattttaaaaaaaaattttttttcgatttttggtttcaataaatcactcctccagtttcccaacagtcgcccatttcccaagaccacatttccaaaaaaaaattcacaattccgctactcttatttttaaacaatttttttttgacaattcaccgcctaattcaaaaaaattcccttccggcttccatcgacaatgcccaaaattcgcaaaaatttttaagtctattttcgggggtttggaattggtcaaatgaattgttagtacggcatgtacactccatgtccagttggccaaccgtgtgcctaaaatgcgttccggcgtgcctcaaaaaaaaatttacataaaaattctgtcgggcgtttcttccgactttttcccaattttcttattaaacagatg

SEQ ID NO: 117631 - DNA, 680 bp, Heterodera glycines
  Promoter: Source sequence=SeqID_9818; Location=1..680; Strand=+; Gene= SeqID_72818
tttttcataatgttccttttttcacttatttttattctcaatcgagccaattttttttaatactttattttcattcaaatttagaattttgccggccattgtttattttacattgacgaaaatgccgacactttgatcgaatcggagggatttttgcaaattgaccaaaaaatgttgtgcgaaattttggaacgcgacgaattgcaaatccgtgaagaaatttcaatgtggaatgcagtaaatttttttaaatttaaaaatgttacaaatttatttttaaaataagtctgaatctttttttaatcactaaattgttttgaataaaaaaaaataaaattttctcttcaatttccttactattttctcttctctgactcgtcgctgctaccatttttagcggcgggcagagaagagaaaaatagtaaggaaatttgagagaaaaacttctctcaatttaacttgatatttccaaattgggtttaaaagcggaaattatcgcatcgattttttccataatgttccttttttcacttatttttattctcaatcgagccaattttttttaatactttattttcattcaaatttagaattttgccggccattgtttattttacattgacgaaaatgccgacactttgatcgaatcggagggatttttgcaaattgaccaaaaaatg

SEQ ID NO: 117632 - DNA, 181 bp, Heterodera glycines
  Promoter: Source sequence=SeqID_11899; Location=1242..1422; Strand=+; Gene=SeqID_75412
ggcattgttcgaacatgaaaaatactgtacaaaaagtcggattgccagttttgttaataaaagtgcagttgaatcctcgcatgtatctgcttatacctaatctattttatattttatttgaaattactcattttcatttagagtaagtatttgtttcctcctcctcccactttttgccatg

SEQ ID NO: 117633 - DNA, 104 bp, Heterodera glycines
  Promoter: Source sequence=SeqID_36548; Location=1248..1351; Strand=-; Gene=SeqID_65835
tgtcgcgctggccagatcagatgagatggctttttgtgagcatcctggtctatggccagccgagtaatgccatagaattgtggaacaagtacaaagaccaaatg

SEQ ID NO: 117634 - DNA, 444 bp, Heterodera glycines
  Promoter: Source sequence=SeqID_40516; Location=1..444; Strand=+; Gene=SeqID_68821
aaaattttcaaaaaaccattctttgggtattttctcgattattaataggtaaaaagataactttctgaaaaaattcaaaatgtatgccaaaaatgagtcttttttggggcaaaaattgaatatttatgcaatttgtgcccaagttgcagtacgattttattcagtatgctaaaggaatgcactaaatttcaagaaaataattttaaatcattccaactatagtttgacaaaatgttgaaaaaggtaatcaatcgccaaaagaaattaatcattaaatttcaaattcattatgatcgataagattggaattcgaattttagagagaatgatcaaaagttattttttgaataagagagttttgattaatgatttttggaaatttttctttttaactcaaaaaaattttaaaaaaagtcatttaagtaaataggccaatcaaaaatg

SEQ ID NO: 117635 - DNA, 1003 bp, Heterodera glycines
  Promoter: Source sequence=SeqID_12362; Location=53..1055; Strand=+; Gene=SeqID_75965
tgctatgaagaaaggggctcaaaaatagcatttctgcattaaaattttttgatttgataaaggcttttagtgcatataaaagcatattttggtgggtttttgagaataagtgcatatttggccatttttgcgtttttagagcatatttcggttattgtttggaaattttcataagaaaaatgcgaaaaagcgaaaaatacactcctaaggatcgactttttggaattttttaaaaaacacccttaaaatcgaaaaaaaaaattaaatttttgtcagaacttttggaaaaaaatttatgtatataaaaatgtaatttgttttagcatataataaaaatttataaatttggaaattcaatatttttgcaattgtctaaaaaatgctccttagccattcgtgtgcgaggaatggcatgaaaaatgcttatgaacaaattccatgtgttttttattagaaataattttcggatgatataataacttactaacatgaattaaaaaagactaactaatagaagctatttttatatatgtaatagttaattaacagtcatttttaatttctttttaaagtttcattttttagtaagttaggaattgtcatttcttacattattaattaaaatgtatttcataaatatcttatattttatggtaatgatctcaaaattgtattcaataatgaagttttttcatcttacaatgtgtacaattattatcaaactcttttcaccgtcgagaatataagaattattaaaattaagaaatatattgaattataaatttttaattttgtttaatattttaaaactgagcaaaaattactgcacaatttttgttcgcatcatattagggctttataagaaaaataaatatttataaaggcacaaagtttcaaaaatcatctaattttgcataaggttggaatttaaagtttgtggaaaaaaatgtattatttttgtatactaattttgaaaaagagaacacgacaaaattttcagatg

SEQ ID NO: 117636 - DNA, 561 bp, Heterodera glycines
  Promoter: Source sequence=SeqID_1411; Location=1726..2286; Strand=+; Gene=SeqID_73355
tttccttgctttgtgcgcttgtgatttctttgtccgcacaaaattgctcaaacgcggtaggccctttcacaaaggcaaggaatgcgttgtcgtcagtctaattagagataatttaatttttaattagtgtgtgcgccgtccccatcactcaaaaaattgacttttttctgatcattttaactagggttaacccaacatgtttcggggaattacgaaattcgtaaattgcacttgaaataagatggaagtatctttaaatgagtttttaagacttttttgttctggactttttctttttgtgtttttttagactttttatgaaaatttcctccccgacgaaggtgttgctccccgacatttttttaatttcttcagccatccccgacaaattttttcggggaatttccttcccgttccccgacattttgctccccgagggtcggggcttaaccctaattttaaccacaaatttttaatggaaagtctcgaaactaaattgtattttcaatgtaaaattccttctaataattaaataattgaaaaagtgtatagtccacgatg

SEQ ID NO: 117637 - DNA, 459 bp, Heterodera glycines
  Promoter: Source sequence=SeqID_4776; Location=1..459; Strand=+; Gene= SeqID_55677
ttttttaaatttcagcttcgggcagaaattacgggtctgttttttgttgcagttgtccttgtgtcatgtttcagattgcttttgcactgtctttccacttcccgttctcttccttttcatccgttttcctctcgagtttgcctttccatttcttttttcccaataaatctgtttcacagcttcacattgacgttgtttacgagcttctcaagtggtgttcgtcctctaacttttgtgtcaaaaatactgccgaatccgcactttctcttttcgctgaagttcaattttcaaaaactcggaatttgagttcatcgctttgttgtaaattttagttaaatggtcatccgaacgtttgtctgttactccaatgccatgccgaacaaattgtcttcaaactttccatggattctcgcgacttttccggttaatgtctcaagtttattcacaatttcataaatg

SEQ ID NO: 117638 - DNA, 209 bp, Heterodera glycines
  Promoter: Source sequence=SeqID_27015; Location=535..743; Strand=-; Gene=SeqID_57740
ttgcgcgacccgcgtcggtgacatttttgcattgatgaattggggatgagtgagttgggcattgatgaattgggcattgatgaattggggatgagtgagttgggtatggatggattggctttagtcccccctcccactaaacatttcctctaattgtactctgctctcttgttgaatgaataaatttttagattttaaattttttaatg

SEQ ID NO: 117639 - DNA, 695 bp, Heterodera glycines
  Promoter: Source sequence=SeqID_21675; Location=1302..1996; Strand=+; Gene=SeqID_52285
aatttttttaaacatgcattttttaaggattaaatgttcgtaaaaatttttaaattgcgcaaaaaatcccatcggagaagctaaatagtagcaaaaggcagaataatgttgagattttgatagttctactgatgaatccaatcaacattataaaatatttgcatcatatttaataaaataataacaaattaaattaaataaaaaataaatttggtaattctactgatggaataatttcatcattatttaataaaataataacaaatgaaattaaataaaaaataaatttggtaattctaatgatgatcaatcaacattgtaaaataattgcatcatttagaataaaataataacaaattaaattaaataaaaaagaaatttgataattctactgatggaataatttcatcatttaataaaataaccaatattaaacataagaactgatgttgaattccttttttatttttttttatttttttcaatcagtttttaattccatttcaaaatgcaattctatttgggagttaattaattaattaagacataatgatgtttaattcctttattccttttttatcattattttccatcagtttataattccattttcaaatgcaattccatttgtgagttaataatcgagaaattaattttactaatccgttttaattaattagaatgaggacctaatg

SEQ ID NO: 117640 - DNA, 969 bp, Heterodera glycines
  Promoter: Source sequence=SeqID_5790; Location=478..1446; Strand=+; Gene=SeqID_59237
gcttgcgcggctactttaagcagtttaataatggattctgccccacctaaagtgttcattcggccgcttcgcggcctcattttttattattcttaattaattaattttaactaatatttattctaattaaaacattaaaatattatgctgttttaaaattcatttaattaaatataaataaataataacaacatatgcaaaaataatctaaatagataaaagttacttaaaaatgcatgcacttttaaatttttctttatttattttatagaaaaattattttcattttttaaaaattgaattataaaaaataacaaaaataattttgacttaataattagcattaaaatatagcaaaaaataaatcaaaaaatgatttacaccgtccgggttcgaacctgaccaacgcaaaatgatgcctcagaatccccaatcacgcagggattctgaagtcttaacgatctctaaagtgaaatctgattacatattcgtgatcagcggcccaaataacccctaaaatcattttttggaagatttttggtgaaaaaaattttccacacaaaaatcatggtcacacccctttgatcccgaatccaaaaatcacttttatttctataacttttttcaaaaaagtgataaaaagctaaaataaaatttataaaatagagcaaaaaattgtggattttttgagtttattatttttataaaatactttttcagaaccgagttctgaattttattatgaaaaatcgaaaatttccagaatttctggaataacttttattgtttgcaagatcgaaatcccaaataaatctcaaaaaattctccctatttttctctattttttaaactttaaatggactgaattggacctttttgatgggagttatgaattttcaaaatgtagcttaaattttcaagggccaaaaaattttaaaatttcaaaaatttttaaaaaattccaaaatg

SEQ ID NO: 117641 - DNA, 171 bp, Heterodera glycines
  Promoter: Source sequence=SeqID_17470; Location=1314..1484; Strand=-; Gene=SeqID_81958
ttttttcattttataattgtaaacatataattttatccattactccctccggaaatgtttttattgcattccttcgcattaaaaattataaaagaggataatttaaaaacatataatgtattattgtaaattaaaaaattccaggcttattcataacattgagagacaatg

SEQ ID NO: 117642 - DNA, 67 bp, Heterodera glycines
  Promoter: Source sequence=SeqID_38588; Location=48..114; Strand=+; Gene=SeqID_67358
tggtgaagaaaattctctggaaaaaaattaatttaataaaattttcaggttcatttttacgacaatg

SEQ ID NO: 117643 - DNA, 309 bp, Heterodera glycines
  Promoter: Source sequence=SeqID_2510; Location=490..798; Strand=-; Gene=SeqID_80145
ttgtgaaatgattatcaaatgttgttgtttttcgtacttattttaaattttattttattatattttccatttttcccttcattttatacactttcatttgacatagttttcataatacttcctcatattcatgctggttaattttctaatattttcatctgtttgcttatttccttggcacttccgccggaaaaaaaatacgtgggcccaatgtaatggcaaaaaattaaatattcaaatggaaatatgccaaaaaaaattattatggcggaagccactataaaaaatcattattaatttacagggatg

SEQ ID NO: 117644 - DNA, 75 bp, Heterodera glycines; identical to SEQ ID NO: 114819
  Promoter: Source sequence=SeqID_36720; Location=119..193; Strand=-; Gene=SeqID_65970

SEQ ID NO: 117645 - DNA, 982 bp, Heterodera glycines
  Promoter: Source sequence=SeqID_4698; Location=1..982; Strand=+; Gene= SeqID_55437
cctcccattccattccaaccgacaaaaaagtggatggatagcagcgaggtgcgttttgttgcacaatgatggacggaattgtgccctgctaggcggatgggtggggtcggtgaagcaaagcaaaggaaagggacccatccccgtgaaaagacccccccccccctaactctgcacaactcatcattctcttaagcaacaacaacgcgtctgttgtaactcctttctttcatcctcttgtcagcgtcaaaagtgtttctacttatcagcgagcactttggttttgcgccattgactcaaaaaccagtcagtccttaggggaaataagccgatttttgtatccactcaaggccaatccttaaagagacgactttttgtacaaacaacagaaaagtgtttactcatacatataaataagtgaaagatgaggagagaagttggaattaataaagtgaccagcacaaattattacgattaaagaagaaaagcattaaatgaaaagacaattaatttaacacgccgtactttaatttgctgccaatgttcggaattgaactcaatgattgttggcaaagacaaataaatgtttgagggctttttacataggatgtaagttaagttcgcgcacaatttgttattggtataaaaattcagtaaaacgtaatcataaaaaaattaaacaatttcattaatttatttggatgaaatttaatttttaatcattttaaattttttatttatttaagaaatgtaacaacactccaataatttatcccccccccccttctcctcgccacttttcgtcgtttggtgtccgttccaatcgaatggtataatttatgtgttcgtttgtcgttcgttgtcccatcctttccatccaattcttctttcttcacttttttcttttgtcagtgtctttttataatcggtgtttttttgtcgtttcttctaaaatggaaaagtaatttcagtttcttttgtgatg

SEQ ID NO: 117646 - DNA, 89 bp, Heterodera glycines
  Promoter: Source sequence=SeqID_8756; Location=2364..2452; Strand=-; Gene=SeqID_69125
ttgtgagcgattaattatcattttgaatttatcggattcacattaaggctttctctattctgatcactcacaatttgaaacttttcatg

SEQ ID NO: 117647 - DNA, 204 bp, Heterodera glycines
  Promoter: Source sequence=SeqID_25851; Location=391..594; Strand=-; Gene=SeqID_56622
ttgtggggctgaatcaacaaaatgagccgttcatttcccacatggacgtggtcggtagcgtaagtgagcccgaagactacacggtcggtggcactggtggcgacttgtcgatgtctctgtgtgaaggtatttattgcatatctggttcataatacagcaaaacgaatatttctatttttgttagctctctggcgacccgatatg

SEQ ID NO: 117648 - DNA, 508 bp, Heterodera glycines
  Promoter: Source sequence=SeqID_15113; Location=1624..2131; Strand=-; Gene=SeqID_47271
atgccttagcttaggtctgagctgaagtctttcttcattctctgcctcggttcaatcccccaaaatctttattcattttcgaaaaaatgattacaatatgcttacgaaaatttgaccgcttttggcatggtttttcaatagtgaagaacaaaattatgattatttaaaaatttttacacatatctgaaaattggggataaatattggcggatttaccgacaaacaaatgagtcaattttgaataaattcgaacaaaacattctttagacttacataggatatattggcgaaaatgaagaaggcatcgaaaaacaatgcgttttaatcagaatttatgggagcgaaatcgaatatttcgataaagaaggcagactacattatgaaaaaagcataataatctcaaaaaagttgaaggaaattgacgcggcaaatgaacactttgtcaaattaattgactagtaaattaaaaaaaaacaaaaacaaatttaatttaaataaattaaaaatg

SEQ ID NO: 117649 - DNA, 731 bp, Heterodera glycines
  Promoter: Source sequence=SeqID_1824; Location=1..731; Strand=+; Gene= SeqID_76192
atcggaagaaaaagggaacgcacataagaggaccaccaaatagaaattgaccaaaatggaaaaacataactcgtactgtctttcgacaaaaaaatgccatagttttgccctaatggacttatttaaatattcttggtataactcgatagccctaaagattctctgtatacaggcaaaatttcaaaaaatttgatgaagattgaaaaaaagtcatgtacgaatttttttttacgatttttggtcataacttttttgaaaagcaataaaatggcggtgccgataggcgccgccgggaaaaatttttgaaaactgatggatccgttaatagattttgtccaaaaaattataggtttttgcaatttttagagaattttttttaataaaatttacgaatttttgggccctgcgatgccgataggcagcgccaggcgaattttaaaattaaaaaaaataaattaaaaaagaaaccgtcaacctgaatcgaactcacgacagtaagtaatgtcaaggttgattcactaaccactacaccacactacacatcaatgaccaataataaaattaactttaattcataaaaaattttttttaaaaagattcgatcgcttgctggcggcggctagcaggggaagggtactgtagcttgggatgggtttttgtaacaataatatactgtagctagttggcatacagtaagcggtgggccttttggaaaaagttgctactggatg

SEQ ID NO: 117650 - DNA, 173 bp, Heterodera glycines
  misc_feature (96)..(96): n is a, c, g, or t
  Promoter: Source sequence=SeqID_40659; Location=1..173; Strand=+; Gene=SeqID_68918
aagtgtccagaaaattaattttctgggagcccgccataaatggtgattttggttgcaaattattttaatgtttaaaattttgcgattaattttttntaatttgtcaattaatttaaataaagaaattgcaaaaaaaaacaattatagaatttatcaaatatttattcaaaatg

SEQ ID NO: 117651 - DNA, 110 bp, Heterodera glycines
  misc_feature (105)..(105): n is a, c, g, or t
  Promoter: Source sequence=SeqID_10078; Location=2430..2539; Strand=-; Gene=SeqID_73147
aaaaattcgaaacaaaatactcctgagatttgtaatttcacgtccaccatggctttaagtcccaccgcgagggggcgggcagtccaaaaattttgtaccacattntaatg

SEQ ID NO: 117652 - DNA, 363 bp, Heterodera glycines
  Promoter: Source sequence=SeqID_18812; Location=1075..1437; Strand=-; Gene=SeqID_83493
actttcacatgatttagcaagcgaacattaaaatttttacctacgattctcatagcagccgataggcaccgccatggaaattttgtagttgtaatgctatttgttaacagtttttgtctaaaaaatgataaatttgcgattttgagacaatttttaaagaaagtttaggattttggggtccggcgatgccgccgggagaaaattgagaattttcttcaaaaattgctattttgagtaactcaacaaagggaaatcatactaaatcccattcttttattcgggttcgaagtgattattcttttgttttcgtttagtgttcacggcgacgcttttccgcttggaaatgcgctgctacgagaaatg

SEQ ID NO: 117653 - DNA, 200 bp, Heterodera glycines
  misc_feature (32)..(32): n is a, c, g, or t
  Promoter: Source sequence=SeqID_20560; Location=1921..2120; Strand=-; Gene=SeqID_51112
cgttgttctgttggtgaattggattaattaantgagctaatcaattaattaattaatgggtagtttcgccaaataaacacaaaaatgggcaaatatttaaaaaaacaaatgaattaattgatttgtaatacatttctattttaaaattattctcttccaagaaaaatatttcaacttttctcaagaggccttatcaaatg

SEQ ID NO: 117654 - DNA, 1003 bp, Heterodera glycines
  Promoter: Source sequence=SeqID_359; Location=2136..3138; Strand=-; Gene=SeqID_84290
gcaaaaaattacgccaattatattatttggcgaaatgatttgtttgtctaacactgctgggacactatgggtcaactccactgtgcagagaaaagcctagtactatctcgtcgtttctctttttctttgtaatttctctctctttggcgtactatctcttcattttaattatgtaaaaagcaacattcacttcatcctgtttaacttttttcctacttgttaaatccacaccaaattttgcatagcgatagagaaaaaaattctgcatcggttaataggtcaagttaatattaaaataggtcaaattgaaaagttatggaataataaaagttttgcattttttttctctctttttggcgtactattttcatgtctctaacacattaaaaatcatgaaattcgcaaattatattaatttttgttgatacggtacaaaatctgttggacatttagaatcaatagaaaaatgattactttccgcattttggttgaaatcagcagtttaagacttgagttataacgtaattaagatttgaaactcccacaacttttttctaaaaaatcaaattgcttagttttcgcttagaaaaagattctcctcttcaaaaactttttttaggtaccaaatttgttcagtttagttgggaatgaagtgagttacgtctgattaaaataaacaatacaaaaaaggcatttaccagtgtaaattttgaattaacgcgcaaaaatttacgccaaatacgctatttggcgttatgagtaattttgtctaacactgggcttgacccatagtgctgggacccattgtgtggccgttgccgcagagagttgaccgcgataatgtgacctcccaatttttatactacgaaaattcagattttaaatatgcataaattcgttctcatttctattgcgcaattattgcatttcttttgtttggtttaattttttttaaattatagaagtaaattgaaacccaaaattttcatcaaatcagcaaatg

SEQ ID NO: 117655 - DNA, 135 bp, Heterodera glycines
  Promoter: Source sequence=SeqID_27158; Location=1..135; Strand=+; Gene=SeqID_57859
agtctctaatgagttgagcagctccgccgtacgtttctttctttgctcttccacagcctctgatcgatcattgttttactgcgcgagcgcgagtcgttcacgtggatgcagcgtgagacgaactgcgcgaacatg

SEQ ID NO: 117656 - DNA, 340 bp, Heterodera glycines
  Promoter: Source sequence=SeqID_13724; Location=557..896; Strand=-; Gene=SeqID_77643
atttaaatgagaaataattttaaaaaggaatttctaggttgtccaaatttgctccaaattggaagtatttttctgcaaatttcgtcaaaagcgggcaatgaaatttgtgatgaaaaaaattgtaagccaatgaaattaaaaaatatattaaatatttaattaggtaatttaaatatattttttatttaagatgagaaaaaatattatcgaaaagatttactgcaatttttgaaaatggaaaacataaaaaaattatttgaaatgaatggaataacatttaatgaaaatgaatttgtgatgaataaaactgaaggaaaagagaagagtatgggacgaaatg

SEQ ID NO: 117657 - DNA, 323 bp, Heterodera glycines
  Promoter: Source sequence=SeqID_3129; Location=1505..1827; Strand=-; Gene=SeqID_83324
ttcccccccctcttccggataagttattttgccctcggcaggtgtcggcaactttccatcgtgccaagggtattttgtccgctgtcggccctcggcggcgggcgtttgtgcctcgggcacactctgtcacagtcgggcaagcgacgcccactgctgccgacggcacgcggacgcgcagtgtccgagcgcggacgaactcggctacaactgtcggcaggcaaacccagtgaattggtgtgccgaaatctttttttttggaaatgccaatgcatttgtttgtccccctttttggtgtaatgtgaataccgactgtgccgcaaatg

SEQ ID NO: 117658 - DNA, 631 bp, Heterodera glycines
  Promoter: Source sequence=SeqID_19053; Location=830..1460; Strand=+; Gene=SeqID_83792
aaataaaagaaaatttgaattttatttgtttaattaattaaaaaagcaatttacaaaatttgttggatatgaagccaattatggtcaattaattattttttttgaattatgtgcccaaaaaaaaaaaatcattttgagtaaattgctacactttccttttaatttattttttccataaaataaattattttataaattattattttttgcaataattatttcttaaaaaatccgagtaaaaaaattgttttccatattatgtatgaattacgtcgtgaatcacatattaatttttaaaatattgttgaaaagaaaaataattgcgtaataacatttaatgcgaataaaacattaaataaattcatttaatgcaataaattcaatttccaaaagtaaaaatgaatttgtggcatttattatttattatatttttctttatttttgtaattaaatccggcaaaatccaaccaaattttgaagaaatatttggccaaagatgggacaaaaatgaaagtgaagaaattgtgataataaaaattgaacaaaatgaacgaaggaattggtcgtcataaaatatacaaatggaaaaaagaattaaatataattaaaaagatgggaaagagtttttatg

SEQ ID NO: 117659 - DNA, 353 bp, Heterodera glycines
  Promoter: Source sequence=SeqID_2860; Location=8429..8781; Strand=+; Gene=SeqID_82008
tttgaaatgacgtcagactggctttaagcaactaatttttgtgttattactcaacgctattccttctatttatttatgacctaaccaaactaattatatattttttggtggcaaaaaaaatcaggaaaaaagtggaaatattttgaaaaatatcggaattatgaagcatttattttcaaataaatattcaagtttttaagtaatattttttgaattttccaaatctgataaaattcagtagaaaagtgaaaaatattaccgagcataaatttccaaaaaataataaaaagcgcacaaaaaatgaaagttgttttaccaattttttcaaaaaatgccaaatctgacgaaaaatg

SEQ ID NO: 117660 - DNA, 237 bp, Heterodera glycines
  Promoter: Source sequence=SeqID_16390; Location=1345..1581; Strand=-; Gene=SeqID_80782
aacccgactaatcagcagacaatgccgatcaattcttagaggggtttgatcagccaaatcatttttctgatcatcttagtagaacaaatgtattatagagtgatctaacccaaccggtgtactgatctttgccgttctgatgctgatcaggcgaattaatgatcccaaaacgggcttccgacttgacttaatgtagaacttggtaaatattgatcataggccccaaactcaaaaatg

SEQ ID NO: 117661 - DNA, 853 bp, Heterodera glycines
  Promoter: Source sequence=SeqID_34715; Location=995..1847; Strand=-; Gene=SeqID_64438
ttgagtggtttatgtatgatttgaagcctaaaaattctataattgagccatgcaaattcagtggacccgattgtatgcgcatgcctgattactgtgtgagttggtgaggacttggcttggctggcgctagaggggcggaggaacatcttttttttgtttttgtgaattaattcgtggatatgtgatctgtttgcttggatggaaaagaaaacggacagacgacgacggcgacactttctttcccactctttttcctccccctttttttgtgacaaaatcaaaagcaaagccattttttttgtatttttgtggaataaatacaggtgagagaaaaaggagagtcaaacggtaaacaaatatgcacacagattcattttaatatcttggatacttccgcttttttccatatcgcaaagctaccaatttttggaccaccaaagtcggcacgagcctaaaaacaaattggtatggtgccgagtaaaaagccgcgccgagaaatttaaagaaagtttttttctaacgtttttaaattttatgatgaattatttttcaaaaaatcggcgaaaaaagcttccatgctattttgtgaaaattattaaacaaaaaatttcggttttcagtctaatcacgcttcaatttttagctttttttttgtcttttaccatgaaattgtgtcgcaatttgcggtccaaatacattttgcccatgtttccatatccgtccgggcggctgcacttgggccatctgcgcgtgtacacactgtccgacgtgatcagtcgttaccacaggttgaaaggacaccaagtgatccatcccattggatgggacgcgttcggactgccggccgaaaatg

SEQ ID NO: 117662 - DNA, 499 bp, Heterodera glycines
  Promoter: Source sequence=SeqID_9179; Location=845..1343; Strand=-; Gene=SeqID_70503
taattttttgttatttttcatatgcatccttttaaaattatacatagacatgtgaatttgtattttattaatgtgaatttcacattgacaaatttccgattggagccaaacggcgataaaaacgcataaaatgatgtaattaaaaaatatattttatcaaaacattaagggaaactatcactctttctatgaaaatttatgtctttgtgcaggatgacaattagcagtttcaacaatttttatggtgctgatccgaacctaaaaaagttattcaatctaaacaattaaaactttttgtgtcctctactattttatatgtttttgcaaaaattttcaaagttgtaaccgaaattgtaaaatttagactgaatatttgtccctaactttttttaactcaataaaaaattttagactttaaccaattatcgagaaaattttgagctatcaatacatataaaagaaaattaaaattgtttgtttcagtaaaaaattacgcatg

SEQ ID NO: 117663 - DNA, 240 bp, Heterodera glycines
  Promoter: Source sequence=SeqID_20779; Location=1609..1848; Strand=-; Gene=SeqID_51344
agattttgcaaaaatgagccggttcgcaattaagcgcagtagatttacatttaataaaattacaaacttaatgattgaaactttttgaggagggatattggaatcgggagggaaagggaaagaatgtaaaggaaaatacattcctatgcgtgccgttcaatagtgttttctgccggtggctagcaacgaagataaatgccatgcgattcccccacatgccaacgttggaagtgccgaatg

SEQ ID NO: 117664 - DNA, 469 bp, Heterodera glycines
  Promoter: Source sequence=SeqID_12793; Location=1..469; Strand=+; Gene=SeqID_76525
tgaaaaaaaattggcggtgatttctaaaaaaaggaggataacaaaaggagggaggaggtgggatttctggataaagagagatgaaaatgagagagagagagaggagcgagaaaggaagagagggacaggaaagtgagaaagggggagagagacaagaaagtgagagggagaggggaaagagagagaggaggaaaaggagagaaagggtgatgaagttggagagaggagagagagagagagaaagagaaaccagcctgccttggtggttgtggtaattgatgtgattaatgatggaacgaacgacggatgcgacacgggacggagaaagagaagagctgcaacagcagcagcctatttggtggaacattctatcggcaacttattgcgtcgccttataaatcattcagcaaaagaattcttagccgaaatcaattaaatttcaaaaatcgaatttcagaaaattaaaatg

SEQ ID NO: 117665 - DNA, 192 bp, Heterodera glycines
  Promoter: Source sequence=SeqID_2753; Location=1774..1965; Strand=-; Gene=SeqID_81423
acaattgcatactacctaataggacacatagaatatgtaaaaagagccaaaatacgatattcattcaacccatcccaaaaatccttaacaaaacatagtcatattttctaatttatataattagagagtgggaaatttcagggttttcccattctttggcatcacgccaatgaacctgaagagagggaaatg

SEQ ID NO: 117666 - DNA, 162 bp, Heterodera glycines
  Promoter: Source sequence=SeqID_28125; Location=1..162; Strand=+; Gene=SeqID_58779
ttttggaattaaatggggaaaaatatacgaaaattattttggttttaaataacgctgtccaatgcttttaaaccccccggtgaggcgggacagttcaaaaatttggtaccccattttactgtggaaagtccaagtcccttatgggacaactacgtgtcaatg

SEQ ID NO: 117667 - DNA, 62 bp, Heterodera glycines
  Promoter: Source sequence=SeqID_135; Location=1594..1655; Strand=-; Gene=SeqID_46909
aaatcattattttatgaccccctcatttaaggacggcaccgccgtctgtaagtggagaaatg

SEQ ID NO: 117668 - DNA, 440 bp, Heterodera glycines
  misc_feature (74)..(74): n is a, c, g, or t
  Promoter: Source sequence=SeqID_3525; Location=1597..2036; Strand=-; Gene=SeqID_85041
gggctgtgtgcggtgcggcggtgcgctgcccgcccattggccgcgccgcttctgtccgcagggaccgcccattntggcacggccgaccaccgcatttaagcgctgatcggccagcgaaaaatcattcatttccaaaaaaatttccagctaatattaaatagaattcaattaaaattggggaagggaacagaaaaagccaaaaagaaaaagcattttttaaatgggacagcgattagaaaaattgaatgatttttttggaattatttgaattttcgcactgaaatttgagtttgattgataataagaaacctttcgatttaatatatttttgtgtatttaattttgctataaatttaagaatttaattaatttattttccttatttctaatcccgaagaacaaaactcttcaaagcaatcacctttccataattcaacatg

SEQ ID NO: 117669 - DNA, 303 bp, Heterodera glycines
  Promoter: Source sequence=SeqID_41142; Location=611..913; Strand=+; Gene=SeqID_69337
gtttcttttcctccgcttactgatatgcttaagttcagcgggtgttcacgtctgagttcaggtcgaaaaatcaaagcaggaatgccagtaatccaggcactccgccacagcatgcaaagcattggtgcgcccgagttacggtccgtaaaacgcgaattagaaccacaagttcgcgccagcacaccaaaaccccacagccgagctgagcaagtaacgtaagaacacgtacaagtacatgatcccacgaagcaacgcacaagcagtgcattttatggtaacgaccctgaaccaggcgtgccaatg

SEQ ID NO: 117670 - DNA, 372 bp, Heterodera glycines
  misc_feature (103)..(103): n is a, c, g, or t
  Promoter: Source sequence=SeqID_17834; Location=855..1226; Strand=-; Gene=SeqID_82366
ttttaattatttaattttgtagtattatttgttcattactacatacatataatactttttgatgaataaaattgtctataaagtaaaatgaaattgttttttntatcgatgagtaaataacgcggatgaattaattaagaactatttattaatttaattaatttttaatagactaattaattatcgtttttaaagatcatcctttgtttggcattaacaatttatcaaacgcttgttttggattcaatgttttcattaacaaatatttctgtgggtctttacatcggagcaatgattgccagtttaatagaaatttttgtaagataaaatttaaagaatttttctttagatttttttaaggttttttcaatg

SEQ ID NO: 117671 - DNA, 452 bp, Heterodera glycines
  misc_feature (163)..(163): n is a, c, g, or t
  Promoter: Source sequence=SeqID_35682; Location=331..782; Strand=-; Gene=SeqID_65176
tggacgcatttcacctcatggcacaattgtgatggacattgaaaaattgtccgcatttgcgagagaagctgtggggagtcgccgatacagcaaaacagtgcaaataatgggatttggatggagaattgtggcagaaataagaattaatataaaaaccaaaganaaaatttttgggctttttccttttctgcaaagcgtcaaaagaaggttaaaaaaagcatttgtttaaattgcctaatgattgtttttttaaggttcatgcctttgctcggcaacctttcgaattgtcacacaaaatgccgaagctgagaattgcattgggaaatttaatgacatcatttttaacaataaatggaactgtcggggcttcgtcaatttcattaaattgacagttaagatgcactttaactttcacttaattgttctaattactactaattaaggaattgatg

SEQ ID NO: 117672 - DNA, 742 bp, Heterodera glycines
  Promoter: Source sequence=SeqID_9928; Location=980..1721; Strand=-; Gene=SeqID_72961
attttatacaatcaaaaatattttattaaattcttttttttcattatttaatatatagggattttctaatacataataagattaaattttgtttaaaaaaaacaaaaagccttcacttaacgccaaaaaacgaatgttggcataccgttgccttgcttcaaattatgttgtaattaaagcggagaattgtcgatttttatagtttttttaaaattttttattagttctcattatgcacctattccttcactaattctttagtaaatctcttaaacattttcgtaaaaatttcattttttctttaatgcattttttatattataataaataattcaaaatcatttagcaatattcaagtgctggcaaattagtcaataaaaaagacttaaagccatatcaaataaaattttcataagatatacatgcatatgaatgaaaatattaaattattataatttccaataaaatattttctgaaatgtatacgtttattaaaagaattgcttaattttatacatttatatatttgcttattttttcagaaagtaattctcaagagaaaaaacaaaattttggcataccgttgcctttttcctttaattatgttccaattagagcgagaattgtgtagattttttatgaagtttttttaattatggcttttcgagttcgagcgaaaacaaagtctcagaccaaaagcgatcggttttatttattatttttttacagaaaatttagaatg

SEQ ID NO: 117673 - DNA, 630 bp, Heterodera glycines
  misc_feature (34)..(34): n is a, c, g, or t
  Promoter: Source sequence=SeqID_43528; Location=1..630; Strand=+; Gene=SeqID_71171
attaaaaaattttaatatttatttaaaaatttcncgattcttctatttccaatgttttttggtcggaaacaaactttttttttgatggcttttatttataacgacataactccttcgaaggttgcaatacatagacttatgggatttttaaaaacatcctatttaaaggaaaaatatttcaatttggatgtcaagtttaggcaaatttttttttgtgtgttctgtaaaatcgaaagagtcgagtgtcatcttatctatgttagtaccgattttttcatttccgaaaaaaccctagcagatttaaaaaattttttaaaattgctttactcattttttagtttcgctaaaagcgaattgaataaaatatattttgcattaaagattagtagaccaaacttacacattgttaagctaaatttagcaaatttataatacaagatggcatctagaattttcaaaaaaaaaaaaattcatttagccaaatttttgggaattttgagaaatcatgcaaaattaaaatataaaaaaacaactttaatttgctgacaaaagaagctgatgaagacgttctcaaaaagcgtgcacatgattttttgagtagcttcatctcccgacttatccgcgaaaatg

SEQ ID NO: 117674 - DNA, 187 bp, Heterodera glycines
  Promoter: Source sequence=SeqID_13104; Location=2725..2911; Strand=-; Gene=SeqID_47105
atgcaaacgctcaataattattatgtattgtctccaaatgctttattttattttgtttccttttaaattatgcggcaaaatggacttttgttttaagaaagttttttcttattactatttttaaaatattttccttttaaaatataattaattatttttgtgctgaaatattgtagacattcaaatg

SEQ ID NO: 117675 - DNA, 61 bp, Heterodera glycines
  Promoter: Source sequence=SeqID_11211; Location=581..641; Strand=-; Gene=SeqID_74569
tctaaatattacattgagaaaatctttacttttttaatatttaatattttatagaaaaatg

SEQ ID NO: 117676 - DNA, 1003 bp, Heterodera glycines
  Promoter: Source sequence=SeqID_2582; Location=233..1235; Strand=+; Gene=SeqID_80530
ttcgctctttcattttcaaatctttcctacgacatgggtctttgttatgatgtaaaaacatagttgatgtgcgtatttgttgccttgccgcaaacgcttcgataaaaggttgctgtgaaaagacaaaaatgtctctgttcctataaaaatagaggatgacgagtcatttcgtcgtaggaattggacatgtttcccccctggcgttaccgtcactgtccctaaatattccgtcattgtcaaaggcattttttcctttaggagatggacttggtggttttccctgtccgcggcttctgttttctccgtttccccagttacacaaatgccgagccgataatcccgggattaaaattgcgtttggttgattccctttcacggggttcctttagccattcattcattgacttttgccaattcttcgctttttaattgccgattccctcgggcgcaatgcttttgctccgtttcgatggttatttgcttatttgcctccaatgtttgccaatttctgttcatccgtccaatgttcgtctctttggcgttgtcactttattttgtccatttcaaattcttttttttctccccccccctttcgccccccctttttcagtcattggcaaatacaaattggtggtgaaaatgtgctaattaattaatggattagcttactcaatataaatttgttacgcgatgagagcgaaacaaagaaaagaaagggcaaacgattggaaaggcaaaggaattaattaggagcaaagagagagagagaagaagaagcggactaattaatttcgctgcgttgtgccaatgcgaaggaaatgccatcattgagcgaacgattgcccaattccattcattccttctctgtctctctccacaaaacaaaggacaattttcgcctcctcagctcctcctattcttcgccttaattaattctcaaagaaattataaattaaaaaagtgaccgatcgatcgaaaaggactgatcggaaaggccaaaatg

SEQ ID NO: 117677 - DNA, 595 bp, Heterodera glycines
  Promoter: Source sequence=SeqID_15602; Location=1753..2347; Strand=-; Gene=SeqID_79889
atcccctcaatgggcagcatttgcgaagtgccacggatgacgagcaaaaattggaaaaacagaaagtccaatttattcacccattaaatataaaaataggcagacaaatgaaataaatgataaaaaaagaaaaagcatattaaaaagtgagagattccaagtgacatgaaagcttaagcacttttggtgaattccatcttttgctgctgttgttggtggcaatttgaagggagaaacggctccaaaagttggacgggaatgcctccgacagtccgctgatgctaaaagcaataataaagggttatataatagcagttacacccagggacggtttcagagggggacgtacattccccggtccactaattgtaagtccccgccgtttcctccagaaaatttttattatataatcttcgtccgaagcggtctcccttttccgtgcctaagtcctgtgactatccgtccccaactccaccttcaactgccgtttattgtcaggaatagacaacacattggcgcgtccgttgcgatagtccgagacaaatgccaaaacaattggttcactaacttctggtcggtcacagacgacaaaatg

SEQ ID NO: 117678 - DNA, 556 bp, Heterodera glycines
  Promoter: Source sequence=SeqID_11584; Location=19..574; Strand=+; Gene=SeqID_75024
taatacattttcgtttttcccatcattttttggtggcggattaaaattcgaaaaccgtccaatttgggaaagaaatatcattaaagtttcaaatttatgcttactgatttatttttttgattattttttcttaaatgaaaagattgcctttcaaaatttagcattaaatatatatttttgtttttgtttaattacatttttgagttagtccggctggattcgacgaggtatttaccggaattcctgtcctttttccggatcatttcgcactcccgttcccgactcccggtccgcattttaccggtctctagtaattaacaaaatcttaaatgttgccaataaaataattaaatcattaatgcattaatgcattaagcattcatttaggcctacgtgactttttttaatgtctattattatttatcgaacaaaccacaaggtgctacatatgcactctaacagtggcgtaaaaacaaaacataaaaaataaatagtttaaaaataaactaaatttgacgaaaaaacaattataaaaaatgtttgaccatacgaaatg

SEQ ID NO: 117679 - DNA, 628 bp, Heterodera glycines
  Promoter: Source sequence=SeqID_4080; Location=1..628; Strand=+; Gene= SeqID_53099
tcaacaaaaatgggtggtttttgcgattattaagctcaatcggtaggattttcatttaaaaaatgataaaatacgtatcaatttaaaaaaaactacgaggaatcatattttctttataggaaacccacgagtatacaaaaaaaaaaattgaaaataatctaatttctgtagatggatgaaccaggagaaagaagaagggaaagtcaaggagaatagccactaggccatttgcacacttgggcagttttacttttaaagaatatattaattattattttttatttttccctttgactccaattttcttcactaatttttcactcataccctcattcttaccagtgcttgtttttcccggatcccggttgccctaccgggaccgggacctgagcttttcaaaacccgggaccgggacctcggatgaccgggaattcccggcccggtcccggtcccgtggcactctagattataccaatatatttatattttttaaaataagcttttagtttcataaatttaatttttttgcccccaatttgagaacataatgggcgaaatgagcttccgttttgtaatgctcctaaaattaaaattttaattatggcagtcttgtgccatcaattacatg

SEQ ID NO: 117680 - DNA, 1003 bp, Heterodera glycines
  misc_feature (689)..(689): n is a, c, g, or t
  Promoter: Source sequence=SeqID_20955; Location=1611..2613; Strand=-; Gene=SeqID_51535
tgatgttttggtgatgatggtgatggccttcgattataatcgacaaacaatccccgtcgacggtgtgtccccgtcctcgtgttttatttgtcggtgcgatgtgtgtgcgaatttttcttgtctcaaccaaatttgccccctctcccaattttgccccgcacattttttacccccaaaaaatgatccccaaatttgcggagaaaaattcgtattatttcccgtttcactccctattaattttccatattgaacgattgttttcactcaatttgtctaattgatcatcgccaattatggcaaaatatataatacctaatagtaaattaaagaattaaatttggtaattttatttgatcaatccatgtgaaattcatagcgctaaacattaccaaaatattttgtaagtaaaattataatataaattttctttatgtatcattatacttctgtgcctaattagtcgccccaattttgcctaaatttgtattgcattttaatcatcaaaatttagggttgtagggtgggctttttaacgagagggaattttgacagtgaaaatatttttgacagtaaaataaagacctttcatgtatttttaattaaaactttttcaattaagttcaaattaaggtcaaatattttttcatttaatatatttaaatatttatgaaaaatttttatttcaaatntaataattttttaaataaccaaaaattctttcatcggatcactgtgaaaatgatagacaaaatccgatttgcactttttttcgtttttgaaaattttatctctataattatgaatattaaattttattatcccaacttgtgtattttattattcttttacttttgaaacaaatttaaattagttttcttcgaagtcaaggtcaagcaagaacttaaattcctttctcgactaattagcgaaaactctcgaccaaaaccattccaatcattcaaattcaacacgacatatcacattctcaatcactacaaaaatg

SEQ ID NO: 117681 - DNA, 1003 bp, Heterodera glycines
  Promoter: Source sequence=SeqID_19151; Location=404..1406; Strand=-; Gene=SeqID_83901
tttaaattgtgaatgggcaaactttgagccaaacttcaaattttgatttgactattctctagaggaagaaatattttatgatcattgtttaattttgttgattgattttatttcttttcttttcataaaaaatccctatcaaatgtgtgtaattaattctaattagttaattattaagggtggcatttaaataaataaaaaattccacattattggagcttctggggatgactttccgacctgaactctgaagtgtccatgtaatgggctatcttttaccattaaagaaaaattataaagtgtttttagatttttctggttttttctaccctttttttaatatttaaaagttttttgtgcagtgtgccgatctttttctaatggtgagaaaaatggcacgtaccataaaatatgacaaaaatatggcgattttttgaaagccattcaaaaattgttaaaattcaattaaaataattaatcgcttttttcagttttaagtaattgaggcgagaaatgaacaaatcgaaagttcgaaacaattaaattaaactcgatattgagtttgatttcataaaaatcttttatacaagcttcttttatttgtcagtgttaattatttcaatttactagaaactatttttgtgcaaaaaaaaaaacatgaaataggcacaaaatttcttcttaggtgtatatttttgaaaattctcagttcaattcttagggtgaattagcaatgcgtcattatttcattttatgcttcatttcggtgccagcgcgtttgctaaaactgccagaacgataaaaatataatttatatattttacattttaaaatattaattttaattaatattatatttaagactgacgtattataataaaagaatacgaaaatatttgccaacattaaattatacatttaaaacgattgataaatgaaaattttatctaaaacatatatcctatctttaataaaaaatattttagcaatttctttataaatg

SEQ ID NO: 117682 - DNA, 394 bp, Heterodera glycines
  Promoter: Source sequence=SeqID_4660; Location=1..394; Strand=+; Gene= SeqID_55266
taaggaaattgaaaaacgaaaaaattcctgtttttttttaattttcgaggagagaccaagggatgtaaaacgcacatgtacacactccgtggtgtaccacgtgcatccttcgtttaatttttaaccgacaactttctcctccctagcgtgggtttctttgttttctggcgcaattattttatttttcacgaaagcataagttcatttagacaaaggttttttatggctttatgagttggaagggctacatggaaattttgtggtttttggatccggattttcgagtcataacttacactaattaattggttcatcgtttttcaggaatgtgttggtcagtcatcagcgttcgaaaaagcatcgtcaaatggtggaactgttgcgtgcgcacatg

SEQ ID NO: 117683 - DNA, 501 bp, Heterodera glycines
  Promoter: Source sequence=SeqID_6703; Location=6424..6924; Strand=-; Gene=SeqID_62558
tgtcgccgagaaaaatgcaaagagaacgattgaaattaaatggtatgctttagatggcgggctctttttgaaaaaaactgttttcagggtcggagaatacgaatccggcatcaatttcgtcctatactatacccggaatcgaacaaaaagatcgtaaattcaaatcctttgaattttaaaaatggtttaatgcccaccatttaaagtattattaccttaagatttatactactaaaatatttagttagaagattttggtttgttctgtttatttatcattttatttttatcgtatcgtatttattccaatttcaaaatttttatatttgtttttgctgaaaagattgcttatttagtttactttctttttattacaaggaaagatttcctctgattttgaatttgcaattttccatgaaataaatgtgaacatatgtcttcttcaagaaaactttttataaaaaagtaatcatttttctaaatttcagcaattggaatatg

SEQ ID NO: 117684 - DNA, 353 bp, Heterodera glycines
  Promoter: Source sequence=SeqID_12329; Location=1191..1543; Strand=+; Gene=SeqID_75925
aaaattatacaataagaattaattgaataaaaataaaattaaaatacaaatatttttcctgcaaaaaatatcttccaaaatatacatttaaattttataagtttattttatttcttataataaagaaattatcttacatattttctgtataatgaccaaaaaatctcaagaaagtaaatggctcagaccaaacaataatcaaaaatatattatatatttaataaatattaaagtattatttttattatatacttactcattgtccgtttatcacataattttggtatttttatttttcatatttttgcagggcttctgctcctccacacaatttaaaactgtttgccgaaatg

SEQ ID NO: 117685 - DNA, 245 bp, Heterodera glycines
  Promoter: Source sequence=SeqID_385; Location=1589..1833; Strand=+; Gene=SeqID_50944
ttttttgaactctttaaaaatttgtaaaatttttatttggtaatgatttatgcagaaaaaatattcaccccaacaatttaactgtttttacgacgattttcctcctcttttagatgatatctgctggatactgacgggccggaaattaatcccaacgcatttccggccttggaaaattaattattcatttttttcaacgaattattttttataatggaaaatattttaatttaaactcaaaaatg

SEQ ID NO: 117686 - DNA, 94 bp, Heterodera glycines
  Promoter: Source sequence=SeqID_15173; Location=2352..2445; Strand=+; Gene=SeqID_47273
cgtaagttttatcacttgaatttcataaactttctcaacaccttgcaataggcaaacagcccggcgttgcgatcggacgcctctgtgacaaatg

SEQ ID NO: 117687 - DNA, 927 bp, Heterodera glycines
  Promoter: Source sequence=SeqID_41523; Location=716..1642; Strand=-; Gene=SeqID_69620
tgttagtttaggcactctgatgctttttctatcaaaaagggagatgaataaaatttttaaaaatttttaattcctttttaaacagcccaaaaagtttaggcttaactttttttttcagaaacttatcagaagcgcaccaaactttgcagggatactgaaaggaagagaaataacctattttaaatattatctagtcagttcatttaaataatttttatccaaaaaatttttttttgggttttcggggcagtccccctgaaccgatgcgcccagatttatggggagaccgaatccttcgggaatagcttccctatagtctgtactttaattctgcgttggagttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttatttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagtctgtactttaattctgcgttggatttttgctccccataattgtttgagtacccctaaacgtacacttgaaaaaatcgatttttttatttcataaatatttttttcagaaagtcatg

SEQ ID NO: 117688 - DNA, 292 bp, Heterodera glycines
  Promoter: Source sequence=SeqID_28440; Location=392..683; Strand=-; Gene=SeqID_59059
tgctgagtcttaccacggacgacagcaacgcttgtaccagcctggtttcttgctcggcagatggatagcgagttttcaggtacttgtttgtctctaacttttgtatcgtaaatgataggaactaagtcatgctgaagaagaaaccgcagtggccgttgatgaaggaagacaattgccagctcgcccgcttgaattaactcttgaattggacagaggaattgcctcagcgaaggcggatattttggcttttttgaatacggattactgcaatgatgaatttgttgaagccatg

SEQ ID NO: 117689 - DNA, 118 bp, Heterodera glycines
  Promoter: Source sequence=SeqID_14803; Location=27..144; Strand=+; Gene=SeqID_78952
gccgaggagttttatcccgtctctattttttcattttttgtttttttatcccaaaatgcaaaaaattgtgcggttttgtcggttaaattgtcccgcttgcacaggtgtggacaacatg

SEQ ID NO: 117690 - DNA, 388 bp, Heterodera glycines
  Promoter: Source sequence=SeqID_15837; Location=134..521; Strand=+; Gene=SeqID_80162
tttacaatattatatcaacaattaacgatctgattgctaatcaaacgtgaaaaagttgtgcatcaatcatgtgccgttgttttcggttcgatttggcattggtcggcttttgcccctcctcgccttccccccccccccccggcccgtccctctcctcggcccccatcattatcacttctccccaacctttgcccgtgttttgctttcgctttcccttctcataaattggatttgcttttccttcgttctgcaaaagcaaaaaacattttttttgttgtgaattagggacaaatgaaagtatttgtttactgagaaaaacattcggagaaattcgatttttcattttacgattttttgagcattttttgagtgaaaaaggaggaaaatg

SEQ ID NO: 117691 - DNA, 327 bp, Heterodera glycines
  Promoter: Source sequence=SeqID_44667; Location=1..327; Strand=+; Gene=SeqID_72121
gtgggggggcgaaggcccaccacgaggccgcgaagagaccgagtgagtaccttcggtgcaggaaaattattaaattttttaattgctttataaatatgccaaaaaatgtaggcttaactttgttagtgaaaattcgatcactcatattttttgataattgagcagaagcgtaccaaactttgcagggatactccccggtaaaggactaacatacactgaaatgagcgccgagctagctggctcaaaaaaatttttcgaaaatatgagtctttcgtttttatttatttgcaaaattaattcataaatattttttcagaaagggttatg

SEQ ID NO: 117692 - DNA, 87 bp, Heterodera glycines
  Promoter: Source sequence=SeqID_41695; Location=1..87; Strand=+; Gene= SeqID_69771
ttttgctccccataaatttttgagtacccaaacggccacttgaaaaaatcgattttttgtttcataaatattttttagaaagtcatg

SEQ ID NO: 117693 - DNA, 203 bp, Heterodera glycines
  Promoter: Source sequence=SeqID_22282; Location=1..203; Strand=+; Gene=SeqID_52958
atgaccaactcgggcagtcagaacattggcaatgtgatcaggtgggaattgaaggggacaaaggcgaagtgatcaaagagaaggacaaagagacagtggaaaacgattgactgataaggaaatgattcaaaaacataaataaaatgatcaaagaaacgtgttaattgatacgatttgtcatggttttgctcttggcacaaatg

SEQ ID NO: 117694 - DNA, 408 bp, Heterodera glycines
  Promoter: Source sequence=SeqID_3245; Location=5773..6180; Strand=+; Gene=SeqID_83886
ttaggaaatgcctaaaattttaattgatttatttaaataaaaaatataaaaatcattctattatgtagaatagaaagaggaattcaatttttaatttgaacgtttgtttacctcaagaatttcctaattaggaaaaattatttggcttatcgtttttcgtaaatgtttgattttccgattcattgcgcaattaggaggagaaagaaaacaagtttcgagaaaaagataaataaataatcattttggaatgcacaaagtactgaccaactcacaaaattaaacagtaaatattataaacacattctgagcatttaaaaaaagacaaaaacacgcggaaagagccgagaaaacgccggaaatgtttatgtaaaaaataattgtacttaaaaaggggagaagaaaaaaatg

SEQ ID NO: 117695 - DNA, 179 bp, Heterodera glycines
  Promoter: Source sequence=SeqID_1581; Location=1..179; Strand=+; Gene= SeqID_74624
atgaaaaacacttttgaggacaaaatgtcacaagacaaagtgtcaccatttgatgatacgaatgaaaatgttaatggttacaaaatgtctacaaaaaatcgggaggatcaattgtcagaggaaaaaaagtcgacaacaaattttacgatacagtgtcgttcgctgtatcagagaaaatg

SEQ ID NO: 117696 - DNA, 355 bp, Heterodera glycines
  Promoter: Source sequence=SeqID_94; Location=3042..3396; Strand=+; Gene=SeqID_66040
ggttcgtttgagggtccgatttgatttgtgtccagaagtagaagaaattgggggtattgaaagacaaagaccctatcctgcccgtaaaattcgtgcattgcccacctttgatatttcgacaattcacgttgaaaaatgcctttcctgtcccatatgcatgtgtccttttgtgagtggggagtgtgccacctcactccattgtttccatatttttcatgccccatgtattgtaccatggcttaggattcagcgctcatgtcctgtttgtaaatttttattgccatgaataaattttttgttgttctctgttaaggcgattgaggacagtttcgtcattgagcgcaccacgcaaatg

SEQ ID NO: 117697 - DNA, 663 bp, Heterodera glycines
  Promoter: Source sequence=SeqID_6107; Location=2319..2981; Strand=+; Gene=SeqID_60375
ggttgttcaagaattctttgctaaattttgaaaaaataaaataatttaaatgtgaaaataataaagcgccgcccgctaacttctaaaagctctggagaggtataatcaggggtaattactggtggttgatcagtttcacccactccattttcaacaaatgcactgccttaattaaaatataaatttaaaaaataataataatcgaagaatggtgactaatagatagggatgcgatttttaggcacaaaaatcgcgaaataggcacctaaaaaggcataaaaaatcgcaaaataggcattaaataggcacaaaaatcctcgaataggcactaaaataggcaaaaaattatttttattatattaacgtttttaggtagtaaatcacgtaaaaattaatcaaaagacttacttttgcttatattccaattgttttaaagttttttcgaataaagacaaatttttagccaaaaatttttatcatgaaaaaatattaaattcggtgatcaattttttgaaatttttttttcaattcttagcggtgtattttttgaattttttttttgggtcatttcttagtggtgggtttttcgtttttattgcatttttgttaaggatttttcaaaaatcctaaaataggcacattaggcacaaaaactccaaaatg

SEQ ID NO: 117698 - DNA, 714 bp, Heterodera glycines
  Promoter: Source sequence=SeqID_26431; Location=1127..1840; Strand=-; Gene=SeqID_57159
ttcactgaaatcgcaccgatattttgttgatgaaaaatgattattattattattattattaagaattatgcacctattaaactttataaatttttttattggtattattgttctattctattttaatattttaaaattaagaattaattttaacttttataatataaaatgttgcattggctaagaaagaagaaaaacttcttaaataaaataattaattaatttttaaaaacacaaaatagaccatattcattaatattctttttatattatgttttctttttttgtttccttaactttgcttaaatttattcttaaaaattaactgctatgtattaaattgtatgtattttcttatttccctgcatttttaatgagttttttttcacgacctctttgctgaaaaaaagattcttatccttcgcaccttgtaaaaatttttttggcgctgtgaagcgcaaatttaattattttaaaattataggttaattattgtatttttgagcatttttaatatgttcctattaaaatttatttaaatttctcttgaaaatagtcttatctataaattcctttacttaactgctgtctaatattattttattttttaaatacaaaattttttatcctaactagcggggaaagcgccttcggcgcatcccccgctaggtagtacgatgtattattgagctatgaataataaaaccgaaaatg

SEQ ID NO: 117699 - DNA, 783 bp, Heterodera glycines
  Promoter: Source sequence=SeqID_29579; Location=1..783; Strand=+; Gene=SeqID_60057
gccggccctccttgtcccccaaaagtcttggaaaaaacgtgccgcgtaaaaagcggtgttgaaagcaaaaaaaggtcattgatttacattaatttacatggccggagaccccttcgcaaaattggaaaattggctgctgaccccttgttttgcaataatctgaattttgaggtctatatctgaattttagtgttctttatcctgaatttgaaaaaaaaacttggtcaacctgaatatacatatacttctgaacaattctaatgctaaaaaacaggtactcgcgcgaaaactgaataaaaattttgtatttggaaaattttgtccaaaaatttttatgttctaaaattaccggtttttaccggtaccggtaccggtaccggttgaaaaagttggtaccggtaccggtaccggtttttgcagtaccggtcagtaccggtaccggtttttgcaattaccgattaccgctcaactctagattaaatgtatcaaaaaataatttaataaaaaattagttcctacattttagacactaaaacttacaaaaaaaaaatgaacattggttttggcaacctaaaagccaaaaacatttattcaaaagagatgacataactcttaattttaatattaaaaaaaactccaagactggtaaagaaacgagagagtacagagaagcaggaatatatttatttatttatttattaaatttaaaatgttttaaattttattattttatttaatgttcagataatcaatctgactattcagtggatattacaccaaatg

SEQ ID NO: 117700 - DNA, 297 bp, Heterodera glycines
  Promoter: Source sequence=SeqID_9018; Location=1..297; Strand=+; Gene= SeqID_70010
gttataatagcaaataattatttttaaatcatacagaaaaatttgttttataattttttatttttgccaaaagcatcatggaaatttaatgaataatgtgtaatttatcataaatcacatttttatttaaattgatttatttatttaaattttaaattattttgacgaaagctcaggcaaaaataaagttacttaaatgactttttgtttagttttttttaaatttaatattttatttatatttacataagtgtggccagtgatgtgtggagtttgggcatttcattggctgaaatg

SEQ ID NO: 117701 - DNA, 107 bp, Heterodera glycines
  Promoter: Source sequence=SeqID_6379; Location=722..828; Strand=+; Gene=SeqID_61316
aagtaaaaaaaaagagtaggggtcgtttcggcaccagcctaagaaattttaatttattttgttaataatcattttaatttatatttagtgacgatgttcattttatg

SEQ ID NO: 117702 - DNA, 1003 bp, Heterodera glycines
  Promoter: Source sequence=SeqID_14774; Location=616..1618; Strand=-; Gene=SeqID_78912
agcgggataatctaccttccctgtaagtttcattcggaagtcccaccgtcacttgggtacctctcctttgtcagggcttcgattgaaaatttcacaaaattagaaaccagagctcaacaaatcagatttaaagcgaaaatcaaatattttgcaacttgcttcaaatcgttaatttttaactatcaaaaataaatcaaatatttatatttgcctcatattattgatgggcggggagtttgggtcaacggcacggctccctgaaaacgcgacactggaaaatgcgacaccggccgaaaatccgacaccgagagagtttttcaagaaaatgcgacactgagaaactccctcccgcatgccccttatgtaattttcaaagacttagaatccaaaaatcttccgtatgaaccgctccaggctaaggcatacgaatgaatgttcctttaaaaaacatgaaatccaaggacatttaaaatttttattatttgcaatgaaaaatggttaatatttattcaaatggcttgttgtcgcttaagctgttaggacaaaggggcgggcaaagggtgaccacgggaatttgggctaagaatggacaaaaggagcagagggaacggcaccgaatatgggcagggtgaagaagggcgagacgaatatccaatttaaatatttattttaaatgaaaggcacaaaggtgagtgatgattgagggattttggtcccttcttatagcagaaaaagaaacgtgggaggagcacttttggggaacaataagtgggaggaggcgtaggtggagcactttttaggaaaagaggaaaaaacatgatgaataattggacagaaaaacagaaaggacagaaaattattaagaaaaaaccaaaaatccacaaattcaacaatctcccaaaatcgatcaaagggcaattagccaattcagtttttttcgtcggccactgtgccgacattcccggcgtcaattgagttcccggcggaggaagctgagacgatg

SEQ ID NO: 117703 - DNA, 300 bp, Heterodera glycines
  Promoter: Source sequence=SeqID_5744; Location=193..492; Strand=+; Gene=SeqID_59095
tttcttagaatacggagaataaccaaacaccacaaaattttaaacttcgtgagcctaattttgcgtataatcgacaaagtttaatgggagttttggggtgttaccgctgataaaaacaataacaacaacaacagtctctatatattacacaaaaagttaacgaatttttaccccctcccccacactaagttttgtgcgtatttcacataaattctatcttttatttattatttgttagatacatatttctttaaaaaaatacgacagttggttccatcgtcttacaatttttttagaatg

SEQ ID NO: 117704 - DNA, 145 bp, Heterodera glycines
  Promoter: Source sequence=SeqID_16777; Location=2114..2258; Strand=-; Gene=SeqID_81194
cgcgaaatacttgagagtctgcaaaagcgagtaaaaaagcctcgcattgctgcaaatgaagacagcgtactgaatgttgaggacgcagaacaacaaattgaaggcacttcaaccaggaacaatttgggcgtcgcttcgagtgatg

SEQ ID NO: 117705 - DNA, 253 bp, Heterodera glycines
  Promoter: Source sequence=SeqID_34138; Location=1333..1585; Strand=-; Gene=SeqID_64012
ggcgcagaccattaaaagtcttgacaatttctcgtactctttgacgctacaccatatgtcagagctgagaggaaatgccggagcggacgaagtgaatgccttttttcgccagttggacgcagttagcgaagattggcccaacgaaaagcgcttaagcacattaaaatcgaaatgttcgggtagggcagaacgcgcatacaattccgccgttgccaataatcccttccggtatgaaaatatccgaagagcgatg

SEQ ID NO: 117706 - DNA, 205 bp, Heterodera glycines
  Promoter: Source sequence=SeqID_17692; Location=841..1045; Strand=-; Gene=SeqID_82223
aaattgttgctatcattcgaaagcccttcagattctcttttatcttgcataattccaaaaaatttcatcaattttgaacaaatttatggccataaaagttggaaaatctggttttttaagttgttctggccataatttttttgaacctttacataatttttcaaaattttgcaggctaatagaggacatttacagctttcgaatg

SEQ ID NO: 117707 - DNA, 985 bp, Heterodera glycines
  Promoter: Source sequence=SeqID_40212; Location=210..1194; Strand=-; Gene=SeqID_68613
actgaaaatgggggagggttgattggtgcaaaaaaatcataaaaatcccaaaaagtagaaaaaagtcaaataaaaatgcatgttagaagcttaaacaaagccgtatttttaaagccatttcaaagctattttgagtcagcagaaataacaaaattgaaaaaaaaccttttccctcatataaatgccattttcatgtggtgtttgttaacaatgagtcggatcggggttttcggtagtaaaaatttctcatcttgattttcataaaaattctcgcacatctttaccggttaggtgctatgacgaagcgaaaaaagaatggatgtgagggttctgaagggaagtgccgtttctcaattaaatttaattattttagtatattgattgataaatttaatatcactaactgatttattttattatttaatattcgatatttgtaaaaacataatgggtaaatccggggggcacgtgaattattgaagtttcacccggggtaaaaaggtggacccggaaaagttcctgaatacggattcggagccctgaaatctaactaattaaatttgattattcgagctgaaacggcccttccccccaaagcctgttcatccatactttttacaactcttcgcccatacttttttctttggtttggaaaccgagctataaaacacaaaaagaaaagtcccatcttccgatcaattcttaatttgacatttaatccgctgagttgaaccagttttgtgcattttaaaaccaaagattgttcggacctcgccttgtttgctatgcgggcggaagatattgcaaatgaaatggccgatcattggcctgttacactcatttcgttatgtgtttggcagccaatcgcgcaattctctcgaagaatcgttgttcgtcggtcttcgctcgcccccccccccgcgctttaaaagggcctcccgcaaaacttcgccggcaattgaaccacaaaatttctcccaaaatg

SEQ ID NO: 117708 - DNA, 362 bp, Heterodera glycines
  Promoter: Source sequence=SeqID_11776; Location=1..362; Strand=+; Gene=SeqID_75275
ttttgagttgggtaaacaaaggaaaaaaaaattaagacgaataaaatatattaaaaaaattatcgaaaaaagtcttggtatcattaaatggccctttaggttctctatctacttaaaatgtttccaaaaaaatatgagcaaatattgtaaaaaaaaatatttgtccaaaacttttttttgattcataaccaaattttttggaattttgcaagaaaatagagaagcttaaaggctatcgaatgttttgtaatcctcaaaaagaaaaataaggcctagcttatggatatatattgtggaaagagtttttcttttacatataacctcaaaaataatggattcttttcagcttccggcgacacatg

SEQ ID NO: 117709 - DNA, 736 bp, Heterodera glycines
  misc_feature (128)..(128): n is a, c, g, or t
  misc_feature (180)..(180): n is a, c, g, or t
  misc_feature (199)..(199): n is a, c, g, or t
  Promoter: Source sequence=SeqID_1678; Location=8796..9531; Strand=-; Gene=SeqID_75274
ttttaaattccgatttataaaaaaatatattttatgcatacatattatgaatgaaatgcatatgaattgtataggaaatcaatttattaatttttttatcttacttaaacatatcaaacgcaaaaatntgcttcattttttataattttatacaattttgataaaaaatttatttatatntaaattgtaaaattttttntaatgaaaatttttaaaatacttcgataattaattaattgctttatttttttagattagacaatccaaatgtttattttataatcttatatgtaaagattttatagtaaaatttatttatttaatttaaaaattgttatttaaattaaaacgcatttaaaaaatttagattaattaattgcttgattcttaaaaaatgaacaaaattattattgtgttgtcagcttttttaatgttcacagccattaacgcgatggaaaatgggacaaaaattgaagaagtaaataatttaatttaaaacttttttaattcatttcaattaaatataattaaggaaagaaagctcccgccgataataatccgtcaaccgtctggaaaagaagtattaaaaatttatttgaatttatttttaaattttataagatttattcaagctatggttattgaattttcaaaacatttatttttgcaaaaaaaacaccaaaaatatttactaaaaatcgcaaaaaaaaaaatttatcagccaaattccgaaatg

SEQ ID NO: 117710 - DNA, 1003 bp, Heterodera glycines
  Promoter: Source sequence=SeqID_10574; Location=2595..3597; Strand=-; Gene=SeqID_46882
atgaggaggagaataatgcccaacaaatgcaaaagtcgagcaccgaacaattccaattgctcaacgcattttaaacgcgaaaattggtctttgtatgtgggaaaaatgtaagaaaaactaaaggaagtactttttaaaattgacaaatgaagggaaaatcactcggaaacggcgagtaaaaagtcgtaaaacttatcgattaaatgtccaaacatttccaaaaatgaggaaaaccgcgcgtagaattccctttccaattgacgcccctcctttaatttgcgttaaagaaaattcattttcgtttttattacctcgcttccctcagtaaatttgtcaaatgaagcacggttttcgaagtaagaaaagtcgattagcaatttattaaacgcacttgacgaaacattggcaaaatcagtcgggacgagaaatgacagcctatgaatttccgcaattatacaatggctcgtaaatgttaggtcctcaacaaatttcaaagagccgtttgcaattttatttggcaacattttctaaaaaaagaaaaagaaaattaagttcacggaaaatggttcatatctatcctaatcccctactcaaaactagagcccggacagagccgggacctaggattttgccgggctcccggtcctgttcatttttaagttcaaaccccgccccgcagagggacccgcaccgaaaactcggcttttgtgcgcatcccgcggcctgaattgcatcaaaaaacagaatgccaaataatttaaaattatgtaaataaattttcattcaaattccataaaattttcctgtgggaccatttttgaaaattttaattacctctgagaacccccctcccaatttggttttttgaaaaatcggtcccaagaaactagaaaagtaataacgtctcaatcataaatattggtcctctaattaaattgtataaatccacatcacaaataaacaagtcgcgcaaactttactacatttattctttaagaaaatg

SEQ ID NO: 117711 - DNA, 200 bp, Heterodera glycines
  Promoter: Source sequence=SeqID_33272; Location=724..923; Strand=-; Gene=SeqID_63387
tcactcattcagttgaacatgccgagtcaacggaaaaaattgagcagcagcaacaacagaagcaaacgatctttggcaaggagaaaacaacgccaagaagaaaggaagaagaggaaaagcaaaagagagaagcagaacaacagaagggcatttcggacgaattggagaaacagcaaatgcgaagaaaggagggaaaaatg

SEQ ID NO: 117712 - DNA, 108 bp, Heterodera glycines
  Promoter: Source sequence=SeqID_3885; Location=1..108; Strand=+; Gene= SeqID_52281
aagcgggatatttttgccgaaatcacctacgcgccgattcagttgtctattcaattcgaggggcttcgaatcgctacggaagaggacctaacaaaatgccatgccatg

SEQ ID NO: 117713 - DNA, 73 bp, Heterodera glycines
  Promoter: Source sequence=SeqID_12939; Location=1..73; Strand=+; Gene= SeqID_76689
ttgcacattaatcaacagaaatgggaagttcaaagacaggaactgaaattattcacaattatttttaatgatg

SEQ ID NO: 117714 - DNA, 677 bp, Heterodera glycines
  Promoter: Source sequence=SeqID_1009; Location=1001..1677; Strand=+; Gene=SeqID_65979
attatgacccctcgaaaatggtagaactttgggcgccatggtgccgataggcgatgccagaaaattttgattttcattgaatttagttaagaaaatgttgcacgcactttgaagtcataaaacgaaattttttgcgatttttcaagaaaaaatttgtttgtttttttaaatttttaaagtttttggtagcagttttgcataaaaatggccagattagatcattttaacaatcattctcatacatatgttttccttttttcacatagaattctcttcttatttcggttttgattttagcttacaaattttctacaaaaaattttcatggatttggacgcatttcttcgtttcttcgctggggtttgcaatttattttaatgtttgtcttaaactttttttttgtccagccgcgcagcagccagcaccaatgagtatttacgaacgctttaacaaggaagtttgcgaaaaaaacccttgagcgtaaatctaaaaatgtacatttagttcttaaaaaattggttgcgatcaaatactgtggagtcaattaacgcaagaagcgttgaccacggaggaaagacgtctttgatttgcgccatacagcgtgaatgtttgttgttttttctatttaaaaataatttttatttgcacttttaatagcacctcttgcgtgcacgatg

SEQ ID NO: 117715 - DNA, 621 bp, Heterodera glycines
  Promoter: Source sequence=SeqID_24554; Location=1..621; Strand=+; Gene=SeqID_55275
ccgaaggattcgatctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacatttatggggagcaaaaatccaacgcagaattaaagtacagactatagggaagctattcccgaaggattcggtctccccataaatcaaccgatatgtattcgattcccgaaattttttggataaagcgtgccgcaacaaaagcggttttgaagaaaaaaaaactcgcaaaaataaggatgatgcattttttagctatttcttggacaaaaaaaatattttgtaattaattcatcataaaatttttcttacaattagattttttttgataaaattttgtgtctagggatggtgatgtgcctgctctcctacggtgccggactcgacgagcaggcggacgacagtgacaaaatg

SEQ ID NO: 117716 - DNA, 129 bp, Heterodera glycines
  Promoter: Source sequence=SeqID_2272; Location=160..288; Strand=+; Gene=SeqID_78837
tttttggagcacagtcagcccctcttcgaccgcgtggacatctttttcaaatgcgacggagccatcaaagggcgtgggaaggaatttgtccaaatttggccccttttccgtgccaacatcgtcaaaatg

SEQ ID NO: 117717 - DNA, 65 bp, Heterodera glycines
  misc_feature (3)..(3): n is a, c, g, or t
  Promoter: Source sequence=SeqID_4391; Location=1..65; Strand=+; Gene =SeqID_54273
ttntgggaatggagcgacaacgataaaaatggacaaaatgcctaaggcaaacggtgccgggaatg

SEQ ID NO: 117718 - DNA, 100 bp, Heterodera glycines
  Promoter: Source sequence=SeqID_7478; Location=2945..3044; Strand=+; Gene=SeqID_46426
ggttaatatgcataagagataattattttgcaattccaacccccacccaaattttgctcctcttttaagtgcgtggttctttcgggtattctttacaatg

SEQ ID NO: 117719 - DNA, 339 bp, Heterodera glycines
  Promoter: Source sequence=SeqID_10495; Location=910..1248; Strand=-; Gene=SeqID_73709
aataattttttattttattaaagtaaactactatttaaatacttattcaaatattgcaaagtatattttttataatttatttttttgaatatgaaaatttattttgtaaaaaatatttaaaatttaaatcatatttttatatttgagtgaaatctataaaaattcgtctccgagggttcaggctgagctttacgacttaaccttaattttaattacaatgagtaattaatatgcttttaatgtaattttttcaaaattataaaattattttttcaaattatatttccataggactttggcgaaaaacgcgttctgggccaagaaggtcgtccaacaatg

SEQ ID NO: 117720 - DNA, 176 bp, Heterodera glycines
  Promoter: Source sequence=SeqID_2832; Location=997..1172; Strand=+; Gene=SeqID_81839
attagctgaatctccaacaattttttttctttatttctgaataaaattcgttgctaattgagcttgcccaatttatgtcctctgaagggttgtacgccccatatttcctccttattgttaatagatttggctattttaatttatatggtaatttctgttagagactaaccaaaatg

SEQ ID NO: 117721 - DNA, 711 bp, Heterodera glycines
  Promoter: Source sequence=SeqID_8030; Location=3727..4437; Strand=-; Gene=SeqID_66753
aacgaaggcaaaaataaaaatattattctgtgcatatatgataatatagttagtacaaatgtatatttttgtagtaaaatcgagcctgattagaagttccaagaaaaatttcaaatttgaataaaaatttgaaaaagaaaagccaaaaatgtcattttttctgattgggaatgaacgaaaaaagtaaaatgggagaagtccccttctgtttgcaaaacgtttttgaaaatgatgttttattacatgttttcatgttcgcaatttcttgctgattgacccagctagactcaaaattcgggacctaatctcgaattcctgtcttggctccatgcaattttattaattatgattaattgttttttttgtctgctgatgacgtactgctcggaaatgtgggtgattcccgtggacaaaacattgtttaataaatttttgtgttgtcatttcttctgtcgttgttggccattaattggagtgattggcaattcggggggaggggggagaatctgtcggtcggcggcgagtgaattgtccgagtcgttcgttgtccatccaatcgcattgtccccccccccctttcgatgggcccctccgatcacttcccctcctcccctctgatcatcgtcacttattagtccgtccttccactgaatttcgttcatttgtccctaaattcgcattttgctttcccaattaatttctccaaaaatg

SEQ ID NO: 117722 - DNA, 355 bp, Heterodera glycines
  Promoter: Source sequence=SeqID_39531; Location=1..355; Strand=+; Gene=SeqID_68083
tcgagaaaaatatcgggtcgggtttcgggtcgagaaaaaggccgggtttcgggtaacccggaacaaccctggtgggcacggcctgccaaaattgcagaaatttttctgacttggaaacaagtcatgaccagagaaattctaaaaccagatttttcgtatgggtttcgtcgacgaatttttttggtttcgccgggactggggttaattattcaatggtggcgttaaggattgcagtcgggattagatttttgtatatactttaattaacaaatcttgaatcttgacccttaatttatgacgggaaagaattaccacgatccaattaaatgctattgtgttttagataattcaaatg

SEQ ID NO: 117723 - DNA, 252 bp, Heterodera glycines
  Promoter: Source sequence=SeqID_5349; Location=2120..2371; Strand=+; Gene=SeqID_57761
ggttggtcggaaaatggtataaattgaaatcatcatgattggttttggttacggtgttttgaataaaaaacggtcattatatgggttagatatttatggggatggcagaaggaagcggagtgagggagaaagtgggataaaggacatgggattgatcagtcgattaaaaagcattccacgctatggaaaaaccgtgggtactagtccaccgggccagttatcttttatgtactaaggatttattaattgatg

SEQ ID NO: 117724 - DNA, 440 bp, Heterodera glycines
  Promoter: Source sequence=SeqID_3476; Location=1056..1495; Strand=-; Gene=SeqID_84824
tggccgctttgaccacgtcctcggcgcattgcacgctttgctgctgcacgtgcagcaatggccacaggtagaaacagagactaatcagaacagcagcagagagtggagaaataaatgagtgtcggcggatgcctttcgattgattataaaaaagtgattgatcacccaaaaagtgattaaatgctggaaaacactgatcaaagcgaaggcaaaattccgtaatccttcgtcattaattaagtcccaagaggggcaattaattcagaattctaaccatgaaaaaggtgccattgtttgctgtggacaatgaaaatgtcctcactgtgctgccggaggtaaaaacagaaaacccacttcccttggatatttaaaattcgatttgaaaaagtgctaattaatttcgctaatgattgctttccgtccgatttgagggggaaatg

SEQ ID NO: 117725 - DNA, 119 bp, Heterodera glycines
  Promoter: Source sequence=SeqID_19263; Location=891..1009; Strand=-; Gene=SeqID_84008
ttatggtttctttgctaaaataaaaaaatcatttttaaaaaggtccaacattttttggaaaatcgccaaagttttcggttcaaatgaaatcggaaaaacaaaaaagccattccaatatg

SEQ ID NO: 117726 - DNA, 102 bp, Heterodera glycines
  Promoter: Source sequence=SeqID_26605; Location=1534..1635; Strand=-; Gene=SeqID_57344
gaaagtggaagaggaaggaaagaggaagagaacgagaaataggaagagaacgagaaagaggaagaaaaagaggaagataaagtggaagaggaacggaaaatg

SEQ ID NO: 117727 - DNA, 126 bp, Heterodera glycines
  Promoter: Source sequence=SeqID_17240; Location=1700..1825; Strand=-; Gene=SeqID_81708
gacagtgccaatgcgtcggatggccaagcggtggccaaatggcttttgtcgcctcgtccggacggtttgccgaagttgctcagatgcggattccgggggaatgaggagcaatggtcttccaaaatg

SEQ ID NO: 117728 - DNA, 107 bp, Heterodera glycines
  Promoter: Source sequence=SeqID_25982; Location=1251..1357; Strand=+; Gene=SeqID_56733
aaactatttttttatggtctgtaaacgacattagtaccgttttatttttggtgattttgcagcatcagcattaaattttccctttctcccattttgcggataaaatg

SEQ ID NO: 117729 - DNA, 83 bp, Heterodera glycines
  Promoter: Source sequence=SeqID_29998; Location=1127..1209; Strand=-; Gene=SeqID_60456
tctaattgatttgataaaatccatccaaagctcttaaatgactttttgtctcttcgattcagccgtcccacgctttaaaaatg

SEQ ID NO: 117730 - DNA, 219 bp, Heterodera glycines
  misc_feature (187)..(187): n is a, c, g, or t
  Promoter: Source sequence=SeqID_13490; Location=1..219; Strand=+; Gene=SeqID_77378
aatcaagccctaacgagttaaaagctgaattgaaatgtccatctaggccaaaaatttaatttccgaaaaatcaatattttttctaaaaatattaccaattaatagagcttgaaaagttttggcttgaaattggttcgttttccctgggaattcattgaaaataaataaggttcaaaaaccaaaaaanatgataggcaagtttcgacatctacaattatg

SEQ ID NO: 117731 - DNA, 410 bp, Heterodera glycines
  Promoter: Source sequence=SeqID_45401; Location=208..617; Strand=-; Gene=SeqID_72696
tttttctctatatttaaaaattagcttattgtttacataagctctgtactaaaattatagccgcaagatttttttcatcccaactacttcgcgtggggtcaaataagctgtttaccagtcatacttccctaatcaatattaagaacgatataaaaaatggaacagttaaaagggaataattttcaataatttttttcgataattttttaaatgaaaattgtcctaaattgctgtaacaaatttatagcatcaagttttgatactaaaaaattcatactattgtaactttttatctcatcaaaaaatcaattgcacaaccatgatctgatcctttcaggatgacctgaaaatttatcttggtttttctctaactaaaaaacaaacaaagtaacaccagaacgccccttatg

SEQ ID NO: 117732 - DNA, 716 bp, Heterodera glycines
  Promoter: Source sequence=SeqID_6484; Location=1..716; Strand=+; Gene= SeqID_61753
tgattggtcaattcggcgccatctgctcccacttggccattgtcgtttgtgcgcaatgcattcccgaagggccaacccgcgcgtgggctattttgggatgccttttggtgtttctcgtctttttccaggccagcattgggcccgtcacgtggtcagagttttgaaaaagaaaagaggggagaaatttaaagagaaaaaaggagggttttaattccaaataaattggccattagccgtggaattttaccctaaaattggtgccttctatttgccaactattttcgaatttctctcattactgagttcgaataatgaaaatgaccaaatgcccatcgacccaattaaaatattttttttaggcttttgcttgccgaaattttcccgcttgaaattcggggaattggcatgggtttgtcgactttggccatttgggtaaggaaattacgaaaatattgaaacctttttaaatatgaacaaaaaattcaatataacacaaaattgaaatgataacactttttgccaaggtcacgagattctgacaaaaataaacaaataacccgaaaatggactctttttttgataagactcacaaatcatttgcttttggaagtttaacttaaatatttaatcaattcctttttgattttgtccaaatgttaatttgccatttgctaattgaggtcactaattgtgccgaaggcctcctctttccgatg

SEQ ID NO: 117733 - DNA, 1003 bp, Heterodera glycines
  Promoter: Source sequence=SeqID_230; Location=834..1836; Strand=+; Gene=SeqID_78827
taaaataactagaatataaaaggcgactcgttagttcactcgctcataagaaaaattaaaattattattattaaaatgacttcctcaccaaaaagtaaataataataaattttattttatttttcaatcaattcctttagcttccctctcccgtcgttcacctacccctgagattgatgagctagatgaagtatccgcatggtatgacatgatacaaacggacgacgagaacgtaaacaatttttttatattaatatgattttttcgctcattaagatacttaattggttcacacctaagatggcccgagttgtgtgccaggaggttatcgaatttgctcagcaacgcaacatgccgtgtgagaaggttgtcaagtggaagaaaattctggacaaaatttgcgcacaacttgcgcaaaagaagtgatcactttccaaaagacgcaaagaatttcctgttacttttttaattaaataaaagatttactcagtgtaaatggctttctttgaactgtcaaacgggactcaatcctgagtgcccacccaccgttccttaatgtttaaagtgggtgtgagatactttagggtcatgcgggagctgtatataagtagctggtcaacttgtccttcatttcattcttaaatattttgaaaaaaaaaatggcaatcaatatttgcgacaagaaatcgctcgtcaaccaaatcctcgggcaggcggacctcaccataacaacaagcggcataaccgttagtgggcctcgtctgtccaccccacgatttatacccttcgaagagtgtgggcgctgccgcgcttgtaaggctaccgaagttgaggttgacacaatggtgaccaaagagggggtcacattgtggtgtagtcggatcagcaaggcccaattcgtcccatttgatgtcgcacaactcaaggagcgcagaccgatgagaaacaggacctgaaacgtaaagcgaaggtagctctagacttggtggaggcaggtctaatg

SEQ ID NO: 117734 - DNA, 271 bp, Heterodera glycines
  Promoter: Source sequence=SeqID_3655; Location=2181..2451; Strand=-; Gene=SeqID_51300
atttgatatatcaaatgtgagcaaatcctaaaaaattacaaaattggatattattttgttacaagacacctaacaaatgtataatgttttttgcgatgagaattttttacattgaaattacatattagaattaaattttctatttttatggtattttttaatccattgaaaaaaattagtaaatttccaacaaattctctattttttaggtctgtcttgacgaagtattatatttatatagtatttcataggctgtatgccaatcgccatg

SEQ ID NO: 117735 - DNA, 570 bp, Heterodera glycines
  Promoter: Source sequence=SeqID_37526; Location=468..1037; Strand=-; Gene=SeqID_66574
aaaaggaattaaaaatttttaaaatatttattcatctcccttttgatagaaaaagcatcagagagccttatttaacttttaattaacatttggtgcgtttcagagcacgttctaaaaaatatttatgaattaattttgcaaaataataaataagtaatgaaaaagtcagaatttcgaaaaattttaaaaacaacaagcgttggcattttttcaggttaagttagtcctttacaatggagaaggcctgcaaaatttggagagattatatcgattttagtgcgctaggttcgatgaaactttttaaaatataagcctaaactttttggcctgtttaaaaaggaattaaaaatttttaaaatatttattcatctcccttttgatagaaaaagcatcagagagccttatttaacttttaattaacatttggtgcgtttcagagcactttctgaaaaaatacttatgaattaattttgcaaaaaataaataagtaatgaaaaagtcagaattttgaaaaattttaaaaacaacaagcgttggcattttttcaggttaagttagtcctttacaatg

SEQ ID NO: 117736 - DNA, 113 bp, Heterodera glycines
  Promoter: Source sequence=SeqID_14078; Location=903..1015; Strand=-; Gene=SeqID_78052
ggtggactaattaatgaattaatgaatttgatattaaaattgggctaatttatgttattttggtcttaatttagtgacctaaaacaatagaagtgatcacacgttacacaatg

SEQ ID NO: 117737 - DNA, 455 bp, Heterodera glycines
  Promoter: Source sequence=SeqID_2339; Location=3956..4410; Strand=+; Gene=SeqID_79220
tttcggttgatattttatcattttttaaatgaaaatccgtacaaattgagcctagtaatcccaaaatccagccttttttgttgaaaatctgttaacaaatttgtattattttcacttgaaataaattaaaatttgaattttttaaaatttttttgaatttttttaaaaattccctgttggtcccggttcccggtcccggacgaaaatcgaggtccccgtcccggtcccggcttctcaggtcccggcaagtcctggtcccgattttgccaaaaattcccagtcccgtggcactctacaaaaaataaataatttatagtttaactctaaaaaaatttaaggaaaataaaaatggtttaatttaaaaggaacaataaaagaaattaggaaaagccagaaaacccattgaatttcgcgaaaacaatgaatttttttagaggaaccgaaagcaccacatg

SEQ ID NO: 117738 - DNA, 216 bp, Heterodera glycines
  Promoter: Source sequence=SeqID_16145; Location=1254..1469; Strand=-; Gene=SeqID_47345
tttttttaaaattttttttattttcagcaacttcgaaacgagttcaacaactcggaaaatatggtggatatgttgcgtcgtcagttggaggacgaggtgctgctgcgcactgagctggagaatcgtctgcacaccgccaaagacgacttggattttgcgcgtcgcagtcacagcaaccaaattgaggagatacggcgcaagcgccaagtggaaatg

SEQ ID NO: 117739 - DNA, 363 bp, Heterodera glycines
  Promoter: Source sequence=SeqID_8184; Location=2203..2565; Strand=-; Gene=SeqID_67240
taatctgtaaaaaatcaataaattggcttgggtttcactgtgtgtttgaattggcgccctttgtatctttctctaaccactacactctcgtctatgtgtttgtggatgggcgtggcctatcgattaaaagggacagcccgtctggaggtcgctgcgcgctaaaacccctctcactatcaatcaataattacgtgttttttttcgcaggttcattttatgcttttaacaattataatcataaactattttttaatcgtaatggccccgagaaaaatcaatgatcaattggtgtttgagaacaaaagtaatcattttttgagttttttataataatttcaaattttttttaaatttaaagaaatg

SEQ ID NO: 117740 - DNA, 520 bp, Heterodera glycines
  Promoter: Source sequence=SeqID_35839; Location=1..520; Strand=+; Gene=SeqID_65304
tattaaacttaatttgtacgggtttatttttgttgtctttttagtttttgtaactcatgcgagcgattggtgagcaacatgtgggcagtataaaaggccataggagaaaattcattgttcacttcctcactcattggttttgatcaggtttcactttctcaatcattggacatcatttttctgatcagcgtttagccccatttctactgaccagggttcactctcaatcatttggtcccatttcttctgatcagtgtttatttcctcactcattgggtcccattaaaaaggcagttcaattgatcgctttctttccatttcttctgatcagtgctcatttcctcactcattttgaccaattttttctgttcaatcttcacttcagtcagatcactcactttcaattctttgttttctcttctttcccgctgatcactttcaattcctctgattttatcattttccaattatttggcccaatttcagtccgttccttccgctcactttcaatttcaaaatg

SEQ ID NO: 117741 - DNA, 331 bp, Heterodera glycines
  Promoter: Source sequence=SeqID_18825; Location=1689..2019; Strand=-; Gene=SeqID_83516
aattgatttgttttgattgattaatgcgattattatttgatccaattgttggacttgccatttaattgttgttgtatttgttttgcttagaaatccataaaaaacgagttaggctttaccaatacttagtacattcaaaaatcattacaggaaattgtttatttaatgacttctttcatttgattctcccaatttgtccgtcattaatcttgatccggaatcgtcagacacaacatttatcattttaacgggctaaattttgaattaccaattcattcattaactgtaataattagagtaaatttttttagttcgtcttttttaattcatg

SEQ ID NO: 117742 - DNA, 1003 bp, Heterodera glycines
  Promoter: Source sequence=SeqID_10509; Location=2773..3775; Strand=+; Gene=SeqID_73735
aataatttaaaattataatcaaaaaataataaataaataaatcccgctaaaataagaaataaaaatcaaaaacgaacaacattataacaaattgacttaaataatatataatacattgattttatattaaaacgattagacattggcatttaaattaaaaggaaagtgcatcatattatggaattattaataccatacactgatagtattttaagctttttgaattaattttatctataatatgctttaatttttatttaatttcataagtgttatgtcaaaaaaaataataaaaacaataaagtatttgtatttgtatggtgagaacaacatataaataaattaaatactacaaactaggccaatataaataagtaaattgaatttattttttttaattttaatttctattagctttgtactgcatgaatttaatgtgaacattttgacataagcaatttgataactaataaataaaaatatttaaaatatcataaacaacaatcgaacaatataacatgtaaaaatatttttatttaaatttttatatttgattactttacgaatacaaaaatcaattgaacatatctttcgctctctcctctctttctcttcctctctctctctagtatttatttttctctaatttctcattttcattttttccattttctcttactcaaaagaacaaaaaacaatcaaagaaactaaataaataaacggcaataacataatgcaagtgaagggcactctaataattcggcataatattttgattgaaattttttcctaataccccaaacgtttttttcctttataagtatatttcaggattttcagaaattccttaacacaaatacagtaataagttgtcttcttacaaattttaagaaacttatttttttaaaatttcatattaaaatcacttcaaattttacttttattaacttttttatttttcgtgcctttaagcatttgctaattgtaagttatttaggaaatg

SEQ ID NO: 117743 - DNA, 148 bp, Heterodera glycines
  Promoter: Source sequence=SeqID_31582; Location=790..937; Strand=-; Gene=SeqID_61912
tttattgaagaatgatgagtgggagcaaattgaagaactggttggggtgttaaaatgtgctgaagaagcaacaaaaaggttcactgccgagccaatttcatttgtcctccctcaagcacgggcactacatgatgagttgtacgaaatg

SEQ ID NO: 117744 - DNA, 272 bp, Heterodera glycines
  Promoter: Source sequence=SeqID_29826; Location=1..272; Strand=+; Gene=SeqID_60294
atgatcagcagtaatgaatggttaaagaatccacatgctcagcctccaaccattcaattgcaaactgtttcaattcatctgaaacaattccgtaaccaaaatggcaaaaccgatctgctggaagacaacaaaaaaggcgaacaattaatgggggaagtgatgaccatgagcagtttaatggggacaaataccacgggaaaaagggatgccatgggctgggcagtttaatgggacgagtgccacggaattccatgggcattcatttcggcatg

SEQ ID NO: 117745 - DNA, 1003 bp, Heterodera glycines
  misc_feature (127)..(127): n is a, c, g, or t
  Promoter: Source sequence=SeqID_714; Location=6..1008; Strand=+; Gene= SeqID_59591
cagtgtttgagtgttgttgttgtctccaattgtgatgacgtcatcatcattttgaggggaaaaattttcccgtttcgactcatccatttctttaaattaaaaaaatttaaaattattataaaaaacncaaaaaatgattacttttgttctcaaacaccaattgatcattgatttttctcggggccattacgattaagaaatagtttatgattataattgttaaaagcataaaatgaacctgcgaaaaaaaacacgtaattattgattgataatgagaggggtgttagcgcgcagcgacctccagacgggctgtcccttcttaatcgataggccacgccatccacaaacacatagacgagagagtagtggttagagaaagatacaaaagggcgccaattcaaacacacagtgaatccccaagccgatttatttattttttacagactatggtactccctctgactgccgccctatccaaattgctaagctgtaaacccgaaaatttatcagaatatttgaacaaccccgaggcggtgaacaaagcgaacgcctacctgtgtggcaaaaaactcaaaacaacctatcagggtcctgattgcaagaccaaagatgtcaaatttggcacattttcgctgaaacctgccgcggaaacctacgcctttgagggatttcttggcaagtttccgaaaattctgtttcggtccaacaccatgcgttcagatgtcaaagtccaacagtatttctacataaaacaccggattcgcctactgtaccctcagctcaagtgcattgttgagtaccacaacaagggccattgcaaatactacccattgggtacaaatttgtatccgaaaaaaataaaataaataaaccccattaagagttgttggccattgaggagggctgttagagtgcacccatcgaaaaacctgccgctgaaacggactatctggactacttgaactttcgcagtgggtggcaatcagcactctactgatcaatg

SEQ ID NO: 117746 - DNA, 69 bp, Heterodera glycines
  Promoter: Source sequence=SeqID_32867; Location=368..436; Strand=-; Gene=SeqID_46316
ctgcaatttttttcattttgccaaaataaaattttcacccccaatttgcaggatgtgaaagcgttgatg

SEQ ID NO: 117747 - DNA, 637 bp, Heterodera glycines
  Promoter: Source sequence=SeqID_2995; Location=1..637; Strand=+; Gene= SeqID_82690
attttcgctaggttagctggttaatttttttaaaatggctcaaaattaaaatactttttaaagagaaaacttaacaatctccgggccgccctcattttgtcagtgaaccccacccctcctcctccccccgaatatgagttttgtgaaagcaaagggataaggttatgtgttttctatttgtcaatctgatgaatatttgttacttttttgtcataattagcccatgacatttggaattcaaatcaaatttcaatgcctaaaaatactatcatatctaataatttactttaattatttattttacagactgagaaaaagcgcattttggcgctttctgccttcattttgttgttcatcggtctgctgttcattgcggccatgatttggaagcagtgatgatcgaccacacaacccacacacgacaaatttccattggcacgacacaaaaaaaacaacaacaaagcgaataatttaattaacataacatcgttgccattgtgtttaatttgtaatcgttggctaattgctttaatgttctttaatccatcttttttattataatttggttggggaataaacgatgcataattcacatttaattggagttcatgcctcggaaagttaatttgaaaaaatg

SEQ ID NO: 117748 - DNA, 289 bp, Heterodera glycines
  Promoter: Source sequence=SeqID_3769; Location=1539..1827; Strand=+; Gene=SeqID_51799
agtccaaacaatcgaagcacaactggacaatctacgcgacctctccaacaattggattgacctgctaaaccgcctcgaaggagcagaaaaagacaaaggcgagaaagaatacgtcaaattcgacacgtatgagaaaattgccgaacgccatgatgcagccacaaccaaactccgggatctgcgggatctcgaagcaacgctcagtgccgatgccaaactttaccgaggcagagcagaaagacaagcaagagcggatcagcaagcaaatccgccaccacaaacggcaatg

SEQ ID NO: 117749 - DNA, 880 bp, Heterodera glycines
  Promoter: Source sequence=SeqID_2132; Location=2682..3561; Strand=-; Gene=SeqID_78015
actgggacaaaactatgagagaattgcaatgattggagaagccacggaggaatttgttgcggggttgaaattgggcattttagaggcagaatttcagcacaaaatagccgcttttgctgacccgtgcatttacggcgaagcatttgccaaactttcggagcaaattgccaatgtgcaaagaatggaaaaatgcaacaacaaaaatgaatatccgataacagttgttgaattttgtccgtttggcacgggaacagtctgtgccgctgcagaaaaaaattgaacaaaaattggatgaaattttggagaaaacaaaacatgacttagagcaattaaaagaccgatataaagcaaaccaataggaggaaaaagagaaattgagtcaggttagaaactttaaaatgaaatttggattgggttatgaaattatctatcaatgaaaatttataaattaggtcgaattttttgaaaaacaagagctcagcaaggcctaaatggattttgtaactcattccaacctttcagaaggggttaaaattttgcaaaaaaaaatactaatttggagtttacactatgtaagcatgcatgctgtaaggcattcgagtttatgaattacaaaatgcaccattttttaaaattaagtatttcgtaaaaaaaattcacaccctattaataagcaaatataagtttatttattaatactcattagcagtctagtgatgccaaataacgagaaatagctcatattaaatgctaaaactttatatggcgagaatttaaaatttattcatattattccaattaaatgtgaaaatcttttttgtcctattatgcctaattttcggtgtccaatgggccataaaaaaattgtgcagcaggaatg

SEQ ID NO: 117750 - DNA, 642 bp, Heterodera glycines
  Promoter: Source sequence=SeqID_3587; Location=4072..4713; Strand=+; Gene=SeqID_50984
ataatttttgttttgataattttgtctcatgtttataacatttaatattttaaattaatcaaatttgtttcatttttttagaatgtcaaagaaaaatttccaagaaacttcaaaagaaatccgccgctcgaaaaatacaaaaaattatttcaaaaacagtcctaatttggaaaaatgtttcgaagaagtggagagtcacataaaggaaaataaaaaatttgggataaaagagcacgtgacaactttctattttaaatgccccgaaaatgaagatcccgaaaaaatgtttaaaaaaatcctgaaaaaattaatgggggatgcaatgagccgagaagctgagccgagctggaaaattgagaaaatttcagtggacctttattgcagtgccctgtcagacccagtgatcatccctgcccgccccttccaacaatcgaatccagacattgttttcaacgagttcatgcacaggcagcaatcatttggggaagtgaatttgttagaccagagaatttcaataattattgccacttattctttccctgttaaataaaatttttttcatttttccatttcattattttttgtttattacaataattatttattcgagtttttttctttattaatttttcagttaaaatg

SEQ ID NO: 117751 - DNA, 210 bp, Heterodera glycines
  Promoter: Source sequence=SeqID_12815; Location=1..210; Strand=+; Gene=SeqID_76541
ataatatgaaaaataaattcgataatcactgatcatttttaccgtttttttacttttgataaatttaaattattcatatatttcggcaatttttttttcgatgtttcaatttcgataattcattgtcacaattttgataattttttatacaattttaaaataatattatatcataattttcaacagtttgttcgcgattacattaaaatg

SEQ ID NO: 117752 - DNA, 185 bp, Heterodera glycines
  Promoter: Source sequence=SeqID_1381; Location=1246..1430; Strand=+; Gene=SeqID_73173
aaatttccagtctctatcaattagcaattaattgttggtaattaaaacaattaaagaggaaagggtatttttacgtaaaaaacccataatatgtcaaataaattgaatatatttaaacagcatgccaacttgtaaaattgatcacaaaatgcgcagctcccttccaaattttagaaaagcaaatg

SEQ ID NO: 117753 - DNA, 512 bp, Heterodera glycines
  Promoter: Source sequence=SeqID_20116; Location=1533..2044; Strand=-; Gene=SeqID_84906
ggtcagccctctttagggcctacaggtgaattgccatttagcgctcaacccaataacgtgccaacgcctggactaagggagggaggagggccatgatgtgcaacgttagggcacttccggtttccattgcattatgcgatgtgtcaactccaattattggaggaaaccaagtgcatgtcggctgacgcaaagaccctaacagactaaaacgcgcctaggtagcgaagctcaagaagcgcgcagcgctttccaagcgccaccctcgcatgcacacacccgctagtttatatactataaaatcaaatcgtgtttcgttgctaaaacaaaaatctccggaaccgctaatcggggggagctgaaatttggcatgcaggggtaacttttgacggcgcattcaggaaaactataggcattccggtccggcggccaactgagcgccagcggcgctgaaatggctttttgcttttttcaagagcctgtaaaactatgggttttggtctgatcgaaaaatg

SEQ ID NO: 117754 - DNA, 91 bp, Heterodera glycines; identical to SEQ ID NO: 100405
  Promoter: Source sequence=SeqID_44125; Location=1115..1205; Strand=+; Gene=SeqID_71660

SEQ ID NO: 117755 - DNA, 203 bp, Heterodera glycines
  Promoter: Source sequence=SeqID_39950; Location=919..1121; Strand=-; Gene=SeqID_68400
ttttctaagaaaaaataggagttttgggggctcggcggtgccgataggcgccgccggggaaaaaattggaaattttgatcatttataaacagtttttcactgaaaattagccaatttataggtaaaattttgaaaaattttatgggaatttaatccaattcttaggggtgtaaaagtcgcatttcgcgccaaaaagcgaaatg

SEQ ID NO: 117756 - DNA, 547 bp, Heterodera glycines
  Promoter: Source sequence=SeqID_21488; Location=1..547; Strand=+; Gene=SeqID_52101
acggcttgaagaacgatgaagccaagtcggagtcgtaagtcgtatgcaatcagtcgaaaagtcaaagttgaaaaccgatgatttataaaagacaatccgaagaaaaatgaagaacgtttttatttattggagagaagacaaaaaaccaaaaaaaaagcgagagagaagagagatgaataaaaaaaaacaataaaacataatcaaatttgaacacactaattaaccgcgaaatgtaatcgttttaaaattagtcaaattaatgcaattcccggcgcccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataacctttatattacccgttgcctaaccttaggcccatccgaataataaaaaactcaaattcgagacttggacatttcgtggcctggacattttgtgggtcagcgcaattcccagcacgaatttgacttcaaatg

SEQ ID NO: 117757 - DNA, 262 bp, Heterodera glycines
  Promoter: Source sequence=SeqID_1161; Location=9091..9352; Strand=+; Gene=SeqID_69071
ggtgtgtttgctcactcttttcaaagggaactctaagaattctgatatgccttcaaatctatcaaaagagttgcatactttctttttatcatttctctttattttctattttacacttgtatttttcatttgaatgtttattcagaaataaaattgaaaaatgtgtcattactaatattaaaaggtataaattaaccaaacaaaaaggtatttaaggagaaaaatagtcagggttttgtaactcaatttggaaattagaatg

SEQ ID NO: 117758 - DNA, 224 bp, Heterodera glycines
  Promoter: Source sequence=SeqID_6444; Location=426..649; Strand=-; Gene=SeqID_61593
ccttgagaggagagacaaaaaaacattggcaaaatgtcactatttttttttggatgggacaaaatctaagtgccaaaatttaaaaaaaatttcaaatttcgaaattttcaagaaaaaagttgttagttttttataagaaaatttaacaaaaaattttttgaaaattttttcaataaaatttcagtttgaaaattaaaaaaaaaaattttagaggcgagattatg

SEQ ID NO: 117759 - DNA, 482 bp, Heterodera glycines
  Promoter: Source sequence=SeqID_15928; Location=998..1479; Strand=-; Gene=SeqID_80279
tctaaaccaatcaataaaatttctagctgtataattcaaatcaagccttattttcaaggaatttttaaaagtttatttaggatttaaaattttggataaactgtagtgaacgccccgtgaaaaaagggtcaaatgatataccaaacgggggccctaattagtacggtgtctctatttgttaaattaaaaaataattcgtaaataattgtgtttcggccgttaaccacaaacccaaaagccaatgcaatcaagcaaagcaaagcaataaatttgagacttttccaagcatcatggtaagattgattaaattaatcaaattattttttaatttaacaaatatagacatcgtactgattagggtccccgtctcttttgctggatatttgcggttttcgtgaaactacgcggcatcttttagtgcttattttcgggttttacggcctaaatcctacctattttggcattttcagcctaaaaatatg

SEQ ID NO: 117760 - DNA, 115 bp, Heterodera glycines
  Promoter: Source sequence=SeqID_17494; Location=2188..2302; Strand=+; Gene=SeqID_81999
aattattggttcagtctcagctagagtgttgcgattcaaaaaactgttcccatacatgggaaaataaaggctttttgttaattctaaatttcagctacaaccatttttcaggatg

SEQ ID NO: 117761 - DNA, 359 bp, Heterodera glycines
  Promoter: Source sequence=SeqID_36978; Location=636..994; Strand=-; Gene=SeqID_66164
tcgattaaagagatgaggaaaagaatgataatgatgactattcgacctttatctaactaaggacaaatcttatatatcgagagattgccttaccttctaaatatttccaattttgatattgatacacaatttaaatatatttgaaatagatctgtaaatttatctgtgtattatataaaaaagaataggtgcccctatgcttatttactacggaaggtcttcctgatccctctgatcatattaaaagaacgacccctcggtgcaacgaccaaaggtgaaaaacggcgcaataactaattaaattatgaatactaatattcgtatattaacatttgaaatttccattattggtacaaatg

SEQ ID NO: 117762 - DNA, 1003 bp, Heterodera glycines
  Promoter: Source sequence=SeqID_432; Location=839..1841; Strand=+; Gene=SeqID_52620
tcacgagtgcatagcaattcgaaaaaccatttcaatacaattcgcatccacaatttatattaatactgttactcgaaatttttgagagttgagaccagagaatttaggattcgtgaccaaagtttggccaaaagagtacaagctagggatgtgcgagagtctcgattcccgactcgggaaatttctcgggttttcgcttttcggtctcgggtttttagtctcgaaaaccgagaattttttacaaaattcattaaaaatcacaaaaaaaaatcttgtctgcgcctctcggcgccgccggccttttgaaatagtgcgacgcaaaaaaagtcgttagttcgatgttgagactcctgcgcaaaaactcaaacaatttttgattttaaaaaatacattaaattaatttcattaagattctcggttctcgattgccgagtcgagaaatttctcgggttttttgggcctcgattctcgataaatcatttctcgcgcagccctagtccaacagcatttgcaaccttggtttaagatagaaaaagtaactattcgagtaactttatacacatatttggcatgacaagcagtattttcatgggttaagaaactgaatttttattgttgttgtaatcctttcaaagtttcatgaattatgttgtttgcaaatttacaggaaaactttcgcagcaagtaccgtatttactgaaatacagtctgttccaaaaccataaggtcactaaaatttttttaattaactgcatataacatttgttaacgtcagctaaattaaacattcttggtatcattcgatagcaataagttctctgttagctcacctaaattttagaaaaaatttcgtcaagttttaaataagttattgacaaaagtacttaaggaactaattgttccgacatttttggccaaaacttagccaaattttttgaaaaactattagggctagcgaattaaataagaattaaaaattttgtagctttggagcaaaattatg

SEQ ID NO: 117763 - DNA, 175 bp, Heterodera glycines
  Promoter: Source sequence=SeqID_24288; Location=1..175; Strand=+; Gene=SeqID_55006
tgccgataggcgtcgccaggaaatttttaagaatttcaattgaatttattaacagaaattgtacaaaaattactaatttttgaaaaaaaaatttaaaaaaatttccgtcttttttatcaaaaatttcggaattcggtgccatccctgctttggcactacatattgccattaaatg

SEQ ID NO: 117764 - DNA, 351 bp, Heterodera glycines
  misc_feature (32)..(32): n is a, c, g, or t
  misc_feature (99)..(99): n is a, c, g, or t
  Promoter: Source sequence=SeqID_31900; Location=1..351; Strand=+; Gene=SeqID_62207
aaaaaatttttccaaaatgctgattttgaccncaaatgatgaatgatttgttgtttgaaaaatgattattttgaaaattttcatctgacaaccttggtntaaagcttctatgatggagcttccatatccacatttttccatattccactatttatgttcatacttccatatttgtccatatttttgaatttttacaaaagtctctattagaacgacccccatcagctattggtctttttgaaccttaaacacggaaaaattttcaaaatcatttttttagtgtagtatacataaagttctaaaaataatccataaaaaggcgaggccacgctggacaccgcccgttccatg

SEQ ID NO: 117765 - DNA, 188 bp, Heterodera glycines
  misc_feature (61)..(61): n is a, c, g, or t
  Promoter: Source sequence=SeqID_15620; Location=1..188; Strand=+; Gene=SeqID_79908
aaaaaatattattagcttataaatataaaaaggaagtaaacaaattttagtattacatgancgaaaggaaaaattacatcacaattaattcgtggattgattatcatataattacaaacattaaacaacaggacattttaagattaaaaattttcaaaaattgttgacaaaaaattcttataggcatg

SEQ ID NO: 117766 - DNA, 243 bp, Heterodera glycines
  Promoter: Source sequence=SeqID_13017; Location=3306..3548; Strand=-; Gene=SeqID_47097
cgtccgatgtaaaaatgcttatatccgatttatgatgaacaaatattaactcgttgcctaaaaaccaatttagaagtttgggcgaaatacggcaagtttttcatgaatttcataaaaatcaatttatgactaatttcctctcccttctttaaagtctattatatgtaccctcaaattaaggcctaattgtgggagaaaaatttaataatttattttatttttgaagagcattgttcctgtatg

SEQ ID NO: 117767 - DNA, 268 bp, Heterodera glycines
  Promoter: Source sequence=SeqID_5286; Location=1..268; Strand=+; Gene= SeqID_57559
attactaacatacttaaccaataaccaaaattaatagtaataattaatgaaaagctttgaataataaatatttgaataaatttgtttattaaattaacaaataaagtatcttaacaagtgatgtgttaaggccgtgccaacgattaacccgaaattacattgaggagacaatacgactggacaaaacactaacacggcgctgacattggtcacagaccccaattgaggcaaatggcaagtctcggcggacacggaccacagccaaatg

SEQ ID NO: 117768 - DNA, 75 bp, Heterodera glycines
  Promoter: Source sequence=SeqID_27993; Location=1..75; Strand=+; Gene= SeqID_58656
ggggagggaggatggccattcatgggacgcataattccgactagaaccttctttattttaacttgcaaaataatg

SEQ ID NO: 117769 - DNA, 471 bp, Heterodera glycines
  Promoter: Source sequence=SeqID_11873; Location=1..471; Strand=+; Gene=SeqID_75381
cgcagaatgttgaccagctcaattggctgaggctccgtttggagcgcgcattggcacttttgttgcccgaatttggccccttccgttgtctgccggccacgggccaagccgaggaccaaaccaatgttggacgacaattgcacagcgcaatccggtaggaatgtaatgccaaaaatttgggggggggtccaagatttgtaatttttgggtttttggcatttattgcgttttctccaacaaaattcggtgctacaaaatggccaacatgtacacaaactctagaggaaaaattggcatcgctttcaaataaaaaaattttggaacttttttggcattaaaattgaaaataatgatacaaatgacctttaggccctttaagcccattgaaatttttttttaattttcatgccaaaatctcaaaaaattactcaattgccgctttaaacccgctttttgtccagccatggcatg

SEQ ID NO: 117770 - DNA, 455 bp, Heterodera glycines
  Promoter: Source sequence=SeqID_8010; Location=940..1394; Strand=-; Gene=SeqID_66678
tcagcggcattccgagtggcgttttttatttgagaaaattaaattgtttagatttgacaggccggcccaaagccaggaaaaaaagttttcagagggggggggggatttgaattttttttggccaaaaattcgtaaaaaaattatcccaatgttatttttaaaattttcagtgcttgctatttttcgtcaaaaaatgatgactaatgtctaagaactttcaaatgctaacaagtttttttttttggatttggacataaatgaaaaaataaatgtttacggattagtaattcataaatagggcattttggaatcccataattaaggatatgtatttcgctaattatttaaaatccagttacgtctccagccctggttttaattggaaataaaatatattcattaaaattcaaatctcaggtctacaagttgtgctcaaatccattctgtgtgcgatg

SEQ ID NO: 117771 - DNA, 164 bp, Heterodera glycines
  Promoter: Source sequence=SeqID_12354; Location=2734..2897; Strand=-; Gene=SeqID_75952
ataatgtgttgaacgaattccaagctcgacagaacccaattgacattctgatcagtgacggcggatgcgacgatgggtgaacaattttaaatgcttaatgattttatgagtccaatcgtcaacaattgcttagactttgtgctttcaattcgtatccaaaaatg

SEQ ID NO: 117772 - DNA, 401 bp, Heterodera glycines
  misc_feature (63)..(63): n is a, c, g, or t
  Promoter: Source sequence=SeqID_6112; Location=7801..8201; Strand=-; Gene=SeqID_60408
cttttggcatttaaattttggtttccttttgtgtacatattttgtcaggaaattcgttcaatntaatcaaaactatatatcttgtcaacattcgatcaatttaattttctcttattatttaatttttttcttttgtcacactgcatgtctctcttacgttacctcttgtactcatttatgctaacatcagccccttagtttaaagcaggcgcttgtacattgccccgccttctcgcacccatcggtcaataaatctttctctccatagccattcattttctgtttttcaccttgctcattttacgaatattcttgtcttccttctctcttaagatttaacaaaaattaattccaacaattcttttaactccttcgcccgcgggcaagaaacagaaaatatg

SEQ ID NO: 117773 - DNA, 169 bp, Heterodera glycines
  Promoter: Source sequence=SeqID_1110; Location=1..169; Strand=+; Gene= SeqID_67985
ttatggcgaaatgtctttaattcaaaatttcaagataaaactttggatttttgaaaaattatataatttaattcaacagagatttagaaaacctcgaaaatcctttatggcctcggaccaatgattcctagaatttataaaatttaatccataaaaatttttagaaatg

SEQ ID NO: 117774 - DNA, 201 bp, Heterodera glycines
  misc_feature (45)..(45): n is a, c, g, or t
  misc_feature (133)..(133): n is a, c, g, or t
  Promoter: Source sequence=SeqID_17112; Location=21..221; Strand=+; Gene=SeqID_81551
ttagcaaattagagaattattaagttaaagaaacggttagaaacnaataaggaaataatcagaaaaaatagataaataaacttggatatttcaaaattaccttgagcgaacgatgccaacctgaggaggaatntaataataaaaataaattttaataatatttttttcgccatcattcacctgtttccagccgtacaaatg

SEQ ID NO: 117775 - DNA, 1003 bp, Heterodera glycines
  Promoter: Source sequence=SeqID_2760; Location=670..1672; Strand=+; Gene=SeqID_81450
taattaaaacaaacgtttattttatttcatattttaccgaaaaatcattgattaatgacaaaataataacaactcaaaaaatgatggaaattttatcattagaaaagtgaatgtcatatttgcaaaattttattacagtttcttatagatttttatttacatattcttttaataaacaaaatgtataatttcgcagctgaaatttgtgagaaaatctgaaaaaaagtatagagagaaaaaaaccatcttttttaccattcattactcattatcaaaaattaaaaaaagaaaaaataacgaaaaaaaaatggaaaaaaaaataactttacataatattttttgactgaaaataaatttgaaataaatctttttgtttttaattaagatttagatattataaacaaattttttgttttaataatttctacaaaaaatttttttaataagtaaataataaaaaatatgttataaaacctcaaaattattttaattaataagcaataaatctatgtaaattaataaattcttgcttatctcctccgtccttcattgatcgcttgaaatcagccccaactgtcagcatccgagtcaatatcctgaattttttataattttttttactgataagatttttttcattgcttaaaatatcccttggctaacttaattgcaaaaaaagtatgctggtgtaaactaaaggttaattaattgctttttgaacaccgattttaatcgattgtctaatattgccagaaaataattatttaatctatttcttaatttgaaaaaaagcttttgtaaaataaattttaattattttaatgatttcaccatcatttagaaatgattttttggcaattgttaggcctttttattgttttattctgcttcttttgctccttctttgttgtcagttcactttgcgcaaatatgtcagaattggccaccaaaatgaagagaatagcaaaaaaagggacgaaaaaatgaggaaaacattgagatg

SEQ ID NO: 117776 - DNA, 350 bp, Heterodera glycines
  misc_feature (57)..(57): n is a, c, g, or t
  Promoter: Source sequence=SeqID_45502; Location=1..350; Strand=+; Gene=SeqID_72788
aaagatgctgtttgacgaaataaagggcatactttatttgaagaagtgtccaagacnatgcagcaataagcctgcaaaatctaataagtggaaaatacctgagtatagaatttattttcagaaagtgtcaacagacttttggaaaaatatatttgcaatttatcaacaattttgagaagtgagttagaaatgataaacttcacgattcaaaccaattttcgttgctctaattaaccgcgataaaaacattcgaatcaattaaatagcttctgagataataaggtttatcataaaatttcaagtaaaaataaaccctcaattattggtatgaacgatactttccaaacatg

SEQ ID NO: 117777 - DNA, 81 bp, Heterodera glycines
  Promoter: Source sequence=SeqID_22112; Location=1..81; Strand=+; Gene= SeqID_52764
actgaacgaagaaaactgaactgatgtctacagaataataaattttgaaattttacagttccatccggtgtgttaacaatg

SEQ ID NO: 117778 - DNA, 60 bp, Heterodera glycines
  misc_feature (35)..(35): n is a, c, g, or t
  Promoter: Source sequence=SeqID_19408; Location=1..60; Strand=+; Gene= SeqID_84134
atttcgtgaattgagaccctgaaaagctttaactnttggtttaaaataatgataataatg

SEQ ID NO: 117779 - DNA, 491 bp, Heterodera glycines
  Promoter: Source sequence=SeqID_7222; Location=390..880; Strand=+; Gene=SeqID_64185
ttatgtttgcatatgtatttacgtctatcctgcctttttgattgtttttggtgcacttcataaataaagagaatcagagcctaccattcactttgacgggcaaaacagaatatcgaattttctaaagaaatcatccaaaactttgagtattgtcaaggggtagtgtttatcttccgggtatttaactcgacttattcattcagcacatgtacattggtttaccaatcgagtagtgtgtagtaaaattaacgaaggagtagagagaaatgaagtcacatagaaattttttcattccgtcttcaaatccactcatttatttgttgctcattaacattttagcgatctcgtagcctaatacacttacaactggatggacaacttgacttcgtataaattcataacgttttacattcctctcccgcactttagcatttatttttttcaattagacattaatatacatcttctaggtagcgctaattgcaggcatg

SEQ ID NO: 117780 - DNA, 1003 bp, Heterodera glycines
  Promoter: Source sequence=SeqID_4294; Location=2847..3849; Strand=-; Gene=SeqID_53936
tcttacgcgccgcgcacatcaaaacgcctccttggcactgacgacaacggcacctcaccgaaaaaggtagaacaaggcttacagtcggaaattggatgtaaatttggtgccattggatcaaaattgaagggtaaatttttccaaaaattattcaaattcattaaattttaataaaatacatgtgaaacggttgtatacggtattaaaaattgtgtaggataaaaaagaaataaatataaaattaattatttctgtgaaaaccgaccaaaaacccaaattttctatttttaaacccttcgacccctcccccacactctaggccaaattggacggcgccgggctggcaaagaagagaccaatggccatatttgacacggagaaggaaccgttgcaaaaatcggatgggacggtggccacagagaaattggaggaggacgcggtggagactgaaccgttgcaaaagccggggaaggtaccacaatctgaaaaagcacacaagaaatgcatattataaaaaataaatttttttcaatagttaattaattgcgaattcaattgctttactgttgtagtgtttaagtggatattttgaattttaaatgcccacatttcccgcccattttactgcccataaatatggaattatttccccttcctttgctttttccaccattcatttgtcatttaatttatctgcatttattatttgtcctttgacctcccaattttctgttctttatttatttggaataaatcaatattccctttaactgttgctcggacacaacagtaaattggcgcagtcagcaaaaggaacaaagccagcataaaagcgacacaaacagcaatcaacatttacgaaaattgtttcgtgttaacaattttcgttgggaaattgaataagtctcgtgttgacttttcaatttcgcagattcgccgaaaaaccgaaacactcgtgttgtgtaaggttccgtgatatacggtttaaaacgtcgcagcgatg

SEQ ID NO: 117781 - DNA, 236 bp, Heterodera glycines
  Promoter: Source sequence=SeqID_31177; Location=1..236; Strand=+; Gene=SeqID_61554
ctcttaaaaaaattattcgcattaaaatattatttttccccccgcttgtaataactaagccagcgaaaaaatatgtaaaatcataaaattcagggctctatttatcatgcaccgataattaggacatagtttccactttgtgaattcctattctcattttagccgaaacagttatcgagtttctataaaagtttgaaacattgtccgcctcaactgctgacattggcaccttcatg

SEQ ID NO: 117782 - DNA, 110 bp, Heterodera glycines; identical to SEQ ID NO: 98226
  Promoter: Source sequence=SeqID_32190; Location=761..870; Strand=+; Gene=SeqID_62515

SEQ ID NO: 117783 - DNA, 489 bp, Heterodera glycines
  Promoter: Source sequence=SeqID_348; Location=2360..2848; Strand=+; Gene=SeqID_83555
aaatgaagctaatatggggggggggggtgtgtacaatgagtaaattgaaccctaaatcgtacacgccaaaacgtcgtcgccgccgtaacatcaccggaacgtggaattgtcgcttcaaaaaattagaaaaatttaaaaaaaaattaaaaaaactatctcttaaaattatttttcttaataggctaggtaacaaaattttgattttttttttcttatgttttttctaactatttttctaatattttgctgcgacgatgcgcccaggtgacgttttgtcccgctttgtcacaaaacataaccttgttgaaaaaactagcaattcccatcctgctgctggtcccatttacataatcaaaaataaattctaataataaatttatcatttaattttgttttcttttccctaactgaaaggatcaaattgtggacgaacacgacggaattgtaagcagcggagaacgacgaagccaatcggcgtccaccacaatg

SEQ ID NO: 117784 - DNA, 268 bp, Heterodera glycines
  Promoter: Source sequence=SeqID_21014; Location=808..1075; Strand=+; Gene=SeqID_51593
tatattatttatgttttttaaatacaataaatttatttaagcataaatggacaaaaatctcagataaaatactgcaaaattttctaaaccaaaaatagaaaatcaaaaaatttttagtgaaaaaggggaggggcttggaaaatatctttaacaatctcaaaataagctgttttaaaactaatattaaatttcattatatatgctcttattttatgaaataagctaaaatttttcaacccactgaaaaaggattttattttacaggatg

SEQ ID NO: 117785 - DNA, 59 bp, Heterodera glycines
  Promoter: Source sequence=SeqID_11679; Location=367..425; Strand=+; Gene=SeqID_75147
ttttttgtttattttttgacccattgaatttgttttgctcacccaattggtccaaaatg

SEQ ID NO: 117786 - DNA, 217 bp, Heterodera glycines
  Promoter: Source sequence=SeqID_9484; Location=3245..3461; Strand=-; Gene=SeqID_46766
acacattgtgcagcatgacgatggccaaggccggcacaggctggtgatcaacaacgccaagcccagagatgccggctcgtacacgtgcaaagcggtgaacgcagctggtcaagtggtcacgcaagccaaatttggcgtcattgaagcggtggaagtgccgaagttcagccaggagctgagaccgcttgacgtgaatgagggcgacaccggcacaatg

SEQ ID NO: 117787 - DNA, 423 bp, Heterodera glycines
  Promoter: Source sequence=SeqID_432; Location=8115..8537; Strand=-; Gene=SeqID_52621
ttcattcgcattggacatttttattattttattctcctccgtcgctgcactcctccgacctcatcaatttgtgcatttatttttatttgtgtttattaataaattgttgatacacaacaattttggcgcagtcagcagcagcagataaattctgcacatcatcaagccaaatcaaggctaattctgcaaaatcttcaagccaaatcaaggcatattctgcacaacctccaagccaaatcaaggcataattcagcaagcctaattttggcaattcaaaagcctgggcggctttcatcggacatcgacaaaaactgatcacctgggtggtgtaagttccgctgggtgcggtttctcatcaacaaaaactgatcacctggggggtgtaaagttccgctgggtgcggtttaatcaacaatcaaaatg

SEQ ID NO: 117788 - DNA, 1003 bp, Heterodera glycines
  Promoter: Source sequence=SeqID_7080; Location=215..1217; Strand=+; Gene=SeqID_63782
agaaaacctataaaagtgtttttgtgcgattttgagccgataccgtattcggcaattttaccaataactttgctgctgaatttgaatttgagacaagcaattatgtgccaggaaaacttaaacctatagaaagagacggaaattgtggatttcgtagtcagggatgcgatcgccaaaacccaaaaaccgggcgcgcgagttgaaaaacccggcaaaaattttcaaaaacccggcaaaaaacccggcaattttttaagccaattattcactgtaaaaaaggtcaataacatttaaacaatatatttatcaccacttttcacctgtttgaacaaatttggcattgaaagaatgtaaccatgagcgtttgggcacaaaatatttgaattaaatttgattgaaattaatgagtttaaccagggttgccagattaaaattttcaaaagcctcatttggtcggcaaaaaagcctcattttgggtcaaaaagcctcatttttacaaatttattcaaaacacattaaaaatgttcaaatattatatttttattttccatgatcaatttgagcaattttttgttagaaataagcattttgtgaaattcttagcacgaaaatcgaagttgattttttgcggcgcttttttctaaaaaaaacttggggaaaagggaggccggcggtgccgataggcgccgccgggaaaaattttgtgatttttaatacaatttgttaacagatttgaccacaaaaatgaccaaattttgcgattttgagcaaatttttaagaaaataaaggatccctggagctcaaataaatgaattgaaataggaaacccggcaaaaacccaaaaacccggcaaaaacccggcaacttcaaaaacccggcaaggacccccaaaacccggcaaatgccgggtttaccaggtaaaatcgcacccctgttcgtagtataagctgggcaattacgggatctgaagctaatcatgatgagattcgaaaggatgtaatg

SEQ ID NO: 117789 - DNA, 76 bp, Heterodera glycines
  Promoter: Source sequence=SeqID_19609; Location=1..76; Strand=+; Gene= SeqID_84350
gcgttactttaccaaagtgtttgcacaacagaagaaggaaggtggagatggttccggatctgcggaggagtcgatg

SEQ ID NO: 117790 - DNA, 238 bp, Heterodera glycines
  Promoter: Source sequence=SeqID_11068; Location=1336..1573; Strand=-; Gene=SeqID_74406
atttgatgccatcattttctctcagaaatgcttttgtaatacatttatttgcttgcttttaaatgaatgtttggttttatgacagacacagcaatatgtttcggattacaatgtaagagattatccgcaaagtttgtattaggcggccattcattttttctccagcttcttttccattttggggccaaagtttcaaattttttttttttgatcaacagcggacgagttgattacaatg

SEQ ID NO: 117791 - DNA, 1003 bp, Heterodera glycines
  Promoter: Source sequence=SeqID_25306; Location=697..1699; Strand=+; Gene=SeqID_56056
gtgtccaatcttagaaatgtaacaatgtttctgaatttgtcctatcgagtgttgtagtgacttaaaaattttaatatgagagtccttggactgaaatacacaaaaatttaattgtataaaaatcttgcaaatgaaaatatgaaataacatgtgggtctgagcgcatccattcgtcgaattatcggaatttaaatcttttagcgatcaattcctcgataaactcaattaagtacaatcccactgttacataagtttactattgattaaataacattaaaaaaaataaattaaactttactgtaaactagagaccggaaatttcaaatttgcggatcccgctgcgggatgggaatccaaaattttttgcgggacgggatcccacgggattaatcccgcaaatcccgcaatcccgcaaatcctgcatttaaaatttgcgagatcccgcgcgggattgcgggattttggataattcgaaaaatttcaattaaatttcaaaaaatttccaaaaatcaaaaaatacctgaagtttttaaaaataaatttttaggggctggcgggatgcattaaaaggggcgaccaagatttttcgaatggatcagacggtaaaaagagatcaggaatcaaatctgttaatggtccaaaaatttgactattttttgcttttcaaaacccttttttcggcgcaattttttcaaaactaggaacaaaggggtccggcggtgccgataggcgccgccggaatttttttttttattttttttgaaaattttgtcaatttcttaactgattttgtccaaaaaatgaccaaatgtcgcactttttgactcgtatctacaggattaataagtaaaagccgatccgacgggccgatagacgccgccgggaaatttttttgcaaatcctagatgaaatttgagatgaaaattgaatttattttgattgattttattataaatttattcaaaaattttggcattccgtcttttaaaattttcaaagaatg

SEQ ID NO: 117792 - DNA, 71 bp, Heterodera glycines
  Promoter: Source sequence=SeqID_36112; Location=1..71; Strand=+; Gene= SeqID_65522
attgaagtttgttcacagaatttgtgcaaaataaattccgatatatttttatgttttgagacttgatcatg

SEQ ID NO: 117793 - DNA, 115 bp, Heterodera glycines
  Promoter: Source sequence=SeqID_7503; Location=2553..2667; Strand=+; Gene=SeqID_65032
aattcaaataaaaaaataatgaattcattatcaatgccgacaagtcaaaaaatgtccaattcattacgaacttatggccataacagccttttgtacaattttcagacttacaatg

SEQ ID NO: 117794 - DNA, 332 bp, Heterodera glycines
  Promoter: Source sequence=SeqID_15293; Location=1082..1413; Strand=-; Gene=SeqID_79516
tcataggagaactgaataaatcaaataaaattcataatcagcaattaaaatatccaaatttttctaaaattttttaaactgtttagttcatgccggaaaaaatggaaacataaaataaagaattttaaaaaatgacataatgcttacaattaaatatcatacccaaataaacaatttacattataaaattgtttaaagaatttttttttttttttgaaaaatgatattgtactacatatgctaaaatttgtaaaaagttctcataatgatattcattaacctttcccataactttgccacacaaatggcttcaattaacaccagttcaaatg

SEQ ID NO: 117795 - DNA, 70 bp, Heterodera glycines
  Promoter: Source sequence=SeqID_23380; Location=787..856; Strand=-; Gene=SeqID_54090
cctcgaaattaaaaaaatatatattttaatcgtccaacgaattttgtcctttagaataaaggaggaaatg

SEQ ID NO: 117796 - DNA, 223 bp, Heterodera glycines
  Promoter: Source sequence=SeqID_320; Location=3402..3624; Strand=+; Gene=SeqID_82137
atgagccgaaggattggcatcagtctgttcaatgccgaaagatcggtcagtgtgtgaaatttcaacaattttcttatctaattgttgtgctaataatgcctctaaagtgccttaatagctaatgatgcattactgccttaggcaatatcattacctataattagctaattagttcatacgcacatttgcccaattttcccttttttctctgctaaaacatatg

SEQ ID NO: 117797 - DNA, 770 bp, Heterodera glycines
  Promoter: Source sequence=SeqID_2701; Location=1..770; Strand=+; Gene= SeqID_81162
aaacaattattaataaattcgataaattgtttttcccttttttcttaaagtcaaataattcaacccttcacttttttattggatttttttgcctaatgttagccatttttgtgatgacatctgattgatgaatcactaaaccaaacattactgctcagaataattaattccaaatagttttggttactaaaagaaaaaaataaaattgaaattttgaactataaattaattaattaaaaaaataatttaaatgtttttgaatgacaatgtaaagttatgaataacacatttgtcaccccagtagttagccccgtattttttggcccctaaagttcgagtcctcttgactgcaaatcattttttgggaattaaatttttggtgcattttaatgggtctggggagtgtttttcttctatgtccgcttggctgcaacaattttttagtaatcaaaccaaaaggttttggtgtatttttaatgggtctggggagttttttttgctgtaactcatttttttgaattaaatcctaaggtctagggcatttttttaaaatgcaatccattggttttggtgtgtataaaaatgacaataaattttttcccatgtcaaaacctattgttttttgttcatccatgaccggcccattctacagtacgggtacaaatgtccaaaataatacatctcgaactcggtgatgtcataattttacagtggagcgttaattattttcacaaataaattatgaatgtattttaatttatttttagatg

SEQ ID NO: 117798 - DNA, 118 bp, Heterodera glycines
  Promoter: Source sequence=SeqID_6613; Location=215..332; Strand=-; Gene=SeqID_62202
aaaaattcaaacgcatatattattaaccacaatttaagttttcaaagcaatttcaaaattcagccgtctcctcctttgggtccatccgtcaattgagcgacaattggtggccgaaatg

SEQ ID NO: 117799 - DNA, 651 bp, Heterodera glycines
  Promoter: Source sequence=SeqID_40986; Location=559..1209; Strand=-; Gene=SeqID_69204
tgtcccccgatttgtggttttagcctttaaaattacaattttttgaggaaaagatttattaaaaggaaaagcattatttgggggttttcgaatctaagtttaatgttagaatttgagtaaaataaatccgaaaacccatagaaagactcttttaccatttgtttcaattttttgcattatcataaatttttgattaattcttaaaaaattgactacaaacgaaaaatttacggttagattttgtcaattgtattggtaggtctggttattattttaaatttcttcaattaaaaatgtcaattaggtgttaattatttaacaattaatttgatatcttcaaattgacttcttttgttacaataaaaaaagaatgcatagaattaaattaaactatttatattattttgaggaaaaaataaattaacataaattccattatgcaatgattgctcttcacatttcacatagttttccacatatcacacgacaagcgagaaactatctgtgctaaccaaataaatattctgttttcagtaatgtcaattcattggaattctttttataaaataaaataatataataaacaaaataaaaataaaattaattttatttgttttacagttaaaacaaccaacaatcgtattcattatg

SEQ ID NO: 117800 - DNA, 491 bp, Heterodera glycines
  Promoter: Source sequence=SeqID_9868; Location=1..491; Strand=+; Gene= SeqID_72897
ataggacggaaaagcaaaaagagccgcctttttgtagggctcaccgcgcgaaaaagcgcagaattgaaatgaaaaaagtgataatacaaaagaaggaacggaaaacaacagaagaagcggcaaggggtggtggaaacggacaacaaaaacaagaagaatgccaaagagtgaattaccaatgaaaaacaatgggggagggcacgggggaaggggaaaggggtgccaatctcagcgaaggaaaagcagtcctaaggctttgtaaaaatttaaaagtgtcccttttttgaatatcccagccgagtccaatgatcagcagagcgctttttttaatttatattaaaaataaatttgttatatttgaaagttaattttgatagattgaagaagcagcagaagcatacgaaagttgggcacaagcagtgccaaatccattaactgctgatgattccgaggcatcggtcagctccaattcactgggagaaaaacaaatg

SEQ ID NO: 117801 - DNA, 80 bp, Heterodera glycines
  Promoter: Source sequence=SeqID_22455; Location=1..80; Strand=+; Gene= SeqID_53126
ccggggatctctagagtcttattatttcaaagtggtgaccgcttacaaggccattccattggaaacgtttgtgaaaaatg

SEQ ID NO: 117802 - DNA, 1003 bp, Heterodera glycines
  Promoter: Source sequence=SeqID_7518; Location=389..1391; Strand=-; Gene=SeqID_65092
aggcaaccaaatgctaaataaataatcaaaaaatttgcaaattaattgaaaatagagaaaatgatgacaaaacagatgaataaataatttttggcaaatgataattctattttagtattttttaaagaatcatctcattgaaaatttggaaatatcctaaaataaattgtaaaatgataatatcaataattgcttctattaatttgtgagaagtcgattgggaagtgtatcggtttctagttttgattaaatattgataattttcgtaattctgaaagaggcaaaaaatgaattgatttactgagaaaggcatataaattaattggtgtgaatcatttgttttttaactttgttaattgctgtgcattttaaactagcttggccttggtttggtttttcgtgctttgcaacaattaaaattaccttttcttttgagtggaggacttaagtgagttcaaaagtttcactaaagcgtttttttatatatttcatttttcttttttatgttatttttgtagtaattattaatctctccgacaaaatcatatctgactagcaataagaaatataatttttatttttaaattaattaagtttaaccagtttaaatttttcaatttgtcagtcattattgtttaattttttcgatttgttgacacaactgcgcttccatttattcgtttcggctttcatttaggccaataattaaattgtgttaatcatttttgtcagttttaatcctaaaattttccattttatttcgtaaccaaatgtaattaacttttattcaaaaaattaattttttattaattaatagatcaaaatgaattttaaatctttttcaatttattttcttctgccaactttattctttgcaagtgttggcgccgattggaccaatttttgggaaggattgaaaaataaattcacgggcggtggcggtgcaaattctgcgcgtatatttttaaaattttttaatttatttattttgctttaagcaatg

SEQ ID NO: 117803 - DNA, 128 bp, Heterodera glycines
  Promoter: Source sequence=SeqID_7316; Location=1175..1302; Strand=+; Gene=SeqID_64444
aacaaagacaaaaaaccaaaaattgaagataaattaaatggatataaaaggaataagaaaaagcctattttttaccttaattatttttctccatccattttaacccaaataaaatattcacaataatg

SEQ ID NO: 117804 - DNA, 271 bp, Heterodera glycines
  Promoter: Source sequence=SeqID_12769; Location=434..704; Strand=-; Gene=SeqID_76478
cctggaaaattgttacaaagaaatgtggatgattaattagtggctggtaatttattttccaaaataatgattggggatttttcaaggtatttttggccaatgatttttttttacgatttcattttttgatcagtcaaaaaattcgatttatctccgcctaataaaaaaaggtttcattgtcaatgaaaaacaagacaaatttgtgaaattcaaggacaatattcaaaaaagcatcgcaaatcaaaaaaaaaccaattttaatttttagatg

SEQ ID NO: 117805 - DNA, 128 bp, Heterodera glycines
  Promoter: Source sequence=SeqID_21202; Location=1481..1608; Strand=-; Gene=SeqID_51791
gacaatgccagagatttcaatggcctgaccgacacgaatagggtacatgggcagcagtcgccgcaaccggggaaggctccagggctagagctgaaaccggtgtcaaccgagaggaaggcagtggtatg

SEQ ID NO: 117806 - DNA, 495 bp, Heterodera glycines
  Promoter: Source sequence=SeqID_23164; Location=818..1312; Strand=-; Gene=SeqID_53868
aaggataagtgacttttgaatttgaccaccataaaatatttatatttttaaaattataaaaattttcatcagaaattgtattaaattattcaactaaaaatgcattcgaattcactgcttttttaccttttttctctgtttaccattgccttgcaaatgccttcgccttttttgccgggtgtcggcccgggacagtcctacggtttattattaaataaaactaaatcaattaaacagaattttaataaccaaggcaactgtcctcccggtctctttgcggatgggggttcgtttaagcttcaaaattttaatatgtttttttaattttttggcattttgtagcatgcgcaacccttcacgtttgtatcgacccatatgagcgctgtataaatgggatttgttgtaagtgattattatgagtttattttttgcaaaattaatttaatgaatttataatttatattttcccataaattttttttaggccaagaaatg

SEQ ID NO: 117807 - DNA, 478 bp, Heterodera glycines
  misc_feature (57)..(57): n is a, c, g, or t
  Promoter: Source sequence=SeqID_30557; Location=1..478; Strand=+; Gene=SeqID_60971
aaatattttttatggataataatagaaaaaaactgggcgttctgtcacatttacttnttatctttatttctctcacttttacgtactatctcttcattcttaataatgtaaagaacaacatttacttcatcctgtttaactgttttcctacttgttaaatccacaccaaattttacatatcgatagagaaaaaaattctgcatcgattaatgcaaaaagtatttttgtttatgcgctccgatccaaaatttacatactcaaaattagtaaattttatttttaatagattttatggctaaaagaaaattaataagtaagctgcaaaataaaaaagcggcacaaaagcggtggcaaaagcaagatctgagaaaagcgcaaacggccaaggcgagacaagcttatctggccaaaaaagtgagtttttcaactgattttaaggtcaaaaacacaatcaccacgccgcgacaacattttcatg

SEQ ID NO: 117808 - DNA, 137 bp, Heterodera glycines
  Promoter: Source sequence=SeqID_15512; Location=1..137; Strand=+; Gene=SeqID_79788
ttgcttcatcaatttgtaagtttccacaattcatttgtcattcttgtctgctcacccgttcaatttaatttttgttttttctcctttaaaactttcaactatttaacaaaaaaatttcaggccaattgctgttgatg

SEQ ID NO: 117809 - DNA, 130 bp, Heterodera glycines
  Promoter: Source sequence=SeqID_915; Location=1199..1328; Strand=-; Gene=SeqID_63920
attttgctttggcaagtaaaagttcagaaagaggggttaaaaaaatatatataaataaataaaacagttttaatttaataagaaaataaggaaacaaataaaattattagtgtcgtatccattcagcatg

SEQ ID NO: 117810 - DNA, 208 bp, Heterodera glycines
  Promoter: Source sequence=SeqID_13685; Location=3692..3899; Strand=+; Gene=SeqID_77598
aagccgggacggctcatcaaaattcgtcaaaagccggatcggctcagcaaaaattcgacaaaagccgggttggctcgtcaattccgtcaaaaagcagacaaaagactgcttattcttctaaagccgggtcggctcgccaaaattcaacaaaagccgggtcggctcgacaaattcttcaaaagccggattgtctaaacaatagacgatg

SEQ ID NO: 117811 - DNA, 1003 bp, Heterodera glycines
  Promoter: Source sequence=SeqID_12960; Location=544..1546; Strand=+; Gene=SeqID_76718
tttattgaaaaaaaattaacatgtgtgaaatataattaaggtatttttaccgaatcaaatattgcattttctcatttttattgataaataatttagtaattattcttgaatctccgcaattcggagcctgtttatacagtagcaatttcgtaaaaaatttaggtttttgttttttaaataatggttacttgggccgggaaataaattgtggaagattttgccggtagatcaagtctataggctaaagaacgctgaaccctaaattatgaatgatcccgcgtgagaagtaaatgattaatgaatcatacagtaattttttaacttttatttttgtgttaagccttggaaaagctaaattgtaattaaataaaaattatagaaattaaacgaacaatttgctaaaattacaagcgaaatttgccgaggtaattagtggcaatactaattatttaattaaattagtaatttaattgttcctttccaccacttttcgaactcgtaaatgaagatggttgctccgccgtcttcaagcagaacaatttgatgttgtacttgccgaactttacaaccagtgtccctcggcacttttccatcgaattggcgccaaaacaaaacttggcactgtagcggtgccgttgtatcaaacggttgtccgtccctttggcatcccaacgctgagcagttacgtgacaagtgagtgaaagtgccaaaggggggaaggcatttaattcattaatttaatcatttgattaattataatttagaaaatagagtgtcgaaaactaaatttcaattttaattcattggattttaaaaaatcataagagaaactcactgaattttttcgttaaaatttaatgttaattttttaaaacatttttttattacacatatatcattaactaattttgacatttgtttaaaacaattaaagctaaaagctgaattaaaaataatttacaaaaaaggtttattcacgccattgaatggaggtcacaaaatg

SEQ ID NO: 117812 - DNA, 105 bp, Heterodera glycines
  Promoter: Source sequence=SeqID_10178; Location=3318..3422; Strand=-; Gene=SeqID_73282
agaagatggtggtgcccaagcgcgcggcaacaagtgcggagagtactcgggcagtgccgacaatgccgacgcctcagggggatggcctacccccttcccacaatg

SEQ ID NO: 117813 - DNA, 1003 bp, Heterodera glycines
  Promoter: Source sequence=SeqID_18201; Location=60..1062; Strand=+; Gene=SeqID_82798
tttttactcccgtttttgggtaaaaatttccgggagcaggagcgggatcggagtttcaaatttccgggacgggagtcccgaacgggattcccgtaaaaatcccgctcccgttaaaaatcccgttcaccgaaaaaagcgggagtcgggagcggaactcccgtaaaatcccgcgggagtcccgatcccgccggactctacaaaatagcagagaaatttgaagaatatgaaaggacagaatgccaaaaatatcgcaaatatttggacattttgtacgaatatttgtacagagaatacgtcggaattccaacagtgaagcccaaatttgggtttaaaaatgaaattgaaattgaaggaccaataatttatgcgataaattgcctgaaaagaatttcggatttttattgctggaataaaagtgtaggcaaattagatggtttgttcatttttaattttgaaccaaaattattgaatcatgggcgattaaattatgaattaaaattgaaaaatgaacaaaaaatgccaattaatgaaatgattttacaattacacagcgaataaatgccaaacaaatgaaaatttagacggaataattcgacaaaatttaacaacaatttggaagaaatgcttaaaaaatcggaagaaaggacaaaagatgcttatttttggagtttctataaaataatcagggccaacattttttaaatttgggttcgaaattcaatgattcagatcattgggtgatcttttattaaataaattattattttttttaaataaaatcaaatttaacttgagcacgctttattttcggaatttgtgaagagattatcgacaaattttgagaatttttttaagctaattgaaggaatcgataaatttgaaaacgtgaaaaagcatttggtgcaacaatatgtggaacttcttggcgttgtgtatttgtgcgaaagaattggcaatgttactatattttgaatcaattaaatgcatatgaattggaacaatg

SEQ ID NO: 117814 - DNA, 125 bp, Heterodera glycines; identical to SEQ ID NO: 115020
  Promoter: Source sequence=SeqID_21628; Location=680..804; Strand=+; Gene=SeqID_52228

SEQ ID NO: 117815 - DNA, 325 bp, Heterodera glycines
  Promoter: Source sequence=SeqID_8706; Location=1..325; Strand=+; Gene= SeqID_68909
tcacatcatcatcaatttgcggtggtttttgtcactcaaaatttatttgagcgaaaaatcaaagttgctcgtctgtccgcccaatacctcgtactgatgcgtgcccctaactccctgttgtctatacgcaatatcggagtacagcttttcccgcgtcagcttgactttttccttgacgcttatcgcaaagcgacagcgcgtccctatggctatttgctgattgacatgcacgcttcgtctgatcccgcgttgcggcttaggacaaatatatttaaggatgaacaagacgaggatgagggaacagtggtgttcattcccaaaaatg

SEQ ID NO: 117816 - DNA, 905 bp, Heterodera glycines
  Promoter: Source sequence=SeqID_1556; Location=867..1771; Strand=+; Gene=SeqID_46928
ttattattattattattattattattattattattattattattattattattattattattattattattattattattattattattattattattattattcaggatccatgtttcgcgcttgtgaactgtatattgtttatttctttctttgatagatttacgtagtaataaaagaaatcataaactattgagtattcggaaaaaaaacagttttcacgcctaaaatcaattaatttcattattaaaagagtaaaaatcttttaaaatttatttacaatattttttctttaaaaataatttttaagcggaatttgaaattctttaatattttcgtctttaaattcaattatttttccctatttagcatcaaaaaataagggaaatataaaaagaaaataataattctgtacatattgtcgttcctattttcgtttgatttgcctaaggaaaaaattctcaaaatttgataagcaaaatgataatttaagaaatgaatataattcttacaaaaataatttttcctataaatttttattgtaattcggctaattggttttggattttctttaatttcttcgtcttaaaattcaattatttttctcctttcacaaaataaaaatttaaattattaaaaagataaataaagagaaaattattgtatagaaaattaattctgtgttgtctttcctatttttgcttgatttagccaacgaaaattttttcaaataataatttaaggggttgaatatgtttttctgaataaattatagcaattaactgttgaaggaaagaatgatgaattcggaaggtataaaaattggtgccaaattaacattagccatacatttttttgattcatgaatttataaaataaatttcaaataaacagctttagaaatg

SEQ ID NO: 117817 - DNA, 391 bp, Heterodera glycines
  Promoter: Source sequence=SeqID_2936; Location=1332..1722; Strand=+; Gene=SeqID_82430
tagtaaagacaaattgaaaggtatatcgattgaatacggagtgtgaatcgctaacaatcggtttaataaaaacgataataaatggacaaactgggggaggcactccccttttgccatagttaaagtggcttttgttaatgctaaaaaattaccaaaacttttgaattagcggagttttggcgtaatgcagcagtttcctgcaattgaatacctaacaggtttctgttggtcagacattaaaataacaggctttttccaccttaatcaattgtacgcaataaaagtctattggatgcataaactgaaaatactatcatagtgtccaaacttcccggttctaaaattacagtcgttgttttattaatataataattgttattttattcaaatg

SEQ ID NO: 117818 - DNA, 417 bp, Heterodera glycines
  Promoter: Source sequence=SeqID_5590; Location=3424..3840; Strand=+; Gene=SeqID_58574
atttacctaattgattcataattaagctttcaattttatttttaattgcttctgtccccataggttatttggacagccaccaaatgattggactaatcgcgccaagaaaccggccaaagttcagaagcttcgtcattgccttaaaacactgggcaaaacgtgaatttaatttattcaaatttttgaaataaataattaataattttgtttaggatcgcatatttatggcaatgttttcggctttttcaccggtgcaattttgtccgttttggcagcaaaagtcattttatggtatccgaacgcatcgcttcctttcttattccaaaagttcatgctgctcttctccacttggtgctttatttatttatccaattccaattaattttttttcactatttgtaaaggaattggccaatg

SEQ ID NO: 117819 - DNA, 744 bp, Heterodera glycines
  Promoter: Source sequence=SeqID_28552; Location=521..1264; Strand=-; Gene=SeqID_59156
acaaagtctaaagtagctaaaatatataaaatctcaaccccaacatgattacgaaaaaagatctgattaatcaagtaattgcctattattttcggttgtaacttctttaaatgtttatcattattcagactgtgtgctttcgaatgataccaaaaacatagggtttgttcgaacatgaacaaagttattgtataacaacccagggattgtcaattggactcataaaactcaattggactcataaagtgcactagagccatattttgtttttgtttgttgtttatgaaaggttttagcaaaaggcactagaatacttaaccaactaacttaattttggtcatttgaatgattattaaaaatattttatattaaggaaaaaaatttttaaacctaacattttttatcaagtaccatctatgttttctgaaaatttttcaggtcatttcgggtgtattttcccgattttattgcatttttaaatgggatttttcggaaaaatgccaaaaaggcaccaaaatagcaaaatgccaaaaaggcattaaaggcacgaaaatcttgaaaaaggcataatacaactcagccggtcgcttaagatgtgaatttatgttcaaaattgtttaaaaaaacctcatataccaagctaatatatccacattatccgtttaaaatgaatttaattcctaattctcattttttgattctttagtaaaattcttgcatttttttcgtctctacctaatcatg

SEQ ID NO: 117820 - DNA, 75 bp, Heterodera glycines
  Promoter: Source sequence=SeqID_4422; Location=482..556; Strand=+; Gene=SeqID_54391
tttcattgcacaacaaataatttggacaaattttccgccattttacagcaaaaacatttacttttataccaaatg

SEQ ID NO: 117821 - DNA, 461 bp, Heterodera glycines
  Promoter: Source sequence=SeqID_13988; Location=2325..2785; Strand=-; Gene=SeqID_77951
aatttttttttcttattcaagacccacgccgttgccttttgtcgtattgtttctgctgcccacccgcgcaagttggttatggtcgcgtccggttgagaaaagcgtgcacttctcggtaaatgagcaaataaatacgaaaatttcattcaaaaacttgtttttgacttatcatgaaaaatgggtccaaaaaaaaatcaattatttaaatcttggacagaattttgagaataattaatgtcctgttttgccaagtagcaccggtgtataaaattagttttttttcaaaatttaattttattattttttttttgttccaatagctttgcatcggcccacccttcccgaacgtgacccttgacaaaaaacggagtatttttcggatgccagacggatcatcgattacgtgttggtctacgaggagaaggaaatgacgaacagcaactacaacaacaattgcgatg

SEQ ID NO: 117822 - DNA, 51 bp, Heterodera glycines
  Promoter: Source sequence=SeqID_2254; Location=3738..3788; Strand=-; Gene=SeqID_78754
tcctgatcagttttaccatgatcattttggtatttgttacagattgaaatg

SEQ ID NO: 117823 - DNA, 1003 bp, Heterodera glycines
  Promoter: Source sequence=SeqID_18435; Location=151..1153; Strand=+; Gene=SeqID_83034
taacagacgatggcataattagtttcacttatcattgagctgtttcggttttacctcggatttgagatcaaatttaaatgcattcccaaagctcggattatttgggcagttaagaaatttcggagaatgccaaagtgttgttttgctgtgctgattggctgattcaccttcccatttgttgtgttatcgccctaactgatgaccttccatttcattcttccacgcttaaacgatgttttcgtcctttgatgggccttttgtcgccacaacgaatcattagagagtttagagagtgagtgaagtggtcatcagtcagtgtgtctccctctaacttctcctcccctcccctcgtctcccctttccctccccctcttttttgccctctttcccttcgtctcccgctttcgctcccctctgatgccccccccccctacgtttccccttttccactccccttcggctcctgcccctgtctcccctttcgttgctccctttactctcgaagccccccccctctcccttcgcccccctccaaaatcgaatttgatttcgtttacttggcgcattccccagaggttttccgctgttttggccgtcacctttcgcccaaggcgcggaaatgtgtcatcatcagtcggcggaaccattcccgagacggggaaatcgcaagagcaccccaaagacgggggaaagaagcgatttctgagaaaataatcatccgaagagattcttttgtaacgcaataaaaagtcggtcactcattcactgactcttgtctttttgtcttttgtgctgcgatgtctcaaaatgaaaatcaccaaaagcggctaatgcccttcccctttcattcgttcgttaattagcctttttctgtttgttaattagcactttttccgttaatttcccctattttccccccaaatttccatgtttatcatttcatttatatcacagttttttattattttcttccttcacattccatcccccaaaggaggcaatg

SEQ ID NO: 117824 - DNA, 177 bp, Heterodera glycines
  Promoter: Source sequence=SeqID_506; Location=3700..3876; Strand=+; Gene=SeqID_54753
tgtgtcgtcgtcgcaaaagtgaagaaaatatgaatgtgtgtagagggattgaaaacaaatggcaggagtcatcaaaatgtgagccttttatacgcaaattctgctgggcactgcagcacccaaaatgtcgccggatgaatctttttggttttgggatgtataaaaggagggaaaatg

SEQ ID NO: 117825 - DNA, 218 bp, Heterodera glycines
  Promoter: Source sequence=SeqID_5384; Location=2803..3020; Strand=-; Gene=SeqID_57845
ttccgagaaaagatggccaacccaagcgattgcattgcgaagatcacaacgaacaaacgaacactgattggatcaacaatttcaaggaggtgtggccataatctcgaaaaatcactgatttttgttttcaaattgtttagcattttcttcgtgccaatgccatttcttccgtcagttacgaaattcatttttctgttcatgtgccgtcaatacaaatg

SEQ ID NO: 117826 - DNA, 287 bp, Heterodera glycines
  Promoter: Source sequence=SeqID_26616; Location=858..1144; Strand=-; Gene=SeqID_57358
ggttttattttatttattttttattatttccatttttatcgcattgacaattcaacataatctaaatttatttatccaagcagagaattttgtctgtccatcttacatgaaaaaaatttttttttttttttttttggttttttaaacacttcttattagtattttttacgctgaaaagtataaagttttggaattaaaaaaactcaaaaaaatttagataatttttttttattttactgatttttgtgtgcatgcttttgcagctgtacttgcgcttcaaagacatg

SEQ ID NO: 117827 - DNA, 765 bp, Heterodera glycines
  misc_feature (354)..(354): n is a, c, g, or t
  misc_feature (356)..(356): n is a, c, g, or t
  Promoter: Source sequence=SeqID_17257; Location=1..765; Strand=+; Gene=SeqID_81724
tgttgtgttcgttaattatttgaattaacgccaaaagatgctcgtttatcgatcattattttgaccccttcgttcagtccatttaaacccgcccttttcccccatccgtgcatttcttcctcatttcatttgttgtatttccaatattattgtgaccccgctctctcccctcgctttttatattatatttatttgtgttgaaataaatcaatatttatttcattgactgttgacggacacaacaaaattttttcactattacacaaattatttattatcaaaatttaacaaactgtctggcaaataattttgctttaatatgactatagacatataaacccataacaaaaaacncncgccgtgcagattaaaatatttctttaaaaaagtaatattaagcctagcattaaatatttaacaattttgcaaaaatttatttaaaataaaaaatgctaatcaataatcttcaatttagccaaaaatatatttttatttccttgttaatattgactgatttatttttacattatatgcaaaaaataatatgaatatggaatatgctgaaaattctcttttttatataaaatcatttatatatatatatctctttttattttatactttttatatttttgggtttccgcctctgaaaatattagttcgacttaatttcagctttaatattcctaaaatataaaaaatctattttttttgaaagtgagtgaatttcatttattatttcattatagaagagtgaacaaaatg

SEQ ID NO: 117828 - DNA, 623 bp, Heterodera glycines
  Promoter: Source sequence=SeqID_26026; Location=1..623; Strand=+; Gene=SeqID_56774
cttaataaaatttttacaggcttgaaaaacttttcgtttttgataaggctaatagagcatgttaagagctttcgaatgataccaagattgttggatttggatgccaaagaaaaaagcttaagtggaaaaacgagctggcgccgaaacgggagcgccgaaacgcgagcgccgaaacgcgagcgccgaaacgcgtgggtccccgattcttacgggtttatttttctattttattgcatttttgttaacaaattttgggcaaaacgccaaaataggtgaaaatagtttttaaaattttttttaggttttttaggtgctaataataaaaacctagaaaataggtgctaataactcgaaaagtagcttaacaacagccaaaaaaaaacatgtttttcgtgcatttcaggctacggggagctcaggaaaaatagtgaaaaacctaaaaatatcatccctactcgtgactccctggggatttttttgggagtcccggtcccaatctagtactttctatcccagtatgattttttttacgggaatgggattttatgggaatcccgttcccacttcctggaacgggtttttacggacccgtagcccgtaatccatattttttcgaccgaatg

SEQ ID NO: 117829 - DNA, 97 bp, Heterodera glycines
  Promoter: Source sequence=SeqID_6988; Location=4048..4144; Strand=-; Gene=SeqID_63509
ggtacggtaatttatttggtaatattgtagcaccaaaaaaaaacataacgaatactgtaaaataaaataagattaaatttaattttttaagattatg

SEQ ID NO: 117830 - DNA, 391 bp, Heterodera glycines
  Promoter: Source sequence=SeqID_42268; Location=404..794; Strand=-; Gene=SeqID_70202
ttcgaaattttgagacgaacaaggtcccactcctttaatgaatttaaattaagaacaaattagattgattgtgccgttttttcaattttgatttcttaatcacccaattgaagggaagagggaatcagattttgcattttttaaaaattgtactctttttattctcgttggtatccaggtgggtttccgctggattataaagttgggattcgaaaaaggtcttcgcccgagttggtgaccccccaacttgaaattttgggaacatttaaagccggccccattggcaagagtcgcctccacttggcttctttttaaccaatcctctaaatcttttagcaccgtcttctttccctttttatgtatattatataataccatcgtttccaggatg

SEQ ID NO: 117831 - DNA, 187 bp, Heterodera glycines
  Promoter: Source sequence=SeqID_16129; Location=1..187; Strand=+; Gene=SeqID_80493
ttccttccattaacccttaatttaattgcttaattgtatttcattttagattcatttcattatgatcttaattgtagcaatttagtgcaattaattattcgttctttcgttcctttgccatatccccagaggcactttcttaactgtcggtaatttcctcgcctcaattggccttatccaatcaatg

SEQ ID NO: 117832 - DNA, 540 bp, Heterodera glycines
  Promoter: Source sequence=SeqID_21500; Location=189..728; Strand=-; Gene=SeqID_52111
ggtgaatattcattcccccccccccccttcacccatttatttccattttataatttttaacccccgcggcacgcacaaattcagtcgaattttttgtttgaaataatcataaatttatgtgtcattttatcattttccaattatgttttatttgccattccgtcaataaaacagtttcttctctgctcgaggcaatgaattgtcaaatgacttgtccctctccgttcccctttcaattttctcaattttctctcaattaaatgcgttcccacgccccccgggggaggagtatcttttcttagtctttcctttccttttcccttcgtccgtccgcccctatttttttgctcattcatttattagccccgtttctccctccgttcctcatttggcagtccgccccccccctttttttccaaattgaatttgtctctcctttcattccattcatttcctcctcctcctcctcctcctcctttcccttccttcactcattctttctcccccttttttcttttcttttttcagtcccttaaaatg

SEQ ID NO: 117833 - DNA, 169 bp, Heterodera glycines
  Promoter: Source sequence=SeqID_4836; Location=1..169; Strand=+; Gene= SeqID_55894
attccaacagtaaaaggggaaggaaataaatccccaacatctgtaaattatttagcatgtttttgttcgaaaatatgagtgatttgcatgagcctggaaaattgcggcaggttaactcttttttctgtttttatttttgaaattttccgtttattttcagtttgtgatg

SEQ ID NO: 117834 - DNA, 950 bp, Heterodera glycines
  Promoter: Source sequence=SeqID_1297; Location=904..1853; Strand=-; Gene=SeqID_71906
tttttcctttccgcaccataattaggcatcattgatgaattttggctaaaattgccagttaaaagccgtcactccgacaggacagacaccagcagacaaccaatgcataaattacacacaaaaaataagaaaaaaaactgatgccaaaagattattgaataatttgtcaattttctattagattgaacgcggaataaaaatgccttaaaacccggataatgttatgaatgcagcataacaaacaccaaaatatcgtaattttgtacaaattttgtataaaaaagggcagctaatttttgtaagcagtgcctacggtccaaaacaaagtaaacaattgtattatgaaaattcaaaggagtagatatatcgcccgtctccattattgaaaaataatctccccgtctctatttatcgtccagggggataaatcaatttttttttctaaaaaatatttattttaatattttaataaaaattaatgaatactaaatcgaattcaccgggatccgaaccagggctgggcgaagctcggcttagcactcgaagccgaagccgaaggcgaagcccaatttttattcgaagccgaagtccgaagctcgaagcccaaaaaacccgaagttttcgaagccgaagccgaagttttttcaaattttttttaattccaaaatttttttcatcacataatttcggttagatatcaaatttaatcaattgacgcagtttctagtagagaccggaaatttcaaatttgcggatcccgctgcgggactggaactcaaaattttttgcgggacgggatcccgcggaattaatcccgcaaatcccgcatttaaatttgtgggatcccgtgcgggattgcgggattttggaaaattcgaaaaaatttcaattaaattcaaaaaatttccaaaaatcaaaaaatgctgaaaataaatttataggggctgatg

SEQ ID NO: 117835 - DNA, 119 bp, Heterodera glycines
  Promoter: Source sequence=SeqID_14881; Location=2031..2149; Strand=-; Gene=SeqID_79039
ttacgacccggttaaaaatgttggaaaactgttcagtgcccgcaactattgttttggagtatctataataataatatattttatactgtaattaaataaatatgttacagtgtgagatg

SEQ ID NO: 117836 - DNA, 317 bp, Heterodera glycines
  Promoter: Source sequence=SeqID_316; Location=1504..1820; Strand=-; Gene=SeqID_81967
aacctgttccgtcattcgtttagaacaacaacaaccattcttcccctatcattcttattttccattttcctcctcccgcgcatccatcgccacattaattgattgaattattatttaattgtgtccttcaaataaatcaaagaaaaaggcacttgaattaatttattaaaatgaataaaagaaacatgtgttttgagaatgccctcattagtttaattttttatgagagatttttcatttgtttattttagtaaaattgcaaaattaaagaaattattaattttttaaaattttctttattctcattaagacaaatg

SEQ ID NO: 117837 - DNA, 110 bp, Heterodera glycines; identical to SEQ ID NO: 98226
  Promoter: Source sequence=SeqID_32494; Location=301..410; Strand=+; Gene=SeqID_62798

SEQ ID NO: 117838 - DNA, 148 bp, Heterodera glycines
  Promoter: Source sequence=SeqID_31911; Location=1..148; Strand=+; Gene=SeqID_62221
ttaccgaaacttcatcgaacctggttctttctattctctttgcaatcgccccagattttttttacggcttaactaggccctattaagcttatttccagaaaatctcgcatgaattctcatttttaaattttttatagatctttaaatg

SEQ ID NO: 117839 - DNA, 146 bp, Heterodera glycines
  Promoter: Source sequence=SeqID_19480; Location=611..756; Strand=+; Gene=SeqID_84201
tttgtggcctgcctttgtttgccaaagattttcactgtttgcgcaaattcgtgccgtcatttctctgcgattgtccaccactgtgtgttgtcaatatcttttatgactatctgtttcccgaattgccggccgatgacagtgccatg

SEQ ID NO: 117840 - DNA, 515 bp, Heterodera glycines
  Promoter: Source sequence=SeqID_38; Location=7774..8288; Strand=+; Gene=SeqID_53326
attgcaattgactgacactgaaaagcaacaatgaattcagctcaattggaaataattctgaaaaggttgcgccctaccaaaaataaattcattggtgttttcccatcggatcgaattccgaagcgggtatctaaatttccccattgcatggtcgtaaatacgggcaaagaagggacacgaggtgaacattgggtggcttgctatgctttaagccatagaagcgttgaatattttgacagtcttggtgagcccccaaaccccgatttagcagcctacctcaacacatttaaagaggtactggtcgctaaagatcaaattcaatttcccacatccgatacgtgtggccatttttgtatatattttttggcaagccgatgttctggcattcctttctgccgtgtgattgagactttgcgcaagactcgaggcatggcagattacctcgtgaaatggtttgtcagaaacttgatcaacggtctataaaagctcacgtttcctaagcagtaagaaagatg

SEQ ID NO: 117841 - DNA, 1003 bp, Heterodera glycines
  Promoter: Source sequence=SeqID_23972; Location=25..1027; Strand=+; Gene=SeqID_54674
aatttcttaaccactgttaaaataagtaaaccatggttaagaaattaaacccgcgatttctcgtcttcccttttttaaccatggttaacgcttaaccacggttttttaaccgcggttatggggcagcttaaccgcggttaacgcctctaaaccacgtattttcattttttggtattctcgttttcccttagttaaccgcggtttaatttttcccttgtaattttaaccacaagtcgtagcagggttaagcccttggttaagagaaaaattaaataatattctaataaaaatggtctaaaaaatttaaaaactgtcaaaactattaaaggaagttaaaaaacataattatctttttataaccagcatttagaaattttttaaattttttgcatcagcgtcgaattgaattctttttgacttcttttcaagtaaaaaacattttttacgaccgtaaacttacatacaaccgacctaaaaattttcaaaatatattcccactaaaatggaattttcaaaaaaatttccccgaatattaattctttctttaaaaaaactttattttattttttacttttattcttttcatgagaacttttttttgaaaacgaattttcgtctaaatagaaagaaaaaaatagtaaataaaaaaaattatttacgatttttgatacctattatttgctgagtaattagcctagatatatattttttaaattttaatcaatgaaaattaattctcacgaattttagaataaaaatttattttttgtatttatttatttaataaattcagtgcttaaccgtggtttacttaaccgtggttcttaaccacggttaaagacgagaatacatattttggttaaaaataaaccgcggttaattaaaccacgattaaggcgttaaccgcgataacctaaccgggaaggaataaggccccctgttcggccataaattattttatgcgccatgaacagatcaagcagatttcgtctatcttgaaatg

SEQ ID NO: 117842 - DNA, 586 bp, Heterodera glycines
  Promoter: Source sequence=SeqID_15150; Location=1..586; Strand=+; Gene=SeqID_79341
tcaatttttgaattgtcttagtgaataagtaaaatttaaattcaaatttttgaattgtcttagtgaaaaagtaaaatttaaattcaaatttttgaattgtcttagtgaataagtaaaatttaaattcaaatttttgaattgtcttagtgaaaaagtaaaatttaaattcaaatttttgaattgtcttagtgaataagtaaaatttaaattcaaatttttgaattgtcttagtgaaaaagtaaaatttaaattcaaatttttgaattgtcttgagtcctcccaaaagtcttggctatcaatgacaatgaatatgtggtgcaaatcacagcaaaagtaaattcgaaaatcaaatttttataaaaatttggtctttcaattgtcacgacgagtcatcgttgtgttgtgaatttggtcttggcacatcggatttttatttatttattttttctaatttttggtactcctttttacgggactcaaataaaaaaactgtgcttcaaatataattattgtaaaaattatcaaagcatactgtaaaaatgatacggtttttagctgtgttaatgagacacagaaactgaccatg

SEQ ID NO: 117843 - DNA, 158 bp, Heterodera glycines
  Promoter: Source sequence=SeqID_40681; Location=1043..1200; Strand=-; Gene=SeqID_68934
ctctgctttaacgagccaaacacaacaaattccaagccgcagtagaccaaaaacattctccagtgtctgctgcggctttccatgctaattactcattgctaattaatcctaaacaccaaattgtcctctgttgctgcgttctattttgcttactaatg

SEQ ID NO: 117844 - DNA, 424 bp, Heterodera glycines
  Promoter: Source sequence=SeqID_11026; Location=1186..1609; Strand=-; Gene=SeqID_74351
gtttgagcaaaagcttttatttcatatgatgtttaatagcagaagcaatggaggcaaaacaaaacgaaaaaaggggagggaattttgagaaataaaatgggggaatgagtccgttttgagttgtcgccaagcaaagggtggcacactgaaaaataattcgaattgaattaaattccgtgccattgacagtttttgtcggggaggacacaaatttaattaaattcatttctcctttttgccttaggcaatgcatccgaaggataaccatggccacgtttttgacattcttagtcactttttgtcggcgcaaaaccgaccgtaaaatcgtcgaataaacaggcaaagaatggagggggggagagggatttgactggggaagggggagaacggcacaaatcaaaaatcagtttttggcattgaaatg

SEQ ID NO: 117845 - DNA, 186 bp, Heterodera glycines
  Promoter: Source sequence=SeqID_6205; Location=5515..5700; Strand=-; Gene=SeqID_60709
ccccccgcgacgcattgccaaaataatctgtgcgtttctctcgtcaaaattctcgccaatcaccgcccccttctcccctttcatcgcatccctttgaactttcccccgcattttattcaaatgcatttgctcctcctccaattcatttttattgttctttagaacattttcgacgaggcactgatg

SEQ ID NO: 117846 - DNA, 591 bp, Heterodera glycines
  Promoter: Source sequence=SeqID_43407; Location=228..818; Strand=+; Gene=SeqID_71075
ttggaacaaatcggtaaaaaaaaacaaacaaagatatggaataccactcggtggggagggtctcctttttcaaaaaaaaaaaaaattatttttttggtaattgcacgaaaatttacattctttcggcgtctaaccggaaattttgtgttcgcccatattcaatcatatggcactgatgcattccatttgattggctagatacccgacttactaggtaaattgggaatctaccaataaattgttgaatctgaaagtaggagacagcaatgtggggagtggttttgacgacgtggaaggacgatgtcgccaataatcaatcacaacacgtcgtgtcacggaggacggacaggaccaatgaacctactccacacggcataagccgagagaaaaaatcagctacttggacttcaccagcctctacccgtttaccaactttacgaccgactatccccctcggccaccctaaaatcatcagtgtcccacccaaatgagcagacggtcaactggcgctctccatccgacaacccctacaaaggtctgctcaaagtcttgcttctaccttcaaacaacaacatcaaagtcactgttatg

SEQ ID NO: 117847 - DNA, 717 bp, Heterodera glycines
  Promoter: Source sequence=SeqID_3032; Location=328..1044; Strand=+; Gene=SeqID_82866
ttttttaaaaaataatttaataactaaataaacagcaaattaaataaattgaggaccaaaatgttgagtaaatgaggaaagtgggttatggatccatctgcgcagagaactgctaccaaatcgccattgcgtgacttaagtctttcaccacttcccgccttcttcactcagttggagcaaagatttatgtttgaatatttaaaaataatttaatgggcaatattccttggatggatcaaattttggcatcaatccttccttcgttttcttgtcatcgtttcatttgtgatgcagttaattcttgcacactcttcgcacatctcgaacccaaccgccactcttccattatccagccggcgtaccttctctttgttgtgaaatagtttgtcccagtcatctaaaaacatcaataaattgaagctaaaaatagtaatttttaacctgaacagagtcttatcgccaacatgaattgacccctcgtaattttccaaagaaaacggtcatcaactcgtggtttattagcttctttcaacccatcctcgggagtttcgtgttgtacaaattgttctgaggtttgatgatgttttgcaagactgatttgattgctcgtgaaaaattcggcttaaatacctttgcaaagtgggcgtggcctaattgtccgggagtataaaagaccctgcaatttgtcagctatgtctcattcgttctgctacaatg

SEQ ID NO: 117848 - DNA, 330 bp, Heterodera glycines
  Promoter: Source sequence=SeqID_15669; Location=767..1096; Strand=-; Gene=SeqID_79974
gtttacctaaaaatgttattcaaaacttggattttttaaagaaattgacaaaaacaaaatcttttaaaaagagacaacaaatatttaaagaggctactagtgaacaaattgcattattaattgaaattagttataatatattaaaggggtacttcccgctcacgaagagacaaaaatatagacttttaccatacgcaaattttgtaagaaaattaggaagagttagaactgagaagggtgcaaagaaagtttttcaacaaaacggtggtggttttttcgttaatttggctccattactattaccagtattaattgccgccttaaaatatg

SEQ ID NO: 117849 - DNA, 117 bp, Heterodera glycines
  Promoter: Source sequence=SeqID_12606; Location=1648..1764; Strand=-; Gene=SeqID_76270
atgtgatcgcccgtggcatgaacatccccaacctctcgcgagtggtcagttttttgcttcttaagtgtgtctttcctatctcatttcttttcaaatcatcagattttgtacgaaatg

SEQ ID NO: 117850 - DNA, 137 bp, Heterodera glycines
  Promoter: Source sequence=SeqID_853; Location=1706..1842; Strand=-; Gene=SeqID_62724
tggaggttatttgggaacacgaaataaatgagaagctgaaaaaggacacagcaatgagggagttttttgacaactggaaggaccattcgccaataaaaatcagagacgcgtttcacggaggacggacaggaccaatg

SEQ ID NO: 117851 - DNA, 496 bp, Heterodera glycines
  Promoter: Source sequence=SeqID_7763; Location=1874..2369; Strand=+; Gene=SeqID_65866
ttttttacatttcaatgattctttcattaatttattcactttccactccagcagaattgcggaattcaaatgaccaaagtgaacgcacttttccccccgaggggtcaatttgcgtgtcaattggggcttttcgtgagtttttgcgtcctttttgaaaaaggaaaaattctgccgaaggtgggctcgtgttcacgattggcactctcttcggcctccaattgtgcgccgttgcactggtgctaatcgattgctttttgatggacggaaaattcatacaccaacggttgcgaaaagtgttggacagcaaaggctaatgatcgaagcggtgatcagggctttatcaatcattgatcagatgcgactttgatcagtttttttatttattcttcattttttatgtctatttgttttttatcagagagaaaaaaacatcgaactgaaaatgaaaaatgaatgataaggacaaaaggtttaattgcttctttcccgaaaaatg

SEQ ID NO: 117852 - DNA, 52 bp, Heterodera glycines
  Promoter: Source sequence=SeqID_14703; Location=676..727; Strand=+; Gene=SeqID_78821
agtaatttttttcgttttttaggcctctaaaaacggatgtttaataaaaatg

SEQ ID NO: 117853 - DNA, 469 bp, Heterodera glycines
  Promoter: Source sequence=SeqID_1715; Location=1..469; Strand=+; Gene= SeqID_75469
ttagtatgcggaataagttatgttcaacaaaaatgattagcaaaccgtcggaattttttgaattaattaatgattatactattgaaatggctaaacctatacgctttaatgacaacactttacgggtgatattttgcaaaaaagacgagtatattaaggagcataaatgctcaaacgttatgatttcgatatggtaggaaaataaatattttttaaaaacaactatttttaggaccaccgcccaggcgcggcttaaactttactcttatatggaaaaaataaataattcagaaaattgcaaattaatttatacggatacaggtggactaaaaaacaataaacttttattttcgatttttagacagtgtattttttatgcatccaaagggaacgtctcctattaaggaagggagttttttagggtatgaaaataaccaagatccttttaatttccaattttagtgaaatg

SEQ ID NO: 117854 - DNA, 119 bp, Heterodera glycines
  Promoter: Source sequence=SeqID_14286; Location=1724..1842; Strand=+; Gene=SeqID_78310
ttttacagaaaaacacctaaaaaatataaataagccaaaaaagtaaaatattattcttttaatagcctcttaatttttcctgaatttgttcttttttcttatcggaacagaacaacatg

SEQ ID NO: 117855 - DNA, 1003 bp, Heterodera glycines
  misc_feature (13)..(13): n is a, c, g, or t
  misc_feature (15)..(15): n is a, c, g, or t
  misc_feature (21)..(21): n is a, c, g, or t
  misc_feature (34)..(34): n is a, c, g, or t
  misc_feature (64)..(64): n is a, c, g, or t
  misc_feature (68)..(68): n is a, c, g, or t
  misc_feature (87)..(87): n is a, c, g, or t
  misc_feature (91)..(91): n is a, c, g, or t
  misc_feature (94)..(94): n is a, c, g, or t
  misc_feature (100)..(100): n is a, c, g, or t
  misc_feature (102)..(102): n is a, c, g, or t
  misc_feature (106)..(106): n is a, c, g, or t
  misc_feature (122)..(122): n is a, c, g, or t
  Promoter: Source sequence=SeqID_1981; Location=327..1329; Strand=-; Gene=SeqID_77177
acaaattaaaatntncaccanatctttcctaatnaaccattttaattacctaattaataaaaanctanaattcaataaaaatttatnaatnaanctaatncntccnttttcacatatatcanagaaataaatccttcctataatgaaatgccattgaaaaattatgaggaaaagtttcgaattttttttctcacatttatacaaccagtaacattatttttaatgaatcacttattttttgagggattaaattaataattatttatgtcatcaaatgtaactgatcaacaggtaacaataataataaaagctgtgccaaaattataatcttttcattcactattcatttattcaaaggatgaggctggttttgtgtcggtcgaagttgcaattagtgggataattacgctgatttgctttttcggaattgcgctaaatgcgtcacttgtctacgtgaccgtcaaatcaaagtacgttttttataaaggtttcaaatattattatttttaaaaatcttctttagatatttgcagaatttttcgacgattataattatattttttattagttttcaaaaaaatcattttttaaacgccgataggcgccgccggggaaaattttggcaattaaatttcaatttgttaacggaatttcacaaaaaagactatttttgcaattttgagccaatttgcggccgcttatttttagttttcacccgctttttgcggcggcaccgccgggaaaaattttttaaagcgttttcaatgaattttattaataaattagtcaaatttttcagaaatttcactcttttctcttcctgcaacccccctcccctgtatttcatgtataataactaatttttatttgacagatcgattcactcccaatgcaatattctgatcgctttgtacgctttctttgccatttttctccacatcggattttgtgtcaaaattgtcattttcatttttggcataaattttataactctcgggacatg

SEQ ID NO: 117856 - DNA, 334 bp, Heterodera glycines
  Promoter: Source sequence=SeqID_15364; Location=135..468; Strand=+; Gene=SeqID_79622
ggtgtttgtaataattaaatttaattattattttaattttattttctaagtaattaatcataacttagcttaagcttagtcaaattaataaaattaagtatttagcgacagctcgaagcatcctctactacttatgaaattttcaaaaaattagtaaaaatttacaaaaagttgtgaccaaaaaagtacgaaaaattttgactcaacaattttgaccctagctttcttgaaattcaataaaattttttgaaatttagcagaacagtagagtaatctttaggctatctaattatataaacaaaattaaaattgattgttttagaaaaaagttatg

SEQ ID NO: 117857 - DNA, 880 bp, Heterodera glycines
  Promoter: Source sequence=SeqID_6467; Location=1..880; Strand=+; Gene= SeqID_61700
atggaaatatgttttagctttatctgtccttgaaaagagaaatttaaaaccggtgctcttttgctatgtcgcacgcgcttttttcaaaaaactttttgggaacatgggagggggtcacacgactttggtcaaatttgacacggacccccattcttaccagtatacttttggacccagatctaccgggtcgggtattgggttttcaaacgggccttgaaaaacccgggtcgggtacccggacccgtctaaccctaaccaatgcaatagtatgttaattatggcgccgcaagtgtcacttttctctgaactttcctccttttggctctgagttcgaatccaaccgtttttatattctacagaatgtattattcaactgtttctttataaacctttttaagaatattttaaatgtaaaattcaacaattttctgatattttttttcatttacgcagaattagtcaagaaatgacgtcgcttgattaaaaatttttcataaatatttccatatgcatttcatatgaatgaacatgtgaagataagattgccaaatattataaatttgctatgtatttatcgatacttatattatttcataaaaaaatttttagaggaaaaataattaaataaaaaatgaaaataaaaataattttgattttacttttcgtatgtgaaaatgtaaagtcggtgataaagaacaagcccgttttcaataatctaaacgaactcggccaagaaaagccctacggcaatggcacaacgaacgaactgcaggagagagaccgcacagaaggcaattagcaccatcattaactcactaattaacactgattaaatgctttagtcgagccgcaaatctatccgccagtacagcagcaaatg

SEQ ID NO: 117858 - DNA, 286 bp, Heterodera glycines
  Promoter: Source sequence=SeqID_15947; Location=2762..3047; Strand=-; Gene=SeqID_80299
attttttcaggtcatttttagggggtgtggtttcccgattttattgcatttttaatggaatttttcggaaacaacgcccaaaaaggcaccaaaaaggcaaaatgccaaaaaaggcatttaaggcacgaaaatcccgaaaaaggcaaaaaaaggcataataaaagtcaacgtagaagcctcaaacgaagtggaaaatgcgttttttatgcttaatatatcggaactagtgcgcagaaaaaaggcatatgcctcaaaagtcggtctctagtcataactttatttgatg

SEQ ID NO: 117859 - DNA, 577 bp, Heterodera glycines
  Promoter: Source sequence=SeqID_10763; Location=3440..4016; Strand=+; Gene=SeqID_74015
ttgttttgttttggtcacagcgccaataaattaattcccttcgtgcttctttttttggtacatatggccttcgaaagcgagttcgtagccgcccatttgtgaaggaaaaacgtagccattatatttaatgaattttgtaaatttagttcggcttttatagcacttatttcaggctatccgggcaaatccattggcaaaatttaattctaattagttaagaatagtggtttttggtcataaagaattttctcattaataggaatagtgatttttgatcatatacacaccgagtcaaaaaacgagacatgtgtcaataaagagagagtgcagagaaactttttgtctctaacttttctctccttttggcatactatctaatatttttattattaagaaaaacaacattccttctctccatataactttttttctaaccatacaatctgcaccaaattttgcatatcgatagagaaaaaaatctgcatcgatttctatgtttattatcatcgcttaaatgttgttttaaaaagttataagataaaaaagttaaattattattctttttaaagatttaatg

SEQ ID NO: 117860 - DNA, 295 bp, Heterodera glycines
  Promoter: Source sequence=SeqID_22928; Location=559..853; Strand=-; Gene=SeqID_53628
attgtatttttctgttttaaaaataaagtctattcgctataataataatctacggccttattaaggcgctaggacttttcgacagcggacctttcgacagaaggacttttcgacagcggacttttcgactgtaaaggacttttcgacagtgaaggacttttcgacagtacactaatttcttatcaataataaataatttatttgtttgacctccgtttctcgaccggcccaaaaaagagtgaccatgccattcataactattactgaaaatatttttgaattgctgtgaaaaatg

SEQ ID NO: 117861 - DNA, 539 bp, Heterodera glycines
  misc_feature (14)..(14): n is a, c, g, or t
  misc_feature (28)..(28): n is a, c, g, or t
  Promoter: Source sequence=SeqID_17867; Location=1..539; Strand=+; Gene=SeqID_82409
tctagagtcaatantgggcatacctcantttcgttgtaataatgtaaccttaataattttttctttgtctttttaatagaatgttacaataaaataattattctttgtcttttttttaaatgattgccttaagccaaaccaatgggcgcaagtgagcacaatttttatggaaggatgtactgtctttttcccctttccaatctttgttcttcattttcccatcatggcctccagctatgctggaaaggggtcatacgaggcaaaatttattaattatatatttgaaaaaaacggggaatctatggtttgataatttggaagtcggggtaaatttttaataatagccttacacaaaatttatcattttatgttaaaaaaaattctttcattcattcggtttatatttttgctcaacacaaatttctggcaattttttcatttttcacttcgttagctcattcctctcgtctctcttttttaggtaatgaactcttgtgatttattaaatttaaaaaaaacaattaacacatccgctcatg

SEQ ID NO: 117862 - DNA, 136 bp, Heterodera glycines
  Promoter: Source sequence=SeqID_35704; Location=411..546; Strand=-; Gene=SeqID_65193
aaatttacgggggtgaccaattttgagtgtctaaaaaatttaattcttaatttggcccaaattttgaaggggcgtcgtgtatgaggacaaccgtttcgagttgcgcttatgcgagtgcccaatgcttgtcgcaatg

SEQ ID NO: 117863 - DNA, 244 bp, Heterodera glycines
  misc_feature (17)..(17): n is a, c, g, or t
  misc_feature (91)..(91): n is a, c, g, or t
  misc_feature (124)..(124): n is a, c, g, or t
  Promoter: Source sequence=SeqID_36989; Location=1..244; Strand=+; Gene=SeqID_66175
gtcagacgatcgattgncacgtcagaatcgcttcggacttccaccagagtttcctctggcttcatcctgctcaggaatagttcaccatctntcgggtctcagcgcatacgctctgtctccgccncatcgcatgcgatcgagacgggactatgttgcgccccaacaccgcagtgccagggatcacacatcagctccgtaagaagccttcactttcattgcgcctttgggttttgaacacccaatg

SEQ ID NO: 117864 - DNA, 118 bp, Heterodera glycines
  Promoter: Source sequence=SeqID_479; Location=1335..1452; Strand=-; Gene=SeqID_53914
tctttctgcaagcaacaattcgccaaatttaaaaagagtaacgggcattgttcccaaatttgtagggatgtgcgagaaatgattttttaccgagaatcgagaccgagacttagaaatg

SEQ ID NO: 117865 - DNA, 1003 bp, Heterodera glycines
  Promoter: Source sequence=SeqID_28319; Location=315..1317; Strand=-; Gene=SeqID_58943
attctctctctctctctctctctttctctatatctttttttctctctctctctctttctctatatctttttctctctctctttttctctcttttctatctctcttttctctctcccctccccttctctgtttcactcactctctctctctctctttttctctcttttctctctcccctcccattctttctctctctctatctttttctttctctctctctctttttctctcttttctatctctcttttctctctcccctccccttctctgtttcactcactctctctctctctctttttcttagaattttttaaacttttctccgtttgcttcatcctttctgggttttgatttccctggcttttattgtccagaaaatatatgtgaaggtccaaatggaacccaggcccacacaccaagtcgacttaataccccaaaatacactgaaatcgggagtttttcgaaaaaattcctagggggttgataacttttctgcagaaaatcattatacgaaaataatacaatttacagtagaactgatcaacaccaaaattgaaaattagtattgacacacataatttcttaaaatcaagaatttgtagagaaaataaacaaataaattttggagacgaatttttgggaacatttttcatttattataggtgtatttttagaaaatttgggttggttcttagggttgtatttttctgaaatatttggggctgattcttagtccgttttatttaaccattttcacaatgattattcgaattttcagtcatatttaaggatgagttaaatatgcccaaaaatcctgagattttcaaaaaaaaaaatattcagaagagggccacttgcaaatcgtgagtttgattttaaaattaaataaattttaaatttaattataaattcattacatctcctttattaaatttttttttttggaatttaagcgccgccacaactgccaccacaaaatgaagagggtctgccgttgccaatg

SEQ ID NO: 117866 - DNA, 201 bp, Heterodera glycines
  Promoter: Source sequence=SeqID_37537; Location=1047..1247; Strand=-; Gene=SeqID_66586
taaaaaaaaaaatttcggggagcgggagttcggaaacttttccgggaacggaactgggaactcccgtaaaaaatgttataaatttttacccgtagacccggcgggagtaattcaaatttaatgaaacaaaaaaaaaattccattctcgagtgtttcaaattagtggaaatcaaattttctaaacttggtattttccggatg

SEQ ID NO: 117867 - DNA, 788 bp, Heterodera glycines
  Promoter: Source sequence=SeqID_20984; Location=625..1412; Strand=-; Gene=SeqID_51558
ttctaaatcaattaaaaattcggaaataaattattaaagacaagttaatagtggaatattaaagaaatgaaaaatgctctagacagaatataatatataattgtgaataaataaaagtgcaattgatcgaattgatcaactatgcatgtggatattatttctctctctagacagaatataatattgtaatttgattgggaaatattaaataataacgaaattataattatggccagcaatataattaatagattaaaatagttatattattaattaattaaaatcattattcggtacttaaatgacccgcctcttctgatcaccactcatttgcctttttgtcacttcgcccacatttgcctttttgtcacttcgcccacatttgcctttttgtcacttcgcccacatttgcctttttgtcacttcgcccacatttgcctttttgtcacttcgcccacatttgcctttttgtcacttcgactcaccacggaaagtaattacattttattcagatgtgtagtaactataaaataaaaattgctagaaacctgtttttgacaaaataaacctaaatttataaatttctcggcgccgggttttagcggttttttgcaaataaaaaatggaataaaaatttacaaagaaaaattctgaaaaataaatgcaattttgtaaaaatttttaaagttaacattctctatttaaaaaaataaataaattattattttgcagccgaaaggggcttagataagcgggtcaatggtttattttattttcaagtaaatatg

SEQ ID NO: 117868 - DNA, 435 bp, Heterodera glycines
  Promoter: Source sequence=SeqID_34565; Location=1..435; Strand=+; Gene=SeqID_64327
ggattcggtctccccataaatctgggcgcatcgtttcggggggactgccccgaaaacaaaaaaatcgattttttcaactgtccgtttggggtactcaaacaattatggggagcaaaaatccaacgcagaattaaagtacagactatagggaagctattcccgaaggattcggtctccccataaatctgggcgcatcggttcggggggactgccccgaaaacaaaaaaatcgattttttcaagtgtccgtttggggtactcaaacaattatggggagcaaaaatccaacgcagaattaaagtacagactatagggaagctattccggaaggattcggtctccccataaatctgggcgcatcggttcggggggactgccccgaaaacaaaaaaatcgattttttcaagtgtacgtttggggtactcaaacaattatg

SEQ ID NO: 117869 - DNA, 600 bp, Heterodera glycines
  Promoter: Source sequence=SeqID_9371; Location=1278..1877; Strand=+; Gene=SeqID_46743
ttataacaagttaaggtgacagtttcatgacaagggcaagcgaagctttctttacaaggtaataagcaaaggctcaaagctgacttaatgagcagaatttgaatcaaaatatggcattttgttgggtcggggtcacttcggcgcggaccatttcggcgccgcaaattttgaaatgctataacttttttatttgccagttagctttagccaatctggcatcatttgaaagctctatgtgtgctctatatttacatgtaaaaatagaaatgaatgattcaaaaataaaaaagttatgccacgcggcgccgaaaaagccaagaaaaagttaatttttgaggttttttggccataacttttttgtaaactgacgaaattttttgaaattttacaggctaatagagaatctgagctatcgaatgataacaaaaatttttaatttggttgatcaggaaaaaagttgttagcaacggcgccgaaaagtcgccgaagtgggcggttcccattttgttagccatcagaataatttttaaaatttttttcaatttttttttaatttaaatttaaatttttaaacatttttttgcaattttttcagtgatg

SEQ ID NO: 117870 - DNA, 799 bp, Heterodera glycines
  Promoter: Source sequence=SeqID_1899; Location=4692..5490; Strand=+; Gene=SeqID_76640
aattaaaaattttgttaataaaaataaataaataaatttttgggggaagaatttttgggaaaattttccaattcttaggggtgtattttttgattttattgcatttttgttaaagaattttctgaaaatccttaaataggtataatgggtagaaaaactccaaaataggtaagaataggtattataaaagtcatcgtagacaccccaaactaagtggaaaatgcttattttgtgcttagcaaaattggtcagatataatgagcagaaatgagtccatttcatcacatatgtcgtttttttcaacttttatatatacgcaattacaccataaagaaatgtataacaaattttaaatttaattgtttgaaatgtgaaatttgctgattcattttgcttattaattttattagttattacgaattaacaaatattttaaatttttatgctccttccaattctcttcacccttccatttattcttcctgctcctcgccttgggtaatgtttgtcatgttaaaggaaggcagggaaatggcgtcggggattggcacggaaatgttaagccatttcacagcagcaccattttcatcgttcttggcaattaaattgaattatttttttagcacataaattctgaacccaaagttttataaacaaaaaaatgccaaccttggccttagggcaaatgttgatgcacacaacgacaaagcacacttgatagcaacctttttcattggtcttggcagatggggcaggcttaaaagaaaaaaaattacagttaaatgcattttcaaaaatg

SEQ ID NO: 117871 - DNA, 984 bp, Heterodera glycines
  Promoter: Source sequence=SeqID_5700; Location=491..1474; Strand=-; Gene=SeqID_58952
gaattagaacaaaaaatcaaaaactcaattttcaataaaattcatatttattgcacaaaatgcacagcaatggagaaagccggtaaattttggaattggaggcgggcgacggccaacgaacggctatttcgtggcattgaatcggttttgtgtaataaatttgatttttattgaaaattgagtttttgattttttgttcgaattcaggttggggatttgaaatgggtcgaaatggatgccatattcttgatcagcgaccccgaaaacataagaaaaaatgttctacccgactctaaaaattgtaatatttcaaaaaatttatgggggacaaggcataatagagccaaaatttctttgcgttattttaaaattacctacctattcaaatttaaataaaaaaccaagaggcaaatccgaatcattaacctgtacaataacaaaaaagatcgaaaatgcattatttctttttcggatttccttttatgatcatgtaaactgcaatagagcccattttgctatttgtcacaaatctgattaaaaaaacaattagaaaaaaatcagactgggcttttcgtattttccatattttaaaaatgttttttttgatattttttcacaatgaatgattcatggataaaaaaatatctgtcgtcgccgcttcaatcaacgagtttttcgtcaagtgtccaaacttcgtcgagttttacacaatttgataaggcatttttaaatgcataacggttttaatttatgttaatcattttaagataaatgttcagaatttgagttttacgcctttgagtgttccgttgccttccccgctccaaaatgttcaacatttgggccttactccattaagcagaaatgctagcattcacagagaaaagaatcgaaaacgccctttctcaccgctggaaaatgaccttgggtcggtgtgttcaatcgccaaaattaaaagtgagtttttccatcgatttactaatg

SEQ ID NO: 117872 - DNA, 1003 bp, Heterodera glycines
  Promoter: Source sequence=SeqID_14810; Location=1158..2160; Strand=+; Gene=SeqID_78958
aaatatttttaatcacttacctaatttccaagtaacatagattatctcatttttcattattacgtttaattgcctaattagtagggatgcgatttttaggttttaactaaattttttgctcaattgatttgaagaaaggagctcaaaaaacgcatttctgcgttaaaattttttcatttggacgtcacttttcgtcactagaaatcactattttggcgacttcgtcactaaaatagttaaaaatcactattttggcgttttgtcactattttttcactatttcaacattttttggaaaattccttaacaaaaacgcaataaaaccaaaaaatacacccctaagaatcgacctaaaattttttttcaaaaaatacacccctaagaatcgacataaaaattttcaaaaatcactcctaagaaatgaaaaatttttcacaaaattcactttctttgcaaaaatttttaattctaaaaattattttttaggaacctattttgtattttttgccctcaaaaatcccagtcctactcatttgcaactgcaaatagtgaataaaaattatttttgctcaatttttggctgaaaatttgtcactattcgtcactatttcggactttttggcactattttctcactattttggcatttttactcactattttagttaactattttgggatttttcgtcactaaaagtcgcatccctaatcatgatgaattttttttaaataattcagtttgttgtacattcaaaaattataaataaaaaagttaaatttaaaattgataataaattataaaatatattgttgttacgaagattctatacttaaaaactatagaaaataaaaaccatggattaattatgtttttagacgtgacggcagtgggcattatatacagttgaaagcagcaatccaggcggagcatgctttgacgatgctttctgcgaaaaggtgaataaaagaatcacaaatatttgagagcgccaaaaaagccatg

SEQ ID NO: 117873 - DNA, 542 bp, Heterodera glycines
  Promoter: Source sequence=SeqID_13767; Location=498..1039; Strand=-; Gene=SeqID_77686
ttctttgatttacgttgtgattttgtccttatatggcacaacgtataattatggcacaggctttctttaaaaacttcttatgctcaaaatgcaaaacttgacaatctcaagctatgcaatgcttttttaattagttgaaatattttgaaagtaagatttcattttaatatcccaattttccttctgtactcaattttctgagccccaaatatcctatgcaatgacataatgttctttttcaaattaattacaatcccccttaattgatcataccattttcgaagaacgcttaattttttgcatttcctttttcaaatttctttccctttatctttgcattcatcaattctttccattttaaagtgttgtaatatgcacatgcattgttttgttcaccgccccacccattgaaagattggtcctcccatttttcatttgccctatgaatcgtaatttttaaattctcttttagctaaacaaattgtttttgactcttttccatttggtacaatttaaaaatttcttgacataattgcccaatg

SEQ ID NO: 117874 - DNA, 305 bp, Heterodera glycines
  misc_feature (58)..(58): n is a, c, g, or t
  Promoter: Source sequence=SeqID_9192; Location=1..305; Strand=+; Gene= SeqID_70551
cagcgaccccaaaaaccctaaaaatcctaaattagactcattttgtttttataaattntgaaaaattttggacatttcgtggcttggacactttgtgggggtgccaaggaggaggaggagacaaattgccaagaaaattatatggcgaaacgttttaaaaaatttttgaatttgttaaatttttcttagaattacaaaaaaaacatttgatatgatgttatttgttcgttcttcattttacatacattttttatggaatcgtataaatttattttacttacagataattaaaatcatttaaaatg

SEQ ID NO: 117875 - DNA, 496 bp, Heterodera glycines
  Promoter: Source sequence=SeqID_42830; Location=1..496; Strand=+; Gene=SeqID_70637
aagagacctacaaacagattacatttaataattagaattgcaaaaaataatcagtgttaaggccttcagaaatccgacataaaaataaaattatttttattttactttgcttttttaactttaattaattaattttttaagtattgtgtttctatgggaatggtgcatattttatttgaaatttagaagagtcgttccactctcccatctttcaaaaaattttcaagaattttcttttaatttttcctgaaattattcgcagctttttaatatttgctgaaaatattcaatttttgctatggaaaattcattttccacaattttcggcaatcagaattacacaaaataatgaactcaactaccaaatttggcattaatattttgtcaaattctgaagtcaaaacatcatttcaaatagatatgaacactaaaaatcaaaattagttaaaattaaatttaaaattattttattttatttttacataattttcagatg

SEQ ID NO: 117876 - DNA, 606 bp, Heterodera glycines
  Promoter: Source sequence=SeqID_22124; Location=1..606; Strand=+; Gene=SeqID_52776
attgaaaatatgtcaaaaataagtcaaaaaaatgaacatttttcaatttttcatcaacggttttttgacaaataaattaacataagttgaacaccgtgctacaaaaaatggccatcaaattttttcccaacctttctatataattatattttcttattacatattttacgattattacgattttttttacatttaatcggatcattaataattttattagcattgcatttcccattttataagtgcattatttttaattaaaaatggtatttattatgtgatcagcagatttgtcactatgggaaaccatcaaaaaccatcatccatttagaaagtgatgaatgaattaatgaataattactttttcaccatttgtgaaggcccaaaagagaaaaatcacaaaaaatggaaattaatagcatttggaattcattttatttaattatcaagaaatttcttttagagcaaataattaaatattttgctttttttatcgttattcgttggatattctcctgctcatcaaaaaaaagtcaattcaaatgtaattgatttgaaaataattttttattatttaaaatagatttttttgctaagttaccaatg

SEQ ID NO: 117877 - DNA, 278 bp, Heterodera glycines
  Promoter: Source sequence=SeqID_26305; Location=1..278; Strand=+; Gene=SeqID_57053
aaaattattattttaaaggaaaaaaaatttttttaattccctattttcccggggtacccggattcccggccccggtttaaaaactggtacccgaaccggtacctggcttttcaatacccagtaatacctgggcccggtttttgcccaaatacccgggcccagcctatcctagtttatacccaagcacacatgaattcagatcgtgctgggtcgtttcgtaaaaactgctaaatttacagaatttttaagaaaaatcagtcatgattcagaaagtaatg

SEQ ID NO: 117878 - DNA, 51 bp, Heterodera glycines
  misc_feature (46)..(46): n is a, c, g, or t
  Promoter: Source sequence=SeqID_12218; Location=1..51; Strand=+; Gene= SeqID_75794
tcatcattctcggcatcgcatcgtttccgtccaccgctgcgcaccnggatg

SEQ ID NO: 117879 - DNA, 225 bp, Heterodera glycines
  Promoter: Source sequence=SeqID_12836; Location=1..225; Strand=+; Gene=SeqID_76565
actggcggtggaaacgggaccacgacagctgaatctgtgccatttgaccgagccgaagtcttcacagagtgccaagttaggtgtcctgcggggtcaacgaaattccggctgaaaggggagctcgcgttcatcccccgtcaactccaatttggatttggccacagagagtcagttggtggccagcttgaacaagggggtggaatccgactacccgattggggcatg

SEQ ID NO: 117880 - DNA, 593 bp, Heterodera glycines
  misc_feature (37)..(37): n is a, c, g, or t
  Promoter: Source sequence=SeqID_25459; Location=760..1352; Strand=-; Gene=SeqID_56189
taaaatggtattagcatagcaaagagacgtcgaaccntgagacacaaaataaatttgactaacgcactaccgctacaccaatagatgctcgttgcgtagtgaagtaattatttcttttctttaattagaaaaaaccaaaaactttggcacgtcataactcggcactcgagttcattccgcaaaaaataaaatcacttttcttaagaacctgtgggtgctctatccacccaccaaatttcattcggaaatcccacggacacctggggaccttcctttgtgagcacagcttttttaatttggaggccaaattgaatgaatgtataagataaaatgccttattttcttattctaaggcatttttgcagcgctcacgcgaagctaacaaagaacaacttaaaaaactggttgaggaacatgaaagggtcaaaagagaatgtgctgagaaaagaaaaaggctcattcgactcaggcgatactattatctttgtgcatatggctttgcctttttcatttcttcctttagtgcctgtttttggtacttcggcgcaccatcccaaaaatgaatttctatcaaaaaataaaatttaaatatg

SEQ ID NO: 117881 - DNA, 77 bp, Heterodera glycines
  Promoter: Source sequence=SeqID_15036; Location=180..256; Strand=+; Gene=SeqID_79210
ggtacggtagatcagagagtgggtttggttaaaattcgaggtgaaaataattcaggatcagcaaatgcagtaaaatg

SEQ ID NO: 117882 - DNA, 343 bp, Heterodera glycines
  Promoter: Source sequence=SeqID_13946; Location=1824..2166; Strand=-; Gene=SeqID_77907
tagtttaaggcatgttaataacactatcgcttgcaaaagcggtctcttattttcacaccttaattatttaaaaagtttatcaaaatttagggatacatctgtcaatgcaaaggttagcaaattaatttgcactgcacaaatttcatcaggttaaaaaagggcatttggacaaaaaataccactttttaaagcacaatttcaaatggatatttattattaaaaagtaaatttttcacattcgggtctttattttaaaaaaattaaattaatatttcttagtcaaaaagatcaaagaatttttgtaatactaattcataaactttctgttataatttagcttatg

SEQ ID NO: 117883 - DNA, 266 bp, Heterodera glycines
  Promoter: Source sequence=SeqID_43550; Location=1..266; Strand=+; Gene=SeqID_71195
agaaatttttcagggacaaaaaacttatttgaaaaaacccactggaaatctatgtttttttttgaaactatgggggtgaaggacgtagtgctcctcaaaaatccaatgccttccgaactagaaccagaaaaggtggacagggattccaaggctaatcccggttgtcgggaggaccccgtgcaactctattctaaggatttcctctcgtcattcatccacagagcgcaaaaatgttttttcttttcaccgcagaattgccggaaatg

SEQ ID NO: 117884 - DNA, 1003 bp, Heterodera glycines
  Promoter: Source sequence=SeqID_170; Location=1021..2023; Strand=+; Gene=SeqID_76056
cgccgccaagtgagcgcgggccatttgagcgccagacttttcagtactgaagccaaaacctattgcgcgactttttcttggaaacccaaacctattgcaggggtgcgcgacttttttgactgcgcgactttatgcaaattattttaattaaatttatttaattttaaattattttaaacgtcttaaaggtcaaagacgttgaatttaaattcatttaaaattctccaaaaattccccgcaccaagcggatccgaaccccaggggggcggccagactgacgcactaaccactcggccacattggcaatggataataaacattaatttgctctcataaagggaaaaattgacgtcaccagcggcgggaggggggcgagagcgggcggcgagaagggggagggggtcaaataaacaaatcaattattgaattcacaattttctcttttaaaagcaaaaagaaatgggggaccgtataataaaatataatttagaaattaaaataattaaaaggttaattaattaattattttcctaaaataatttttttattacttctaaaataatataaatatttttcagtgaattaacaaatacatttaagtttaattattgatttgtctgttaattttttatctcctcaaaaataattacagcaccctttcaggtgttgggcgtttgtttatttgaccaataatttttaatttcacatctttacgttgcccctccctcacacctgctcatttgtctggaatttgtcttgcgccaaaccgctgtgccattcatttatgtaatttgacaccagtctgataataatttcgccaaaatttatttattatttgtccatttattacgaattattttgcatctatcactccaaattttgttaaaaaaaaaaaaattttattgtcccaatttttaccattttgtgttttttaaacaaaataaatatttgttcaaatttaaagaattaatttttaaaattttagacacaaaaacaaatcatg

SEQ ID NO: 117885 - DNA, 180 bp, Heterodera glycines
  Promoter: Source sequence=SeqID_4220; Location=3798..3977; Strand=-; Gene=SeqID_53652
ataaatttaaaatgaaatcatttaataaaacaatcaaatagaacactgctgctccaccgtccgggaccaaagagctttgccgaccttcgcaccattgatggcgttctatttggcactttcgtgggtacgtgccaacacttgggtcttcaagtgagcgacgaactcttccgccgagccatg

SEQ ID NO: 117886 - DNA, 846 bp, Heterodera glycines
  Promoter: Source sequence=SeqID_7957; Location=1484..2329; Strand=-; Gene=SeqID_66491
ttttaatcagcggaggtagcgtttaagagagagacagggcatcggtcggtccaaaatggcacagcccaaaatggggcgtcaaaatggcataaaagaatggcacaacccattacctccccccctccttcctattttaacgttaccccacccttaaacactaatctaatttcccccccccccctaaatcgaagtgccttcgctctctctctccccttctcctcttccccccccccctatccatccctttccctaattagtgaagctgagccgtgccgtgccccgaagggagtgacaattaaaggcctattttgtaagcggacaacaaaagaaccatgcccaggggcaataggaggaaacggcacacggcacacacacgcgaccattaaaacactcatttggcaaacggagaacgatcgatcgatgcttcattcatttgaatggccaaattgagtaacgaaagaaaaagcaaatctgcgaaatcgccgcgcccattcattgccctccccccaattaattaagcaattaattagtacttttcgttgcttcacctgcgccctccccgggcgctgttcatacatatttataagttgggttggcactgctaagcgcccctttcgttgagtttttttctctctttcccacgtggatttgaaggcctttctttctttcttcgtcctgccgattttctccccgttaaaattcatttccatttcaaattttccccatttttccttccccaaaatgctatcaattgaggcgagcatcggtaaattaggacaattagcacaatttttgtgccattttcagaccgttttttgagtatggcgtcgccactggcgaacaatg

SEQ ID NO: 117887 - DNA, 180 bp, Heterodera glycines
  Promoter: Source sequence=SeqID_32155; Location=456..635; Strand=-; Gene=SeqID_62487
ttcaccctcattttttttagaacaaactatcaattagggaaaattcgcaaatttttccccattacaattcaaaaaatcaaaatttgcgtattttttccccaaacattttgcaggggatacggtttttcaaaaattaaaaaaaatttcgtttaaatttgggaaaaacaggtgggcaacatg

SEQ ID NO: 117888 - DNA, 292 bp, Heterodera glycines
  misc_feature (27)..(27): n is a, c, g, or t
  Promoter: Source sequence=SeqID_38271; Location=1..292; Strand=+; Gene=SeqID_67139
atttgagtcgttttagtgcctattttntgggggtttttcgatcctaaaaaacgttccctcttattcataactttgcgcaaaagtattaaaattttaattcttggtattaaattcatagctctaagcatttgctagaatattgttggccaccataacattttgaaacgacgaattttgtgaaattttatgctttaataaacaacacagagagaaatcaaattatgccaattaagaaatctgggttcatttgatttccaaaaaaatacctcaattacaaatttttttacgaatg

SEQ ID NO: 117889 - DNA, 89 bp, Heterodera glycines
  Promoter: Source sequence=SeqID_43969; Location=1192..1280; Strand=-; Gene=SeqID_71529
ggtggccggggaacggatgatggggacacgaaaaaattcggaaattttttaggtctcgtgaactgttcccgattggctggtgtgagatg

SEQ ID NO: 117890 - DNA, 150 bp, Heterodera glycines
  Promoter: Source sequence=SeqID_15307; Location=2446..2595; Strand=-; Gene=SeqID_79541
taacttttctaactttcttagagattatttccttaaacatactgaaaattttttttgaagaattctccaaataaatttaaaaatgtgaattttatttatcaaaattattaatcatttttcaagctaacttattaattacagcagcagatg

SEQ ID NO: 117891 - DNA, 863 bp, Heterodera glycines
  Promoter: Source sequence=SeqID_5970; Location=950..1812; Strand=+; Gene=SeqID_59868
tctaccgtaaaaccttaatctaccatagtcatgtagacaacgtaggcatcaagaataaatatgtgttgatggacgtacgcatttctggagcattgaatatcgtgagtatgtggatgcgtacgcacgcatctaccgtaaaaccttaatctaccatagtcatgtagacaacgtaggcatcaagaataaatatgtgttgatggacgtacgcatttctggagcattgaatatcgtgagtatgtggatgcgtacgcacgcatctaccgtataaaattaatctaccatagtcatgtagacaacgtacgcatcaagaatactacgtgttgatggacgtcgccatttctggagcgctgcgtacgcatacatctaccgtgcgtatcgtacgcatgtagattcttttaaacaccatacgtatatagaaatgtttgatagtcgtagcatctggagtgctgcgtgcacatgtatctaccgtataatacgtactatttttctaccgtacgcattcctggagtgtacgaattcttctaccgtacataacgtacttatctttctaccgtagactattattgtgcgtacacatgagtctactgtacgtaatcacgtttgcatttattgggatgttacgcatatagattaatcaattagtctctctctttctttgttgcgcaagaatgtttacaaggcattgtcgactgacagattgtttataagaaggtgggagttcacatttcttctcattcgttcattttttaatacaaaaatttcgtctccttgtcctcaatcaatattttaatttaaaaaattaagcattaaaaatcattaaatcaatgtcaactcaacccactagctttttcaacgtcgccatg

SEQ ID NO: 117892 - DNA, 123 bp, Heterodera glycines
  misc_feature (98)..(98): n is a, c, g, or t
  Promoter: Source sequence=SeqID_3143; Location=1493..1615; Strand=-; Gene=SeqID_83395
acgcgtagtccgtgcccaaattccttatttatctacccgacacggggacacgtgttttgcgtataggagaccggtaaaaaactaataaaaaaataaanttataagggtttattaagacggatg

SEQ ID NO: 117893 - DNA, 718 bp, Heterodera glycines
  Promoter: Source sequence=SeqID_9072; Location=1..718; Strand=+; Gene= SeqID_70157
aaaaattgttaaaaatcgtactttttttgatcccgaatacactaaaaaaattacgatttgcttatttcctacccaaaattgttaaaaatgatcatgggaggcgaaaaatatgaaatttgatactatattaattgaccaatgatcttttgtttttctaaaaatcattgttaacatgacaaaaatttagcaggggtgggacgggacgtacgctacgcaatttgcaccattttccacgaccgcggctttttacgatttttttgttaagaaattacaggttcaagaattttatttattgaaattgaagcgcaattttaaatgacgtcgtcaatgtcggacaatttggcggatcggatgaagcatttgttgagcacggctaaacttgcggatgcgtactttttggtgggggacggagacggaaaggaggcgagtttatgtttcaatttttgatttttttaaacctttttttgttttttaagcttttgtctgcccacaaaaacattttagtgtctgcttccgacgtttttgaggctccgttttgactccaaaaatggaaaagtggaaaatggtaaaaaaaaaatgcgtaaaaacaacaaatttcctagcaaaaaaacccatagtagtgacacttttacgttgaaaatgtttatttttcaaattagcctctgccgataatcccgtggaggtgcctgatgttgaagttgtggcgttcaaagtgatg

SEQ ID NO: 117894 - DNA, 362 bp, Heterodera glycines
  Promoter: Source sequence=SeqID_12789; Location=388..749; Strand=+; Gene=SeqID_76501
agtgcgtacaggtacgatcagagacacagcagtggaagggcaaaaaaacaaccggaaaaatgagcataagtggtcagagatgcaaaaatagtgatcagcagcagcagaagggcaaaaaagtgattggagaaagggggcaaaaggcagagagatcgggaaaaaatgggcaaaagtaaagtgatcagagacgcaaaaaaaagagtgatcacaagcaactgatttagtgaaaagcagagcgataggagaaaaatgactaaaagtgataagagaaaaattgaaacaagaaaaattgcaaaaaatgatcaaaaaagtgatcagaacccagaacagaaaggcaaaaagcagagtgaccaaggaaaatg

SEQ ID NO: 117895 - DNA, 665 bp, Heterodera glycines
  Promoter: Source sequence=SeqID_23320; Location=1340..2004; Strand=+; Gene=SeqID_54024
tgtctttacttatccgctttttctcctcttttttttgtatgtgagtcatcatttgtgctcctctaaacacttttgttacacttatttcaattcgatcgcactaacgggtatcgccggatcagtcaccagcctctccttctctttatccgtttttaaccaagaattttacagattgtcaaacccattcattcattcatttgcactcccaacgcacgcacaatttttgtttttttttattattattggatttgtcaattctgctggatttgctgctctcctttttaaaacaccaacaaaaaatgatacattttttgtgcagcttttgctaattaatgtacacttttttccattgtcactcatttcattcactgctcattgtcgtacaatttggaaaagtccacgcaacaactcagttcaaattgataaatttgatttcacctccaattgtctgctccactttatcgttacgatttccgtttacattttcacttttaagttagaaattatttatttcccattcattcattggaaacagggaatacatactgtatttattttattgtacggtatctttgaggcaataaaaaaacaattccacaggacaatgcctaacataaatcatttagatttttacaaaaatacacatttaattgaattggcaaatg

SEQ ID NO: 117896 - DNA, 68 bp, Heterodera glycines
  Promoter: Source sequence=SeqID_10696; Location=1278..1345; Strand=+; Gene=SeqID_73948
tttttgcaaagttaaatatttaaatacaaatttaaatagtatttatttttaaatgtcagtttaaaatg

SEQ ID NO: 117897 - DNA, 984 bp, Heterodera glycines
  Promoter: Source sequence=SeqID_2537; Location=3084..4067; Strand=+; Gene=SeqID_80257
tgttccgatcagtcccatcctgatcagtccctcgcgccgatctgtccgatcattcccccctttccctttccctttttctctgtttgttgttttcacttttgtctctgtcgtccccacccccactttcccaaatgaaacgaaaattggtgaacatttgttggatgtgattgggcaaaattgtagcggcgggtggcggtaatcggaaaattgtcgtcgtcggcgggtcccaaaaatgcgcgaaaattggaaataaattgatcgatccatttgggacgaccatagggggggggaggaaatgcaaaattcggccaacacaatgagacattttggtagtacgtcaaaatgagataattcaatcaaagaatggtcaaatcgaaatatatggtgtaaaatttgagtcatcaaaaaatgagtgatcagagataattctttgcttctaactttttttatggtggttctgctgatcagcacctttctgatcggcagacattccgaatcatcttcggttaaaggtgaaaaaaacatagtgacgcacggcttgctgatcaaacagtgtttgtgatcattgtgctgaaatttcattcacgtgatcacacacaggatgatcttgaaaactcgtctgacaatcaccagcagagctgatcagttttttgcgcaccagtacttctatatatcaataatacaatcagtatttgaccctatcgattcattgcttttcggcactaaagccacagtcaatcaatattttcccaatcgattccttgattttctgtgtcaattctacaatcaatcaatattggctttcggcaccaaatccataatcaaggcattttttcccgatcgattgattggttttctgtgccaattccacaatcaatcaataactgcctttcggcactaaagccacaaatcaatcaatattttcccgatcaattacgaacgctatttaaccccctttttggcacacaggacctcagcaaaatg

SEQ ID NO: 117898 - DNA, 133 bp, Heterodera glycines
  Promoter: Source sequence=SeqID_2084; Location=3266..3398; Strand=+; Gene=SeqID_77762
tttcattaccaagaaattgaagaatcaaagaccacccacttctttgccaacgggaagccctgagcccaaagtgagcgtcagagaaagcattttggcgaccaaagtgcggaaggagaggtaattctgcagcatg

SEQ ID NO: 117899 - DNA, 360 bp, Heterodera glycines
  Promoter: Source sequence=SeqID_24401; Location=934..1293; Strand=-; Gene=SeqID_55130
aagggatgcctaaagggatggatcaatcccttaaacatttaccatacgtcttttttactatatggatccatccctttatgattgactaaagggatggcctaaagggattgatccatccctttaagattgagacagttagagtaatctctacactatttctctattactctagtatctctaactgtttctctctttaacacagtctctcgacactctaatagaatatgggttgaataataggtccgacagttagagtaatctctacactatttctctattactctagtatctctaactgtttctctctttaacacagtctctcgacactctaatagtactgcccccccctcacacaaaatg

SEQ ID NO: 117900 - DNA, 158 bp, Heterodera glycines
  Promoter: Source sequence=SeqID_5225; Location=739..896; Strand=+; Gene=SeqID_57323
gctgaatttttccgtttatttttacaattattaatcgttctgaatcaatttttttgaaacatggtaaactgcttatacgtcttgttggaaaatctgttcatgttttctttttttcggttcaaaaaccaaattttatttcattatgtttgctaaaaatg

SEQ ID NO: 117901 - DNA, 122 bp, Heterodera glycines
  Promoter: Source sequence=SeqID_30568; Location=1..122; Strand=+; Gene=SeqID_60982
ccggtgagattggataataatttttgatgcttaacttttaaaaacggctctcttgacagaatgacactgtcccacccggcagaaaggttgaggtgttcccgttggagctgttggaagtgatg

SEQ ID NO: 117902 - DNA, 192 bp, Heterodera glycines
  Promoter: Source sequence=SeqID_11123; Location=341..532; Strand=+; Gene=SeqID_74463
ttgggacggagagagagagagggagggggaagagagcgaattggacgacacatccaacacctgagcagagattggccattatgggagtggtcgaatggcataatagcaaattaaatgcaaagtgaaatgattagtgcccctttccctcgcctgaagtgcccgcaggggacaaagcgcattcagcgggaaatg

SEQ ID NO: 117903 - DNA, 184 bp, Heterodera glycines
  Promoter: Source sequence=SeqID_11817; Location=1100..1283; Strand=-; Gene=SeqID_46988
ggcacgttttttctttttttttgggggggctgattttctgaaaatttctttttgaattaaaaaaaggtgagagctttttaggaaaaaccttcccagcaaaaaaaaaaattaaatgaattttctttctttatttctcatgtggccaattagaaatcactgctttcagagattgcgttgagcaatg

SEQ ID NO: 117904 - DNA, 595 bp, Heterodera glycines
  misc_feature (13)..(13): n is a, c, g, or t
  misc_feature (30)..(30): n is a, c, g, or t
  misc_feature (52)..(53): n is a, c, g, or t
  misc_feature (92)..(92): n is a, c, g, or t
  Promoter: Source sequence=SeqID_25043; Location=1..595; Strand=+; Gene=SeqID_55777
agtaattattatntattttaaatgtttttntaattatatgaatttttactgnnaagagattaaactgattctttttttctcgtcgtcttatntagtagataccttttcttcccaatgtaatgcttgctgataaataaaaacgttattttataaacttatatttcttcatgctcttctcaataataacaaagttaaaaattattaaaattatatatataaaaatattttaattttttgattgcttttttttacaaaattttttttgttatttttttatctatcaattggggagcgcccttaatcaggtcatcaatgactttctttggggtttaaaagaattattattttatttttaaacaatgatttatatatatttcaattgccatttgggtgtatgctatgcgcaattagagaatggcaaatcaacctttttattagtttttgcggggtatcaatttaaatgttgatatttaattaaatcaactaacattatgccatcaacgcaaatatcaacgtaatttttaaaatttgcgaaaattttttaaaatttatatgagcggtttataattttagtgcgagagataacgcaaaaatg

SEQ ID NO: 117905 - DNA, 1003 bp, Heterodera glycines
  Promoter: Source sequence=SeqID_8746; Location=1330..2332; Strand=+; Gene=SeqID_69088
acataaatcccacttgaaatttgtcaaaatgattaaatgttaaagacattatgccagagatatttttcaaagaaaaatgaacaaaagaaggtttttggttgagaccgagtcggaccggatctggtcaaaaattcgccggaccggaccggattggcattttcaaaaatgaccggattccggatccggtctctcataatccggtcaatccggtaatccggtcaatccggatttttcccaaaatcgccggaccggattgccggatccagaaaaatccggtaccggatccggtccggctcggtctctattaattattcttctttttttacactgttctgaacattcgacaaagttaatcaaaaactgaggccaggccattaggctagcaaactaaatagataactactaaacctgtagagccatttaaatttgttggatttgattgaccaagaaaaatgaaaaccccaaagattaatgagcacaaagcattggaaaaaagtggagacagctaaagaagccgaattaaattaaagtgaacataaaaaataattaagtgatgaaaaatgagtaatggaattatttgagtaaaggatttaaaaaatattgtgatgcgtaaagtctgttcatttaatccgtctaatgggaaacgaacttttatttattttattattatttttttgctcattggtaaattcccaattaaaaaaatagagaacttaattcgatgattgaaatttaaagagttttttaaaatattgaagtttctgtctgtttcaagtgaattttcttatgacgtacaacgcatcagcagacttggtaatcggaattccataagaatttatttataaatttgattaagtggttccaatatttcacttccgatgggccccaatggctaattcttttcgctgtgtacggcgcccgctctctgtggacaactttaggactttcgttcaactttggcgttgtgtacattactgccaaatcaaagtgattaattagcatg

SEQ ID NO: 117906 - DNA, 1003 bp, Heterodera glycines
  Promoter: Source sequence=SeqID_3947; Location=987..1989; Strand=+; Gene=SeqID_45684
gagagtcccacgactcgggaaatatgtagtcggaggactgactatacatatgcaactttgcagattccaatccaatcgaaactaagacttttgccggattatttccttttcataaggcatttatactttaggcactcagagttttgcattgtgaaatttcaaatttcacaacatatgataattggcattatgtttttttgaaaaagtgttttttaaattctatcaaatttaaaattgtttcctttgccttttctaccactctttaattgcctgcgattgatttttgattgtcgtttatggaagagttcacatttttttccatccattcctttacaaaaattggagggaattctcttcctatttatgtcatgtcgcaaaagaatatgcatggaatggtactgctgttgtatgggcccatattttttgagattgatgggatggaattggagaataaaaatgagcacaagaaaaggaaggaaaggtgaaggccttccatcgtgtgatctttggtcttttccatcagctcacaaatattcgagtggaaaggaggggggggggaaggggtaacaacgattcatttttggtgtgcaatcgcattgaaaggagagaaagtggaaaaatgaaaatggcaccgccccgtcccctttcacatatttgatgggtgtgtatattcttaatttgttatttgcatggttttatttatggaatttcatttttctggttcttttttatttcatttcattttaaagaacttggtaaattaccttttgtttgttcgaatttcttgaatttgatgtttcgctttattctgactgacagtgtccgactagtcagctcaatttgcgctaaaaatcggatttttctgtgagaatttaagcctcatttgcactttcacatttttctctcccatacataaataattatgcccagtctaacctccacaatttttagtccgaccaaattttccactcattttgcgtccaaaacattccatccaaaaatg

SEQ ID NO: 117907 - DNA, 819 bp, Heterodera glycines
  Promoter: Source sequence=SeqID_10197; Location=1..819; Strand=+; Gene=SeqID_73309
ccaactaattaaattttgggggtgcactgtgaaagcctctgtaaaaatttaatttacgatgaatagacaaacaattttttatggtaaattttatattttgggttttctttatttaattagaaaggcacttttagcctttagaaaaaaaaaaatcaaaatgccattttcattgcctactctcgacaaattgggtcacaaaattaaattattatttttagcgcaatttttaaaggttataaaatggacttttatatcccatatttatccattttttggcattttgtccatatttgggttccatttcttgatttcaatttttttttaatttgctcgagaaccttttttaattttaacttaattaaaaattggtaaattgggtgaacaaaacgaaaaattgaaattttcgctttttcaatggtttttaaacaaaagattaaattgtgtttttattggtcaagcgtttaaattttcccagaaaattaaaaaattttcttttttccaatgccattttaagatgaaaatagagctgagcgggaccgggactggtactgaaaaagcgtacaaatgagtaccaattcccggtttttttcccggctttcccagccaaaaagtcccggtttttctcaaaatttccggtccagctcagctctagatgaaaatgacagctgacatatataaatcaaaaataagacagtgaattgcgaagaccaaagctaaaaattttagaaataaattaagtaattaatgccaatttccatttatttgcctctcaaaaaataaaaataatttaaaatattttagaaagaaatttaaaggatg

SEQ ID NO: 117908 - DNA, 436 bp, Heterodera glycines
  Promoter: Source sequence=SeqID_32470; Location=1..436; Strand=+; Gene=SeqID_62774
agttcgtgtgtttaagtaagacaaagcaagcatatcgacaaacgattgtcatcaaacttttttcaagtctaccgaattttaaatgattgaactcattagatagttcattactttttaaagaaagtgatcctttttgagtttgggacatagctgataatgaatgaatgatatttattttattctgcactgtctttgtatgaataatatcactgaaagtttttttattgggttcccggtgatttagtagtcagctaagtgttttcgtcattattagatataaatacatttgtctgatgggttctggcgaaagcatttactaaaaaatcaacaattgattggaatcaaaatgataaataaattcgtaatacccctaaaaatatcttgttttaaacataaatctaaaacaatgtttaaatttttcaggtgttcggatatg

SEQ ID NO: 117909 - DNA, 548 bp, Heterodera glycines
  Promoter: Source sequence=SeqID_20866; Location=581..1128; Strand=-; Gene=SeqID_51451
tttttcattttttatggcaaaatttaattttagccaaaaaattccgaaaataagcattttgctagcgaaacgggtaaaaaatgagacttttatgcaaaattcacgtatttataaagcagttttttccgttgtttgcacatattttgggtttttttttgtcacatatatatgtacatatttggcgttttttagcacatataaatctgttccatcgtgataaaattgtgaaggaatttaaagaaaataaacatacaaaatgccaaaaatatcgcaaatatttggacattttatatgagtatttgtacagagaatatgcccaaattccaacagtgaagccaaaatttgtgtttaaagatgaaattgaaattgaagggccaataatttatgcggtcaattgtctggtgcaaatttcgcaattttattttcattttaattggaatatttttgaataccgtttaaatcaaaaatattacaatttttttgcaccaattctattaaataatgagcaattgaattatgaaataaaatttggaaatgaacaaaagatg

SEQ ID NO: 117910 - DNA, 678 bp, Heterodera glycines
  Promoter: Source sequence=SeqID_11458; Location=1..678; Strand=+; Gene=SeqID_74857
agagaaatttggcaaaatataacaaatttttggccatggggaaacattgacggcacggacacatttttagaatatgtatcaatctaaaacaattgccatagcaccgtcccatgggaaacttttcataaattgggcttctcggaattaagtgaaagcccccgaaagaattgggaataaaacaaaatgccaatctcagctgaaaaatggcaatcccagccagttgaaagtgccaatctcggctgaaaagccaatttcttccggctgaaagtgccaattccggctgaaaatggcaatcccaaaccctgagaaaaatttagaatcccactaaaaaattcgttaaaaatttaaatatcttaaaatagaaaaaaatgcttagaaattttccgggcatttgtctccattccgaacccctgggagtcgaaaaatatggcctaaggcatgacgatgaaaattcccggcactttgaagcgatcagcgcgggacacaagtgccgatgaagatgatggtggcggtgattttgacggcagcagcaacgagactgagtcggacagcgctcagtttggaagccaattgaaaagggacggcgccgccggagggataagcattggcacttttcttggcaacatttcggcatcggcacgcgctcaactgcacaacattgtaaacaatgcgagcatg

SEQ ID NO: 117911 - DNA, 588 bp, Heterodera glycines
  Promoter: Source sequence=SeqID_31366; Location=635..1222; Strand=+; Gene=SeqID_61732
attaaaagcaataaataatattttgattatttattttatttctgtatttacttaaacaaaaaaaaaatttactaattattcgaataaaaattcgtttgtattaagaacaaacatttaaaataaaagaaaataagttcactttattataccaacaattaataattgaaacttttagtaaaatatctttttttgtttgtttatcaatatgagatccatttaaattttttcacaaatcaaaattttctaaattattaattttaaatgacttccgctgaaaacccaaaaagttctggacacagacaagagttaataaataattaaaaaacataaatttttgtcaagagaaaataataaatgatttaaagtagagaccggaattttgaaattgccgggaccgggacttggaaaatgaaccgggacgggacccgggacttggactcccgttttaaacgggattcccggtaccagtaacagtttttggccgggatcccgccgggaccgggattttttcaaatttttgaaattttgattaaaaattcgaaaaaattttataatttatattttagcttgggaataggccaagcaatg

SEQ ID NO: 117912 - DNA, 246 bp, Heterodera glycines
  Promoter: Source sequence=SeqID_29848; Location=1..246; Strand=+; Gene=SeqID_60310
ctctttgcccccctcgctccctctccttcgctccttctcatcactctctttctcgatatccccgtacatcctcacaaaatctcatatccgtttcccaatcttctcctgtcgccgatcccttccttctcgatcctccctcatccgtcctccccccccctccccgaattttcacgctttgtccatcgtccgcccttcttcccctcattgtcgatttttatctttctatccgttatttttcagtccatg

SEQ ID NO: 117913 - DNA, 56 bp, Heterodera glycines
  Promoter: Source sequence=SeqID_40377; Location=490..545; Strand=-; Gene=SeqID_68732
aaattgtacaattcagatcacaaaaaacaattatttcttgctaattattcgtcatg

SEQ ID NO: 117914 - DNA, 176 bp, Heterodera glycines
  Promoter: Source sequence=SeqID_10354; Location=722..897; Strand=+; Gene=SeqID_73536
tttatgtacatacatacatatgtacatacattgctcttgcagtttaggccccacgtaattttatgacaataaaaaaaagtcaatcatttgaaattagtttagatcagtttttaaaatttcatccatttgacatctatttttgaaaatcagcagtttcttctttctgtttaataatg

SEQ ID NO: 117915 - DNA, 134 bp, Heterodera glycines
  Promoter: Source sequence=SeqID_16293; Location=1723..1856; Strand=-; Gene=SeqID_80680
taatgataaattttagctctcgacatcgccgatttcgaaattcttatttagtgtcaagaaatttcttcattttttagtgcctcggttcgtgagtctctgagaattttcactaaagaagaatagaatttaaaatg

SEQ ID NO: 117916 - DNA, 421 bp, Heterodera glycines
  Promoter: Source sequence=SeqID_33437; Location=1..421; Strand=+; Gene=SeqID_63507
tattttgaagtgttttcattgccaaaagaaattcttttttctgtcaaagtcagggctcggaccaaaactttttcaaaatcagaacatcaggcccaaaaaatcagattttgaggtcgaaaatcagaatattttgcaaaattgctttaaatcgacttggggaacaatttaatcaatttatatagcatcaaatttgtatttttcacctgaccaagtaagaaaaagttaaggcctcaaaaagtgagaatgttcactgattggacgcgtaaactggaatattgaccaaacttcttcttcctctgacttgacagctccctttctaacggctaatttaaatattcatttattaattatgtaaatttagataatacttttagcttttgcctatttttatttgttttttgattaccaattcaaaaaaatg

SEQ ID NO: 117917 - DNA, 266 bp, Heterodera glycines
  Promoter: Source sequence=SeqID_37405; Location=802..1067; Strand=-; Gene=SeqID_66485
aattgaaatgccatcggtaggcagccgactttcgtatggccaaaatggaatcaccgagaggagaagacagtcggagacatgacgacactgatggcacaaaccgggtgctgtcaggtgaacaaaaaactgatcaatttattgataaaccagaatataagattaaacaatgaactaattagttagcaacgaagctgagattttgggcccttttttgttgtccaaccttctaaatcagtcttaaggttttgccaaggttatctaatatg

SEQ ID NO: 117918 - DNA, 453 bp, Heterodera glycines
  Promoter: Source sequence=SeqID_5412; Location=1..453; Strand=+; Gene= SeqID_57937
tgtcaaatatggacataaatttttcaaaattgaatgtaaaatttcttcaaatttattggttgaaattgcatatgagatacatttccaaattttttgactcggtaaggcgctttgacaaagacggctttcgttttggcaattagtcggtcaacattcggaaattggtctcgaattttttcggcaattatgtgcaatcattttaaaagaaaaaaaacataaaagctaaaatttattaatttttttagcgcaaaatcaacaacaaaagcgaaatgttcgcttttttgcttatttttgacataaatttattaatttttaagaaaatttaaatttattcaatattctcgagaaattttggcgaaaaaatgattttttgaaaaatttttcgggttttgggctcaaaaaggctaatttagctgctgggggccgttctaatagaggtttttttgaaaaatg

SEQ ID NO: 117919 - DNA, 657 bp, Heterodera glycines
  Promoter: Source sequence=SeqID_40062; Location=1..657; Strand=+; Gene=SeqID_68503
ttatttttattctcaatcaagagccaattttttttaattctcactgtttcattcaaatttagaattttgcctgccattgtttattttacattgacgaaaatgccgacactttgatcaaatcggatggatttttgcaaattgaccaaaaaatgttgtgcgaaattttggaacgcgacgaattgcaaatccctgaagaaattcaatgtggaatgcagtaaattttttttaatttaaaaatgttacaaatttatttttaaataagtccgaatctttttttaatcactaaattgttttgaataaaaaaataaaattttctcttcaatttccttactattttctcttctctgactcgtcgctgctaccatttttagcggcgggcagagaagagaaaaatagtaaggaaatttgagagaaaaacttctctcaatttaacttgatatttctaaattgtgtttaaaagcggaaattatcgcatcgatttttttccataatgttccttttttcacttatttttattctcaatcaagagccaattttttttaatactttattttcattcaaatttagaattttgcctgccattgtttattttacattgacgaaaatgccgacactttgatcaaatcggatggatttttgcaaattgaccaaaaaatg

SEQ ID NO: 117920 - DNA, 180 bp, Heterodera glycines
  Promoter: Source sequence=SeqID_18370; Location=3393..3572; Strand=-; Gene=SeqID_82973
ctattctggtcatttttgcgcactttgaacctgatcaaaaactgggttaaagagcctgtattttcagtcctttgtttttgtacaggaaatacagttacaggtcattcgggaatacagatacaggtacaggtctgaaggaccttatgaatatttagtttttttccagaaatcgaaaaaatg

SEQ ID NO: 117921 - DNA, 1003 bp, Heterodera glycines
  Promoter: Source sequence=SeqID_11497; Location=718..1720; Strand=-; Gene=SeqID_74923
tcaaaagcattctgaagatttcttttggttttgaatcattttattgccctcttagatgccctagcgaaaacacagctgaggctttgttccaacatgtcctattaaaagaagaattatattcgcttttctatcctttggatgatgtcataacactagaagtaactataatcccagatgtcgacaatagaccaagaaattaattttataaaaaacaaaattacgagaaattggaaaatttctggaaaaatacttaaacgatcaattaatctcgaaatttttgcaaataaactttttaaacgggtgaaaaatttctacatagcggcatttagtgcccctgaaatcgaaaatttatatttttcattcttagaaatgcttgaaaaaattcaaaaattaccagggcttattatgtatgaatatagaaaacagtccttagctatgcaaaaattagaaattggtatcaaagaacgaaatatatttaaatgtcaagaagcagagaatatgtcagataccaatttatcgaagataaataaattccaaaaacaagtgccaaattatcgatttgacatgaaaatgttatacaataaaatacgattaactgctattaagcatttatttaaacccgaaaaataaatttttttttagcccatatcgtacggaaagaaaaagagaaattttttattcattatttcggcatatctaataaaatcgcaactttttcttgcaaaaaaaaacgaaacattttcgttactaatagaatcgcatgatttctagtgtaatatttgagccttactgcacaaaagaccaaaaagttttgcaagtttgaaggtcatttactaatttaatttgctgaatttggactaaattaggattgcgtcagaattacaatgtaaaaaagtgactatttaagaaactcaaaattttcattaccgatataaaatttttacttctacccaatagcttttttaattttattttttagtaaaattctttcaattttattatg

SEQ ID NO: 117922 - DNA, 348 bp, Heterodera glycines
  Promoter: Source sequence=SeqID_17273; Location=1..348; Strand=+; Gene=SeqID_81738
aaatttaattggccgaaaatgatggaattttgaatgaaaatccgaaaataaccttaaaaacagtaattgaggcacaaacaaaggtaaaggaattggccaaaattttctatattaaaaaccggaaagtgtccaaatgatgttctgaaatggaaaagagttgtttctgattattgcctaataaatggggccatttactttataaaaggcaaagaaaatatcgaaagacctaaattaataatccctcattcattacgacaaaagcttttcattattttccattcagaaggcaattttggagtcgtaaagacttggcacgaaattaaagagcgattttattgggtcgaaatg

SEQ ID NO: 117923 - DNA, 120 bp, Heterodera glycines
  Promoter: Source sequence=SeqID_7019; Location=2330..2449; Strand=-; Gene=SeqID_63581
aaaagtgaatttaattaagtgttctattggttttgctgtttttatacttttcttattttttcaatgaaaagccataatttttaatgcgagaacagaaaacacaaccaatagaggccgatg

SEQ ID NO: 117924 - DNA, 804 bp, Heterodera glycines
  misc_feature (16)..(16): n is a, c, g, or t
  Promoter: Source sequence=SeqID_18184; Location=1..804; Strand=+; Gene=SeqID_82765
catacacatttttgcncatttttcattcccccataaaaaaatctagctatattttaaaaatttctggcggcggcctcaatgataaaatgatatcaatttgtaaaaaaagaatctgaagtaattaacttttatactaaaaaatagcaaaacaccattctatttttgatgacctgaatataaaattaaattaataaattttatttaaatggcttttaaatatctttaaaaaagtaatattttgttatcagcagtaaaataataaaatcatggctcactaaccaaatcaataaaaaaataaataaaacttacaaaaaaaattttactgctcgcaacaaaaaagaaatattatttaaaaatgaaatcaaccaaagcgataataatgaagaaaataaagctatttatattttaattaaaatatatcgccagaaaggaggtcgaagaaaatcctctgtaaaacaagataaattaatacgaattatctttaaaagaaacagcattaataaagcatatagataataaaacttaattaatttaagctaatcacaaaacattagaactattttacaaataaaatattattttataaaatatacttcttaacctaaaggaacaatttatggaatattttattataaaaaatttaaaaaagaaatttccacaataaataaagatttaatgtaagataaaattaattaatcattaaggttttcgaactaaaaatattgtatcaaattaaattaataaataaaatgaagtgaaattcgttatgattaaatgtgctttcatgaataagaacaaaaaatg

SEQ ID NO: 117925 - DNA, 337 bp, Heterodera glycines
  Promoter: Source sequence=SeqID_21511; Location=1..337; Strand=+; Gene=SeqID_52121
atgaaaggtaaattaaaaataccttctgattttgctatgaaaatcagaatttttccggttattaagtttgaaccttaataatcagaattattctgacatgaaaggtaaatcaaaaatacattctgattttgcagtgaaacccagaacttttccggttcttaagttgaaccttaataatcagaattattctgacatgaaaggtaaacccaaattattttgtaatgaaaaccagaattattccggttgttattttgcacctcaatgtcagaatattctgagtcatcagaatactactgaacatgaattgtaaatcaaaaatacattctgttttgctatg

SEQ ID NO: 117926 - DNA, 263 bp, Heterodera glycines
  misc_feature (20)..(20): n is a, c, g, or t
  Promoter: Source sequence=SeqID_22940; Location=929..1191; Strand=-; Gene=SeqID_53643
agttcggatactgaaaattntatacataagaccgaaaagtcaagtcggaaaaaatcgaatcaggtggattggggaattcaaaatttttgccggacggatttgtggattaatcgcgcaattaccaaaaaaatgcggaaaaaaatccacctctaattttccaaaaaatttaaatttataaggaaattttcaaattaaacaaatttttagagaaacgcgtgattttgcgggatcccagttcgtaatcccgcattttttgtaaaatg

SEQ ID NO: 117927 - DNA, 101 bp, Heterodera glycines
  Promoter: Source sequence=SeqID_33609; Location=1..101; Strand=+; Gene=SeqID_63622
tttattaataataatatttgttttccagatcaaaatgcctatgtcaacatactatatgaatgtcgtgaacgacatcatagcgtcctgggttgcactccatg

SEQ ID NO: 117928 - DNA, 210 bp, Heterodera glycines
  misc_feature (20)..(20): n is a, c, g, or t
  Promoter: Source sequence=SeqID_38372; Location=999..1208; Strand=-; Gene=SeqID_67203
taaatgggaagcaagaattncggtctaatcaaacgatgtaaaatttctaaacttttttaaaacttaatgagtttttaagcaaatttttcgaatgcggagaaattggaatttgtgaaaaagtttgaaaaaaagaaaaaagaaaaaactcatggctttaaatatgacagaattaaacgaaaaaaattagaagtgaaaattgcgaatgaaatg

SEQ ID NO: 117929 - DNA, 976 bp, Heterodera glycines
  Promoter: Source sequence=SeqID_14899; Location=665..1640; Strand=-; Gene=SeqID_79063
tgatacaaatattttaaaagaaagttctatagcattagtattgtaatttagaagttaaattttataagaacacgtactgaattccaaacccgggtccgaattcgaacaagtcgaaagtagaaatttgcgaaattagggtttttgtttgaaaccggtttaaatacacggagacgaactgaaagccatcaatccttcaataagagatcattcacgccggttttgaaccaaaagcagggcttctatctgttctgatttatcagaaatgctctgatacgcaaattttgctcatttttggacaagaatccgtaaaaaaacttgaaaaaatttcaaaaaaactttcggcggcagcctattggcaccatcggactctaaaaatccattattttcttaaaaatagctcaaaaatcacaaaattggactatttttcgacaaaatcagttaacaaattgcactcaatttttttcccggcgcctatcggcaccgccggacccaccgtgtaattatattttcgtcagtaagcattttcgtcagtgaacgatttcgtcagtgattttcgtcagcgaataatttcgtcagtgaacattttcgtcagtgtactatttttatttattttgctgttttccatttttttcgtcagtgttccaattcgtcagtgaacattttcgtcagtggatgcataaaattaaaaatttttcatttttatcaacttctttaatacagtatttatcgctttttgcgtatggtaactctagataaaataagtgattatttgtactttaataaatgatttacataaaagaaattgtactttaaaactgttgaatattattagtaactcaaacttcttatctcgccatcgttcccatgcgttctcgagtgcctgcctatttgcatatttgtttagtccttatctagtttttgcaatgcataaaaatgaacgatatgaaaattcattcgtttactgcaaccaaaaatg

SEQ ID NO: 117930 - DNA, 155 bp, Heterodera glycines
  Promoter: Source sequence=SeqID_6541; Location=1897..2051; Strand=-; Gene=SeqID_61934
gcttataaaatgggggtaatatggacaatttaaagggaatcaaaacatgaaaaatataaatatataaatttagacatatggaaaaagcccaagaaaaatatacaataaaaaatatacacaaatatatacaaaactaataaaaacagatacacatg

SEQ ID NO: 117931 - DNA, 76 bp, Heterodera glycines
  Promoter: Source sequence=SeqID_25708; Location=1245..1320; Strand=-; Gene=SeqID_56452
ttcaacaaatttttctcgatccgcaacactagcacaaattcgcgcgcccacttcgtcaggggaacagcccaaaatg

SEQ ID NO: 117932 - DNA, 155 bp, Heterodera glycines
  Promoter: Source sequence=SeqID_3717; Location=1079..1233; Strand=+; Gene=SeqID_51590
ggtaatttaaactgtttaaagggtttaatcactaacttttcctataatttcatggtgcaactgtgctgtttggtggtcggcaagtgtttccatccggcgttgaaaaaggcttctatttcgagcccgctgtgctcaccgatttggacgatgagatg

SEQ ID NO: 117933 - DNA, 107 bp, Heterodera glycines
  Promoter: Source sequence=SeqID_8413; Location=2307..2413; Strand=+; Gene=SeqID_67980
atcttgattttcagtttggaaagaaagagcatttagtggtatcgaatatatcaagattttcaaattggttggttatgaaaaaatagacactgttaaaagtcaaaatg

SEQ ID NO: 117934 - DNA, 1003 bp, Heterodera glycines
  Promoter: Source sequence=SeqID_3947; Location=793..1795; Strand=-; Gene=SeqID_52553
gaataaagcgaaacatcaaattcaagaaattcgaacaaacaaaaggtaatttaccaagttctttaaaatgaaatgaaataaaaaagaaccagaaaaatgaaattccataaataaaaccatgcaaataacaaattaagaatatacacacccatcaaatatgtgaaaggggacggggcggtgccattttcatttttccactttctctcctttcaatgcgattgcacaccaaaaatgaatcgttgttaccccttcccccccccctcctttccactcgaatatttgtgagctgatggaaaagaccaaagatcacacgatggaaggccttcacctttccttccttttcttgtgctcatttttattctccaattccatcccatcaatctcaaaaaatatgggcccatacaacagcagtaccattccatgcatattcttttgcgacatgacataaataggaagagaattccctccaatttttgtaaaggaatggatggaaaaaaatgtgaactcttccataaacgacaatcaaaaatcaatcgcaggcaattaaagagtggtagaaaaggcaaaggaaacaattttaaatttgatagaatttaaaaaacactttttcaaaaaaacataatgccaattatcatatgttgtgaaatttgaaatttcacaatgcaaaactctgagtgcctaaagtataaatgccttatgaaaaggaaataatccggcaaaagtcttagtttcgattggattggaatctgcaaagttgcatatgtatagtcagtcctccgactacatatttcccgagtcgtgggactctctaggcctagcacaggattctcgagcagtacccggcgacagacgccgattcaaattatcaccttttgttgttttgctgataagaaaaagaaaatgaaaggatatgtatgtgtaggaagggaataggttctgctgtgtgtgactgtgtgctgctgctgctacctttttcattctttaattaaagtttcccaaaatg

SEQ ID NO: 117935 - DNA, 178 bp, Heterodera glycines
  Promoter: Source sequence=SeqID_21277; Location=1289..1466; Strand=-; Gene=SeqID_51868
ccccccccccccccccccccaaaaaacttatttttgcaaatttcaaaaattttcttgaacaaatattcccacttttaaatggttagccgacaatttgcggactgataggggcccgaactgtcaaaaaataaaaaaaagttatgatgcatttccagattactcaattcctcccaaaatg

SEQ ID NO: 117936 - DNA, 149 bp, Heterodera glycines
  Promoter: Source sequence=SeqID_41140; Location=337..485; Strand=-; Gene=SeqID_69332
tttcttctcagcgccatacaattcgatgtcgaatggacaagcggagcgctttgtcaacacctttaaaagggcatgtcgcaaactgaagaaggagggcgcgcaaaatgttgtgaacacatttttgacgtcgtacaggacaacgccaaatg

SEQ ID NO: 117937 - DNA, 162 bp, Heterodera glycines
  Promoter: Source sequence=SeqID_22586; Location=1..162; Strand=+; Gene=SeqID_53255
gaccatccgttgccgaacaaaattcgttttcgtatcatttctattgggtaatttgaactttatgtattttaagttttatttattttaataattttcttcaggtacattgaccattccgtcattacatttctccgttcgaacaagcacatttgggacagaatg

SEQ ID NO: 117938 - DNA, 344 bp, Heterodera glycines
  Promoter: Source sequence=SeqID_14117; Location=730..1073; Strand=-; Gene=SeqID_78102
tattgagacctagaggtccctgcgtgcttgcatttttcactggcttcacttttcagcgtgttctttcctacgcagagaaacacgtaaagagtataaaaggactctgatttagtgcgtttgtcagttcactttgaccaaacaaatatatgttcgctccaattttttcattgttacagtttacgacctttttattttttttagtttttatataaaagaagctagcaccgttccctccccttcattcgctccatttgctgagaaacaatacaccctccccttctgtttcgtaacatatactttttttgctttagattatttagcaattatttcaaaaatactaaatg

SEQ ID NO: 117939 - DNA, 224 bp, Heterodera glycines
  Promoter: Source sequence=SeqID_7379; Location=1092..1315; Strand=-; Gene=SeqID_64657
aatcgtgaaattctgtataataaataagaatcagagcttggagattgggacccccgcggggatttttacgagagttccggtcccgcacccgtttttttttggtgaacgggattgtaacggcagtgggatttttatgggattcccgatcgggactcccgtcccagaaaagttttaactcttgctcccgcctccggaaaattttttaccgggctctaataaaaatg

SEQ ID NO: 117940 - DNA, 381 bp, Heterodera glycines
  Promoter: Source sequence=SeqID_35861; Location=551..931; Strand=-; Gene=SeqID_65322
cttcgacttggtagggtgagcaagaagaaattggggattttgtttattgcacagaaaaataatttacaattaatgtggtgaagggagctttttgtattgggtgaaaaactgttgctgaacgggggaaattcgacgagaaatgagaagaatgaattattgctcgaggaaggtatgatttgtgggtgggatttgtcgggagttccttaactgctaattagtgtaagggtgggcgcctttttcgtttggttaatggaaaggcggtaagcggaaacttcccataactttcgtctaagtaaccaaattaaacattctagatatcattcgatacccctaagggttctctctattacttcagggtaattttcagaaaatttgatcatg

SEQ ID NO: 117941 - DNA, 842 bp, Heterodera glycines
  Promoter: Source sequence=SeqID_8235; Location=1..842; Strand=+; Gene= SeqID_67392
gccggcgttcgcgttcatcattttgtaatgacataataaaatgttggggatattatgtgaacattaatctctatcgcttagcaaacccgtgagagcatttccgatatcccctcactttcctttgatttaataatggctttgttgtacattttacaacaagggctcagtgatcaatcgatcggaatgttcgcgtgttgtgtatttagcagggatggcattccgaggcctaaaaaattttccgggaatcggattccaaatcccctaaattttcggaaatcggaattccgtgccatccctggtatttagcatgaagcttttgcataaatttttttaatggaaaacggagaccagaagagcttttgaaaggagaagtacatagcaattcataacaaaatttaatgcgtgatacaattttttggctctatcgcacttttttaggcttccaatcgaattttaggcatccaatcaatgaccaacctcagtttcttaggccataacttttttctttcttggtcaatgcctacattcttggtttcaaaccaaagcttaaagtcccgaaaacataaatttaaaaaaagaaagcaaaaaatatatttattaggtttcaaaatttttggcaatttttttatgagtaacaaggttaaaggagagggagggggctggggcgtgtttgagtatcgatcaattctttttcgcaatgcgaaaacccaatttttagcccttcttcgtttctctccattttccatctttcaaaagacaaacaattcattaaaagctcttcttcagcagtcgctttggccaaaaaaaagagataaaacaattccatcaatataattaaaatg

SEQ ID NO: 117942 - DNA, 309 bp, Heterodera glycines
  Promoter: Source sequence=SeqID_5731; Location=455..763; Strand=+; Gene=SeqID_59056
tcgatgccacgcgttgttgcgcaatgcaagggcggcggatgcgaatgttgcggcggatgtggttgcgcggaatgcggcggatgccaacaattacagttaggcggtacgtacgtacaaattggcaccaattaattagtggttctctcgactcaggatttatttcctatctgatttaagccttttgaaattctttttcccaaagacattgttttctctacggcacaaaatgcttcttcaaacggcactcaaagcgatacacaaaacagcacaaatggtgccgttaaattgaatgagctagtgccaaaaatg

SEQ ID NO: 117943 - DNA, 328 bp, Heterodera glycines
  Promoter: Source sequence=SeqID_20601; Location=3015..3342; Strand=-; Gene=SeqID_51151
tttaaatcttttaaactcaaatgtgttttccttctattattgaagagtaagtccacaatcagcaggaagaacttttactaataatttaatgaaatttctcaaattaaaaaaaaaattctcaaattaattcgactatagaagaaatgcacattcatataaacattcaataataaatcaatatatctatctatttcatttctctctccatttctaatatttccattctaatattgctttccaagtgatttcgcatctaaaaagcaacagatatattcagcaattattcccctttttacacttatattattttaaaatctaactcaaaatg

SEQ ID NO: 117944 - DNA, 1003 bp, Heterodera glycines
  Promoter: Source sequence=SeqID_1734; Location=5913..6915; Strand=+; Gene=SeqID_75572
ttgtgcgggcgaaaatgataaagaatgagttttttggaatttttatgcaaaaataccattggtttttccaatttttagcacatattttcgcacatattttggcattttttagcacatattttattacatatttcaggatttttagcacataaaaatcccagccctagtaattacaatatacaatatataacgtatttgaaaatgcgccatcctttttcttaattctttcggatatgtataacaataccatatgtaaattttttcaaacctttcccaatgaaaaatatttttgttatataaattccggactttacatgtacaaatttattgcacacatcctgctgaaactgctcgcaaatgcggcggtggtgtgaaagggtcaaaagcgcatacaaaatttgcacaacccataaaaccgaaatgtgtttgaaatggggctgccgtcgccgccgccgcgacgtccaaatggaaatttaagtgcgttttgtgagtgcgcggcgcatcccccgctacttttggcgctccgccgcggtgtccggacacgcccaaggggcggtggcgggccgaaaaagtgggacgacggacggacgaacggacggaaagcgcagcaaattaggcggcaaagtttatagccgacttgcataaaaagcgacaatccatcaagccgatgaggggtttaattttttatcgaaatgaacaacgataatcacccaataaaagtgggacggatgccgaaaacgaatgggatggaagcgaatttaagggctgtctgatctgagcgcatcagtctatgtgggcactgtcctgtctgtcatcaaaatacaaaattcaaaactgcatcgaatttctaattcaaaaatgccgttaatttcggcatggattttttaccaacaatttatgtacaaattttatttttgaattttgactaaatttcttctttttgttattttcaaataatttgttaatccgatatcccatcattaaaagcacacttttgaaaatg

SEQ ID NO: 117945 - DNA, 655 bp, Heterodera glycines
  Promoter: Source sequence=SeqID_6597; Location=1..655; Strand=+; Gene= SeqID_62141
tttatagacaataaaaaatatttttattttttaaatcctttatttggtgcgctaacttcctaaagattaagtcgcgaattttagggaggaaaacccaaaaataggtgcagaaatttttaaaaatttcgattaagggtcgaactgaaattatactgttgtttataaaagataaataaaaggtttttcaagagcttaaaaatgccgattaataaaatttcttttatgttcaaataacaaagttaattagattttaatttcgcccctatttcggcattttggtgcatttcttccctattttcgcccacattcgcctctgttttggtattttcgactctgtttaggcctctaaattggaatttttcgcccttaaaaatccgtgtcttaatattgtttattgtttattcataaaaataaaattcatcacaagggcgaaaaccacttactctgacgactattcagataaatgtgtcgtagagtaagtgacaaaaatatatggatgatcacaggaaattaaaaagacaaaatagtgaaataaataaaataaattgaggtcaaaagtcaaatgaggtcgaagcataaaaattacaccaaaaagtcccaccataacaatttttccgtgattttcctcacgcaaaacctgttcgataaatcaatg

SEQ ID NO: 117946 - DNA, 163 bp, Heterodera glycines
  misc_feature (61)..(61): n is a, c, g, or t
  misc_feature (160)..(160): n is a, c, g, or t
  Promoter: Source sequence=SeqID_32889; Location=890..1052; Strand=-; Gene=SeqID_63120
tggtcttttttgggatttgacgctgtattttgacttttcagaaatgtaaaaaatctcaacngagaaaatggcagcgcggcacttcaaaaaagaaaacaccgaaaagagggattgcctaagggggcggcggaaggcgacggggaggggacgacggaacgtnatg

SEQ ID NO: 117947 - DNA, 623 bp, Heterodera glycines
  Promoter: Source sequence=SeqID_25126; Location=1..623; Strand=+; Gene=SeqID_45911
gagtttgaccatagacaaaattaaattcactatagaaagatgcagaattcttttctctatcgatatgcaaaatttggtgaggatttaacttgcaggaaaaaagttaaacgtcacgaagtgaattcggtttttctctattaacagagataaagaaatagtacgccaaaataagagatgtttttttctctgcactctctctttattgacacatgtctcgttttttgactcggtgtgtttacccatggcaaaatgactgggctttgacggaattgaccgggaccgggcttccttcgggatgactaggtctcggtggttttccaaaaaaaaagggaccgagctgccccgtaaaagcccccaggctcgtccgctcaatattaaaaactgcgtttgctcttgcctctggtgctaggtttatgtagcggcatattgaacaaaataacttttttttaaagaatgaaataaattccaagacggaagagattgtttttcattcattaataattgggagcaacacacacccaaaaaaaaaaagtttttactttattttcctaattttaatttctttttttttgttagatacacaaatcaaaaattagcatttgccatttataccgagcgaaatg

SEQ ID NO: 117948 - DNA, 702 bp, Heterodera glycines
  Promoter: Source sequence=SeqID_10931; Location=3091..3792; Strand=+; Gene=SeqID_74238
aataaatcaattccaaaaattcaatattattgataaaaaattttgttttgttattttttctttaataaacgtattgccgctcaaaatttgtgcattaaaaatatttttgtgagttttaatttaattttcgaattactcccgctcccgcccgggactcccgttaaaaatggacgggatttgaacgtgagcgggatttttacgggattcccgttcgggactccagtcccgtaaaattttgaactcctgatcccgctcccggaaattttttttaccggactctaaacaaaataaataaaatatttgctaaataaaatttaaaatttactaccaaagtttaagggtgactaaaatgaaaaaataaaaacaacttcataattttcgcttcattttaataatttgtttttgtattggatgttgggcccattaattttttgtaaataaaaaattttacattaatcaattaaaatgataaactatgaattaattaatatattgaaaaacaagaggaatacagaacttttattaaaaattataaaaataaattttgtaaaataaaacaaattattttaacaataaatttataacatttcgaaagaaaaaatcatacgcattctttctaataatatttatcaaataaaacaaagtaacattgaaaacattcattttatatctttaaaagaaaaagttataattgcgataatg

SEQ ID NO: 117949 - DNA, 80 bp, Heterodera glycines
  Promoter: Source sequence=SeqID_3060; Location=1087..1166; Strand=-; Gene=SeqID_83017
taatttacactaattagctaattagagaatgagtctagcaaatcaaaaattgtgaattttacccaggggaaagcagaatg

SEQ ID NO: 117950 - DNA, 640 bp, Heterodera glycines
  Promoter: Source sequence=SeqID_15684; Location=1292..1931; Strand=-; Gene=SeqID_79994
gcaaataataaataatataattttacgattttaaattacaatttggttaattgtctattttatctaatttattttatgtttaaaataatcaaaattcccttaactttttcacagatacttctgattttttggttgatccatcttttgctgatggttcatttcatccattcgcttctttgcgcgcatttggcgaccaaattgaggcgaattttgggcccaatttcaaattcgatttggcgactctctgaaggaagaattaattattcactaatgttttcgatcaatttgctcgtttttatcatttttatgtttttcttcttcaattaaaatttggttttctgtaataatcggaaaattttgtcgtttcccgggtatttaagactaaaagatgaaaatttacacaaaaaaaaaggttttttccaattatatgctaagattcatattaagtatctgctcatatgctatgaagaaatgggctcaaaaaagcatttctacgttaaaattttgatttggtgaaagtttttagtccatataaatccatatttagcgtttttagtttatatttctgccattttttttgagggagaggacaaaacaccggtcgaaatatcgccgcaaaaaatacatataataagaaatg

SEQ ID NO: 117951 - DNA, 734 bp, Heterodera glycines
  Promoter: Source sequence=SeqID_17628; Location=1..734; Strand=+; Gene=SeqID_82154
agtaatcccaaaaaccaacctttttttgttgaaaatctgttaacaaattgcacccaaatttttaaaatttcccccggcggcgcctatcggcaccgccggaccccttctttcccaaaagttttttgaaaaagcgctccgaaaaaaagtgatgtgaaaatcaaatctgaatttctaataatactcgatcatttagtccaaaatgattaattgtttgaaataattgaagaaaatttgtttgaaaattttcattaatttaatttgctttattttgggttttattaaataaaaaaccaaataattttgtattattttcacttgaaataaattaaaatttgaattttttttaaatttttaaaatttttttgaatttttaaaatttcccggttggtcccggttcccggtttttcttgcggtcccggtcccggtcctgaagaaaaatcgaggtcccggtcccggtcccggcttctcaggtcccggcaagtcccggtcccggttttggcaaaaattcccggtcccgtggcactctatattttacccttgattttattaaatttttttagcttataactttgtcaataatagaccaaataaaaccattttatgctcattttgaagggaaaattcggaggaatatttctaatttagtcaaaagattattaaaattgtttattggcaaataaataattcttgtgttattttatatggtagagacatggaaatagtacactaaaatg

SEQ ID NO: 117952 - DNA, 99 bp, Heterodera glycines
  Promoter: Source sequence=SeqID_16293; Location=329..427; Strand=+; Gene=SeqID_80681
tggcaaagggtgtttacagtaacgcgcagttttgatccaatcactactgtaacaccgttatctgcccatttcctggattctgtacattttcacgcgatg

SEQ ID NO: 117953 - DNA, 1003 bp, Heterodera glycines
  Promoter: Source sequence=SeqID_2200; Location=570..1572; Strand=+; Gene=SeqID_78462
gattttggtataaaaatatttaaaatgtcccggttcttagatggcgtcgatttgactttattcttaggttatgaacgtaactcatcaagagctttgccatttccgcacctcaggtgtattttttctgagcattacaggccacgagagaataatgaatggcatcaattttattcaattttttttgagtacaataataatttgatttaaatattaaattttctgatcactgacgcctcacaaaagagcattttcttggacaaaaaaggttaataaatttattacaaaaggcgtacaaaaagaattggtaattttacgagcgaaatttttttggtcgtgacaattagtctatagtacagccgcaaaatctgttaataaatcgcataaaattttcaaaaatctcccccggcggcgcttttcggcaccgcctgcctaaaattcgtctatcatttttttataatttggccaaaaattcatataaatagtcttttttggtaaaagctggaggccattcaattcaacgattgccccaataattgaaaatgaattccaatttttgttttcaattatttctgctcctggcaattttcactgtgacgaaacaaaagcattcaccgaatcgaatcgaaaggattgtaaagcactgaatggtgtaaaagttgaaatttcctttgacgcaacaattaattttggccaaaatgggccatcaaattctgacgattcgtccgagtcaaacacgacgaataaaacccaagcagcagcgccgacgacgggatgttcattgaatggggtggaccttcaggcgaacggattcgaaaggatgtgtgccgaatggcccgacttggctcccatttattgctacggcaaaatcattgaggtgccgagcaatttggtcccaattaatcataatgacatcaaaattcattaattcattacgatgttgagagtgaattaattggttgaatgactttcgcttaaggccgtcaacttttggggcgcccgaatg

SEQ ID NO: 117954 - DNA, 321 bp, Heterodera glycines
  Promoter: Source sequence=SeqID_13223; Location=796..1116; Strand=-; Gene=SeqID_77050
ctctcattttttactcttaggtcgaaaaagtcaaagtcgtagctgaggaaagaaatgacttttctttgtgaggattgacttttcacattttgctttgtcattatttgtcgaccgacgaatcatttcataaaactatgcttattaattcatgactgacctttccttggtttttcgattccatttacacaatattttatcatttggctttcttttttcgtttttaactatgaatgcaccgtggtaaaggtcggctatgtaattgtcctcggtgggagaaagtgttgtacaaaaggcagccctttcccgacaattacaccgatg

SEQ ID NO: 117955 - DNA, 91 bp, Heterodera glycines
  Promoter: Source sequence=SeqID_21785; Location=2324..2414; Strand=-; Gene=SeqID_52398
aaaaaatggtttaaccaagtaaatcgagatttgttaatttttaaaatttagtgaagcaaaaaactcgccttttttccttgtcaaagaaatg

SEQ ID NO: 117956 - DNA, 96 bp, Heterodera glycines
  Promoter: Source sequence=SeqID_8553; Location=544..639; Strand=+; Gene=SeqID_68510
ggtccctcccctcccctcccatttcaaatttggcatttcctcccaaatttggcattttcagggccagcagtcgccggcgtcgtcggtctgacgatg

SEQ ID NO: 117957 - DNA, 647 bp, Heterodera glycines
  Promoter: Source sequence=SeqID_12417; Location=1059..1705; Strand=-; Gene=SeqID_76024
tttcggaaagatatttgaaatttgatgaacggattaaaacttatttctaagttaggcaaattagaaattgtataaataggtctcacttttttcaaatctcatttcttttcattatatcggcatgccattttttaattagtctcttatcccattaatttgctcaataaccttagtttttctagtcaactcgtttttactaaatttcttttttcttagccataaattgacaattttcttttatttcgtatataaaaatttaaatctttgctctactttcataatcaactctgagttttcgactttctatgaaatttccccccaaatttttcagtttttggcattctgaattgggtttttttcattttttatatttttgctctctcatcctcttaattaactaatttgaattaaggttattaatattttctttttttttaatttttgggttctttattttttttctttcttattttgtgccattcaacccaatccgttttgttttgtttcaatatttttatctcgtttctccttaattcgacatgcccctgggttttttctcctcatttttcaaacgaatttttgacaatatttcacttattttttgtcctaaatccatttttcctttattaaattttgaagccaaaatg

SEQ ID NO: 117958 - DNA, 329 bp, Heterodera glycines
  Promoter: Source sequence=SeqID_44385; Location=1..329; Strand=+; Gene=SeqID_71880
ctgtcggcattgtaatgggcacgggatttggcttgacgtattgcccggcaatggtaatcggtaaacgagaagaacacattaaatatatattttggtacttattgtctcaaatcctgtgtctaaatggacttaaaattcctctaaaattataaaatcttccttggagaccgacatcacaggaaaatcgcactcgggaagctttttttatccattgctctgaatggaaatctagattttcctcactattattttagctccttaccattcgaaactctcgttcattggattcaaattttatttatttatttttcaacattttagttacaatg

SEQ ID NO: 117959 - DNA, 135 bp, Heterodera glycines
  Promoter: Source sequence=SeqID_3670; Location=227..361; Strand=+; Gene=SeqID_51373
agtaaatctattcaacaaattatcactttttctcactaattatttagacccatggatttgaaaacattgaagacgaacatcgagtcgggtgaagttaacacgctcggcaaattcagttatgcaattctcaaaatg

SEQ ID NO: 117960 - DNA, 925 bp, Heterodera glycines
  Promoter: Source sequence=SeqID_2885; Location=1..925; Strand=+; Gene= SeqID_82175
tctgtaaaaggggatgttaaagcgtgtcgatggattaaatattgaaaatagtttcagatctgttcggccataaacaattttatgcgccatgaacagatcaaatagctttcgcctattctcaagtgtcggcagttgcaggtattctaatcgattttggtatggaattggtggaaggctgcatttaaaaaatacccgtttggtgaaatatttttgacacttttctatttttttaatatttttttgaagagacggattccaaacctccggagcgtattccaataaaggcctaatataagttttatataacgtaatccaaatcttagatgatttggatttaattattcgaaacaaggaacgcatacgtaaatacgcattccttgttatttggttaatatgatcggaaaattgtaatttattatcaatgtttactcctaaatccctaattgtatccacagcatttattgtatttccatcaaatttatatgtttcttttgggttttttgaacccaaatataatacaaaagttttttgaattgaaacttttatttgccatttatttgcccattcgaataaattatgcaatgctttatgcataatttccgtgtcggctcttgctttataacaaatatataatttaacatcatcagcatataattttattttcactcctgatggcaaagcatcaggaagatcgttaatatagaccaaaaataataaagggcccaggacagagccctgggggacaccagagccaacttttttatttgaggataaagcatccccaattttaacatgaaaagtcctattactcaaaaagctttttatccacattaaaagtttgccccgtataccaattttttccaatttgtataaaagtaagttatggggcactgagtcaaaagctttctgaaaatcaatataaatg

SEQ ID NO: 117961 - DNA, 361 bp, Heterodera glycines
  Promoter: Source sequence=SeqID_31747; Location=1..361; Strand=+; Gene=SeqID_62054
aatcgcaaaatatgcacaaaaaaacatgaaaattatggcagcctgatcattattattaatttgttacacatttcttggataaacaaattccataaattccatgtgaagtgttttgttaccgattcggcagttattattacgctgtgtaagactatttggtccaaatacaaattccttttaaaagttattcatgcaaggaccaactgaataatatccataaaaacatcaacaaaaacatttattattgttatgtggcgaagtgctgaagtgattgatggtggcaatttttgtaccattccaatgccgggggggggggggggcaaaaaatcggacaaggcaaatgccgtaattgtaaatgatg

SEQ ID NO: 117962 - DNA, 801 bp, Heterodera glycines
  Promoter: Source sequence=SeqID_17878; Location=1..801; Strand=+; Gene=SeqID_82425
aatttgcgggttttctcccttgaaaacggtaacccttcatacaatcggcgtagccaggggggggggctgaggtggctaaaccctccccccccccgaaatccaaaaaatgaaccccaaaatggcaaaaaaacattcattttttggcgaaaaactgctataaatctgcaaaaaaaaacacctaatcgggatttctgaaaaaagaaaaatacaacctaaaaatcgaatttttgaattcataattcagcacctccccccctcccacgaagccaaaggtctggcctatacgcccttgccttcatacatataagtcatatatgtagattttatcaagaaattcaaaacaaaaattatgttgcaattatatcaggggattagactgatttttggttatggattctttcatttttgggacaccctataaaaaattcacgaatttatttagacaactcaaaaattgaggcacaaattttggatcgggattcaacgaactttagctactttttctgggttgaatatgttcttcaaaaaaatattttataaaaaatggaattaaaattatttttatctttcttcaaaactttgtttatttgtttaattatgaaatacaaattaacagctccttaattgggtctgaaaaatttgaatatttttaaaactggccttattaaactcgagatcactccaagaggattttattttactaaaaacattacctaaaaaattaaaaaaaaattttttttttgggctaagcaaaaaaattaaaaaattctttccattgagagctaaaccatttaaaatatg

SEQ ID NO: 117963 - DNA, 444 bp, Heterodera glycines
  Promoter: Source sequence=SeqID_37000; Location=1..444; Strand=+; Gene=SeqID_66184
tgtaacattaagaagaggcattcatgcttttgccagtctctgtttttagcattgactttttgaatctgagctcagatttttgtatcaaatacttggttttttgtaatactgcagaattgcgattccgactaaaattcaaaaatttatttttaaatttttcctggggtaacaaatgtgctgattacgaattaagcttccatttagcaaaatccaattttatttttaatttttatcatcaaatatgcacttgatctaatgtgaattttgaaaaaatttaaacagaaaaaaaaaatcaaaagattgaaaaattatagacaaagttaatggcatatatctaaattctactctcggataaattctttatatctttttttatttgttttagcaaaatccatccagtgataaatttgttcattagcttccaaattatttcacgccaaaatg

SEQ ID NO: 117964 - DNA, 185 bp, Heterodera glycines
  Promoter: Source sequence=SeqID_44319; Location=428..612; Strand=+; Gene=SeqID_71816
tatttttttaattttatgaactgattgatttaaattaaataatttttaaaaggaagtaaaataaatcaaattttattaaattaattcttgcttattgggtattttttaattaaaaaaataaaattttacaaattctgcacaaatgtacttatccgaaggagaagaagcttcgttcgaaggcgatg

SEQ ID NO: 117965 - DNA, 136 bp, Heterodera glycines
  Promoter: Source sequence=SeqID_29702; Location=1426..1561; Strand=-; Gene=SeqID_60175
ctttccgtaatttacatttttggcatttattttcttggccctatcctcattttgtaagcattgtcttttctatctaatttccattttgttcctccacccaatttcctgtttttgtaatttctgttccatcccaatg

SEQ ID NO: 117966 - DNA, 86 bp, Heterodera glycines
  Promoter: Source sequence=SeqID_12731; Location=1558..1643; Strand=-; Gene=SeqID_76432
cctgaaaggggaggggggagtgagtgagtttagtccctttgtcaaactgccgaccgtttcgcgattgccaaatccggcaaagaatg

SEQ ID NO: 117967 - DNA, 379 bp, Heterodera glycines
  misc_feature (30)..(30): n is a, c, g, or t
  misc_feature (74)..(74): n is a, c, g, or t
  misc_feature (80)..(80): n is a, c, g, or t
  misc_feature (139)..(139): n is a, c, g, or t
  Promoter: Source sequence=SeqID_29125; Location=1353..1731; Strand=-; Gene=SeqID_59676
gcaaataaatttttttcgaaaatgaaaatntataaattttaggttgcccaaaacatataaaaaaagactatttntaagtntaataatagccaatcattagggaatgtaaaaaaagtctcgttttgaaaaacccgcgacncgatactctcgagcatcactaattgtgtacccccttgaagacacctcaactaccggaacttttaaatcaaggtgatttttttgagaaatgaacttctcgataggctttaccaatatttaaataatgataaaatagattttaaaatatatttttgttattattgtcaattagacatttttgatattcctcgtcaattaatgattttttaaatttttgtttgtttttactttcaaaaaaatg

SEQ ID NO: 117968 - DNA, 305 bp, Heterodera glycines
  Promoter: Source sequence=SeqID_2262; Location=1433..1737; Strand=-; Gene=SeqID_78778
accaaaaaagagagagagttggggatgatgaagaatcaatgaagaaattttggattagagaaggcaaaaagcaaatggcacagatttgcttatgcaatgaaagtcaaaagcgggcgtatttggttgtttttaattttattagacaaaaaatggccaaattttgggtttgttagtttcaattacaatttgaaaattgcgttgggaaatcaaatttatggcgttttattttaaacttatttaaaattttcaactttttttcgaccttttttgttttcaataatcatttgctaattagagccgggatg

SEQ ID NO: 117969 - DNA, 128 bp, Heterodera glycines
  Promoter: Source sequence=SeqID_3459; Location=1998..2125; Strand=-; Gene=SeqID_84756
tgcgccaatttgtcaatgcaaaatggtcatcgatacagattaacgctatttattgggagaatttttagggctttttcgggaacggcagcaaatgttacgatgtggacgaatgcctgtgggacgaaatg

SEQ ID NO: 117970 - DNA, 441 bp, Heterodera glycines
  Promoter: Source sequence=SeqID_18862; Location=2359..2799; Strand=-; Gene=SeqID_83564
aaaaaaaaatttctcaaaaaattactttcttggcaaaaatttatttaggtatctatgtttggggttttttcctcttaaaagtcccagccctttttactccatttccagctgcaaaccagttaataaaaaatatattttctcaaattttgggctgaaaattatgtcactagttcggactttttgccactattttgtcatttttactcactattttagttaactattttgggttttttcgtcactaaaagttgcggcccttaataaatcaatattatattctgtattatgttgcataaaacaattaccaacaccgaaaacattgcagacattctgtcggtcacgcctctgattaattccatggcaaaataagtgagtttatttaatagagtaaagaatttttttggcttaatttggaatgatttaaattttctttgcaaaatg

SEQ ID NO: 117971 - DNA, 588 bp, Heterodera glycines
  Promoter: Source sequence=SeqID_8861; Location=435..1022; Strand=-; Gene=SeqID_69448
tttgttattcgtttttaaatgtgttaaattccataaatacatagtaatagtcagagaacggatttttagttgctaaaaatagcgaaataagtacataaatagttgctaaaaaactgaaaaatgccaaaataattgctaaaaaattggaaaaacctgtcaataaatgtgtgaattttccaaaattgcctcattctttgtccatttcggttgcacaattgtaaatcaaacacattttaagattttatttcggttgtccgccaaatcatggcgccaggatttttgctttttaaaaagtcgattgtatttctgaaaaaaaatgttagattgatttcgtacttctctcatcaagaactatccgcaaaaaaaataaagtctaaaacttaaaaatctgttcctcgtaaaaaattcatcatatattttgacttttgcaattttaattgcctaattaaatttaaaatttcattagttgccccgttctcgctctaacatcgacataccggcctttggatgtgccggtgccaattatgtgagaataaaaattttaaaattaaattattgtattttaatcgcttttttcttatgcagatg

SEQ ID NO: 117972 - DNA, 150 bp, Heterodera glycines
  Promoter: Source sequence=SeqID_37720; Location=1229..1378; Strand=-; Gene=SeqID_66717
gccaaagaaaacacaaacgaacatttgtcgatttaaatatcttttaaatgatttccgcattccatcttttccatttggttgtttttcccccgttcactttatttgtttcttttcgtttttctttagtttttttatttgcaatttccgatg

SEQ ID NO: 117973 - DNA, 722 bp, Heterodera glycines
  Promoter: Source sequence=SeqID_22138; Location=1473..2194; Strand=-; Gene=SeqID_52787
ataacagattatctcttctatggtgagtttttcaattcctatgtactttattaagtaaacaataataatcaaacatttttctatgattgcaaagcatttaaaaaatcataggcttgtttattttcattatgttttggaaaaggtcaattaaataaacaatttttttttgtaattttattaattgtataaatcttatgcaattttctataagcaatcgatagtaacaaatagagaagataaagtctgatcaagcacacacctttcattatttccggttaaatatgtgttcatattttaacaaaaagcagtcttgaatgtcgtcgaaatttgtggtaattccatggcttatagccgaccaattgcgctggaattttgccatgaggcttattttttgtgctggtttcgaatttacaggcgcccatgcaattggagctcattaaattttttgtcgatttttcttcaatacccactttaaacgataagcatttcctcgcacaccgctctatttgctctgttttaaacaacaaaattttcccaagcattcatacctactttcttaattgcactgggatcacatctaaacgactatgctaaaaacggggaactaaactgtattaatatttttaacaaattgccgcccttttcgcctaccctgttaagagaaatcttaatttcactaataatttctcaattttcttctataacagattaactcttctatg

SEQ ID NO: 117974 - DNA, 151 bp, Heterodera glycines
  Promoter: Source sequence=SeqID_6792; Location=1..151; Strand=+; Gene= SeqID_62923
aaacgggccaaaagaagcttttcatgcactagccgaacgcctttggcactcaccacgcgcaactcgcctatggcattggcactgcctaaagaaatttaaaaaattcaaaactcaatttatcacaaaattgctttaggcattttttttaatg

SEQ ID NO: 117975 - DNA, 559 bp, Heterodera glycines
  Promoter: Source sequence=SeqID_13408; Location=1..559; Strand=+; Gene=SeqID_77292
ccattcctttttcttgtccattctctaccagtgccttcctctgtttgtccttcacttgcgcgtccctttccatcgattgcattcccttttctgtttggtttgttgttgttctcaaagacaaataaactatttttctcctcctgtttcttcaagtgaaatcccaaaaaaaagtttgcttctcatttgccataattcaaaaagttggccaaaatgtcaccaacggcaacccaacgacggcattcacttttggcattgggttccttttcgtgtggtggcctaagacgaagcgcacggctttcaatgaaagcgcgaaaatgttcacgaaaaatgtgtggtgaaattaatatgtatttaaaatggaatttaattttaaaatatctttttttgatgaaaatttatcaattttaatttttactctgaaaacattttatctgattgggccaattatcaaaaagtgaggacaaaatcatgtgattacttggcttttagctacgtgtgcaacgacatttggctgcacatttttccatggcttacccccgcaaaagtcgggctgaacatg

SEQ ID NO: 117976 - DNA, 227 bp, Heterodera glycines
  Promoter: Source sequence=SeqID_7785; Location=1..227; Strand=+; Gene= SeqID_65952
ttcaaaagaaattgacgcaagcgcacgcaacgaattctttaattgcgaaggaatccctccctaaaaatgttacttttttgtttatttgtttttcaatttactcccttttccattaggttcttccctctccattaattgaacaatatcgcaacaaatgcgaattttctgtcggttattcgtccggcgacaaccgttctgcggtagttggttttatgagtggcaaaatg

SEQ ID NO: 117977 - DNA, 119 bp, Heterodera glycines
  Promoter: Source sequence=SeqID_12858; Location=1..119; Strand=+; Gene=SeqID_76586
tgatcaatcgcttcgatctcacacttctttatttttgattatttacaacaataacaaaagtgaattttaaaacgatcactccaaaagagagaaagaaaaaagacaaaacattggcaatg

SEQ ID NO: 117978 - DNA, 468 bp, Heterodera glycines
  Promoter: Source sequence=SeqID_993; Location=1..468; Strand=+; Gene =SeqID_46456
ttatcccgttttttgaattcccgcttgttttaaattccccccccggcatcttaaaaaagcatcattttgcttttcacctggttcttaatattttagaatttcagaaatgctgtgtaaaactttagcttgaaaatctccaaattattgacattctaatcttttgatatagtaaatttgtttagttgtctaatccaatattataatttataatcgaaactagcgtcgaactaaacgagaccaattctcatcattttttctgcatctttccttccctcactaatttttcgtgaaagtaatcaaagccaaaaaatattttgaattacatttgtacatgttaaaaatttaaaaacaaaacttaatatcacataaaaaataaaagaactgattttgatagtttgatttgtaatttaagatccttccatttttagctgtcttttgtttgtcacatacaaattccgtccaaaaatg

SEQ ID NO: 117979 - DNA, 197 bp, Heterodera glycines
  misc_feature (70)..(70): n is a, c, g, or t
  misc_feature (79)..(79): n is a, c, g, or t
  misc_feature (86)..(86): n is a, c, g, or t
  misc_feature (115)..(115): n is a, c, g, or t
  Promoter: Source sequence=SeqID_40793; Location=1444..1640; Strand=-; Gene=SeqID_69033
tttatagccaaatgacgtttaaatgagtgatggtaaaggcagcttgggggcccatgtttgtgatggggancggtaaatntgaaatntaattgaaaatgccaaaaagaatattacnttaattgaatcacatttatttcaaatatttgtcaatttttattcttaaaatttggtctccatttttcagtctctgtccaatg

SEQ ID NO: 117980 - DNA, 1003 bp, Heterodera glycines
  Promoter: Source sequence=SeqID_6494; Location=1241..2243; Strand=-; Gene=SeqID_61784
aaaatgaaaggtcttataaacttataaagaattaaaatttttattattctcaatacataccaaaacttgttggtgcacagctagtaaaataaaaccaattattaattttattaaaatcatgcatgcaaaacgcgttaaaacttgaattaaaatgcaattttaatattccgcacacgaaaaaagctaatattcgtatctattcttgcgattttagcagttttaaataatgttacatttataaagtaaaattgcctattacttttatttattttgtttccgaatttagcaaccagaatttcttgaaataattttatatttatgatattaatcatttttcggatcaaaaatatgactatcattgtctttggtccaattatttgctgataaaataatgtatcacttatttacattaaaatgaaaggtcttataaacttataaagaattaaaatttttattattctcaatacataccaaaacttgttggtgcacagctagtaaaataaaaccaattattaattttattaaattcatgcatgcaaaacgcgttaaaacttgacttaaaatgcaatttttatattccgcacacgaaaaagctaatattcgtatctattcttgcgatttttgtcgtggcgacaagaaatttgcgtcgaactctgcggggtgaaggggacgggaaggggatgaaatgggcgaggcgcgcagagtagccggtcgggggaacgtagggggtcgggaccgatcggagagcgatgagtcgtgccggttttcgtccaggcaaatagaccaagttgggcacaattttaataagagtatgtttattgtgtcgacctcaaacttgggtaattaaaccgtcccaatcgggacggtgagggaaacgaaaaatgggggacaaacatgataatgtgaacggggaaaagggggcacaaaaacggtgacagtaaataaatcacaaattgaaaaatgtggcaaaatcaaaaggggtcagaacggcgaaacggcgatg

SEQ ID NO: 117981 - DNA, 1003 bp, Heterodera glycines
  Promoter: Source sequence=SeqID_16235; Location=1990..2992; Strand=+; Gene=SeqID_80614
ctttgcacacaaaagagtggacccataatgactagggttgtaaattatatggattaacatattttttctgcgcatatgctatgaagaaaggggcttattgtactttttaggtttatttaagcaaatattaaatatgcacaccttttttgggatttttgggggtttacaacatatattttggcattttttatccatattttggtccatatttggcctttttagtccatatttcgggcttttttagtccatatttaatgtccatatttcgcgttttttagtccatataatttacaaccctaataatgacgtcggcgtacaaacagggggaagaaatcaaaatagggggattttcggaccgggtcagtttagtacgggccgttttagtacgagcgcacatttttccactataacttttttatttgttatccaaatccaactttcttgatatcattcgagagcccttcggatgctctattagcctgcaaaatttcaaaaaatttcgttaggttttaaaaaaagttcgggccaaaaaagttggaaaatctggttgtatgaattcttctggccataacttttttgaactttaacgagattttttgaaattttgcaggctaatagaggacacttagggctatcgaatgataccaagattgttgaatttggtttgcaaagaaaaaagttatagccaaaaacttgtgctcgtactaaaactgcccgtactaaaccgaccccgaccggggatttcgcttcaaaaaaattatggcgaaattaatatttttaaatttgaaaaaatcattattttgaattttcattagtatctgcatgaaaaaagctcgcactagtcagggcttccttttttggttgatttattattgtgaccataatgataaaatttcttttatttctttgagccacttcaaaatcatcgtcttattataaacaatcgtaatttaaatttcctaaaatagtatcgggattcctttcagcatatcttcaaaaaatg

SEQ ID NO: 117982 - DNA, 287 bp, Heterodera glycines
  Promoter: Source sequence=SeqID_4255; Location=1899..2185; Strand=-; Gene=SeqID_53776
ggtcggtcaaaaaaggagggggggggggggtcgctggcagaatgttctgaatactcggtccgttaagtgattggccttcgttgtgatcaatgtgcccccggcttctttaatatttcctccggaaatgggtgccatcagtgtggttgtgaccctttgggcagtttggatgggggcgtgtgcgatttgattaccggccaatgccaatgcaaaaagggggtgaccggcagacgctgtgatcagtgcgcaacgcggcatttcggcttcggcccggaagggtgcttggaatg

SEQ ID NO: 117983 - DNA, 58 bp, Heterodera glycines
  Promoter: Source sequence=SeqID_12503; Location=978..1035; Strand=-; Gene=SeqID_76141
tgcaggtcttaaaaaacaataaaattttttattattaaattattcagcccaccaaatg

SEQ ID NO: 117984 - DNA, 326 bp, Heterodera glycines
  Promoter: Source sequence=SeqID_5998; Location=1545..1870; Strand=-; Gene=SeqID_59969
ttatattattataaaaataataattaccaaatctatttgagaatttaagaagagaatgaaacttcaccttattattagttttaattatattttaatcatcgaaattgatcaaatttggagcagagaagaaaaaattgaaacaaaagtcatttgacgaaatatttggagaaaaatgggaagaaaaggaagaagaaaggcgaaatgaactcaaaaaaagagaaataattgcaaaattttataaaataaaagagaaaataaagcaaaaaggaagaaaatacccaagaaaagaatggaataaaattgaaagaaaaattgcgaaaaaaatg

SEQ ID NO: 117985 - DNA, 173 bp, Heterodera glycines
  Promoter: Source sequence=SeqID_6674; Location=949..1121; Strand=-; Gene=SeqID_62437
tttctttttgaaatatgtttgtatttttagttttacctgtttgccaacagccatttgaaccagaaaaattaaagacaaaaattgtaaaactgcctatggtaggatctcttttttgaaaaaatggaatttttaaaagttattaaaaaattttagggtatgggtagtgtctaatg

SEQ ID NO: 117986 - DNA, 299 bp, Heterodera glycines
  Promoter: Source sequence=SeqID_11520; Location=3045..3343; Strand=-; Gene=SeqID_74945
taaacaaaataacatatgtattttaaaatatttccaactataaaatcaattaataatttcgtttaatgaatgaatattggattgaaaaaagcaaaaaaataataataaaaattttacaagcaaatagatattttaaatgaatgcagcgccccaacccttactaatatagcaaataaattttaatgaaaatttatatcatatatatataaaaaaaaattattttctaattatttgaaaatttaaaatttaacgcaacttttggcccaaaaactattctttacacatttcggttcataatg

SEQ ID NO: 117987 - DNA, 496 bp, Heterodera glycines
  Promoter: Source sequence=SeqID_27435; Location=775..1270; Strand=-; Gene=SeqID_58130
tatcagtttaattcaatcattcggggccaatgttcttcaagggggggggggataattggagactgcggtattaatagagactgggccataattagagcatatacggtacataattggacgcataaaaatgattgagcggataaattgaaaaaaataatattttttacaaatactccgtctgttttttgccaaaaaatgtgatgaatttatttctgtttcaaaattgtttttgcgttctttttgctctctcatttttcccaactctctctttttaagttacataacaacagagttttgccttgccttttttgacacaccaatcaattggaaaaagggaaaattgagccacaaaaatgaatcgacggtaaggaattttttaaaattacaaaattttcatttacccatacatttttttacgaatctcagttggctttgtagcgacgtgtggatggacattatgccatcgtttgaccatgctcaactcggcctcaaaatg

SEQ ID NO: 117988 - DNA, 1003 bp, Heterodera glycines
  Promoter: Source sequence=SeqID_14204; Location=217..1219; Strand=+; Gene=SeqID_78216
ccatcaaaaacctttgctgcgcatgttaatggcacgttctttgactttcgcttttctatgaatgttaaatgtgacataaatatctaatttatatggctaatatttttagttttttgcctatttttttcctgactcctttggtctgaacgacaaaaacattttttttttgttaagctacttttcgagttattagcactattttctggttttttatttttagcacctaaaacttaaaattattttcaactattttggagttttgcccaaatttgttaacaaaaatgcaaaaaaacgaaagataatgaatttctcaaaaattcatctcctgatttatttatttattttcttgaaaagatttttggttttaaaaattatacacctcaatactaatttggcttatgtttgttactttttgaataaaattttacgtttttaaccctaaatttgaacgtttttagcaactttttcctatttttagcaaaatatttttgggggtttttagaacctaaaaactaacaattttggcagtttttagcaactataaataaagtagagaccggcaggctccacttcgtttaggtgctggcgtttgggcgctcgcgtttcggcgccagcatgtttttggctattgttctttgtcatccaaatccaacattgttgaaaacattcgaaagcttaacatgtttagaagctttttctaagctattgcttcacgattagacaagatttatcaatcggttatttttggtcttgtatcgaaaaaacgatcgaaccccttatctgatctctactaagtacgccgtcgtatttccaaaaaacgcctctataatgtcaaaaaatttgtaactatgaaatctaaaataaacaattttattgaaaatttaatttttttttttttttgctttggcatttagcctaaactgcagggcttaacagacatatttcctctacttttccagaaacaaaccttttaactgctgaaactgaattgcatgggaaaatg

SEQ ID NO: 117989 - DNA, 94 bp, Heterodera glycines
  Promoter: Source sequence=SeqID_4697; Location=1566..1659; Strand=-; Gene=SeqID_55436
ggtacttccttgttttgctacacccccccccctcgaaaaattttaaaaattactatttttgggctttttaaggtcactgattatcatcaatatg

SEQ ID NO: 117990 - DNA, 57 bp, Heterodera glycines
  Promoter: Source sequence=SeqID_31027; Location=456..512; Strand=-; Gene=SeqID_61393
ttgcgttcttcgattaccgaaatgcccaaaatcaccaaattactgttttaccaaatg

SEQ ID NO: 117991 - DNA, 220 bp, Heterodera glycines
  Promoter: Source sequence=SeqID_14732; Location=3651..3870; Strand=-; Gene=SeqID_47229
aattttcggcgattatttaggacacttttgatgtgatggtgacattcattgttagttgtattcattaatacaaattcgtgtgtcaataaattggcgatgtaaattaaagaatggaattttacattgttgttttatgaagaaaacattcgttttgacgattgtattttggttgtatgacatgaattgtacaaaagtagctttgttttgtagtgctcaaatg

SEQ ID NO: 117992 - DNA, 456 bp, Heterodera glycines
  Promoter: Source sequence=SeqID_36277; Location=1..456; Strand=+; Gene=SeqID_65636
tttccaaaaatcgtaacatcatcatcatcatcatcataatcatattgacgataacaaatccaaaatgtcaaacctaagctggatgattttgtacgagccacgtgagggtggtcgtatggtaccccatccgctgttcgaccccggtccggaaatgtcggcgcgcgtcattgccaccgctccgcttttttcgacatcatatttttgtttgttttttattatcttttacattacatgtcttggcaatgtgcacatcgcaccgttccatgtaataataataataatttttaagccacccaacacgctaatgaatcagacgacagcgtggcagatgctgtcatctccggcggcggtagcggcgtagcatacactgtaacagaagctgcgttgctgaacaacaccaccagcacactaataggcacgacgtcagccgccgccgtgacatcaacgacggcgatg

SEQ ID NO: 117993 - DNA, 464 bp, Heterodera glycines
  misc_feature (24)..(24): n is a, c, g, or t
  Promoter: Source sequence=SeqID_17740; Location=593..1056; Strand=-; Gene=SeqID_82279
ttgtgttctgttgagacagacatntcattcggctgcataacttttcataaccactcgaaaaaaaatgaaaaatttttagttttttaatggttttttcggtaagaaataaaaaactttcaaaagaatttttcgtttttttataattttaaataaaagtctgttttccttaaataaatttttcaaaaaatctttgttttttcaaaacctctaattaaattaaatttttccatttttgaatatttttggtatttattttatttttttgataaattgattttgttgttccaaaaggatgatcagcagcagtggcggctttgtgttggaaagggcaattcgcaattttcggcaaatggccctttatcagccggtgatgaatggcacgtcatttgtcaatcattcatttattaatattgtagtgcatcatcatacaataaatttaaaaattttagacacactttaaaatg

SEQ ID NO: 117994 - DNA, 596 bp, Heterodera glycines
  Promoter: Source sequence=SeqID_9801; Location=1149..1744; Strand=+; Gene=SeqID_72739
ttttggtccctgttgcttttgctcctacagcctttttctgctcccgcagctattttcgatcagccattacagtctctaacaaattttcaaaaattccgactgtgccttcggaaccagcggcatctcttttaggcaaaaaatcatttttttaaaattcgaattgatgacgtgtaaaattttctttacccattatatttctcaatataatattgataaatcaattaaatttattttatccacgaaaaatgatcatttttaggtgatacaattttaaggatataagaaaagaaaattgaaaacattttatgatgaaaaatgatcattttttcttaaattcgttctcaaatttcttttttatattagtatttttagttattttacaaaatttctctatttaatggaaaaaatataacctaatccaatattgctaatataaaaagtgaaaaaaattttacaaactgtgagcataaataagctgatttcattattttacaaaattatttttaataaaaaataattgatttctttgcgcttcattcctgcattaggagaagtatttcatttttccgcgctcatttttaaacttttcatcaatg

SEQ ID NO: 117995 - DNA, 520 bp, Heterodera glycines
  Promoter: Source sequence=SeqID_30264; Location=1..520; Strand=+; Gene=SeqID_60685
cacacattagcaattcctttcaaaagggaagaaagacatgcatcactgtgaaaggaaatcaaccgataaaatttcaactaaattttaatttttcctattcatgacttactttttcacccaattttttttgcttttgtgtaaagggaatgaagaagtttaagacttagttgaggtaatatggcaaaaaataacagaccgataaaatgtttgatgaatggccaataaaaaatgctaataatggaatgacaaaatgctgaggatatgagaaaatgggaaagcgaagaagaaaatggtggcaaatgggggggggggaagtgtgaatgatggcccaatttatgacggaatgatccgtcattggctgttatttgccaagagatcataaacggacaaaaagcattagaagaaagaagcgatggaagtgttaagagctttctcgctcaatcggcccattgaatgtgtgtcaatttctggtgaaaaagtctaacgactgttctgccgtttagagaattttagggcaatg

SEQ ID NO: 117996 - DNA, 151 bp, Heterodera glycines
  Promoter: Source sequence=SeqID_3980; Location=3517..3667; Strand=-; Gene=SeqID_52676
gctcccacgcaccatggcaagacgaagcatgccagagtgggagacatcgttcagggatgcctaggcgcggttccaggctggacaagttgtccaagcgccacaaagattcgaacaagccaaccgggtggccgcacccgtcatgccaaacatg

SEQ ID NO: 117997 - DNA, 78 bp, Heterodera glycines
  misc_feature (24)..(25): n is a, c, g, or t
  misc_feature (72)..(72): n is a, c, g, or t
  Promoter: Source sequence=SeqID_45119; Location=560..637; Strand=-; Gene=SeqID_72484
ttgcagtatgtttgggttttaaanntctcaatattataaaatatttttaattatttaaaaaatttatttttnaagatg

SEQ ID NO: 117998 - DNA, 710 bp, Heterodera glycines
  Promoter: Source sequence=SeqID_10215; Location=636..1345; Strand=-; Gene=SeqID_73340
tcccaacagggggttgtgtccagctcctactacaccgccttcatcgtgctcagttgcatgtgcgggttgctgctgttgtgcatggtggctgcttgtctgatcacatgcaaaaagtgcgtgcgtgagtgatcagagtctcctttctgctgatcagaatcgagagtcacgaaatgaattgtcgatccgagccttgaaagtgacccgagtctctggtcccgggtcagcaatctcgaagttgaatgttccaatcaacatataaagtgatctgagtcgagagtctcagaatgaagtgccgatcataactttgaaagtgatctgtgtctaatatcttcaagttcaatgatccatcaacatatagagcgacctggatcgagagtctcgaaataaagtgccgaatagtttcagtctatgaaatgcctctgatgggatcagactctatctttgaccaggaccgaattttcgatacaggaacttgttgtttccaactctggaaaactcaaatttattaaaaaaaaataaattatacttatcggcacagagttgtgcgcgcgcgtcgcgactcgccggcgtcgttccggcgccaccagcagctggcagcagcgggcgccagccgtgccgcggccaacggcaccggtggcaacagtaccgcagccgctgccccgctgatcacgcgcggcgacccggaacgcgtgttgctgacagccggcatg

SEQ ID NO: 117999 - DNA, 874 bp, Heterodera glycines
  Promoter: Source sequence=SeqID_15056; Location=1..874; Strand=+; Gene=SeqID_79227
aaattcgattgctgtgctataagtaataaaatttatatcattggactagtttaatgcctttttataattacaaagttactgaattattttaaaatacggtaattgtccattctgaactcgttttgcatattcacaaatttaccaagttaaaatttaatttccattacggtacttatccattctgaactcgtttttcccaattcataaattttttaatttttgggaaagtattacaacccaatacgaattcactgatcggacagtacagaaaattggcagagagtgcgtgtgtgaaaagtgattgttagattgttaccaaaaaaggataagattgacaagtgaattgtggtccgagtgatcacgatcaagagaaaacagtaaaaaaattgtgcagaaaagtgagtgtgcccgctgaattgtgagtaatcacggcatcatttggcaaacaaattggtgttagacagagagtgtaccgtcccgactgatcagagagtgatcagcgtttatcatacaaaagaggccgagagggcgatacaattacgatacaattactgtgtaaaatcagtcagttccgaccttaagtacaccgcgggtgaaatcagtgaccaagtgatcggagaggcatttttgccgatcaaagtgtgattcattgatcagtaaggtacaaaaaaggggtttttacgcaacaattgttccgattcatataactttggcttaacattttaataactaaatcaaaataagtcacactcctgattaccttgaaaggcgtttcaagcaaaagccaataagtgatctcgagcgggtaagacggaagcttgagagagaccgaaagaaaaaaagtgaagaaaaattaggagaaaaccgaaatatg

SEQ ID NO: 118000 - DNA, 86 bp, Heterodera glycines
  Promoter: Source sequence=SeqID_29440; Location=1188..1273; Strand=-; Gene=SeqID_59940
tcttttttacacactaattaaaaatttttatcgttttaaaatttgtaatttattaaaatgatgctttctacatttccgatggcatg

SEQ ID NO: 118001 - DNA, 227 bp, Heterodera glycines
  Promoter: Source sequence=SeqID_19064; Location=1138..1364; Strand=-; Gene=SeqID_83809
ccttttgcagcgttttgctgaacctggaaatggccaaacaaaacttccgctttcgtcaaacccttcacagggggatgcttcgggcacacgacagagcgtttcagtaggattatgtgaagcgcacaaacagcatgcattgaaccaactgaaaaaagagagggcagcgtacgtgtttgcatccatgccaaattattagacaaaaagcattttttttttctaggcaaatg

SEQ ID NO: 118002 - DNA, 666 bp, Heterodera glycines
  Promoter: Source sequence=SeqID_6629; Location=409..1074; Strand=+; Gene=SeqID_62262
aggataggccgcggtgaattaagccaccaatgcaagaaatgagagtttagaaatgatgagcaaatcatcgtcctaggccaaccggactccataagcacaggagtccggctagctatcctttcaggataggccgcaatgaataagccacatgaatgcatgagatatgaaagtgttaagaaaatgcaaaaacatgagcaattcagcgtcccgggccaaccggactccataagcacaggagtccggctagctatcctttgaggataggccgcggtgaattaagccacatgaatgcatgagatatgaaaatgttgagaaaatgcaaaaacatatgacaattcagcgtcccgggccaaccgaactccataggcacaggagtccggctagctatcctttgaggataggccgcggtgaattaagccatatgattgcatgatttgagaaattggtcgagaattaagaataatataataataataataaattgattcaataaaatgagaaattacgaggcaaaaacgccccatcgtccgctgtcgacagaggcggattaatttgccttcggaaaattatataaaaaagaaggaattcatatatatataaataaagaattcattcaattattatctaaataaataaattcaattataataataatttagcattatg

SEQ ID NO: 118003 - DNA, 810 bp, Heterodera glycines
  Promoter: Source sequence=SeqID_12106; Location=3090..3899; Strand=-; Gene=SeqID_75667
gcattagcgcttggcttgcccgtatacgattctccttccgccccattcctttccatccaccctttggcgtcgttcaacattctttcaataaacatttagcaattggaaatttatgtgttcattaattgttgaacaatttttaattgtttttaaatttaattattttattacttttaattctttatttctttttagcgaaaagcatttaattagtgatctttcttcaattcatcaccaaaaaaaaagggacatcagcagcgaacagtcaaacatcggacggaattgctttggtggacattcaacagacccaccagcagcatcgtcagtccttcggcacttttttggcttcaagcaacggcacagtgcttcggcggactaaattgtgaaggaagtccgactgaggcccgacaatttgaataggcacgtcgagctacggtgcgcgtctccctgcttcggcgattcaacggattttgtgtgctgttcgactacgtggatagtgcaactggacccgttactcagcgatcactttacgagacagtgaaaggacaaaggcaacgactgactgcggactgtacaactacggacatttacatcgcggacttgccacttttgagtgcagatcgggacaaagtgattttaaattaattgaaacaaacaaaaccaaaacacagaacaaataataaataataaataagaccgaaaagggaaaataaaacaattaaaattaggaattgcttcggcagcacaaggcaaagaatttactgaagtttcagtgtgactcccgcttcggcgatacaaaggcacaagatg

SEQ ID NO: 118004 - DNA, 689 bp, Heterodera glycines
  Promoter: Source sequence=SeqID_18462; Location=283..971; Strand=+; Gene=SeqID_83062
aatggttaattatagtttttctgataattttttaaattttttagatttttagtgccaattgggattggctataaatttttagatttaaatcaattaaaaaaaattttttttagtttggaaaaatttttcggtcctcggtaaaaaaagaaaattataaattattaaaacattggaaaatgtgcaaaaaaaaaggcatcgacaaaaaaatgaggcatttgtcatataatatagtatattccagcgctgtactaaatcgaaacacagcctgcgtattttttttatcttgacgcaatttaattggttcgaaaattgtgattataatttaccgtacaccacggcaatttaaaaaaaaatatgattaaggagtattaaatattaatcgagactaatttctggagagttattttttttagtgacaccgattggattccgattgcacacaacagtagcggcttatgggagtttcagatcgatgtgagatagctagaaaataattttaatttataaagtaaatttaaaaaattatagttgtttttggccgaaattttttaaataaatactacaataaaaaaaaaaaaaattatcttttatttataatttacaaaagttgcggccaatttttgtcttttttttggcattttgtttaatttttggtgtcaaaaacttttataaatacttatttatcaatg

SEQ ID NO: 118005 - DNA, 307 bp, Heterodera glycines
  misc_feature (159)..(159): n is a, c, g, or t
  Promoter: Source sequence=SeqID_25574; Location=1..307; Strand=+; Gene=SeqID_56315
cgccatggccatttatttttcaaatattttatattaaatagatatccagaaaaatggctatctcttttttgagaaattttctatgcaacaaacgctctcgaacatgaaacgaagtgcggtgcgccatggccattttatttttcaaataatttttatatntaatagatattccagaaaaatggctatctctttttttgagaaattttctatgcaacaaacgctctcgaacatgaaacgaagtgcggtgcgccatggccattttatttttcaaataatttttatatttaatagatattccagaaaaatg

SEQ ID NO: 118006 - DNA, 152 bp, Heterodera glycines
  Promoter: Source sequence=SeqID_24492; Location=791..942; Strand=+; Gene=SeqID_55221
ggtttttttctgtaactattttttggtattgcccattacatttttttagaattttggcgctggaaaaacttggcgttgtgttcaatcaggtggtgcacaaactcaaatacacgccacggaaggcgattgtgcacgccccgtcacaaaacatg

SEQ ID NO: 118007 - DNA, 466 bp, Heterodera glycines
  Promoter: Source sequence=SeqID_37416; Location=1..466; Strand=+; Gene=SeqID_66495
tttacaaaaggttgaaatacggctcctaaaaatgcatgagggagaagaatgaacacacttttccgatttcaatttcacttttaacttttgttgtcaaatgtcaccaattaattttaattaaaattatttggtggtattaatctataattggcactttcatcgtcgtgtgagcattaacagatataatttcttattttttgccggttttctgtttttgtacgcggtgtttctttttttctgaataaaatggtaattattaattaaacatagtctaaacctggaatttttacaagatttaaaaaaaatatttttaaatgcaaaaattaatataaaatcgtttgcctttgatttaaaattctcttgggattataaaaaaaataatttttaattttttaataaatcccccctgaaatattttttaaataattatttttctaggataatttttagcgtgatcacgaatatg

SEQ ID NO: 118008 - DNA, 1003 bp, Heterodera glycines
  Promoter: Source sequence=SeqID_13241; Location=158..1160; Strand=+; Gene=SeqID_77070
gcgggaggcgcgggatcggagccccaaaaatattggattcgggaaatttggcctaaaaagactaaaaaacagaacaaaataataaaaaagaaaataaattaacaaaaaactgaaaaattcggtaattattctaggtttttcatgtcccctgaatttttaaaaaattttccagtctaattttttgcgctgaatacgaatatgccatttgtttttagcttttacgcatttcacgtgagttacgtgaaaatttttgtgaaaatttaagtaaaaacgtgaaaatttaaaatttaaagaaacgatgtttgcaaatctcatcaacttttataatgcagattgatagagaaggcgtaacaaaaatttaaaaaatttcatcatataatctgtgacctggcgattaaaatgcatttgatctgtgactgagatttttaacttcttttttttaccataaattggagttaagccctgaccccggccttttaatccttctctccattcgccgacctttttgggccttctcccgacccatagtagggctgggcgaaacttcggtttcgaaaatatcgcggtgttttttgggcttcgaactttggacttcgccttcgaataaaattgggcttcgccttcgacttcgagtgctaagccgagcttcgcccagccccgtaaaatttttaatgcattttgttaaaaaattgaattttttttttaaatagtcaatttttactggaaaattttttaatttccgggggggggggggggggactgcctcgcccctgtccccgatccctgtgacgtgcccttccccgcgctcccccgacatgcgttctccgacgaggaatttttacactgttaaggattgattgcgttgtaaaattaaaatcaaaggatatttttcaaaaatcaagcttggttctcttccaattaaatattttcttgctcttttttgtctgtaattttatgaaaccgtccaattaagatcggacacgtagttgtccaattaagcatg

SEQ ID NO: 118009 - DNA, 230 bp, Heterodera glycines
  Promoter: Source sequence=SeqID_6674; Location=951..1180; Strand=+; Gene=SeqID_46282
ttagacactacccataccctaaaattttttaataacttttaaaaattccattttttcaaaaaagagatcctaccataggcagttttacaatttttgtctttaatttttctggttcaaatggctgttggcaaacaggtaaaactaaaaatacaaacatatttcaaaaagaaaatatcttattttaattgaagaaaaaatccgcggagaatatcaatgcgcggctggccatg

SEQ ID NO: 118010 - DNA, 109 bp, Heterodera glycines
  Promoter: Source sequence=SeqID_27931; Location=1931..2039; Strand=-; Gene=SeqID_58597
ataaattaattaagtgcattgaatttctgtgcaacggctcagaaagctgttgtacctactttgtatgaatgttattttaattaatgtaaaataattactaaatcagatg

SEQ ID NO: 118011 - DNA, 725 bp, Heterodera glycines
  Promoter: Source sequence=SeqID_43114; Location=647..1371; Strand=-; Gene=SeqID_70868
cgcgcgcgtggcgtgcaaccaacacaactgccaacagcttttcacacatgcgaaaaaaaaattgcgcaaatttcggcaaaatgcacgggacaagcagcagcagcaattactatgatctgagaagatgtggagagaggtgttttcaatgagcgactgatcagagaatatgattttttgatggatgacgacgaccttcaaaaaatatggggaaaaataaataaaaattacattttcaaacatttatttttaaaagtgtaaagaacggcgaccaaaaaacatcgccgaacaacagaagaaaagcagagagagtgtccatcatttgttgttgtaacataacacatgcacaaaaaatgtcttgtgaatttgtggtggactgatttttggcggtgcatttcaaagggagcggcgcaaaaaaaatggaaatttttttaaattggctttttgttggcatttctgttgacatttggaaaaattaggctctaatgcagtttatgagtccaatcgacttttatgagtccaaaagtattttatgagtccaatcaattgtggcacatgtgttaacaggtcttgaaaatgttattgcttatgtggatgacattttggttttcacaaaatctgatgactttgatgaacacttagactctcttaaaagtgtttttgaaagattcagaaggtttaatttaaaacttaaaccacaaaaatgtattttggcttcggcaagtatg

SEQ ID NO: 118012 - DNA, 510 bp, Heterodera glycines
  Promoter: Source sequence=SeqID_29790; Location=627..1136; Strand=+; Gene=SeqID_60249
tttaatagcatctttcagtgacctacctattcgtcattccttcatttttatctttgtttatccatgtacatattccaactctctctgaatcaataactccgcttttctcttcccaattttttttttattggtcgttttcgtttagtcgcaatattatggacattgtacccatttttattccaaaaattcattgttattttgctcaaaacaaataaatagtacaatttatttgtatattcgaagagctcaaatgttctgagcattcaaaattctaaaaaatcgttttgtttacaaaaaaaacacaaataaaaaatattttgaatcttttttttgttatagctttttaaaactattaatttttttgaattttaaattataaaaagttgaaattcccattatattaattgaatttaatatctcatgacccctaacactcttctgactctaaattttgaatttccttgcgcttacaaataatttaactaaatttaaatgttcagaaaagcgatg

SEQ ID NO: 118013 - DNA, 1003 bp, Heterodera glycines
  Promoter: Source sequence=SeqID_4079; Location=1557..2559; Strand=+; Gene=SeqID_53098
aatcttgcaccaaaaatagccaatttgcattttgggccaatttctacaaaaataagagaatttggtttcagcggagccgattggtctccgcctcgctagggaaaaaagaaatttattgctccaaaaattttacttttttacttttttgtttgtattttcgagcattataaggtatttttcgtaaacatctatcaacaaaaaaaggttggtttttgcgattattaagctcaattggtaggattttcatttaaaaaatgataaaatatgtatcaatttaaaaaaaactatgaggaatcatattttctttataggaaacccacgagtatacaaaaaaaaaaattgaaaataatctaatttctgtagagggattgaaccaggagaaagaagaagggaaagtcaaggagaatagccactaggccatttgcacacttgggcagttttacttttaaagaatatattaattattattttatttttccctttgactccaattttcttcactaatttttcactcagaccccattcttaccagtgcttgtttttcccggttcccggttgccctaccgggaccgggaccgggacctgagcttttcaaaacccgggaccgggacctcggatgaccgggaattcccggcccggtcccggtcccgtggcaatctatttcaaacacataaaaagccaacaaatttaaatattttttataaaataacttaatttccattttttcatttaacttttttaattgaaatttttcaaaattttcatatttaaaaaaattcgcgatacttcaagccttcaagtgctaccaagaatgtacggattgattaatcaagaagaaaatcatggttcataaacccaaggaggttaaatgatttatttttgaaattattgtgttaataaattgttataacaccaaaaaaggttttaaggaaacattaattttcaaaaaaccaatcacattattaagaatggtaaaaatcattaattatacaattttcagatg

SEQ ID NO: 118014 - DNA, 118 bp, Heterodera glycines
  Promoter: Source sequence=SeqID_21522; Location=1107..1224; Strand=-; Gene=SeqID_52132
actgtcattccccgcgtcccaaccactcacatccaaatactcgtcgttgctgcgctcctcgctctccaacttgcactccgcttccgtctccaattgtccgttgatcacattcagaatg

SEQ ID NO: 118015 - DNA, 573 bp, Heterodera glycines
  Promoter: Source sequence=SeqID_5251; Location=3138..3710; Strand=+; Gene=SeqID_57465
actgcaaaagaaacaaaaagataagacaacccaaaattgggtaagcatttttaatttaaaatttttggtatattttattacttgaattggctttttacgagaaaccggagggggggggggggactcccggggatttgcccgcaaaatttgtaccttttggagtcatagttgaagtccttcggtccataaaatatttaaaaaacatttacaatgttttagttggaattattctgagacaaaaaaaaagtcacaaaacaaagaattaccaaattggcactgggggaatttttagtacaattaaaattttgtattttttccagtaagtccattaaaatgttggtgccaccaaatcaaaaagaaagaagaaataagtgaaaaaaatgtctgtttaccgtaaattaaaaaataaatattcaaattttctttataaattaatgtaaattgaccaattttcactcattcaattattcttttatttttgaaactgtttaattataaaaaagccaaaaattgcttccataatctcgaaactcgcctgtatctgcccgaatatccggggatttcgttggaatg

SEQ ID NO: 118016 - DNA, 374 bp, Heterodera glycines
  misc_feature (70)..(70): n is a, c, g, or t
  Promoter: Source sequence=SeqID_22954; Location=1..374; Strand=+; Gene=SeqID_53651
tttcttaacaaattcattaaaaagtccaaaaattttccccggcggcgcctggcggcaccgccgaaccccnaaaattcctatttttcttaaaaaattggctcaaaatcgcaaaaattggccattttttggtgcaaatctgttaacaaattacacccaaagatcaaaaaaattttcccggcggcgcctatcggcaccgccggcccccctgttcccgaaaaattttttggaaaaacgcaccgaaaaaaacggtttttgaaaagcaaaaaaaaaaaaaaaagtcatcggcggccgaccccccttcgcaaatattttttccgacccacccacctttttaatgtatgattttgcaggagaagaagccaaaaacgaaaatg

SEQ ID NO: 118017 - DNA, 78 bp, Heterodera glycines
  Promoter: Source sequence=SeqID_33620; Location=628..705; Strand=-; Gene=SeqID_63627
ctatacataatgtattatggcttttttgtaaagaaatttaaataaaaattatttactttaatttaagctattattatg

SEQ ID NO: 118018 - DNA, 94 bp, Heterodera glycines
  Promoter: Source sequence=SeqID_384; Location=6431..6524; Strand=-; Gene=SeqID_50942
cgtaaaaacagttaaattgttggggtgaatattttttctgcataaatcattaccaaataaaaattttacaaatttttaaagagttcaaaaaatg

SEQ ID NO: 118019 - DNA, 234 bp, Heterodera glycines
  Promoter: Source sequence=SeqID_5289; Location=767..1000; Strand=+; Gene=SeqID_57580
tgtgatattctaaatttgaatgtccatggctaatcattttgcttttccgttttaagtttcatcgctgccgactgttggcttgaggtgttcggtttgcttccacgttttcaacttggccttggcattgcgctgattagtcaccgatttgactatttcgttgacgaacacttcaaaatccgcaaatggacatttgacaaattggaaattcgaagcaaaatacaacgatggacaatg

SEQ ID NO: 118020 - DNA, 108 bp, Heterodera glycines
  Promoter: Source sequence=SeqID_701; Location=1561..1668; Strand=-; Gene=SeqID_46122
ttccgtgttcttcgaccgttgcgttcgctcgtctgcgccttggaattggaaagactgcgcaaattgagcgaatatggcattttgcaagaggacgacttcaatccgatg

SEQ ID NO: 118021 - DNA, 303 bp, Heterodera glycines
  Promoter: Source sequence=SeqID_358; Location=9392..9694; Strand=-; Gene=SeqID_84289
tggcgctcctggacaagggtgagcagagtttgttcgattaatttctattgatttggtggtgcaacaacaattcggggactattagcaattgtccacaccacaaattcgacagagaaataaaggagtcatcaattgacgcgcctgttactcattcttgtagaagagtaacaaaccatcaaaaaaactacaaaatcgccatcgtctcgcccaacatttgtgcactttcttgtagaagtgtacaagaaaaagcagcagcaagcattcttgtagaaacttgcaaattcttctcttctcttcacaatg

SEQ ID NO: 118022 - DNA, 205 bp, Heterodera glycines
  Promoter: Source sequence=SeqID_31443; Location=411..615; Strand=-; Gene=SeqID_61787
gtttaaaccaaaacctattggatgggtgcgggagtgaacctaaacctattgaaggttttaaacttattgattaataaaaattaaataattaaattaaattaaaaataaataaataataaaaataaaaataaataaacaaatcccaaaactaaacacgctgaactcggcaagaagttcagtctgttgaagaagtcgacgagcaatg

SEQ ID NO: 118023 - DNA, 341 bp, Heterodera glycines
  Promoter: Source sequence=SeqID_43257; Location=1..341; Strand=+; Gene=SeqID_70978
gaaccgaacattcacaaattaaggggcgggggatccttttaagcatccgcagtcaagaaataagcacatttaattcctaagatccgacccctccaaataaggacaaagtcttagaaataaggacaaatgaaagccctatgattttcaaaggacatcattaacaaaaggtgaacaaacattttgttaaaaaccagcagagtccaaataataaatccaacttatgtcaacaaaaatccttattatataaagcggaattgcgacatcaaaaaccgaaaagaaaatcattttaaattcatgcttaattaatctataagaaattagctaaaattatgcttaaaatg

SEQ ID NO: 118024 - DNA, 126 bp, Heterodera glycines
  Promoter: Source sequence=SeqID_22598; Location=1142..1267; Strand=-; Gene=SeqID_53265
agtccacgggagcagcttgttcaatactcgttgagcccgctatcgacttcggcagcgccttcaggcagaattatttaatcaattcatccgtttaaatttaataaaaaaaaattctgttccagcatg

SEQ ID NO: 118025 - DNA, 381 bp, Heterodera glycines
  Promoter: Source sequence=SeqID_23995; Location=1..381; Strand=+; Gene=SeqID_54696
tcctgaatagcttttcagaaggcagctacgaatttttttctgaaaaatcgaaaatttccagaaattctggaataacttttttcttttttgtgataaaaaactcaaataaatcccataaaattctccttatttttctctatttttaaagctttattatagttaaattgatgaaaccatcaccgagttatgaattttccaatattagcccaaattccaaggaccaaaaaaattaaaaatattttcgaatttttaaaaaattccaaaaattctgaaacgtaaaataaacatcatattcgtgctcagcacctcaaaatactccagaaaaatatttttcactccccttttggccccaaaaaaattttggcaacaattccaaaaatg

SEQ ID NO: 118026 - DNA, 61 bp, Heterodera glycines
  Promoter: Source sequence=SeqID_34587; Location=1250..1310; Strand=-; Gene=SeqID_64339
atcaattttcgcgtttcgtaaggagtgcactccgtgccatgcgccgaaaggccgcaaaatg

SEQ ID NO: 118027 - DNA, 369 bp, Heterodera glycines
  Promoter: Source sequence=SeqID_8258; Location=1151..1519; Strand=-; Gene=SeqID_67475
aattctaagggatttttaagaaaaaatcggttcaggcccctagctagaaaaaaaaattagagggggggggggaatccgagactttttagcccttttcactaaatattaccaattttttttaatttttgagtaaaatttaaaaagtctgataaaatgagggttccgataggcgccgccagggaaaattttggaaattttgatgggcttggtctaaaaatagtttccaaaaacgattttctaaatttaatcccgaaaattggccacagaactttttatttccctgtaatttcgggaaagaattcatacaaatttttcccataaatttcggattgaattaattttttcacattttccaggattttgacaatg

SEQ ID NO: 118028 - DNA, 530 bp, Heterodera glycines
  Promoter: Source sequence=SeqID_5763; Location=639..1168; Strand=+; Gene=SeqID_46114
attgggggggggggggggctaattaggggagaaagagcagcaactcgcccccggggtcaatggcaacacatacaaatggcaacttgtattttacaaaacaaagcttaagcctaggcataacctaagcaattgtacgagttgccttttgtacaagttatcatgacacctctcgccccccccgtgccgtccctcccccgtcgcgaatttttttaaattgatttttgtctaaatttcttagagatgtttttctaatcgtatcgtatttttttaaaacaggtttctttcaatttaaataaaactaaaaaaatagcttttcaaaaaaaaatcatgcttttttgaaatttttactaaaaacctttttgaaattataaaattcaagaatttcaatttttatctttcgattcgagcgggtacagaccgggaatttcttctcaaaatagtaattttaaaattgggtctgctgatcacatcattcattgatcatccacatttcatcaattgatcaatgccttctcttccgtttagtaatg

SEQ ID NO: 118029 - DNA, 304 bp, Heterodera glycines
  Promoter: Source sequence=SeqID_45297; Location=787..1090; Strand=-; Gene=SeqID_72623
ttattaaaattttatttttttatgctttttaattgcacatattttttacagacatttcatatatttccggtgataaaattattaataataaaaaattaaaatcaatctaattttgttggcattatcaaaaaaatatatatttaagttttttaattttaaaattaatgtataattgtaattaaaataaatttaaatttttaaaagaaatttagtctgaaaaaggcgaataatgaggcgtgcaatattgttgttttgcatcattgtttcaatgtttgctatttcggcagtttgttgtacaacaatg

SEQ ID NO: 118030 - DNA, 67 bp, Heterodera glycines
  Promoter: Source sequence=SeqID_38526; Location=346..412; Strand=+; Gene=SeqID_67313
tttgtagttcgttccattttcctaatttcatcttatcctaactgttatatttttcccccagaaaatg

SEQ ID NO: 118031 - DNA, 80 bp, Heterodera glycines
  Promoter: Source sequence=SeqID_8125; Location=2350..2429; Strand=+; Gene=SeqID_67055
ggtcattttggcaaggctcaaaaaggaataatttcctccccatcattttataattacttaatttttttttattttagatg

SEQ ID NO: 118032 - DNA, 239 bp, Heterodera glycines
  Promoter: Source sequence=SeqID_6261; Location=1..239; Strand=+; Gene= SeqID_60914
aatttatttttggtcactcaatggcacagccaattatctgttggcactttactccttttttgagctggttcatcagcttggtcattttctgtttgtgtacaacgcattttctggccaaaatttcatggagtatcgtttgacagcaaaaattttatttatccctgtgattggaatgggtaatttataaaatagaattaataaaaatatgtttaaatttaggtggaatttttccggcaatg

SEQ ID NO: 118033 - DNA, 363 bp, Heterodera glycines
  Promoter: Source sequence=SeqID_3098; Location=1055..1417; Strand=-; Gene=SeqID_83188
aaatttttaaaaattcaaaaaattgtttaaatttattagaaaatccattggaatgccattgcatgaagccaaaattcctgctggtcgggcaaggcgaactccaaatgagttcagcaatgctagtgatcaaagcagctaatcgagacctattcgattgtggcacgggaaatcacttgaaaataaatgtaaaatttaattttataaaataaaaaaaacaaattcttaaggtacaattagaaaatcaaaagcattgggaaattggtgcatttttggttcaaatctagcctatgaacaactcagtgaattaaagaatgaattgcaattccatcagcaaaaagtgttgaaaaatttgatgctttaatg

SEQ ID NO: 118034 - DNA, 1003 bp, Heterodera glycines
  Promoter: Source sequence=SeqID_17643; Location=184..1186; Strand=+; Gene=SeqID_82171
aagttttttttctgggccacgaaatggcacttctcccccatttgccgtactaaacataaagcttcttattaccctataagctgggcactgtgacgtccggccttggcaccgctcttggccgttaccgtaccacgctagcaagtggtactgctgggactggtggcaatgatattgccagcggcacagcgttcgtcggtccaacacttggccatgcgatggggctgctgatgccacgagggggcgctgcggtgccatcacgcagcggtgcagaaacgccgaattctgcgcacaaagtgtcacagtcgataagtgggcaaattttatttctctatttcaacatacaattaaatgtaatctaaattaataaatatatttatcaaatttcaattaatttctctattggtttggcgcataactattatcattttttttgttaaaaataaaaaatctcaaaaaatattgcaaattagcttaaaatgtttgaaaatgatatttttcaataattaggtttaaaatcagaaaacccgagttttacaatttaaattcaaaccaggctcaagaattttttttctcggcacttttgaaaattggccaaaacttttttgtgccattttgtagaggacaaataaggctattaaaatgacaagaagcaaactaaacacaaaataaccctttggaaaaaccctgctataattatttactgtccgttattattttgaaaaatttggcattttgaaaccccagtccaagaaattgatcattcaccaatctccactgatcagatgaagaagcgtcggatgagctggaagaaagcagcgatagcaatagttcatcttcatccaccagtgatctgttggacacaaaaagttttgtcagtgccaacaatgaatcggatgcaacaacaacaaatgctggagcagcagcctcgggcaatgccaacaacaaaaagcatacggttggcacagtgccaacaacaacatcaccaccaaatgccataacaatg

SEQ ID NO: 118035 - DNA, 516 bp, Heterodera glycines
  misc_feature (53)..(53): n is a, c, g, or t
  misc_feature (57)..(57): n is a, c, g, or t
  misc_feature (66)..(66): n is a, c, g, or t
  misc_feature (101)..(101): n is a, c, g, or t
  misc_feature (122)..(122): n is a, c, g, or t
  misc_feature (133)..(133): n is a, c, g, or t
  misc_feature (135)..(135): n is a, c, g, or t
  misc_feature (138)..(138): n is a, c, g, or t
  misc_feature (148)..(148): n is a, c, g, or t
  misc_feature (159)..(159): n is a, c, g, or t
  misc_feature (161)..(161): n is a, c, g, or t
  misc_feature (172)..(172): n is a, c, g, or t
  misc_feature (179)..(179): n is a, c, g, or t
  misc_feature (182)..(182): n is a, c, g, or t
  misc_feature (184)..(186): n is a, c, g, or t
  misc_feature (189)..(189): n is a, c, g, or t
  misc_feature (196)..(196): n is a, c, g, or t
  misc_feature (206)..(207): n is a, c, g, or t
  misc_feature (214)..(214): n is a, c, g, or t
  misc_feature (218)..(218): n is a, c, g, or t
  misc_feature (234)..(234): n is a, c, g, or t
  misc_feature (270)..(270): n is a, c, g, or t
  misc_feature (275)..(275): n is a, c, g, or t
  misc_feature (280)..(280): n is a, c, g, or t
  misc_feature (294)..(294): n is a, c, g, or t
  misc_feature (298)..(298): n is a, c, g, or t
  misc_feature (304)..(304): n is a, c, g, or t
  misc_feature (312)..(312): n is a, c, g, or t
  misc_feature (322)..(322): n is a, c, g, or t
  misc_feature (324)..(325): n is a, c, g, or t
  misc_feature (335)..(336): n is a, c, g, or t
  misc_feature (342)..(342): n is a, c, g, or t
  misc_feature (346)..(346): n is a, c, g, or t
  misc_feature (352)..(353): n is a, c, g, or t
  misc_feature (358)..(358): n is a, c, g, or t
  misc_feature (360)..(360): n is a, c, g, or t
  misc_feature (365)..(365): n is a, c, g, or t
  misc_feature (378)..(378): n is a, c, g, or t
  misc_feature (380)..(380): n is a, c, g, or t
  misc_feature (382)..(383): n is a, c, g, or t
  misc_feature (395)..(396): n is a, c, g, or t
  misc_feature (407)..(408): n is a, c, g, or t
  misc_feature (411)..(412): n is a, c, g, or t
  misc_feature (418)..(418): n is a, c, g, or t
  misc_feature (427)..(427): n is a, c, g, or t
  misc_feature (431)..(431): n is a, c, g, or t
  misc_feature (435)..(435): n is a, c, g, or t
  misc_feature (441)..(441): n is a, c, g, or t
  misc_feature (445)..(445): n is a, c, g, or t
  misc_feature (452)..(454): n is a, c, g, or t
  Promoter: Source sequence=SeqID_9763; Location=1252..1767; Strand=-; Gene=SeqID_72609
tttgaacggagaaatcaatttgcatggcacggccccctactagggagaatggnatgntgggaaagncgagaatataacttatataaaatatggattttcancattttccactgatgaaaagngagtgaatggngnagnagtttgattnaagtaaaaagnanagaaaatttgngttgttntgnannnaanggatagnttaaatattnnaataaanttantataatatttttttgntataaaataatttttaaatttaaaaatttaatttantttgnttaanattaataaaaattnaaanaatttnttagaggnaattgatgantnnaaaatgagtnntttgtntttngtttgnnttggnantgtgngaattttaatggngngnnaaatgattgtannatttttgttgnnatnntttggnatattttgnatantttntttttnaatngaatttnnntggagagttaatatataattttaattaggtacccaaaatttaccattttagcgctaatgatg

SEQ ID NO: 118036 - DNA, 377 bp, Heterodera glycines
  Promoter: Source sequence=SeqID_7809; Location=191..567; Strand=+; Gene=SeqID_66031
accactcattgtgccattctttaggcccctctgcacgttcagcttgtccgtctgctagtctccagatcaggccaagggcgcgactctacctgtatgtacgcttggtttatcctctcgagcaaacaacgtttagtttgttgaactattttgaccagagagaaatgccccccacgggaaaaaaaacgctgcccggaaaaagacacatctaatttcaataaatggtcaaatttgtttaaatgcatttttagcgcctaaattttttcatattttttatttataatttaaaataaaggaaattgtagtaaatattcattgtaataatttttttgatacgaataaattatattttgtgattattcaatttaaattaaagaatg

SEQ ID NO: 118037 - DNA, 536 bp, Heterodera glycines
  Promoter: Source sequence=SeqID_14386; Location=471..1006; Strand=-; Gene=SeqID_78420
tttggttttaacagcagattatgtgctatagtaagaaggggcaaaactacaagaaaatttgaacaagcgcaagttgtcgatttaaaaaaatttgttttttttttaaaatacgtataagaccgagatttcaagacgacattttcaaatatggttttccggttccgacctccccaagaccgttatactggaaaacaggtcaattcgaatttccaaattgccgggccaggaactggtttctgggttggtaaaaaatttaaattctcaaatgcgagttaaaaacacaaaatttcataaattgtatcagtacgagaaaataatcgatctgctatgccataacactcaacaaaataatgctcttagaaatgaggaacaaaaaaagtgatcaaaaagcgaaaaaattatacgattctagtagtttgatacgcgttgaatgatctgcttttttagatttatggttgctacccacccttgggtcataagtaataacctatatttaaacgaggagactgccaaagcggcaatcgaagctgaagatg

SEQ ID NO: 118038 - DNA, 276 bp, Heterodera glycines
  Promoter: Source sequence=SeqID_1504; Location=1119..1394; Strand=+; Gene=SeqID_74024
ggtaactcagcacctgttcaacaaagagctgcgtgtggcgcgcactaattcacactatttagtattaatgcgaaaccctgcgggggcgttgcagatacggaccatcgccacccacctcttcccgtcaaggactgcccattttattgaggcctaccgggacgcatgcgcgaaaaattttggctaccttctggtggacatgcacccagagagtccggaagagatccgccttcgaacaaatatatatgaacaaaaacaaatagtttacctaccaaaatg

SEQ ID NO: 118039 - DNA, 657 bp, Heterodera glycines
  Promoter: Source sequence=SeqID_12878; Location=1489..2145; Strand=-; Gene=SeqID_76611
atctatttaccaacgacccacagtagaaaatgttatatcagaaagaaatgggataaaactgtcattttatcattaaaagaaagaatgattataaatttaaaataaaagaggcgcttggatccactcgcattgactcaagtgatacaatgggttcgtctcggtttaaaaccaaaaattaaagaaaaatagggctccaaatttcccagatcgcaatggattgatttcacccttatggcgaatggctttctggttatggcggcaactacgcatttcatgatgccggtgtcaatttggtgactggccaaatcatttgcatgctcaatggaaggcgtttgggtttgtccaatctttcataacattctgtatatattttttattcaaataaaatttcaaatttttttctaaaaattgccaaaatggtttttaaaagatcaattttaaaattttcaatgtttgatgtagtattttcttaaatttttaggaaatttaagaaaaggtttgaattttttaaaatttaactcgtattggcccctaacccttggccttagatgaagcttttttgctgtttttgataaagatttctttgcaaataagaataccttcccttccaatattttttaagagtccgaatccctcttcaagtcattgaaacagatg

SEQ ID NO: 118040 - DNA, 797 bp, Heterodera glycines
  Promoter: Source sequence=SeqID_20156; Location=680..1476; Strand=-; Gene=SeqID_84941
actgggaacgtgatccaaagaacaccaatttccgggacctatcctgtggtcgtaaacagtgacgatgagtgtgagcgcgattcacgatgcagctttaggcttaacgaatccttaaatcattttcgaattttcggacctggaatcggtttttgagttttgtaaaaatacaaattctcacataatttcgaccggaaaattagtaaaaaaataaaaaataaaaataatgcaagtcattttcatcagtggttggttttgaccgtaaatttttatatccgatggctaaaaatttgggggactataatcatgagaaaatttgactcgagaaggaaaaataaaacggtgctgacacaaaaaccaaatttggcacttttttcgtaattacttttccactacaatattataaaaattgatatattcactttgtattttataattcttttacaattattcaaatcatataaaaatagtcatctgaaaaagaaatcaattgaccgaaaaatttcaccttgatcatataattaaaatcattttgatgtgctcttccctttagaattattaatttaaattgggaatacaagaaaaatcaaatcaatatggcaaaaattttactatggtaatgcgtttgtaatttttaattatattataatttataattccaatattaaaaaaccaatcactttggaaaaaaattcattaaggcaattatgaataaatataatatttgcctctttacaattattattttcttttaaaaaaattaaattataaattttttttttccaataaagcccaaaatg

SEQ ID NO: 118041 - DNA, 63 bp, Heterodera glycines
  Promoter: Source sequence=SeqID_12447; Location=420..482; Strand=+; Gene=SeqID_76074
atattaataatattaaattgccaatttcatttaattttttaattttttgggatttagataatg

SEQ ID NO: 118042 - DNA, 368 bp, Heterodera glycines
  Promoter: Source sequence=SeqID_6122; Location=128..495; Strand=-; Gene=SeqID_60438
tctccgtctatggtgaacagttgcggttggctgccgtcgaccgtccggccgaattttttgtccattcacccgccatttacagtgcacgccaaatttcatgctcaattacaggcaataatttattaaaaatgaaagtatttcccattaatccttttgattattacgcatcaattaccatggcttccaatttctttgaaaaattcaaataaaaggaaataatttgcactgtcattaaatatcaattcaatcttgtaaatatgaagtcctctccctaagcaaaatgttaattctaaccacttttgttgtgtattaaaataatattttgtgccgtgttcggtggtgtagggccaagtggaaagcgcagaatg

SEQ ID NO: 118043 - DNA, 64 bp, Heterodera glycines
  Promoter: Source sequence=SeqID_20795; Location=1..64; Strand=+; Gene= SeqID_51368
aaaaattattcgaatttctccattttgtttccataatttccgaaagttattcggtatcataatg

SEQ ID NO: 118044 - DNA, 198 bp, Heterodera glycines
  Promoter: Source sequence=SeqID_2922; Location=1..198; Strand=+; Gene= SeqID_82347
ataattattttctatttttaggtcttcaaataactcttgaattggcttacatatttcgagcttcctctgaaatctgatcatgaaggggaatttttgattttacaaaacttctaaattaaaattatcgcgcttttgtaggcactgtaccgtgccaccggccaatcgtataagccggtgccaccaaaacagtcggcgatg

SEQ ID NO: 118045 - DNA, 394 bp, Heterodera glycines
  Promoter: Source sequence=SeqID_9017; Location=2179..2572; Strand=+; Gene=SeqID_70009
attttttaatatgttttttatcaatgtttttaataataaacatgttataatttaataaatgatgctgaaatttcaatttttgtgaagtgactccttatatcaggtaaaacatttcttttttgtcaatttaaatatacttttcatcaatttctagcaaattcggaggaatttccgaatcccacacaatttattctctcctcccttggaacaaacaaaattgttctggggaaaagttcctcgtgttttagagatttattcttaaatttttaggtataaaaaatttctgacaaaaaattattggaaaacgggattctttgaatggcgcaatttattaaaataaaaaggacatttatcctatattttttaattttctcccccttggaacaacaaaatg

SEQ ID NO: 118046 - DNA, 306 bp, Heterodera glycines
  Promoter: Source sequence=SeqID_2670; Location=3641..3946; Strand=-; Gene=SeqID_80991
cctgaaaaaatgttgccataaatttttaaacgagtggaaatccttttttgaatcgattaaattaattattcaattgaaaaaaataattttttagccgccatttcttgcaaattttaattttccaaataaataaaatattcataagaatatttcttattaaaatacagcaccaaacagcaaatggcgtaatacaaaataccaaatactcctcataatgcaaagtaaatgtttttttttgaatttaaaaaaaaattaaaattgggcgattaatgcacgcaattagaggacggacggacccgagtaatg

SEQ ID NO: 118047 - DNA, 510 bp, Heterodera glycines
  Promoter: Source sequence=SeqID_4720; Location=854..1363; Strand=+; Gene=SeqID_55503
agcgattttgagtttaaaaagctcaacgaagagcagtttaactgcttgatgctcctcgtggcgctcaaatcgccgaaggatgctgaattgcgaaagcgcatactgtcaaagttagcggccgatggtgacagagcaacttatgaaaatgttgtgaacgacttacaaatgtttctgtcgaccatttcggaagcgaaagcgatggagagaccaccgaactccaacattttggctgtaaagcgcaggcagcaaccgaagaaggacaattttggagaaaagggctataagcagcaaccatgttggcgttgtggcagagagcacactccgttgcactgtccgcatttgaagacaatatgtcgaaaatgctcgaaagttgggcatgtgcagagtatgtgcgccgcgcaccatgaatggctgacaaagcaaaaaggaccaaagctaggcaagaagatgaatgccctgcgaattggtggcctcatggtgaacatcctgaatggatcaacacgactgatg

SEQ ID NO: 118048 - DNA, 150 bp, Heterodera glycines
  Promoter: Source sequence=SeqID_7492; Location=2028..2177; Strand=-; Gene=SeqID_64989
tgatcccgccaaattgccctcttcggcggtggcacaatgtgagcagcggggaaaaatggcacaaattatttgtggcacttttacagtatttttaaatgattttcatttgttcccacagtttacatttgctttttgctctgtgtcgagatg

SEQ ID NO: 118049 - DNA, 217 bp, Heterodera glycines
  Promoter: Source sequence=SeqID_14560; Location=1..217; Strand=+; Gene=SeqID_78633
tttatttaactttattgttaaaattatttatttatctccccctagtttttgcattgttatttccaacttggcaataattttggaaattaacattttcattcattcattgatatgtatatatttttgtattcataatgtataatttttagccttataagttgttaaagaaattaagaaattaagaaattattattatttttattatttaaaataaatg

SEQ ID NO: 118050 - DNA, 559 bp, Heterodera glycines
  Promoter: Source sequence=SeqID_5400; Location=2893..3451; Strand=-; Gene=SeqID_57891
attctgcaaatcagtaactacctttttaaacggccccttaagatggttcgtttttggtaacaatttgaccccctccccccctcctctcagcggtggtttttagtctctgctcggaggccaaagtgcgcaaaagtgggcgtcataatcattcactcattcatttgcccttccatttcgccctccacccaaaacagcgacaaaattcttcgccaaattcctcccaaaattacaaaatttatgccaaaaaatcaattaaaaatgccaaaaagaaaaatgccgaccgaattaaatgtcgaaattgtggcggcacttccctttgatattcgctgggccaatgtgcgaatttcttttgcatttgaccattttttgtacaaaaaacaagcccaatggatcagaaatgaattgatcagacaaaaaattgtggaagaaaatgttttttcaattaatttttaatttatttaaacaatttttttggatttagaggcaacggcttggacaggcaaaacgtcggattaaattaatgtcgttccgtctgtttgaaaaccgcttgcgcaacatg

SEQ ID NO: 118051 - DNA, 727 bp, Heterodera glycines
  Promoter: Source sequence=SeqID_14132; Location=850..1576; Strand=-; Gene=SeqID_78127
tttcagcgggtgttctcccaataaaagcagtgcaagtccgccttttatacttgggcgatttggacaaatttctcaggaaaacggacattttatgattttattttggtttttagggcatagaccaattgtttttaatgattcaactaatgttagcatatgggaaatgtttgttagggtaagtgcaaaaattgaggaggaaggatgaaaatggattgacaaatggagggataaactgacagtggacggattaacagcttaatgctcgtgctttgaatctcggatgaaaacgtaaacggcgcgagctaggcaaccattaacgatgacatatgctaatacataacaactgaagcattttaatttattgtatggcacggcagaataaaaagggaaagacacagcagcggagagagcgagcgaaagaataaatgtgctgctctggacgaccattagttcataactcagtttcatttggtggagagaaaatttgagaaaaagcaaaaaaaaaaaaagataaatgtaatcatttgtgtctttcagtggatagtgtgtaaaagtaaaagcatttctttttgtaagcgaccccatttccttatttttattcacaggctttgtcagggcttcatttttagaaataattgtttatttttatatcccaatttgatgaagttcgttttatctgataaaattcgttcgcagcgcattcgcggctttcttgttgacataaatg

SEQ ID NO: 118052 - DNA, 295 bp, Heterodera glycines
  misc_feature (76)..(76): n is a, c, g, or t
  misc_feature (105)..(105): n is a, c, g, or t
  Promoter: Source sequence=SeqID_17426; Location=1..295; Strand=+; Gene=SeqID_81913
ggatttggattcttgtcgtccgactgcgttgtatcaaacactgaagccagccattcaagcaaagtgttcgcctatnttgtacaaactcgcagatggaccaaattntttggggttattcatactcttttattatattgagatggtcgtattgaagagaacctattgttattttagactttcccatcgtctcattttcgctgtgttatgtcgcgactccgtcctcctgtacagctcccaaaatgagtttccactcgcttacattgaaaatctccagtacgacaagttgacttcaatg

SEQ ID NO: 118053 - DNA, 87 bp, Heterodera glycines
  Promoter: Source sequence=SeqID_8844; Location=1..87; Strand=+; Gene =SeqID_69407
atggccgcttattgacggacatcgaagcaattgtcaggattttcactgcccatatcaccgaagagtgcgaaatatgtcggggaaatg

SEQ ID NO: 118054 - DNA, 72 bp, Heterodera glycines
  Promoter: Source sequence=SeqID_7004; Location=2358..2429; Strand=+; Gene=SeqID_63548
acttggttttttgtttattttagaatgaatttgtgcaaccaaaacttcttttaggaaaaaattgctcaaatg

SEQ ID NO: 118055 - DNA, 132 bp, Heterodera glycines
  Promoter: Source sequence=SeqID_10327; Location=1714..1845; Strand=-; Gene=SeqID_73506
ttcttttcccttttttctccgttcacatttcactgttcttttttattcgttcaacaaatcacgccttacaccttcaaaaagccgtcctctttaagctgggcaggctttttcttctccttccctccccctatg

SEQ ID NO: 118056 - DNA, 349 bp, Heterodera glycines
  Promoter: Source sequence=SeqID_29308; Location=1..349; Strand=+; Gene=SeqID_59818
tatttgttatttcttttctcattttattttttgcctttccttcttttttttgtttgtttcattatcatatcattaacattttatcaatttcatttatcatttcatatcttttgtttattttcaatttttacaacaattttcggttgtttttaacttttttttccttttcctccaaattgcgaaggtttaaaagtcactgtgacaaagaattcgattatttttgcaagaagaaaatggaaattaaaaacaatttattatttaattatttttctttccattattgagagaaaagtgacaaatataattatataattaatttcattttttatttttccgatcattttaaatg

SEQ ID NO: 118057 - DNA, 517 bp, Heterodera glycines
  Promoter: Source sequence=SeqID_14448; Location=2004..2520; Strand=+; Gene=SeqID_78492
aacagaacgatcgttcgttggggcgccagcgacattttgacaattctttattttttcaactttcatttgtttgtgactgcttcttttaaattgttaatcataaaacggaatatcatttatgttcaaagtattacatggaaatcgagtttttctaaattaatattccagtagagaacacctagagcttttgaatgacactataaaatatttggttgaaattgagacaagttatgatttttattttctaccccttggcggtttttaattagtcggaaaaattttttcgaaaatatatttttattttttggatcaaaaaaatacaataatgttgtggagcggactcgaaatcgtttcactttttatttgattgatagatttttctgccttttttcccgacatgccaaaattgaaaattggcccactaatttatctcgaattttttatggtcaaaaaccaaagctgatataacaaaatcttagtttttctatacaatttagaccagtagaatccgaatatg

SEQ ID NO: 118058 - DNA, 70 bp, Heterodera glycines
  Promoter: Source sequence=SeqID_26085; Location=426..495; Strand=+; Gene=SeqID_45973
ttttccctttctttgtgtgcactttccctgccgtcccttttcagtggtgaacaatgagagtacctccatg

SEQ ID NO: 118059 - DNA, 93 bp, Heterodera glycines
  Promoter: Source sequence=SeqID_41567; Location=1..93; Strand=+; Gene= SeqID_69649
agacgattatctaattgaatttaaaaaccgaattttattaaaatatttattttagaatattcaaataacaattaaataattcttttagcgatg

SEQ ID NO: 118060 - DNA, 72 bp, Heterodera glycines
  Promoter: Source sequence=SeqID_7827; Location=2533..2604; Strand=-; Gene=SeqID_66088
tgattgcaatttcgttttttcttcgtgaattcaccatgagacagaattgcacgttgacaatttttcgcaatg

SEQ ID NO: 118061 - DNA, 617 bp, Heterodera glycines
  Promoter: Source sequence=SeqID_1008; Location=2401..3017; Strand=+; Gene=SeqID_65976
aaaacgagaagaaatgaacaaaggaaaaccccgagacgcaagggcacgggcgtccgagcactttcactggacggtggcggaattcgaggcattgtattagtgcaggttttgattcgggactttttaattaaaaattaaattttcgattaacaatttgcgacttaaataattttttcctgcaaatgaaaaattggggtttactttcttgacaaacagttaaaaaacacttccataaaaaccatattttttaaagaagcatccaaaataaacaccaatatcattcgataaacctaggtcttccattctcctgcaaaattccaaaaaattcgttctgcttcaaaaaagtcattgcccgaaaacctcaaaaaaaattttttatctaagcattttgtttataaattttccgaaacagagaatattctttaaaattttgcatcctaataaagttatcgaatgatataaagaatgtttaatttgagtgtttctttaaaaagttgtgatttacttcatttgcaaaattatttattggctggtcttttttatggtcatgtcaatgcaatagagcggcttaccaccatatttttcgctatgcttatcccttatcaaatttgcagatg

SEQ ID NO: 118062 - DNA, 92 bp, Heterodera glycines
  Promoter: Source sequence=SeqID_11412; Location=2012..2103; Strand=+; Gene=SeqID_74806
aattttttttgatgaaaaaggatgtttttatttaatgttttatacgcttgtattttaaaaattatttcgctaattatttttagttttaaatg

SEQ ID NO: 118063 - DNA, 361 bp, Heterodera glycines
  Promoter: Source sequence=SeqID_4636; Location=371..731; Strand=-; Gene=SeqID_55179
ggtggcaccaaattttcaaaattaattaaataataatattttaaaagattaaattataaattttatttaaaaatttaaaaataaattaattaaataaaattattattattagctctaaataaaaaacaatcctttttatcaattttaacggtactatatcataattttttttaaataggcatttaaaaaataagatttataaaattttcaaaatattttaatttatttttaccaaatttttttttatataaaaatgaataaataaattattatgcatttttcttttgccacaatattatattataatattttgtaaattgcattgtcaatttagttttttcagccttgcccccctccgatg

SEQ ID NO: 118064 - DNA, 99 bp, Heterodera glycines
  Promoter: Source sequence=SeqID_34730; Location=1..99; Strand=+; Gene= SeqID_64452
cactccgcctgcaaatgccccattcgccactgaacagcatgacagcaaaccccagtctggaggctagcaggccaacgtacagcaacaaacgggtgaatg

SEQ ID NO: 118065 - DNA, 231 bp, Heterodera glycines
  Promoter: Source sequence=SeqID_30275; Location=1427..1657; Strand=-; Gene=SeqID_60695
agtcttctccaatgattcattccctcataacaatttactactgtattccccattgttttcactactgtgtgtgttatgagcgctcggaatggactgcagattttcaaaatatctcaatgtctgacgaatgaagaagcattgagtattattatgaaaatctgagggccgttcggtgccaaaaattctgcatcaaattataatttcgggcaatgctttgcccctcacaaaatg

SEQ ID NO: 118066 - DNA, 364 bp, Heterodera glycines
  Promoter: Source sequence=SeqID_713; Location=5061..5424; Strand=-; Gene=SeqID_59588
tagtctgtaaaaaataaataaatcggcttggggattcactgtgtgtttgaattggcgcccttttgtatctttctctaaccactactctctcgtctatgtgtttgtggatggcgtggcctatcgattaagaagggacagcccgtctggaggtcgctgcgcgctaacacccctctcattatcaatcaataattacgtgttttttttcgcaggttcattttatgcttttaacaattataatcataaactatttcttaatcgtaatggccccgagaaaaatcaatgatcaattggtgtttgagaacaaaagtaatcattttttgggttttttataataattttaaatttttttaaatttaaagaaatg

SEQ ID NO: 118067 - DNA, 205 bp, Heterodera glycines
  Promoter: Source sequence=SeqID_40804; Location=977..1181; Strand=-; Gene=SeqID_69043
atgagcaggagttggcgcgcgtaagaaagaatgcagagacaagctaccgcatcgagaaggtttacacgaagagatagcgatcggacgggaccaccgagatgcttgtcaaatttataggatatctcaatcgtgagtggattgctgagtctcagcttgtataaaaagcatatgcatttttcattttgttcaaaaataaacaatcatg

SEQ ID NO: 118068 - DNA, 98 bp, Heterodera glycines
  Promoter: Source sequence=SeqID_35973; Location=1..98; Strand=+; Gene= SeqID_65423
tgtttagtcactttcattaaacgatcttagtattaaaattgtttttcatttttttaataattttatttatacaataattcttttaaattttagatatg

SEQ ID NO: 118069 - DNA, 116 bp, Heterodera glycines
  Promoter: Source sequence=SeqID_6520; Location=2522..2637; Strand=-; Gene=SeqID_61882
cagccaaaggcggcttcgtcatcatttgccactcaatcgggcgatcaaaaggacaaattatcaggcccacgagttggtgctgaaccgtgccaagggccgaggtggacaaatggatg

SEQ ID NO: 118070 - DNA, 996 bp, Heterodera glycines
  misc_feature (95)..(95): n is a, c, g, or t
  Promoter: Source sequence=SeqID_8226; Location=4011..5006; Strand=-; Gene=SeqID_67362
ttattaaaatgccaacaattaagtaaataatgccagtcattaaaatggtacaagcgctgatccatgtttgatgattggtactctgaaaaatcggnctctaatgcactttatgagttccaatcgagttttatgagtccaatcgagttttatgagtccaatcagagtttttgagtccaatcaaatatttatgagtccaatgaccctttatgagtccaatcatttttttgtaagtccagtcagagtttatgagtccgatcaaaaatttgggcgccaccacaaagtgtccaagccacgaaatgtccaaaatttttcaaaatttataaaaacaaaatgagtctaatttaggatttttagggttttcggagtcgctgaatacgaatataccctttatattaccccttgcctaaccttaggcccatctgaataataaaaaactcaaattcgagacttggacatttcgtgggctggacattttgtgggtcagctaaaatttgtgaataaagtacattttacaattttattcaacttaggagattttttcattccacaataagatgaataaataaaaaagttcactttgtttgcgcatgcgctagaagacattgtgtttgttctttagataaaactgaagttggcgatctcacgttatgttaaaaaatgttttaaaaattggaactgacaagaaaataaagtcgtttgtttacactaagcgattaaaatacgaagagtttttgcttatttaaagcatgtttcttttgacaaaagttacatttaaataaaaatgctttttttcttcattttcctggtcgcaccaattaccgtaatctctcccaataattaccaatcacctgaaacgcttaatggaagttgcatcgcttattttgactaccgtaattcgaaaaaccaaaaaataacggtatacggtaattgaaatttaacgcataaatgaatttaataaaaaaatttagtggcgctgtaataaatgccgcagggatg

SEQ ID NO: 118071 - DNA, 141 bp, Heterodera glycines
  misc_feature (97)..(97): n is a, c, g, or t
  Promoter: Source sequence=SeqID_15075; Location=1..141; Strand=+; Gene=SeqID_79245
caacctaaaaatcgacttttcaaaaaacctcttacgaattttaaagcccaaattaggtatgtagaaatttatcaaattaactgtttaaaaagatttntaatatattttcatatgttagtcgaaaaaacattttagcaaatg

SEQ ID NO: 118072 - DNA, 325 bp, Heterodera glycines
  Promoter: Source sequence=SeqID_4213; Location=3280..3604; Strand=-; Gene=SeqID_53620
gtttgaggtactggcgtatcctgcccataatatctgggcatggaattaattttggaactgcgctgcctaacggcggtgcttaaagtgcgctaaaaatgatcaaatgattatcaatttttatttttcttaattccaaaatgaattcgaaacgcaaaaatttaatcataattcatgtggtaaaaaatgcatttaaaaataaaaaaattcttgaatttgcttctgaattttttaattttaaatagaaaattcctttttctgaaattcacaataacaatttggcgaagaaattcattgaaatttttataaagcattttgattaaaaatg

SEQ ID NO: 118073 - DNA, 270 bp, Heterodera glycines
  misc_feature (70)..(70): n is a, c, g, or t
  misc_feature (127)..(127): n is a, c, g, or t
  misc_feature (134)..(134): n is a, c, g, or t
  Promoter: Source sequence=SeqID_23222; Location=1..270; Strand=+; Gene=SeqID_53940
gcttttcctttttgcagactgtacacatcctttttgtagtcaaagtcgaggcaatttttgcgttttttcnttcaatgtcaaaggatattgcgaaatatgtgcacagataaaatatgaaaaaatattnattctcnccttttccatttgcttttgcttaaactgttgcataaatatttttgtgtaaaaaaagaaaagtggccgattggctaaaagggaaaagtggaaactgttgttggattggaaaacgaacgttgggcgggtgaaggaatg

SEQ ID NO: 118074 - DNA, 72 bp, Heterodera glycines
  Promoter: Source sequence=SeqID_2670; Location=3413..3484; Strand=+; Gene=SeqID_80992
actgaaattaaatatggtcaaattgaaattaatgaattaattacttattaattaactaattaccttagaatg

SEQ ID NO: 118075 - DNA, 150 bp, Heterodera glycines
  Promoter: Source sequence=SeqID_29451; Location=1285..1434; Strand=-; Gene=SeqID_59949
tttggcattaaatttaattaacagttgcttccattcttttttaccctagcaacaaaagaatgtaatcatttcttggcatttgaaaaaaggttgttaaaagtgcacaatttctaataatattttgaacaaccaattcaaatataagcaatg

SEQ ID NO: 118076 - DNA, 272 bp, Heterodera glycines
  Promoter: Source sequence=SeqID_13981; Location=1058..1329; Strand=-; Gene=SeqID_77942
ggtggggaccaagaaaaatgccgaaaaggggaggcatttgatttatccgagaatccttcgtttttaatggaatttttggacacgaatttatgattttttggagagattttggcaaattctagtgaagttggtggttccgcagtgcctacagatgccgttcgaatgcaataatttgttcgtttcccatttttagtagaaacaattcggacgaagcggtggacgacttgctgccgtcggtgtgcgaaagtccgtggttgttcgccgaccaaatg

SEQ ID NO: 118077 - DNA, 1003 bp, Heterodera glycines
  Promoter: Source sequence=SeqID_2239; Location=1057..2059; Strand=+; Gene=SeqID_78646
ctattagccttacaaaaaacaaaccaaaattttagcttctaaaaaagttattaagaaaaaactcaaaaatttcgacttttttggaatttcatgttataacttttttggtaattgtctaatcgcgaagcaatagcttagaaatatcttctaaacatgttaagctttcgattgataccaagattgctggatttggttaacaacaaaaaaagttataacccaaaaacttgggctggcgccaaaacgtcggcgccaaaacgatacggaccctaatttgacgccctagtgataagtactcacattttttcaaaaaaaacaaactacaacagcaaaacggaggagagtcgaacaaacaaacaaaacaaaacacaacacatgatggtattcataaataggttgtacgtaatgggagtgcgcgaagcaaatgttttagattttatttccgccgggagggccaaaaatatgcgccaaatgggcgtggaactacaaagtacaaagaacaaaagacggagacggaatggactgaaatacatagaaaggaatggtaatgggaacatttgtgattttattacgtaattaataggggttgaattaatggatataaaatcgtaaaatatggccataaaatatggacaacaaatcgcgaaatatggacataaaattgtgaaaatctcaaatatggacataaaatggaaaaaatatggacatcaatttttctaatttgtgggtataatttctccaaacttcttcaaactggctaaattcaaaataaaaaactttcaaaaatgcctaaatatttatttatttatttattcaagtaataaaagtccaaaagaagggacaaaggccgcttatactttcggaagagaatgatagtccgggaaacatgatggtgtcagatctccaacttgaaattaatcttgtaaaatactttttacttttttcttgaaggtgggcaatgatttgatattgaaatatctgaatttttgcagatttcttgtagatg

SEQ ID NO: 118078 - DNA, 1003 bp, Heterodera glycines
  Promoter: Source sequence=SeqID_4847; Location=1003..2005; Strand=+; Gene=SeqID_55934
gccatttcccttaattttcccgcggctcttccaaatgaaagccggcgccgaatgataaaagccgaagtgtcgctctgttatttgtgctcatcgacaaatgccgccgacttcttggccaaatgcctttgtaagcaccgcaaacgaaagaaatgaacggcgaattgcgccaacccaaagcagcagcaccagcagcagaaacagaggcaggcacagaagggttgcatcgtcaccagcagcaccgatcatttcgtccggcgcttctccatcgtcttcggcccctctctttggccatcgtcgtcctcccccgtcgccttggccatcgtccccatcgtcgtccccccgatttccccccttttctcgggtctctgctcataatcgcctcctccccctcccgcttctccttctgctaattcttccgatggccttctcctcccttctcattcattctgcaaatgccctccaccatcggcacgaacacccgcaaaaatgttcaattgagggcgaaatttgcacaacaattaatgctcatgtgtgccgaaatgggacgtaagtgaaaaatgggggaatttgttggagaaagggacagaggggagagaaatgcgaccccaattaggcgaaatgcaaagacagacagacagaaacaatgattaatgacggatggcagagactggagactcccatgtctttgagaagatttgaaatatgtagggtaggtatttggtttaatccaaccaaaacaaaaccgagagccaaaagcggcctaactgagaattgataaacccaattaaaacccggtcattaactgccctaatttgagactaaaaacacagcatcgattggcttattcattagtcattgtctgcctaacggctggcaaatcaaaaaccgggattagaaaatggacgcctttgtccctacatggattcccagccaaatctcgatttaaccaatttcaacaaaaacttcgttcagctgtgtgtccgcttgcactcttcgcggcatg

SEQ ID NO: 118079 - DNA, 248 bp, Heterodera glycines
  Promoter: Source sequence=SeqID_6964; Location=5883..6130; Strand=-; Gene=SeqID_63426
accgactccaaccccatgtccaaaagttggccaaatgagtcaatggtcagacagtaagcaagcaagcctgagcagagagaagcacaaaattaaaggacacaacggtaaaaaaggaactaataaaaatgttagcatttatttttgattcaatcccaaccaaaagggccgtttttgtgagaccaatgccatcagaaccaatcggagggcttttgtaaaactcggttaagttttacagaggattttaaatg

SEQ ID NO: 118080 - DNA, 789 bp, Heterodera glycines
  misc_feature (10)..(10): n is a, c, g, or t
  Promoter: Source sequence=SeqID_32177; Location=1..789; Strand=+; Gene=SeqID_62503
accgagttanaaggattggatttccatctaaggcttaacatttggcccatttctttatcaaacggaggaatagataaaataaaataacagttcttaggtttgggaccatttagttctgcgccgcaaatgtaattttgactgggcgccgcaactgtcggcgccgcaaatgtcgctctggctgggcgccgcaaatgtcgctctggctgggcgccgcaaatgtcgctctggctgggcgccgcaaatgtcgctctggctgggcgccgcaaatgtcgctctggctgggcgccgcaaatgtcgctctggctgggcgccgcaaatgtcgctctggctgggcgccgcaaatgtcgctctggctgggcgccgcaaatgtcgctctggctgggcgccgcaaatgtcgctctggctgggcgccgcaaatgtcgctctggctgggcgccgcaaatgtcgcatcacctcggcgacgacgttttggggtgcaccgccctgagagaccaaagcaaagggaaaggtttttggttttccttgacaatgaacatatgtaatattggtcatctgaataaaaaaaatgattgaattgaatggagatttaatttttcaatttacatatttttttaggaaattcatattttaacttttgacttttatgaagttgaccaatagaaaggattattcatttgaaaaataatttaaaaatttcaatttttggttttgatttttttttgaaaaattcccaattactcctcccggtcccgtgcaatactaatccaaaaaaaaaacagcgaaaaaatg

SEQ ID NO: 118081 - DNA, 375 bp, Heterodera glycines
  Promoter: Source sequence=SeqID_4231; Location=2152..2526; Strand=+; Gene=SeqID_53695
aacaattacatttttagaacatatttttatgtaaatcttgtaaattctcgaaaaattttctgcaaaatctaaaagcaaatgcaaataaattttgaatatagtttaatgatcaatataagatcaaaatttcaatgttgataagaccaataaatatgcctcggtagctcaatggtcggatgcccacggattgggatttagggtgggttcgattcccacccgagtcctaacatattatcattatttatttgtaggaaaaattactaaattctcaagacttttccgtcagccttttaaattgaatttttgaccttttttaagattgtatcagctcatagagcaattctctccagtgcatccgatgtttttgaagcaatg

SEQ ID NO: 118082 - DNA, 364 bp, Heterodera glycines
  Promoter: Source sequence=SeqID_43991; Location=1..364; Strand=+; Gene=SeqID_71547
aacttaataatgcatcattctgtgaatgccaatgtcacataaatattaaaagtacttaaaaaacattttttttcaaaaaaatttgaatgacttggaaaatttgcaaaaaataattttaattttacttaaaaaaatgcatttaatttttctgagaattctttctttttgaaataaaattaatttggtccattaggcagaatgaacccaatttccgttttttgtgattaagctttaagcgcgtcattatgcttttcctatttaagggcatgacactgttgcgcatggtctaatgtggtatcaacgaacaaaaaatttctcactttaaaagtattttttttaataaaaaaggtttctgtggtccatg

SEQ ID NO: 118083 - DNA, 101 bp, Heterodera glycines
  Promoter: Source sequence=SeqID_31073; Location=649..749; Strand=+; Gene=SeqID_61446
tgtgaagtgtttttctgggcaaaatatttatgaaataaaaaaaattcgaatttctttagacctcagtgcccgttgacaaattcaatcggaccgatgtgatg

SEQ ID NO: 118084 - DNA, 266 bp, Heterodera glycines
  Promoter: Source sequence=SeqID_17426; Location=2563..2828; Strand=-; Gene=SeqID_47444
gctcttttgttcttgtacagtgacctgccaattgcctgatttttgcgttgattctatgcctttgtgtgaattgcgatccaattaaaaatattttattgtttgtcaatgaattttgcgataaattgctgcaaaaacaaaaaatatgtttttttaaacgtaaattcaaacattgatcgggtaaatagataaagaactttgctcccgtattggaatcagtttaaaaggtagtctcattatcatttgtttatttcgttagctttaaaatg

SEQ ID NO: 118085 - DNA, 470 bp, Heterodera glycines
  Promoter: Source sequence=SeqID_7909; Location=5181..5650; Strand=+; Gene=SeqID_66346
tgtgaacagtgtcccagagttggttcagatacccaaactcatccctaacactgatgattacattctcaatggatttgtcaagactgcttttgaaatgtgggaaaagctattataaagatgtaatttttagaatagcaaactttttttgcgtgttggaagaatttgattcgcttggactaagaaatatcgttgactgcgaattaatacttttgttttttgtaggtgacatatgagatggatttatttaatattttgacaatgcttaaattagaattaattacaaaataataaaaaatgaatgagagcaaaatgtggtcgaacatcagaatctgcattgaattaaagccggatggatttttcaaaatttaaaatagtgctagttaaaaattttaaattgttgaatctgtggcgttacttttgtttgagttaaacattcattttttgttttaagaaaagttataaaatatatg

SEQ ID NO: 118086 - DNA, 478 bp, Heterodera glycines
  Promoter: Source sequence=SeqID_30387; Location=500..977; Strand=+; Gene=SeqID_60802
aagtcattcccaaaaaattaaataattttttgttttgctaaaaacctccccaaatgtgggataatatggaaaaaaaataaagaatcatattagggatggttttttaagttttttaactacaaagtattacgtttttcttacattaagagaaattacagcttttggaaattgactaaacataataagtcaaaaacaaataaatttttggatttaaacccataaattggttctaatttgtaagtgatgcaattaataaaaaaaaatccgccaattaacggtgccggaaaatctttgataaaaaacatagataatgatagcaaaaattggcaaattcatatgaatatgattatcatcataatattcccctttgacaaatgagtagggtaaatttatcgctttgtcatatacataattaatcagttaattacccgtgtgaaatgagtatgtcttcagccaatatgttgtgctcagagcaatg

SEQ ID NO: 118087 - DNA, 1003 bp, Heterodera glycines
  Promoter: Source sequence=SeqID_6030; Location=622..1624; Strand=+; Gene=SeqID_60060
ttaggcataagtcgcgacaaaatatacaaatggaaaaaagaaatgaatttaaataaaaagaaaattatgaaaaagagtttttatgaaacgaaaaaaaaagaatttattgaaagatttgatgaatttaaaagtttataaggataaagcaaacagaaagaatttgtgaaggaattgggcatttctgaattgacatttcgaaaatggaaaaaggaattgatggcaaattagcataaaagtaagagaattttagttttacttaaatttttatttccaagcatataattcttattccaatgaggataaattgcaaaggatgaagcaatacttgaaaatgaaagaagaaaatccaaaaattagtgacgaaacaattactaagaaattgggaattggaagaacatcactgattagatgacaaaaaattttaaattaatatttactctgtgatgttttgatcaaaagagcattgttattgttatggccttgaataaaactcatttcttaaaaaaaaactcattcgaaaaattatagagactaaatttcatttatttcttatttcatttgaaaaacataacacatatttaataaatcgcttttaataaatgttaaacccaccaaattaatataaaaaagggagtaaaaaattgattcagtaaaatgtaaatattctgaatgatttctttatatatatgattaccattttataaaaacatttttttattcaaaaatatttacgaatcaaaaatgtagagctttaatattatggaatttaataattatattaaccaaaattatagagaaaatggacaacaaaaaagaaaaataattcaaaaatttgaagcaattaaagaaaagtcgaaacaaaaaagaaaatttcaatggaaaaacagaggtaaaattgagagaaaaattggacaattattaggcacaaatcgcgacaaaatacaaaaatggaaaaaagaaatgaatttaaataaaagaaaaattatgaaaaagagtttttatg

SEQ ID NO: 118088 - DNA, 168 bp, Heterodera glycines
  Promoter: Source sequence=SeqID_18037; Location=336..503; Strand=+; Gene=SeqID_82621
ggtatattttttttttgtttattgttgatttatgggtttttgaatgacaaaaaatactttttcgagggtttagtaggggtcaataaagaaatatttattggtttcgtttccattttagttcaagatgatcgacaaattccatatcgtgagcgttttggtgaaaaaatg

SEQ ID NO: 118089 - DNA, 156 bp, Heterodera glycines
  Promoter: Source sequence=SeqID_27446; Location=429..584; Strand=-; Gene=SeqID_58143
ttttttcactttgtttttttacattccttcccacacaaatgaataaaaacatttcatttaaatgcatttaaaataatttttaatttattttatttaaaattaatttaaaatgattttaaaaaagctttaccacaaaatattttctcaacaaaaatg

SEQ ID NO: 118090 - DNA, 811 bp, Heterodera glycines
  Promoter: Source sequence=SeqID_4970; Location=1..811; Strand=+; Gene= SeqID_56396
ggcaactcacaatcagttgattgctgattgggggggctttgcagttcgacgacgcgtttatgaacacgcactatgggtcaactccactgtgcagagaaaagcctagtactatttcgtcgttttctttttctttgtaatttctctctgtttggcgtactatctctttattttaattatgtaaaaaacaacatttacttctctccatataactttttttctaatgcatacagttgcaccaaattttgcataccgatagagaaacaaattctgcatttttcaatcgcttttttaaacaaaacaatcgcttagttcaatagttatagatagggatgccaaaaatatgcatataaaatcgtaaaatatgcgcataaaatatggaccaaaaatcgcaaaatatgcacataaaaagtgaaaaatatgcacataaatttttccaattgagggtataatttctcaaaatttcttcaaattttttaaacataaagtaaaatcttcaaaaatggctaaatgtggtattaaaaatcattttaggagaaaaaaacacgatacagcttaaaatttactcattttagcgaaaaatcaacctgaaaagcaaaattttgcttatttttgacataaattaaccatttttgagaaaatttatttattcaatatttttcgtgaaaattttgctaaaaaattattttttggaaaattttccggtttttgaggtcaaaaaggccaatttgtctgttgggggccgatctattagaggttttttggaaaaacgccaaaatatgcacataaaatatgcacgaaatgccaaaatatg

SEQ ID NO: 118091 - DNA, 391 bp, Heterodera glycines
  Promoter: Source sequence=SeqID_43673; Location=611..1001; Strand=-; Gene=SeqID_46750
gccaatcaagccgtacatggcggccttccttctctagttcaacgatcagatcgaagacattttcgtcccaaaaatggtcagacatgaaaatacctgaaattttccattcaaaatgagcataaatggttttgtttgttctattattgacaaagttaaaagctaaaaaaattcataaaaaatggtaaaaaaaaatgtcaattttttatgtttgtatttgttcttttggcgttctgtatttattattatgcacaaaaaacatttttagcactaacaaacggaactcaaatgatgtatataaggaggcgttttcacacacttctgcctattcctttcttctttcatcagcaacacatcgacgtgcccaacaaccgcaacaacagcgacaacaatg

SEQ ID NO: 118092 - DNA, 62 bp, Heterodera glycines
  Promoter: Source sequence=SeqID_16847; Location=1..62; Strand=+; Gene= SeqID_81269
attacaaggaatacttatgtggaaattgtggtatagagcagaatccgggaaagccaaaaatg

SEQ ID NO: 118093 - DNA, 847 bp, Heterodera glycines
  Promoter: Source sequence=SeqID_8380; Location=1..847; Strand=+; Gene= SeqID_67864
ggattatataataaattaattattaaataaagaatgaaattaaattgacaaaatattaaccagttgcattacattaaaacaattggcccggatagaaccacagttgctataattgaaagcactcggacaagaattaaaatgagataaaaaaataatataaagctgaaaaaaatatttattaaaatatgcaattaaaaaataaatgataaataatatcaaaaaatattgtgtaaaggcgctaaagcgctaaaaattaaaagttaaaaatccaaagggagcaaaataaaatttgtaaatctaaacagtctgaaaagtgataaaattggtaaaccaaaaagacacaaaagtgccaaaaaattgtgtcggtaattctgaaggcttgaaaagatcaacagaacaaatttggtatcaaaaatttgctaaactggtcattctcaatcaccaaaaaagaggtacgaaagtacaaaattggtgaccggtcgtgttcattggtatttcgactccatttgctgaaaagctacggtggggagataagttatctaagcgataattaatgatctatttttttaattttgaaaagatttgaaaaaaattaaaaaataaaggaaaaagataatattgtaaattaaaataattagcgcttaaaattaaaaagaaaaccgggttttatgctacaaaatttgttattcctcgacatgagattaatatttaaaaaatctatcaaaaaattaaatatttaattgtataatcagtctctcaaaataaaaatgatgttgacaatccgatacatcaaatataaacaaaataaattctaacaaattaaatattattataaattttaaggatg

SEQ ID NO: 118094 - DNA, 135 bp, Heterodera glycines
  Promoter: Source sequence=SeqID_2636; Location=894..1028; Strand=-; Gene=SeqID_80836
actttgtaaagaatcaacgagatagaatgggtaacctaggtattcgattccggctgcagattttacccgcttcaagaacctggcagcatcagtatttgtgcaggagtttaatatctgcgagaaaaagccataatg

SEQ ID NO: 118095 - DNA, 229 bp, Heterodera glycines
  Promoter: Source sequence=SeqID_17759; Location=1..229; Strand=+; Gene=SeqID_82297
cgaaaaaagtttatacaattgaattttttatgtgttttgctacctaaaaagcgttaataaattttttttactattttcgtgcctattttaggatttttctgcctttttaagtgcctatttcgcgattttttgtgcctaaaaatcacatccctatacataatggattatggcttttttgcaaagaaatttaaataaaaattattttactttaatttaagctattattatg

SEQ ID NO: 118096 - DNA, 191 bp, Heterodera glycines
  Promoter: Source sequence=SeqID_21146; Location=1686..1876; Strand=-; Gene=SeqID_51730
gcagggggcacctcccactgcacattaaggaacagcaacgagttgtggtcgccgaggaccaacaagcacatcgatttgtgctaacggcaaacaaagttggtgccgttagcgggggtcctgccacaaacaaggaccagcaaccgggagcacctcccgctacacctcggactaaccagagcgaaacgaaaatg

SEQ ID NO: 118097 - DNA, 705 bp, Heterodera glycines
  misc_feature (55)..(55): n is a, c, g, or t
  misc_feature (120)..(121): n is a, c, g, or t
  misc_feature (128)..(128): n is a, c, g, or t
  misc_feature (133)..(133): n is a, c, g, or t
  misc_feature (195)..(195): n is a, c, g, or t
  misc_feature (234)..(234): n is a, c, g, or t
  Promoter: Source sequence=SeqID_27618; Location=1..705; Strand=+; Gene=SeqID_58298
tattttaaatgtgtaaaaaatgcaatggtctaattaaaaacatagctaattcatncgagttaggaatttaagttttttacgaaatcgtccactaattaaccatgtttattttgttgatcnnatacaanttctnaatatcaatgtcaatgtatatttgtgtaataattaaaggctcagtctgttaagacttaattnttatacgaacagaaacttgaacacgtctaaccctacgtntaaacaattgtaagaataaaattgttgtcctgttacctccgaaaatatttgtggtcttcgaattgcttataatatttcagtctaaggttagattgtccaacaatttatcgtccttctacgtgattccgaagtcatttttctatttgatttaagaaaattggattttaaatgttgccttttgacgctgccataaaatttgagtcatgtgtaaattttacataaaattattccactaaatttgaagcaaatttaaagaaataatttaatatgggaccaaaatagaaatgaatctttctaaatgcataaaattaatgagttaatcattggtttttaaagctaaacaaacgtgaaaaatctttcaaaactttttttctccaaattttggctttaaaaggcatttgcttacaattatttaatttgcattctttcatttgtttcccaccacaaattcccatccattatcgagccatg

SEQ ID NO: 118098 - DNA, 84 bp, Heterodera glycines
  Promoter: Source sequence=SeqID_9640; Location=2751..2834; Strand=-; Gene=SeqID_72165
tttttggcacttttctccccctcaggcatttcaagtggtgccaatgtggtggctgcgcttcgcgttgcgcaaaagccggaaatg

SEQ ID NO: 118099 - DNA, 429 bp, Heterodera glycines
  Promoter: Source sequence=SeqID_33316; Location=1..429; Strand=+; Gene=SeqID_63414
gaaaaggaaaaattcgaaccaaggaggggggaaagaggaggaaaaggatgaaaataacatcggggaaggaggagagacggaggagaaagagagaaaaaggaaaaattcgaagcaaggagggggagaaagaagaggaaaaggatgaaaatatcatcggggaaggaggagagacggaagagaaagagagaaaaaggaaaaattcgaagcaaggagggggagaaagaagaggaaaaggatgaaaatagcagtggggaaggaggagagacggaagagaaagagaggaaaaggaaaaattcgacggaagaaggagggggagaaagaggaggaaaaggatgaaaatagcagtggggaaggaggagagacggaagagaaagagaggaaaaggaaaaattcgaagcaaggagggggagaaagaggaggaaaaggatg

SEQ ID NO: 118100 - DNA, 82 bp, Heterodera glycines
  Promoter: Source sequence=SeqID_3268; Location=1..82; Strand=+; Gene =SeqID_83973
ctactgtcattggcaatatttcctgacattggcaagactattctcattgaagttttggatgttggtgtaatttgtggagatg

SEQ ID NO: 118101 - DNA, 524 bp, Heterodera glycines
  misc_feature (11)..(11): n is a, c, g, or t
  Promoter: Source sequence=SeqID_14521; Location=1..524; Strand=+; Gene=SeqID_78572
cacatgcacgngcacagtttgaacgccgtttggggcgacgacgccgcgggggccggcggcgccctcgcgcgtgaagtaaaatatttaaaaaaacaactataattaattattatttttataattatcattaataatatttttaaggttctccgtgtggatgccaccaaaccgtacataataggcggagcacgcgcagcggtgctcaaagttgctgagagccaacaaaagcaggtgcaaacaacgctttggctagttaatcgaattacgatttttattgccattaattcctctcatattttaatggaaagtttcgattggaccaatgttttctcacaattattcgaattttgcaacggaggactcattcctcttatataaatacaagatgtgaaaatgccgttgtgaagccgcgatttaaattacagtttaatatagtgattaaaattacttagccctccaactttgggccatctccaacatcgaacgtccaatatttcaacaatgtcacggcattccaacaaatg

SEQ ID NO: 118102 - DNA, 52 bp, Heterodera glycines
  Promoter: Source sequence=SeqID_7735; Location=399..450; Strand=+; Gene=SeqID_65780
aaagcgctcatttatttttattttgttcataagttttaataaattcataatg

SEQ ID NO: 118103 - DNA, 705 bp, Heterodera glycines
  Promoter: Source sequence=SeqID_14818; Location=1961..2665; Strand=-; Gene=SeqID_78971
atacaatcgggaaaatgtaggacaatatccagagcagaagcaatcaattgtaaaaggaatttgtgcctcatttgtcaggtacattgtttaattttgttcgtagacaggaaagaaacaaaaaatttcgaaaatttcaaggattaattagaaaagaattcaatttttaaacaaaagtaacataaaaacttttttatctaattatttgcaaaatgcaaaggaatattttgaattcaactaaatcattggttcgaaaaaatgtaaaaaataataaaatcattttgtcgttttgcagcttattagtgatgtgagcgaaaggattttacacgggaattgggagccgaccgagaccggcaaatcaccggggacccaaaaaattctgagtcgggaaccctggagcatcacaactgattttcactgcctccatacatttttcttgaatttaaatcaaacagaaaacagacaaacatttgccctattttataatcagtgccggagtttgcctatgctttcatagaattttaaatttacataaaactagtccataagcataaatttattgatgaatattcaaaattacccctgcgggagggttaaaagtgcactcatttatggctgggccaaggcaaaaatgaagacaaaaatggcaccaatggtgtgccggcggtgccgtcttttgccgcgcgcttttgctccctccggcgaatg

SEQ ID NO: 118104 - DNA, 1003 bp, Heterodera glycines
  Promoter: Source sequence=SeqID_9553; Location=29..1031; Strand=+; Gene=SeqID_71868
gtccaaaaaacgtctcgggtcgggtcgtggggctcggagtcggggctgaaccctagtatgtaccgtcgtcataaacgggcggcaacaaatgtctgagcggactgaacgaactgccgtagtgggggaagcgcagattgttgcaccaaccgttcggagttctgttggcacaaattgttaaagtgttatttggagtcaaattggcaaatttagggaaaattttttataggcttacaactagggctggtcgggaccgggaattttgacaaaaaccgggaccgggactgaccagaaaagtcgggatcgggaccgggaccaagtttttcgaccgggaccgagaccgggaccgcgagaaaagccgggaccgggaccaaccgggaattttcccaagagaaaattttttgaaaaaattttgaaaatttgagtgcactttgttacgaaaatttcctaaattcaaaaatgtgcccagaagattttaaaattttcttttgggggaggaattcgaagaattttctattattctctgtttcatttcgggggggggggggatctggaatcttggaattttctgggtcccaaaattctggattttttaataaattaaaatttcttaaattttttgcttttaatcgctgtttttgtggcgctgttttccaaaaaaaacttttgggaacattggtgagggggcggcagggtccggcggcgcttatcggcaccgccggaaaatttttgaaattttgagtgaaatatgttaagagaatttgtcaaaaaatgaccaatatttggcacttcaaataagtaaatcagatgttttcccttttttgcataagggctaacagatctgcaaatttctgcaaaatttcaatcattctgacaactacgaactgaataagaaaagccgctttttcaaacttagggaattcctggtctatattttttgacagccctagtacctacctattctaattaatattttaattcaactttgacttttcattcaagaatg

SEQ ID NO: 118105 - DNA, 366 bp, Heterodera glycines
  Promoter: Source sequence=SeqID_28585; Location=370..735; Strand=-; Gene=SeqID_59184
aaaaacatgttttttcagttgttgttaagctagttttcgagttcatagcaactattttctagttttttattttagcacctaaatctaaaatatttttgaaattatttagttcaatactgattttgacctatttagcaactgtaaatataagccctagtcccagcttttgttcgcaaatacaaaaaagaaaaacgaacaaaaacaatgcattcttttcaactataaaaaaatattcaatttgttttcttgtgattttgttttaattaactcttttttttcctttttcatatatatttttgaacaaaaaaggcccactgaacttcaaaagtgccgaaaattgccttaataatttggcacaacaaaatg

SEQ ID NO: 118106 - DNA, 560 bp, Heterodera glycines
  Promoter: Source sequence=SeqID_22534; Location=1723..2282; Strand=-; Gene=SeqID_53200
taattgaaattcttcaaaaaatagacgattttgaaaactattaaaaattgaaagaattaaaagacaattttgagcaaaagaaaggcctcatcaataaagtgcccattcaaaaggagatggttgaattgttgagtcaaatcattaaagtgtacagctgctcaagttcttcaccgatgtgccactataaatgggacttggacttatttgtgaaaaatgtgccgaaatttggccaaattttatccgaaattttgcacaatgcatcgaaatcagtaaaatatgacggaacagctcaattaatggcactgcccgtctcattagtggaacatttgctggttcgactgtacactgtggttcaaatgtgcctaattattaatttatttattcaaatacattattttatttatctgtataattagttaaatgtttaaaaaatttgcccaattaatcaaaggttaaattcatcaatttgtcaaattggcgaaaacgtttactttgtgattacggtagaaaatatcgtatcacaacttcctctggtattttctccacgccgaaagacaatg

SEQ ID NO: 118107 - DNA, 226 bp, Heterodera glycines
  Promoter: Source sequence=SeqID_29870; Location=1270..1495; Strand=-; Gene=SeqID_46181
cttattcttctcataataattcacacatttttaacattccttttgtttgctactaattaagaaaatttaattaaatgaataaaattctactatattaaatttgctttttgttagataatgaaacccttgcagtcgccgttgtttcatcgcctgttaatttatattcaaagtgcatcgaataacttcatccttttttatattaattttccagacagtgcattaaatg

SEQ ID NO: 118108 - DNA, 199 bp, Heterodera glycines
  Promoter: Source sequence=SeqID_36431; Location=676..874; Strand=-; Gene=SeqID_65733
gatcatcttagaattttatttacatgtttagcaatgcgatggcatgcgacgcaatcgcagcgcataatatgggctttgataacacacgggtcaaactgatagtcgatacaatgtattaccataattaagatttattgtcttaaattttaataataaagagattaattaaggattcacaattggcacattatatgagatg

SEQ ID NO: 118109 - DNA, 75 bp, Heterodera glycines
  Promoter: Source sequence=SeqID_21334; Location=685..759; Strand=+; Gene=SeqID_51935
tgtaaagtgaattttcgttttttttcacatttcttaaatttttaggatgatgttgttgtccgacttgaaaaaatg

SEQ ID NO: 118110 - DNA, 79 bp, Heterodera glycines
  Promoter: Source sequence=SeqID_10875; Location=2296..2374; Strand=-; Gene=SeqID_74155
cctaaaaaagtgcacactgaattgaatcgaattccatggcattactgtgcttaatttcctgtccaaaagcagcaaaatg

SEQ ID NO: 118111 - DNA, 110 bp, Heterodera glycines; identical to SEQ ID NO: 98226
  Promoter: Source sequence=SeqID_25524; Location=668..777; Strand=-; Gene=SeqID_56266

SEQ ID NO: 118112 - DNA, 278 bp, Heterodera glycines
  Promoter: Source sequence=SeqID_7068; Location=1171..1448; Strand=-; Gene=SeqID_63730
tcatgatgccctggtttagattttagttttattttgacgatttgtatcgcattttttagaagttttctgtgacatcactcgaccaagtcacaacaatcaccaaacatgttctacggttgacaggaaaaatgaataggcatgtgttgttttttttctgagcattgcttttttctacacaaaatgtttggtcgcttaaaatatggcttttcattccctattcctttctctctctaaactttaatttctttcttattaaaaatcttctaaaaaacaaaatg

SEQ ID NO: 118113 - DNA, 342 bp, Heterodera glycines
  Promoter: Source sequence=SeqID_13862; Location=2530..2871; Strand=-; Gene=SeqID_77808
attttcgtaaaaaaattctttaggatgcgagggttctcagataaacttaaaaagcctgaaagcctcattttgaaagatttagcctcattgacccatcaaaaaaccacaaaatgaggctaaagcctcagatctggctaccctgttattattagagatcggaccggtcggtttttttcggtatttttcgattttcggtttcggtttttaaccgaaaaaaaccgaccgagaaatttttgagtttttcggttttttttcggtttttaaccgaaaccgttcgaccgaccctcttgtccggtctctagttattattgttgtcctaattaaaaataacatgtaaaaatg

SEQ ID NO: 118114 - DNA, 95 bp, Heterodera glycines
  Promoter: Source sequence=SeqID_3359; Location=4107..4201; Strand=+; Gene=SeqID_84357
attatcatccaaatttcctctgctttacaaggttgtacgagccaattgtgctcccacttcgtccactggaacaaaacacctgcgacgtgcttatg

SEQ ID NO: 118115 - DNA, 154 bp, Heterodera glycines
  Promoter: Source sequence=SeqID_27865; Location=658..811; Strand=-; Gene=SeqID_58536
gggaagagagtaggaggatcaagaagaggagggaagagaggaagtgaaaataaaagaagagggggaaaagaagaaaagaaaagagataaaaagtgaagagaatggatggagagggggagggaagaaaagagaagtgacgggaagagaggggatg

SEQ ID NO: 118116 - DNA, 1003 bp, Heterodera glycines
  Promoter: Source sequence=SeqID_20418; Location=431..1433; Strand=+; Gene=SeqID_50953
attattgtgtttaaagatgaaaagaaaaaaatatatttacataaatttaaaacttttgttaaaaattcattttttaaaggaattttgaagtgaaagagaaaacattttttacatttaatatggttttccaaaattttcaattaaggtcgtattttacaaaaacaaacaacaaaaattcttgagcggtgtctttttgagattttgtgaaaatgccttaaaatgaatatacaatatggaaatagtgacaaaaatctaaaacatggaaaggaaaaaaaattcatgaataaagctcaaaatattattttgtgtttaggtcaaagtgtttaaaaaaataggagtcaaaataaatccgatgcctaatcatagaattcattgttttgcctaagattttggttagcgacatttactgctcgccaagcttttctaaccgaagtactatttttttagcctaatatttctcatcattaaaattcattaactttttttggatataaggtggtcaatgaggaagatttgatatttagcgcattttggaaagccatatttgataggacaaaggtgtaccgaagtaaaaaaaaagattgaaaaaaaaacttggaaactaaatccatataaactatttctcagataagcattaaaaattatagaatatcctaatgatctctacggtacagtattgccttaactccattgtggaacaacaatcttgtttaagtggaatatagataattaaaaaaaacggcaaaatgccaaaaaaggtatttaatgcatgaaaatcccgaaaaaggcaaaaaaaaaagaagacataataaaagtcaacgtagaagcctcaaatcaagtggaaaatgcgttatttatgctcaatatatcgaaactagtgcgcagaaaaaaaaaggcaattgcctcaaaatgcggtctctattcattacttaagagaataagctgaatgatcggttaaacgtggaaagcggggttgataagattataaaagaaagaacggatg

SEQ ID NO: 118117 - DNA, 147 bp, Heterodera glycines
  Promoter: Source sequence=SeqID_22611; Location=983..1129; Strand=-; Gene=SeqID_53281
aacaaatcgcacggctgatgataagaacgaattggcctacccaaaactcaaagtaatatttttaacacattttcactacatatatgcataattatttttaagcttcgacaaagagaatattttcggagaactgtaattcccaaaatg

SEQ ID NO: 118118 - DNA, 303 bp, Heterodera glycines
  Promoter: Source sequence=SeqID_12194; Location=1278..1580; Strand=+; Gene=SeqID_75769
gggaaaaattaaaaaaaaatttttttttaattttttggagtggagaaaaatgaaaattggcgcgattccattaaataataattatttaaatagtgatgccatgcaggtatggcacggaattccgacttccaaaaatttttggctttggaattctgactcccgaattttttggggcctcggaatgccatccctgatgccaagtccttgaattcaatgccgtccttgggaattacttgtggaattttaaaaaaatccttttttaacatgggtgtacttgagaagaaatgttccttcccaataatg

SEQ ID NO: 118119 - DNA, 1003 bp, Heterodera glycines
  Promoter: Source sequence=SeqID_24006; Location=939..1941; Strand=-; Gene=SeqID_54707
aatatttgaattgttctgattacttctttgttaccaaacgcggctcataccttattcgaaatcctttattttaaatttttttgggttgattctttaaatttattagaaataaatgaattcttaccaaaaattctaatgcaattgtcgtattcatttttagtttcattaaatttttcttaaatatggagatgtgcaaaaataaattgattaatatattcattttaaatttgagtattattatatcattttttagatttttgtattgttatagcctttattttcattaattttttaaatagttatgtgtccaaatttttgggttgcttttatttattttttatttaaaacattgaattttaatatattaaaccactttgttttattcaaatgctgctacttctttcatatacaagtccaaaacaccacattcaatctagttttattgttgcggaactaatttaggctatttaagacaattataaaaaattatcattcaggtcacaaaaattattgtatatttatgtttatttatctattttgatttgtttactaatatagtcggagtttaataaatggtcagcctattgctagcatggctaacatatttatttatcatatgtgatatttgttttaatatgtacatcctttacttttatatatttttgcgtttcttatagtcttttttaattatggtttaaaattagctctttatttttagaatataatttaatggctattaacaaatataatataaattttaaacaaatttaaataatttataaattttaaaaagatgttataaattgcaatttttgtatatttataataaatgataaggaatttctttttaaaatatgtttacctttatttactaatatctgataaataatcatatcaccgagatggttatgcttaatttacttattttttttcatcgagttttcatttataaaaaaatttaatttcggtttatataataattttggaaaatacgatacgtatg

SEQ ID NO: 118120 - DNA, 144 bp, Heterodera glycines
  misc_feature (55)..(55): n is a, c, g, or t
  Promoter: Source sequence=SeqID_34598; Location=1119..1262; Strand=-; Gene=SeqID_64347
aaaatatcagtaattattttatgattataagtttttttttcaaaaaattcatctnttattagagtattttatgtaattcaaaatatgataattttaatttaatttttaaattggctaatttttcatttattattgcctaaaatg

SEQ ID NO: 118121 - DNA, 158 bp, Heterodera glycines
  misc_feature (15)..(15): n is a, c, g, or t
  Promoter: Source sequence=SeqID_7436; Location=3059..3216; Strand=-; Gene=SeqID_64810
tgtttgctcggattngatggaattattgccttatttgttatattcgtgtccttaatttgggtattcgtacattgccaatatcatttacttttgggttgtactcttctgaagtgttagtcaattttgctttttgttgtgagtctgctaattcggaaatg

SEQ ID NO: 118122 - DNA, 143 bp, Heterodera glycines
  Promoter: Source sequence=SeqID_28832; Location=1..143; Strand=+; Gene=SeqID_59414
tgctgtttgcatatggtaacaaagcaaatattaaatacgctctcaagtaccctttcaaagggccaggacattgttatgtcgagtgcaaagaagagtccggcaataaaattggaattgatgagccggctcaatatgccaagatg

SEQ ID NO: 118123 - DNA, 92 bp, Heterodera glycines
  Promoter: Source sequence=SeqID_16429; Location=1..92; Strand=+; Gene= SeqID_80841
gtaacaattttggtaaaaataaataattttatccttacaaaagtgggttcttccgtactttcacggaattaccgataattttgggcgaaatg

SEQ ID NO: 118124 - DNA, 147 bp, Heterodera glycines
  Promoter: Source sequence=SeqID_1230; Location=418..564; Strand=-; Gene=SeqID_70239
atccatttttacagtttcatcgaccaaaatgtcatcgcttttcttcactgttttcgtccacttttcgccgcctgtcaaatcgatttgcgcatcgaaacgacaagtgatcgcatttcggagtttattctgtgcaacatttggccaatg

SEQ ID NO: 118125 - DNA, 165 bp, Heterodera glycines
  Promoter: Source sequence=SeqID_5793; Location=1159..1323; Strand=-; Gene=SeqID_59245
ggttaaactaccgtggcctatcctactgaatagttcaaaattgattcgaactttttagacaaattcctcacttcatttgtagggacatcgacagtgaattcgtcgccctgcaaaatgccgagcagcggacggaccaatgggtcgaattttcatctgccaaaaatg

SEQ ID NO: 118126 - DNA, 380 bp, Heterodera glycines
  Promoter: Source sequence=SeqID_20630; Location=1521..1900; Strand=-; Gene=SeqID_51182
gtaaattttcaccaaaatttacttatggcataaacatttattttggataactccgctgtgtgccaaaaattgtaaaatctcttcaaagttttgggaaaaaagccatctcaaatttatatcgtccaatgttggaaaagcgatgaacggcagattgttggaatcattaatagaataccttgaaactttaaccatttgctaaaatgaatttaaaaaattatcatttataaaataaaattacatgaaaaaaaagtgaaaaaattttcaaaaaggacaactttttaactagcgccgacattactatgtcctagaaaaaactgtttgttgccattttagaagaaaagaacttagcagaagcacgtgccaagtttgaaaaaatcatg

SEQ ID NO: 118127 - DNA, 388 bp, Heterodera glycines
  Promoter: Source sequence=SeqID_17659; Location=1..388; Strand=+; Gene=SeqID_82187
tctaataatgactaaacttttttatttttaaaattacccacacctttttttgttttcaccgattttaaaatattgactccttttactcgtttttcaatggtttatcaatttcctgattgttgaggctgcgggcaccaagggcaccggaaggcagagtgcccgaatgcgccctgcgttagctgcaaaatggtttaagcaaatttaaaaaaatagtaaaatttttcatcaactgcttgagaattttgttctgaggagagctgctgagactgccgttagtgaccggagggtccagactgcagtgcgggaacagttttgtgttttttgtatttagtttttttaacatttagcttttagtttctagtgcaaaatattaatttttattagaatg

SEQ ID NO: 118128 - DNA, 172 bp, Heterodera glycines
  Promoter: Source sequence=SeqID_24996; Location=1..172; Strand=+; Gene=SeqID_55732
caattaatcatttcttctgcggctgatcaccgtttttgatgttttgtccgtcactcattgtcagaacacgaacaaaaatgtcccaaatcggctggtgaatccataaatgtaaatcagtgcctgtttggtcgaaaatttggtgatttgaacgaagaaaatccaagtcgaaatg

SEQ ID NO: 118129 - DNA, 740 bp, Heterodera glycines
  Promoter: Source sequence=SeqID_11; Location=7775..8514; Strand=-; Gene=SeqID_69058
agagagagagagagtgttaagagaaggataacagaaagattgattgatgaattgattttaattacatgtcaatgacggataattctttttttttcattgattattactgttgtaacaaatttttagccataaaattatgctaaacattcaaaactgcaccgttactttcaaaataataaggcgacgcctgagcaaagacgaatttttaaaaattgctcgtaatggagcaaatgttgaattgaacacacgccgttttcactcaataattatgcggcttcgctacgctgggagaacagttgcgtgccttatttttcaatcaggacgagttgttttgactggtgtaaggaaaccaagttttgcaaagatagttgcccaccgtgtccttcgacgtatacaacatgcttataatcatgctaccaacaaagcagaaaaattttctttgataaatttgcgagtggtcaacattgtatgttctcacacattcccacaccgaatacccattgttcacctgttgcctgtcctgtacactcgtaaagaatttttttctgtccgttatgacccaacaatattcccagcacttcgatgcaaactctcactgactgataatgatgttcatgcaacttgtattgtttatcattctggcaaagcaattatcactggactcgcctctgttgagcatataaataaggccttttcactattgtcttcattcatcactgataacattgaataaaaaaatg

SEQ ID NO: 118130 - DNA, 264 bp, Heterodera glycines
  Promoter: Source sequence=SeqID_13260; Location=553..816; Strand=+; Gene=SeqID_77089
ggtgagcgagccattttggtacttttaggtcgtgcactacattccccggatttttacaatttttttatatgtatttttcttataaaaataatttataaaattttctacgaaggcaattgactatctaataaaaccaatggggggggggctcaatttttgcttctcggtgaaagctttattagagggggagctgtacattagacattagtagaaatactttattttactaaattattttgcaaatgtaaggtccttacacggatg

SEQ ID NO: 118131 - DNA, 823 bp, Heterodera glycines
  Promoter: Source sequence=SeqID_1830; Location=1109..1931; Strand=-; Gene=SeqID_76216
tggatccacatgtattacaatttaaaaaaagctttaactataatttaaaaaagtgttaatcgatctcagtgtcatttttccaataccaccaccacttttctgcttttatggacatatatatatatatatatatatttcacaatagactttctttcatttcacatgtgaatatttatttgccaactcactttattattttttgcttgtggatggatttttccaatttaattattaattccctttttcaaataaatgatatatttttactttttatattatttaaagatttatattgtatttttattacttagtttttttttgagtcttagtgttttgttttgattttttggggttttttaaaattatttttctttttttgggtgttctctaaattctgttacaatagtaacatttttatttaataaatcatatcaaatttacgaataaaatttttttaaattattttcaatggttgttcccgaatatattctcgaactttgtacaatcttaataaatgttgactatgccataaaaaatcaaaccattaatctcgggaaattcttttttatttcaatgctaatttagaaaaaaacaaaaattcaagcaaacaatgaatgtgatcgcctttcatcagaaattcccgtttcggatttctccttttcatttttcttttaaaatgtttttttgtcactacaaaaaatggtaagaaaaattgtaaaacatttacataaattttataatattttttcttaaaataccaagtttttttcattaggttttgttaaatttagcagctgcgttaaacggcaatatagaaataatg

SEQ ID NO: 118132 - DNA, 895 bp, Heterodera glycines
  Promoter: Source sequence=SeqID_10447; Location=537..1431; Strand=-; Gene=SeqID_73652
tcgctttttgggggtatattcttctaaatttcaaaaaaagtcgatccttatttgttagaggtatattttcgccttttttttgcatttgtcttgtgaaaatttgccaaaattggcaggcaaaatatgtacaaaaaacgaaaaaatggcgaaatatggatttattcccgaaaacccccaacaatatagatttatatggattaaaaaccttcactaaatcgaaaaactttaacgtactaatgctttttttgagcccctttctttatagcatatgagcagaaaaaatatgttaatccatataatttataaccctatttattatttattgtttttttaaacttaaatttaattttttttttaatctcagttgctaagagctgatcaaaaaggaaaaaagaagttatagaagagaatccaagaagatgtcgcaatttttattattccgtgatgacgaattttgcaatggccagtagacatatttgatgtttttacatatgtatatttttatgggatagctttatatttttttggtgtataaaatagcgtaaaatttttgcctatatattttcgaaaaatgttttttttcacataatttttatgttttcaatatttcaatcgtaagcattgttgaaagcatataaagggttaaaatgcgcgaccggaagggatcgggatgccgcgagatcagattaatattgaattcagggtccagaacctcgggatctgtcccaagcttttttttcttcattcatcgggattgatcgggaccaggattgaaatgtaatcctgattcggagtctctccgactccagagcccggtctctagttaaaatacccaatttatttaattttgtttagtaccaaaaataaaaaagatttatagacaaatcgaataatg

SEQ ID NO: 118133 - DNA, 943 bp, Heterodera glycines
  Promoter: Source sequence=SeqID_12897; Location=3102..4044; Strand=-; Gene=SeqID_76631
aaaaacaaagaaatttaatttataaaacatttttttaattaaaataaaaatatataatgatgaaggtaaaaataaaggcgctgaatatttttatacaaaaacccaactaggtaaaattttatataaatttaatataaataaaacctttaaattcatgattttatgagttaatttaaatttaattatttaataaattaaaaaattctttcaaaattttttaagcaattttttgcattaacaaaatatttaaatttctacatcaactttatttattttaatgattttcaacagctaattcctaaacaaagaacgccaacaaagccaattggcctctcctttattaatggcaccaaaattcattcaattttcccattacacaatgccgtgggtttgtgcgtttccaaggagccgccctcacattcgatggcatattttggccgcctgtgtgtatttaggtgtgccgccgacacattatgtctccaattgctttaataaatgaaaatgataattcacttcaaattttgtggaatcagagagaagatttcttacttaattttattacaacaaaaaatttttttataattaaaaagatagtttttaatattcttatctaattttatgatcaaagattaaaatattattattttttcaatattttaaaaatgatttaggttattttattcgatgaaaataggctcaatttttgcccgaatttggggcaatgacaattctggggacagcgcagctggggctgacccggacgaccgttggtccaaccaatacaggtaaaaaaatatgataaattaatgttacaattagtctggaaattaaccgccttcatgtacaatagtgattattagcgtattcccttataataatgattaccataattcgcttacaacagtgtgattaccataacagggaacgtgagaagaccagcatg

SEQ ID NO: 118134 - DNA, 276 bp, Heterodera glycines
  Promoter: Source sequence=SeqID_18701; Location=1527..1802; Strand=-; Gene=SeqID_83375
ttatatttttttgccgaaatgtgtgcaaatgtccttcccctaatgtcccactgccaaatgctatattatcaaattacgctaatagcctaatgcatattctaataaatgcgttttataattttccttaagcatgaggctatttcaatatagaaatgtgcgtgtgccacgtttactgacgacgtaatgggtggacctgaatatgcataaatttagcatttcatttctttataaatttaatatttatttaattatttctgcaaaattatttattcaatg

SEQ ID NO: 118135 - DNA, 761 bp, Heterodera glycines
  Promoter: Source sequence=SeqID_17204; Location=966..1726; Strand=-; Gene=SeqID_81672
ttttgcgccgtttccattgccttttctgtgcacacagagggaaaagtgggtggggtaaggatttaaaatttcaaaaatttatcagggcgtgtcaggatcagtcagctggagataactcaactgctgatgggacaactcagctttacgagaatttaaaaaaattataaaaattgaaaaaaaaataaataataatttaaacaaattaattaaactaaaagtttttaaatttaagtttagataatgttaaattttttaaaatttaacagttgtctttcgggtgtcatgataacttgtacacaaactcgtataaaggcaacttgtacaatagcttaggctcggcctaagctttaggctaggcctaggcttaggctttatttaaaaaaaaaattattgtacggctgagttgtccatcttgacccatatcagctgagttgtcctcggttaactagtccagaagcctgttagggttttaaaatgggctaggaaaaactagatttagcgtggggcatcttttgccaaaaacatttgtatggcccaacaaaaacagcgccttgaactctgtttgtccaatccaatgataatcctcagtttcttaggcaataactaaaaaaacaaaacaaaaaaaaaggacgtgccgatttacatggccggacggattctttcgcaaaaatttcgttgaccccccgcccctcccctttttcataaaaaaccgaaaaacatatcttaaaaaatcaaaaagatgagtattttttattcagatg

SEQ ID NO: 118136 - DNA, 323 bp, Heterodera glycines
  Promoter: Source sequence=SeqID_3735; Location=2601..2923; Strand=-; Gene=SeqID_51668
tcgcgtggtcgctttctgccagctccgttttacgggcactgttgttgacaaacaaatagtgggcgaaaacccaatggaggcatttgtggattggctcgtctacaaactgccaaagaaatacgaaacttatgcctattcacaatttggtggtcgcttcgacaacgtggcacggatgtaagaaatgttgcccaaatgacaacatggtgcttcccaatggaaaaacggcgggacaagtgcgggagcgagacggcaagaggatggagtacatcagaagatattgcaatcgcgtggatgtgtactgggaatgctgaattacggaaatg

SEQ ID NO: 118137 - DNA, 172 bp, Heterodera glycines
  Promoter: Source sequence=SeqID_5950; Location=313..484; Strand=+; Gene=SeqID_59778
agctgctgtattgcgatacaggtgggcaggaataaaaagaaaataaaaaccaaaaatttagattctctagcttttgctcatcggaaggggcggtgtccgttgaaggaggggaaatttttggggtagaacattatttttgaaaattttctataaacatttgtttagtgagatg

SEQ ID NO: 118138 - DNA, 188 bp, Heterodera glycines
  Promoter: Source sequence=SeqID_36532; Location=95..282; Strand=+; Gene=SeqID_65819
tttctcattggatgtgtgtcatttttacccaactcactcagttttaattcgaactttttgcttttgagggccttcctttgcctcgttcttaccacgtttttctcaacacggcttttaaattggcaaactttcgctcgtccgtggcttttgccgtcgttctcaaccgcgcattggcacttggccaaatg

SEQ ID NO: 118139 - DNA, 124 bp, Heterodera glycines
  Promoter: Source sequence=SeqID_21469; Location=623..746; Strand=+; Gene=SeqID_52079
tttcctctcgcgcttcagctccgcctttgacggaaatgaacgcttttacaagttcagctgcgccaaattccacgggggatggacggcggcgattttagaggaaaaatgcgaagcgacggaaatg

SEQ ID NO: 118140 - DNA, 55 bp, Heterodera glycines
  Promoter: Source sequence=SeqID_600; Location=2728..2782; Strand=-; Gene=SeqID_46000
ggtatttaaattcatttaaaagttttaattgactctctaagggatgaacaaaatg

SEQ ID NO: 118141 - DNA, 606 bp, Heterodera glycines
  Promoter: Source sequence=SeqID_14580; Location=852..1457; Strand=+; Gene=SeqID_78653
tttcagtacagaaaattaatttaaataattaaattaaattcatttataattgaataacaatcttttaataataaatatatttgtctctattttagtatacacgacccttcaaaaaaacgagaccatcaaataatttgacaaatttaatgcaatccaacttttttacaagcatctaaattaagcatacatggtatcatttgatagccctaagtgtcctctattttcctgtaaaatttcaaacgatttggttgagcttcaaagaagttgtagccaaaaatatttaaggaattttaagcgcagcttgggtcgtttatttaaggatgaaatcacagcctaatttaagaataattttagttttttttttaataattaaagtgccaaaactttccggtgcccaatctttccactgtgaatccttaaatgtcgcccattgtcttgcaccagtttttttgtaaatatttttggtcccactgatttaaatttatataatttagagcacatttaattctctataacgaacctaattattaacttttaatggagcatggatatttcggcacgttgttcttaataccaatataatgcctgtttttagttaaactcatg

SEQ ID NO: 118142 - DNA, 223 bp, Heterodera glycines
  Promoter: Source sequence=SeqID_4722; Location=1502..1724; Strand=-; Gene=SeqID_55524
ttattaccaaaaaagcaataagaaacatcttttgctttactctcgtcacttaaaacgaaaaacccaaaaattcttataaatatatttaatatttattgtcggtccattttggaatttggttctccggtttttaatccatatatgaaaaaagacatcgatgctcttgaaaatgttcaaaaaacatttttacgtattgtttttagacgtaataataataaggatg

SEQ ID NO: 118143 - DNA, 154 bp, Heterodera glycines
  Promoter: Source sequence=SeqID_19999; Location=1790..1943; Strand=-; Gene=SeqID_84775
attgcccggattcccggtcacccaatggaattcgttgccaccctcaacaaccgcaacagcgacaacggcaccacatgaccaccagcaacaacaacagcagcaggcaaatgttggggacggtgttggcggcgaccaactgcagcagcaacaaatg

SEQ ID NO: 118144 - DNA, 331 bp, Heterodera glycines
  Promoter: Source sequence=SeqID_34845; Location=422..752; Strand=-; Gene=SeqID_64542
ttttggtgaccttgaacgggcgcttcgcgcccattttttaaatccgttgaactcatacgggcgcttcgcgcctgttttttagcttgttaggccgcttcgcggcatcagtcgggcgcttcgccggtttttcaatttttgttggccttggacgggcgcttcgcgcccgttcttcaatttttgttgaccttgaacgggcgcttcgcgcccattttttaaattcgttgaactcatacgggcgcttcgcgcccgttttttagcttgttaggccgcttcgcggccttggacgggcgcttagcgcccgttatttaaattttgaggtacaaaagtgatg

SEQ ID NO: 118145 - DNA, 301 bp, Heterodera glycines
  Promoter: Source sequence=SeqID_2052; Location=1198..1498; Strand=+; Gene=SeqID_77525
aggacaatcggacagaggtggacaatcggacagtggacaatccgacagtcaaatatacaaatagataagaaaatgccggtcgccgaaagggaccgattttgccatatcaagaaaaaaaaggaaaataggcaaataaattaattattttttgcgaatgacctagaaaatgtaaatgatgtgaaaatgcgatgataaaaatgtttgccaaattacttgcaagtaaaaatgaccattctcgtgcactgcacaaattaacacttccttttccttcgaaaattttcatttattccctcaaaaaatg

SEQ ID NO: 118146 - DNA, 687 bp, Heterodera glycines
  Promoter: Source sequence=SeqID_17445; Location=1..687; Strand=+; Gene=SeqID_81930
caattaattattatgggagcgaaaaaagtggtaaataaaataaataaataatgacacgggtgtaaacacatttaaatcggcagcggttcaaattttccggcaaaagtaaatacaatggaacaaaaaatgtaaattatttaaaccagtttaaacaaataaaatcatcggcgtctgtaaagtaaatgaattaaaccaatggtacgaatgtttaaaatcagtggcggttcaaagtaaaatctttaaaccagtagcggctcaatacttttccggcaaataacaagttaaaccattagtgtgagtaccttcaaaccagtgacggctcaatccttttcctgcaaaagcgtaatgttttccggaaagtaaatacatttaaacaggtaatggattcaacccgttttccggcaaagtaaatacatttacaccggttatgttgtcatccttttccggcaacagtaagtacagttcaacttacaaattagtgtaaatacatttaaccagcggacgttcggaataatttaaatttaaacttacgtcaatctttggcgttttatttcatttgccgctttttgattttttgattttaaaaaaacaaagatttaaaaaatgaaatcttttttactaaaatgcattaaaattcatttaggcatctatcaattcttctccaggagtctatttctttttttgatg

SEQ ID NO: 118147 - DNA, 645 bp, Heterodera glycines
  Promoter: Source sequence=SeqID_8874; Location=1..645; Strand=+; Gene= SeqID_69487
gctttattttgttgaataaaaattccatttaaagttttggaagcgtgttataaaaaatgtccttatttttgaccctaaaatcttatttttgaccagcgatgtccttatttcgggaaattttcaagggtaaccctgtttttaggtcattatttgcctcaaattaattatgcccttccacaaaaaactgcccaaatgtgcaaatactggcaatagtgtcagaagagtgcaatgttttgttgttcctctttcttcacaccatcccaaaaaacgagatgtgtaccaataaatagagaatgccagagaaaaacattatctttttttctctaattttttgtctccttttggcgtactatctaatattttcattattagcaaaaacaacatttatttcgccacatataactttttttctactcatacaatttacaccaaattttgaatatcgatagagaaaaaaattctgcatcgatttctatgtttatttttatagcttaaatgttgttttaaaaagttataagataaaaaagataaattattactgtttttaaagattttatggctaaaagaattttattacggaagcgacagaccaaaaatgcacgccaaactcgtgagaacaagcgagaggagcgacgaaccaaaatg

SEQ ID NO: 118148 - DNA, 1003 bp, Heterodera glycines
  Promoter: Source sequence=SeqID_3531; Location=5..1007; Strand=+; Gene=SeqID_47637
tttgggacggaaggggacgaaattggtcggtttgatcgaaagtgaaaagcaatcggagacaaaaaccaatcacaaaattgaataataaaataattcaaagggatcgattctcatgaaattgccccaaagtgaaggaattctttggatttggttcgaattcgcagtcttctgaagaagaagtgcaaagtcaaaagccaccaaatgactgaacaaaaggaccgaaactttctttgctctcccaaaatgaaccaaagaatcaaaggaatggggggaatcaacaaaaagtgacgaaatctgtgcccattttccagaagtcgccttctcgtgagaaacgggggagcaaagccaaggcaatgctccgctcggcattcattttgctcataaaaaccctttgaatgttagaaaaacagactttccaccgtttgtctgaattttgaaaaactacgaatgaaaaatggagggggagggatttgtcaatgaatgaaataatcactctttgaatgctaactgatcggaagaaggaaagacctgctggtgggggttggatggacttggagaaggcggaggaattgtgagaccatcgcaatccaacagttaattttaagcatcgtgagattaatccgtattgaaaagcggacagtttcccctggtccttgccaaatggtccctcacccctccccttggtacagattcatttttaacttgaccacttttacattggtgccgtagagattggcaacaaacatattcagccgatgttcttttaaagctaaatcacagtgtaaaaaactattagttctcaagatctaacatacccaaacagaactattttcgttgcctttattaaataattgctgcgataccgtacttcttgttttctcggatgaaaaatctcgagtttttagagttgacttatttcaccctttgttcattcatcattaaatactttgataatttcacttttaaatattaattcaaagacattgcagcattttctttgatg

SEQ ID NO: 118149 - DNA, 518 bp, Heterodera glycines
  Promoter: Source sequence=SeqID_26163; Location=1..518; Strand=+; Gene=SeqID_56914
tgaattttttagcgtagcaacagtagacgttttggtttttttttcatattttgtagatttttaatcatatttttttgttcaattttaataaatttatgtaaatgcaaaaaattaattaaaacaaaaagtatatattgaaatataaaaaataaacattcggttaaatggcaataaaaatttttcttttaagaaattaattaaatcggattcattgcgaggaatagcattacaatctaaacaaagcaaaacatgttggaagaagccggatgccattgaattggttcgccaattttcattccataatattgtcgaaagaaattttataattgccaaaatgttggagagttggcaaaacaacggaatgccatccatggaacagtctttctttatcaaggcatatttcaagcaaatttccataaaaatttctgaaatattattaattgttggcggtagattggaacatcccgaaatgaatattttcgcaaattacggatttaaaatgcaaaaatggcagaatg

SEQ ID NO: 118150 - DNA, 173 bp, Heterodera glycines
  Promoter: Source sequence=SeqID_11956; Location=2103..2275; Strand=-; Gene=SeqID_75477
cctgaaaattcgaacaaaaagtcgtccatttcgactaataaagccctgacccgaattcgaatgaaaagtcgtccatttcgactaattcaaaagtcccgaattcgaatgagagtcggtgaaattcaaattttcccccattttcagcgattgttgacctttcgcattggatgatg

SEQ ID NO: 118151 - DNA, 99 bp, Heterodera glycines
  Promoter: Source sequence=SeqID_31873; Location=87..185; Strand=+; Gene=SeqID_62182
ggtggccaacatcaattagcgaatattttggcttaattaattgagtcaatcgccaaatttgaggcccaacaaaatgccgaacttgccaatgccgagatg

SEQ ID NO: 118152 - DNA, 564 bp, Heterodera glycines
  Promoter: Source sequence=SeqID_4781; Location=1024..1587; Strand=-; Gene=SeqID_55686
aggcgttttgagaatgattgctaattggtttcattgtttggataaaattgttattgagtaaaaattgggcaaaaataaatttccatacaaaaatattttgctcatttggctgtaaatgaatttcataaaatttaacggacggggggaaattttgaaaagcaatttttctggggctaaaaaagtgcgctgatcacgaatctgaactcagattttgaaaatcattgatttttatctatgatttttcatggactacttgatttttttccaacattttaagaaaattagtcgggcgtaaaactcatacacagatgttgtagagcctaaaaagagctttcgaacgagctattgaatgtatgtagaagtcgaatttccagccaatttggaatgcttttgccagtggaatttggcccattttcgcgccaaacattcgccatttttattttacttatggccatgctcttgacaatttgcgtcgccacatttcgccaacaattctctacagtctcaaccaattgatttcaatccgatcagataatttgttgcccgcgtctattgctgatgatg

SEQ ID NO: 118153 - DNA, 1003 bp, Heterodera glycines
  Promoter: Source sequence=SeqID_13107; Location=518..1520; Strand=-; Gene=SeqID_76901
tttacggcccgtatttatatgcaataactatatttatttaaaaaacactaattgtaagcactacaatccattaaacattcatttaataaaacacccataacgaaaagagttcgattcaattttaatgggaaatgatgcaaattaatcgtttttggtggtctttatgggatgaatgagagaataaatgttgagaaaataaatatgaaaccggaagtaaaaatgaaattaaattttattatatttataaatcaaagaattatttccaaaaatttaattgtattattaaaaagtttggctgattagataagctgaaaagagaagtaaataataaaatgtgcttttaaaaaatgtgaattttgatttggtattttttggagaaaaatcaatttggaacataaataaaaagcgatttttgatttttgaagattttttcatttaggtcatttcccattaaaatgattgaattcattacgagccgtacacttaatgctaattacaataaataagtatatttaatatgcaaatgcaactacctaattgttctgctgtttacacataagcaaaacaaacacagaccattcatattcattcattcattcattcgtccgtcgtcacaaatttcattttgttgcttatccgctttcccaaaaaggaaatttcaactggaagagcactctctcttgagctgaagaagcatcgcatttgcccatttttacagccattcaaatttcggcgctttgaaatgtttgcgctttatcttccgctgcgcttttgtgctgtagaaatacacaaatggatcagcttttatctcacatatatctcacatatctacaaaggctgtacttgcatttttttaatttaaatttaagtaatttatttatcattaaaacattctttaatccaatgtttttcttttttccataattatgtttatattttccaattattgttttatcttattttggcattctcttaattaattaatctcttctcttcaattatg

SEQ ID NO: 118154 - DNA, 260 bp, Heterodera glycines
  Promoter: Source sequence=SeqID_12959; Location=1305..1564; Strand=-; Gene=SeqID_76717
tctttccaagttgcgccaaataactttgtattttctaatcaaatttttgagaattttttaaaattttctagtataataaagaccgaataaataacaaaattattatttttttaaattttatcttcatcttccaaccaaatttgggatttttccaattaaatttttgagaattttcacaaaattttccagcaaaacacttttccattccatcccaatcacttctaattgatcaaaaaatataatttaaacaatcaaaaatg

SEQ ID NO: 118155 - DNA, 531 bp, Heterodera glycines
  Promoter: Source sequence=SeqID_1767; Location=2140..2670; Strand=-; Gene=SeqID_75833
tcttgaataaaggattgttaacaacaccgctaccaatttgggaatgttaatggacccgcctggaccctcagtattcaggagtttttatggcatctattttggcctatttcgaattccggacccgaattcaaacaaaagtcgaaaattagaatttttcataaatcacttttatgtacgaatctgtgcgactttttttcgagttttggtccgggtttcgagatagggcaaaataaaagtcgaatacatgaccttgtgatttgtatggctcggagaaatatggatataaaatcgtaaaatatggaccaaaaattacaaaatatggacataaaatggccacaatacggacaaaaatggtattaaaaatcattttagaagaaaaaaacatgataatgctatgatttattcattttaacgaaaatcaacccgaaaagcgaaattttagcttttttgcttatttttaaaataaatttatcaatttttaagaaaatttaagtttattcaatattctccagaaaattttgcgataaaatg

SEQ ID NO: 118156 - DNA, 238 bp, Heterodera glycines
  Promoter: Source sequence=SeqID_17177; Location=436..673; Strand=-; Gene=SeqID_81618
tctttttattttctttttcagcttccaactccgttgctgttcctactccgctttaaggcattcggcaggtgattcattcatcacagtgccatttgtcctttttttgccatttgtcctttatttcatttgccattgtccgttttctttcccatgctaataatccctttctttttcttgccaagaccgtggcgttgccattgtaaaagccggtcaaattgtgtacggtggtgaagtgatg

SEQ ID NO: 118157 - DNA, 180 bp, Heterodera glycines
  Promoter: Source sequence=SeqID_7855; Location=2194..2373; Strand=-; Gene=SeqID_66168
atttttgtttgtctgtttcaaaaagagtctctgttacgatgccatcccatggccactcgattccttcgcttgttcacgcattagtgctctcagcttatgccaagtgcttttccttttttgtccgtgcgacgccatgcgccgtcttcccaccattttaaggccaaaaaagtcggcgaaatg

SEQ ID NO: 118158 - DNA, 586 bp, Heterodera glycines
  Promoter: Source sequence=SeqID_41263; Location=251..836; Strand=+; Gene=SeqID_69433
aaatttaaaaaatttgttaatatacaaatttaaaaaatatatttataaaacttgataatcaaattcagacactgccttgaagagttttatctaacgaaacgaacagaaaaatcgcatttcaaatttggtaaaaaaaaacgaatccgggccctgttaatttccatttttatttttcctggcgtaatttaattaaaaattagtttattttttcttttaataaaatccattaactcctgctgaaagcaaatgcaaataaatatccgagttttgatccatcaattactttaatagtaataatctcttttgactggttctatttttcagttgcgtcccccccccccccctattttatttttccattgtttcgctttatttcgtcactcttttgtccattttattgcatttatctttaaaaatatgaatattttatttcattttcaattcaatttaattttttaattaattaattaatttccttttaaaattgttaagcaaatgttattgaggctgttgtgactgactgttttttgttaacaaaagtgcaatttactacacactttagccacatttatttcttgttatgatg

SEQ ID NO: 118159 - DNA, 167 bp, Heterodera glycines
  Promoter: Source sequence=SeqID_7337; Location=3206..3372; Strand=-; Gene=SeqID_64502
ttcaccacaactaacggcaatacgactatcaccgcgctcccctagacacggcactttccattggatcgtttgaggagcctttcgaattttattggagtggcgacgaggcgggcagtgaagtgattccgttgagcattgccaacctgcaacagaatgaacaaacgatg

SEQ ID NO: 118160 - DNA, 128 bp, Heterodera glycines
  Promoter: Source sequence=SeqID_1326; Location=6945..7072; Strand=-; Gene=SeqID_46807
catcgtcaaaggttttcgagattttgccgagtaatccactcaccgacactccttatcattttaaaatacactcgagccaaaactacattgacctgtcaaagtgttaccttttgaccgaatttcgaatg

SEQ ID NO: 118161 - DNA, 671 bp, Heterodera glycines
  Promoter: Source sequence=SeqID_6549; Location=1653..2323; Strand=-; Gene=SeqID_61976
cacaacaaaaaataaaaaattttgattgttttaagcaaagttataccatgctttgtcgaaaaagagctaaatgacgaattttacgaaaagaccaagcacgcaaaaaatgattcattttgaaacgatttttataatttaggccccattttacatgaaaacttaaatattaagaagcttgcataaattttgccaaattacattcaattaaaataaaaataaaatattattttttctcgtgtccagacatttgcgccccggacatttgcgccccagacatttgcgcctatgtctaaaatcgggttcaaacttaatatttcaatccctgatattctaaataaccttaaataaatgatagcaattgattgtgtctaataattggaacttcagaaaatttttgaaaaatcgttaattattcaaataacatttaatgcttaattattcaaataacataattaatgctcataataaattaaattactatgttagggatcgaaaaaatttggtttgaacccgattttagacatagccgcaatgtctggggccaaatgcctgaggcgcaaatgcggggtaaccttttttcttgcgcattaattactttgaaattttttttattttcctgcaccacccccaaaataaatttacccagtattagcgaacagtatgaacgcatg

SEQ ID NO: 118162 - DNA, 129 bp, Heterodera glycines
  Promoter: Source sequence=SeqID_15089; Location=1814..1942; Strand=-; Gene=SeqID_79264
tatttaacccaaaaccaagcgcagcaacagcaaacccaactcgtggcacatccccgagtgcttttcctggacgaagattggccagtcgaaaaggaattggacgtcaaaatatgttccgaaactgaaatg

SEQ ID NO: 118163 - DNA, 322 bp, Heterodera glycines
  Promoter: Source sequence=SeqID_5950; Location=826..1147; Strand=+; Gene=SeqID_59779
ataatttttttggataattttgtctcatgtttataacatttaatattttaaattaatcaaatttgtttcattttttagaatgtcaaagaaaaatttccaagaaacttcaaaagaaatccgccgctcgaaaaatacaaaaaattatttcaaaaacagtcctaatttggaaaaatgtttcgaagaagtggagagtcacataaaggaaaataaaaaatttgggataaaagagcacgtgacaactttctattttaaatgccccgaaaatgaagatcccgaaaaaatgtttaaaaaaatcctgaaaaaattaatgggggatgcaatg

SEQ ID NO: 118164 - DNA, 1003 bp, Heterodera glycines
  Promoter: Source sequence=SeqID_27314; Location=84..1086; Strand=+; Gene=SeqID_57993
gaagccgaagagggagaggaagaggaagagaatggcattggcaaatgggggacggaggaagagaagggcgagagagagttcatgggcaaagagtaagagggagggagggaagagacggcacggcgaaggacggagacaaatggacgaaaacggacgaaatgccaaaaccaacagaatgaaaccaaaacaaaaaaaattttgtttgtcagcggaaattgaggaaaagcaaaaattaaaaaggaaaagcaatcaaagcagaaaaaggcaaataaaacaacggacgaacggaatcggtgaagcaaaaagggaaattaataataatggccaaggcaaaagcaaaaggcaaaatttgggaaaggaataaattggcaaaagggaggacaaaaaacattcaatcatttggaaattcaaattgacgaaagggttaaataaacaaagctttgtcggacatcattttaacagcaaaagcgacggatgggaggacaaagagagaaacatttggcaaatgaaaagggggaaaggggagaagggaattcacttaggaagaatggatgttcttccggaaatgccctcacttttgggccattggcattttctgagggcgaataaaataagtgccaataaaaagggagaaaagcaaaacgaaaagcgccaattgatgccgttttgccgcacgttttgtgccgtgccgttttttcccgctgtgtgttcgcaaatcggcgcccttttcctttttccattgtccgctctttttggcctacttttttttttaattttccattttttattcatttaaaaatctctctccaaaagtacaaagcacataatttttctttttgccttttgttacgccaaccatcagaagagagtgtccggtctgttcttgatgtgctgttggagttgcggaagtgaaaacaccgctaaaaaagcacagaaaataaacaaagtaaacaatggcactttctatgcccgattaatgaaattgttgccccaattaaaaatg

SEQ ID NO: 118165 - DNA, 51 bp, Heterodera glycines
  Promoter: Source sequence=SeqID_122; Location=5013..5063; Strand=-; Gene=SeqID_72911
tattcaacacattttcacgaaataattggaggtatgtgtcgcatcggcatg

SEQ ID NO: 118166 - DNA, 61 bp, Heterodera glycines
  Promoter: Source sequence=SeqID_5608; Location=753..813; Strand=-; Gene=SeqID_58630
agagtccgagaatcgcgcttcacgctttcaattacgtgaacaactcatcctatactgtatg

SEQ ID NO: 118167 - DNA, 114 bp, Heterodera glycines
  Promoter: Source sequence=SeqID_35160; Location=1..114; Strand=+; Gene=SeqID_64784
aattattatgtttttgaatatattataccttttattaataatggatgttgttcgcgtttccgggatgtcaatccaaagaatcataaaatttcttcacttttttatcttcagatg

SEQ ID NO: 118168 - DNA, 527 bp, Heterodera glycines
  Promoter: Source sequence=SeqID_7517; Location=1343..1869; Strand=+; Gene=SeqID_65091
ttaattaattgactctcttttcatggtcactcttcgtttcgccttcggcgatgccacaccgtcgggcgggggaggcaatgaatgatttgggagtggcacggacagtcaccggcggcgcacgtgtggcgcgaccagcagcagaccaccaaacgatgcgccgggcgttggtcgtcgtcccccgcggcgtgggcgaccggcggcagcaaaaggcaaatcgaaagggtggggcgacccgtcgccgcccggtgggcacgcctttcggcgcgttgccttgctataaaagcggggcattcattaagcgaagccacacacagtgcacaccaccaaaacagccaaaacaacaaccgtgggtggttcaacagcagcagaggaaacccaatgaaagcgaaaacaaaaacgctctctctctcattaggaccaattagcaaaatttaattagagagggaaaggattttctgattaagcattttcaatttctaaatcccgctttgaaattataattttgctttttgttccttcagaaaatg

SEQ ID NO: 118169 - DNA, 926 bp, Heterodera glycines
  Promoter: Source sequence=SeqID_7194; Location=66..991; Strand=+; Gene=SeqID_64105
tttgttgtgttgcggcataaggataggcatcggatgagcacgatttctgtggtttttggatatcaaaaatgaatccaccaatctaattttttgtataaattagggaatgttattgttatattgggtgttaattgtctctcatagtagcgtcagagaagttgttgaaattaagaggacagacaattaaagggtgaccgaaaatttggttaacaccccatgccaattactgagcttaccaataaatttaattcacggaatattaaaaattgcaaacaaaattaataataatacagaggacaatgtgacaatgtttacagtaagcggtgcaataaatcatttaatagtcctaccgtattccgtgacgaattcattgcaaaaaatgtgtgtgccaagcaaaaaatggtggccgacaaaagcaacgaaacagggccaacaaaagtgtaaatgccgaagaggtccaaattgagccagcaaaaatccgacaaaggctggggctgggatggcacaattttatgcaaattttgcataaaaatggtaacgacaataagcagcagagggaaccctgtgggaattttaaaaaaattaatttaatttaaattaatttaaaaaatctattaatgtccttgcttaaggacttttaaaaattaaaaaggaatattatttgtttaaatttatttcataaagtttgtagcgacagcattaaaaaaatatatttaaattaataaaaatttaaagttttattttctaaataattataaattaaaaatatatttgtgtatgtttaaaatgattgttttaaattcattatgaataacataaaattaataatttacaaatttatgccagaataaaaatattaaagcagaattataatattgtataattaccgtatccaaagaggtacagactgatgtgtttgagcaatg

SEQ ID NO: 118170 - DNA, 792 bp, Heterodera glycines
  Promoter: Source sequence=SeqID_10672; Location=1960..2751; Strand=+; Gene=SeqID_46896
tgccgttaaagttgtgccgagaagatttttttgagcaggtgaaggtggtggtggatcagcagtgggccaggaaattgaaatggtcaaaaggtgaaaaatttagaatttgaaaaaaccatgacaacgtaaaataattgaaaattggagattaatctaaaattcgataaatgagaacatatatttagaaaaataggtttttatgtgtttgatattcgggaaataccaaaacattatgtacatacttaacacaaaattagtattacgaatcgcattaaagttgaacccaaatttataatttctgtagatattgattttttgattttttataaatcgcaataaacattacgccaaacaaaggcaaacctaaaaaaagtaaaatcaaagcgacatatttttcctcgctaaatgttagtctccgttttttgccatgttttttaggcgtttggtgttataccatttccaaattggtttttgttttcatcggccgttgccaaattgagtctggataggatcaacttattatgttatcattttcccggcattcctttactgtttgaacctgacattagaaatgccgggctctactaatttctctaatccaattgctataatatctaggtagctagtttacttacttcctttgctttttgattctgacattgaaagggctctactaatctatctctaatccaatggttatgacatccttttaaaaatgccctgctttaatctttctctaatccaatagctatcatttatccttttaagtttagcaaagattgtgaaagaatg

SEQ ID NO: 118171 - DNA, 238 bp, Heterodera glycines
  Promoter: Source sequence=SeqID_10421; Location=1668..1905; Strand=+; Gene=SeqID_73617
attttcaaaaaggaagacaaattggcaaatctgtcagcttcggtcttggttttctacgccctttctctctcctgattcattcctttttctgattgttaccgaataaaatgatgggttccttagtggaaattgtgccattctttgcaaaatttattccatttacctttccatggtaaaatatttgtggtttcctttttgtttttgcttacttttcctagcattttcagctgtcaaaatg

SEQ ID NO: 118172 - DNA, 1003 bp, Heterodera glycines
  Promoter: Source sequence=SeqID_16593; Location=471..1473; Strand=-; Gene=SeqID_81004
tggatgaattaagggaaaaattaattgtcactcacagcaaataaaaagaatttggtgccccagcctttcctttcattgtttaacaatttgtcattaaattcgactctgtaatccgacactgcgtcattttgtgagacaattcggatgattgcggaacatttgcagctccaattttctgcgccaatgcaaattaattattattaattaatattttattaatatttaaactgaaccttttttggtagtggcacaaaaaagaaaaatgctcaaacttttcgcattgtcactgtcttctgtccagtggtttattcgtgccaatattttccatggtaatccctttatgtacgtgactgtctcgcttttacgttcactcccaacaacttcgcgcgcaaattccgacactttttcaatttccatcaaaattgtcccttccgatttgctttgatcgaaaatgaatttgcttattttttcttttttgacggttaaatcgatggtaagtgtcactttgtcctcttctttgttgtaaaagccattgagcgggtccatcaattgcttaattgttcataattggataaattaagggaaaaattaattgtcaaactcaccgcaaatgacatgaaattattgaaacccaaccagtattttttattgttaaaaatatggtcacaaagtgtcccagtggaattttccgccactttcatttgcgagacaattcgaaaagtggccgaatgaacgcagcagcgccaaatcaaaccttaatggtgattaatttgttaattagccttaattaagagttaatttgaaccttcttttggagcggtacacaaaaggtaaaattccaaacatttttcattgtcagtgccttcatttcttgtttttatttgtgctaacattcgccatggaagtccacttatgtacaaagtttcgctgtatcggttactcacagccatttctcccacaaattccgacattttttcaatgtccattattaatgttccaaatg

SEQ ID NO: 118173 - DNA, 209 bp, Heterodera glycines
  Promoter: Source sequence=SeqID_315; Location=6563..6771; Strand=-; Gene=SeqID_81964
aatgaaagaaaatataaataaaaattaaattaaattgaaaaagattcaaaaaatgagaaatttatcatttgaaaaaataagaataaattttgcgatgattgagaataattctgctaaatttagttttcacaaataaacttcatctgctgaaccattaccgtcgctttttgctgctcgacgaccaattcgctcccaatgcttcggaaatg

SEQ ID NO: 118174 - DNA, 298 bp, Heterodera glycines
  Promoter: Source sequence=SeqID_11555; Location=480..777; Strand=+; Gene=SeqID_74997
ggtgtggtgccctttttttgttccgccattctttctttgactcttcccataaaaattcggccgatcattttttccttagatcgcaatggatcaaaactgcaaagttgaagactttgaagcagctgatccgctttacgtgtccgtgaaatccaacatgagaaaagcgtactgggatttgtttagagaagacttggcaaaagagcctccggaatttggacacgccttttcactgctgggggacctaaaacaagttcaaaaatattattatgctttgtttattttttaatcgttcaagatg

SEQ ID NO: 118175 - DNA, 822 bp, Heterodera glycines
  Promoter: Source sequence=SeqID_98; Location=1304..2125; Strand=+; Gene=SeqID_66810
atggaggcgtaaaaaaggaccgaattctgaaagttccatttttggacaaattttcgcgagacaaatttatctataatttccgtaatgctctgaaaaaattgactaatttgccccaacatatcaaagtccgcagggacatgacccaaaacgaactcaaaattttatattcccttcggcaacaagcctatcaggccaatattgctgctggtgaatataaatattttgtggttgatttggaaatcaggtccctgaaaaacccccacccgctcagaactcgctagggacacgcgagcaaaccaaccgaaaaaaaatagaaaaacggtaaaaacaatccctggatttcctgccttttaataaatgcccgatcaatatcaaataaaatagctgatttagaacatttggctaaaaaatacaatccgtctataatcctaatcaatgagacctggttaaactccagaaatacggtagaagcggaacttacaataaattgtcaataccaaattgtttatgcgaaccgaacagaaaaaagggcggaggatcggcaattctattaaaaacattgatcccttatcagacacttttctctgggacaaaattccaatgcgaaattatacccattaaattattttttaaaaaccaattcaaattataaatatatatcggccaccgaattgtaccgttcagaatactaaaaagctattcaaatttatttcggatcaaagcgattctgaaaatatcatatactgtggggaatttaacatcccaaacattttatgggatgaaaataaggtaaaacatataaattatcctatgtcaaatatg

SEQ ID NO: 118176 - DNA, 792 bp, Heterodera glycines
  Promoter: Source sequence=SeqID_25315; Location=1..792; Strand=+; Gene=SeqID_56064
atttttaagaatgttgcaatggacagacagaaaagaggaagaaaatgattcgtttttaatcattaacatttacgtacatataaatgaatatattggagctcaccaagaattaatccgggccgggcgccgttttcgtacaagaggatattttaaaaaaataaatgaaacaattgcatttaaatcatatatactactaatgttaattatgctttttaaggttttgacccaattaggtattaataactacaaaaagtaaataaaagattacgatttttgaaattattttggcaactaaattagaccagcttggtatcattcgaaagctcttgatgaggaggagctttttcgtagcaaatgttaaacgattttaaaaaaagataagagcgttcgaaaatttgtttttcttctaactcatgaataaatgcataagcaagcaaaaaatggctgtattacgatgcgttatataccgtatttgctctttttatatgccatggtatattatttttcaacctcctcagaaaggggtatataattggagaccggcagattaatggagactggcacataaaaagagcaaatacggtagatggtaggtcagatcattgttaattaattttgctgatcagatcgcttttaaggacctgtaattagttcactagtaaatccggtcagatgactgataacgattttgatcagatcattaataaatctttatcagatcactagtaaagcccggtcagatcactgaaaacccattctgatcagatcgctgtgtccgcccattggctgatg

SEQ ID NO: 118177 - DNA, 302 bp, Heterodera glycines
  Promoter: Source sequence=SeqID_14868; Location=822..1123; Strand=-; Gene=SeqID_47241
tttataaaacagacaaaatgccacgatatttgatcacatacttttttgttttctttttgaatttcttgccttttccgagattatgtaattgacatttttgcgggaaaattcctcctccatctcccctaagggcccttataaatttttaaggaaaaataggaaagaaaatatttctgcttgggtccctttgagtcgagatctgaaatttgggattggtcatttttatattggtttggtttacatttttaatttctttttaaatttattaattggactgcttttgctgttgctcaatttcgatg

SEQ ID NO: 118178 - DNA, 379 bp, Heterodera glycines
  Promoter: Source sequence=SeqID_5912; Location=3778..4156; Strand=-; Gene=SeqID_59650
ttttattgctgcttttcaagggttcaacgatgatttttttttgagatgctaattttctgcttttttgagaaaagaaaatgatttaacacaccattccaaaaaacgagaagtgtaccaataaatagagaatgcagagaaaaaacaatatcttttttctctaacttttctctccttttggcgtactatctaatatttttattattaggaaaaacgacatttatttcgccacatataactttttttctactcatacaatttacaccaaattttgcatatcgatagagaaaaatattatgaatatttttaacgctcgagttttatttttttacgcttcaatctaaaattataaattaataacttatttttataattttagatg

SEQ ID NO: 118179 - DNA, 91 bp, Heterodera glycines
  Promoter: Source sequence=SeqID_27457; Location=907..997; Strand=-; Gene=SeqID_58150
aaaaaagaaaaaaaatttgcagtcaaaaaattattcgaattctcccaaattttgtttccataatttccgaaagttattcggtatcataatg

SEQ ID NO: 118180 - DNA, 164 bp, Heterodera glycines
  Promoter: Source sequence=SeqID_397; Location=106..269; Strand=+; Gene=SeqID_51352
tgtttcctctttaatcgttttatttttatatttttaatttgtcctctctgtcagatctttttggcattttgtcattcgcggcacttcgtcactgctctttcggctctgccggggatgctgcttcgtcaccaccatttgtcactgtgacttcgctctcccaaatg

SEQ ID NO: 118181 - DNA, 341 bp, Heterodera glycines
  Promoter: Source sequence=SeqID_24189; Location=384..724; Strand=+; Gene=SeqID_54901
tattctctatgaaagaggggctttataaataatattaaataaattagtaaattcaatgtaaaaaataaaaaaatggttttagcaacgaaactcaaaacctatataacatatatataaaaattaaaataaaaaaatgatttattagtgagcaacacgcgtgcgcaatgataatgaataataacacaccggaggggaaaccattagtgttttgttattgtttgcttaaaatgagcgagaaaaatgggggcagagaaagaaaaacagcagcatagagaacagagaaacaaaatttaaaaagagttagtaaaagacaaacagatagtggcgagagaaagtacatg

SEQ ID NO: 118182 - DNA, 436 bp, Heterodera glycines
  misc_feature (29)..(29): n is a, c, g, or t
  Promoter: Source sequence=SeqID_39271; Location=866..1301; Strand=-; Gene=SeqID_67874
tgcacgccggagtcgttgaaagggcaaantcggacaatacaagagcgcttgtacagatattttacaaagaaagacactctacgatgggtcgatgtaatagacaaaataataacaaacattaacaacagtgtgaatagaacattgggagccaaaccgtcttcaattaattttgaaaatgcccgtgcgctctgggaaaaattatataaggcgaaggaatttaaaatttcgaaaaagaacaaatttaaaattggcgatatcgttcgaattaccaaggaaaaaggaaaatttgcaaaggggtatctcccaaactttaccgaagaattgtttaaaatcgttgttgttaatccgacgacacccgattcatacaggattgaagatttggaaggaaatttaataaaaggcatattttataaccaggaattagtgaaaatagatg

SEQ ID NO: 118183 - DNA, 413 bp, Heterodera glycines
  Promoter: Source sequence=SeqID_7855; Location=1467..1879; Strand=-; Gene=SeqID_66169
attttgaaaaaactggggaaattgggatccagctgggtagcattgggcgccgaatttagaaatttttggtcaaattaaccaagaaaattgaatattcattttgtgggcaactgcccccccccctatggttacgggtctgaacaatccattgaatttatatgtgaacagccgtaatgctaatccttttgtctttttaaggtctttttgggcacgttcaaccttgtgttggattttgttgtggtgctgttcacctatttcatcttcaaaaactgtgtgaaaacgactctcagctatttgaacgacatcgaatttcgcaattccttcacaacgccttacttttggtccctccctcctccgttcattccaatgcatttttaaatttaaggcgcatcgacgcaaaaagaaatgaaatg

SEQ ID NO: 118184 - DNA, 168 bp, Heterodera glycines
  Promoter: Source sequence=SeqID_4616; Location=1..168; Strand=+; Gene= SeqID_45859
tttcaactttagctaccgcgcgaggacgtgacggagttgctgccgaacgacggggacttcctggtgcgcacgacagaagaaacttcgggcacagagcgcgtctttgcattgtctgtgaacgtcggaggcctggtcaaccacgtcatcttccgccgacacaacgggatg

SEQ ID NO: 118185 - DNA, 78 bp, Heterodera glycines
  Promoter: Source sequence=SeqID_15149; Location=555..632; Strand=+; Gene=SeqID_79340
tgtttacaaaataatgaatactttgaaaagcctaagtatttatttaaaataaatatttttgtaaatgaataagaaatg

SEQ ID NO: 118186 - DNA, 755 bp, Heterodera glycines
  Promoter: Source sequence=SeqID_32331; Location=1..755; Strand=+; Gene=SeqID_62644
ataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataatttaaaaaaaataatgctggtgtggtaagtgtgaagaactgtgttcctccaggcaaaaaattctaagaaaatttataagcatttgaagggttctcagcagtttccctgcaaaatttggtgagattctgatcagtctagaacgttgggtgatatttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgtagggttctcagcagtttccctgcaaaatttggtgagcttctgatcagtctagaacgttgggtgataaaatgaaaaaaataattaaaaaaaaataatgctggtgtggtaagtgtgaagaactgtgttcctccaggcaaaaaattctaagaaaatttataagcatttgaagggttctcagcagtttccctgcaaaatttggtgagcttctgatcagtctagaacgttgggtgataaaatgaaaaaaataattaaaaaaaaataatg

SEQ ID NO: 118187 - DNA, 1003 bp, Heterodera glycines
  Promoter: Source sequence=SeqID_23582; Location=514..1516; Strand=-; Gene=SeqID_54269
aattatttttcttcattattactattttcgttataatttatgccttattattgtaatcagtttaaatttaatataattgattttgttttttgtcttttcttaaaggttttgattatttcgatgcactaactttccgctatgacatttgtaattaaatttttaaaatatttcttaattaaatatttaaaaaatgaatatttagcccagaaaactgtcagagagccattttgttagtcacagaattaaatgattttattttagtaacgaggtgtttttaataaatttgctctagaatatttagtttttaatttactttcgaaatgtcgatagaattattaaatgatttaactttttttttactctttttcaattattttaatttttttttaattcttgaactcagcttaatttaacattgatcataatttgaaaggaaataaatatttacattaaataattagtgaaattttttttactttatattttattttcattttataaatttatttgttttttcaaaatcaaaaatttttatataaaatttataaaataaatggaaaatagtttaaaagttttttcttatttaatacttcaattttttatatttgccatcaatacactccattccctaatttttttttatttttcgtaaaaaatgtaaaaagttataatatatcttttttttattttaaacaattcaaatcttctttgcgacgaattattactaatctcaaataaaaacataaataaataatataattaaaattttataaccttttagaatttttctttccattaaaaatttttgtttcataaatagatttgtataaattttgtttgaagctttaatgaaatggtaaaaaaaaattcattcttttccatttgggtttgcttttatttgtatttttttgtaataatttttagcttttcttatatttgtatattaatagttacttttggttgtaatatatttagattttaaaaacttgttcaggtccatatg

SEQ ID NO: 118188 - DNA, 130 bp, Heterodera glycines
  Promoter: Source sequence=SeqID_8834; Location=2032..2161; Strand=-; Gene=SeqID_69360
tcggcatgttgtctgctgcgcaaaccgatttcgcatcgttggaggacaaggtttggaaaagattagtgggagttaaaataaacaataatttatatttcaaatgttctagaaaatccaattattggttatg

SEQ ID NO: 118189 - DNA, 157 bp, Heterodera glycines
  Promoter: Source sequence=SeqID_3203; Location=4045..4201; Strand=-; Gene=SeqID_83675
gctgcaaatttggcatacattttattttatggcaacaaaatgccaatgtatataggtagagagggagaccaatacgagatgttcgagaaggtgattcgtgtcggtggtccaaaaatccaaaaattttcggatcggcatttaagattatccgaaaatg

SEQ ID NO: 118190 - DNA, 94 bp, Heterodera glycines
  Promoter: Source sequence=SeqID_17919; Location=1718..1811; Strand=+; Gene=SeqID_82474
actaagggaatcgtcgatgagccacttttgcgatcaatcaaatttgaccgaataattctggcgccttttcatgtcttccagggcattggaaatg

SEQ ID NO: 118191 - DNA, 487 bp, Heterodera glycines
  Promoter: Source sequence=SeqID_18541; Location=40..526; Strand=+; Gene=SeqID_83168
acgacgaaatttacttttgacgcaattttttattgtggaatattttttgaaataaaatttttgtttattttttgtaagttaattatgtaataattatttgataataaaaaataattaatggatgattaatgctattgattttgaattaatgtgaattgggagaatacattttcttcgttcatcacatcataaatgtggccctggctgatgctgtgtgtcgtcttcgttaaatcaacaaattaattcccccccccaccctcacaaatgtttttttgtttgtttattattaaaaataaattcattatttcaaatttgtcagctgaaaagcttacaaattttctttttgggcaattggaaatcttatccaattaagttattcgatctaaattcattaaaatgtattaaaatattcaacagaatttattttctcttagatttcaaaatgttatccgccgatgaaaattattggcacaatgtgcaaaatatg

SEQ ID NO: 118192 - DNA, 152 bp, Heterodera glycines
  Promoter: Source sequence=SeqID_40238; Location=541..692; Strand=-; Gene=SeqID_68638
aggtgctagtgcgttttataaattccgccacccatgcgcgttttttaaatccgccagcgcgttttataaatccgccagcacatttttttgcatatatctttaataatattaaaattttatgcaataatttcagctatattttatacaaaatg

SEQ ID NO: 118193 - DNA, 73 bp, Heterodera glycines
  Promoter: Source sequence=SeqID_23202; Location=642..714; Strand=+; Gene=SeqID_53911
tatttattgccgtagctcaaaattccctaccttcggcaccaaatctgtaccggaaactgttccatggacgatg

SEQ ID NO: 118194 - DNA, 135 bp, Heterodera glycines
  Promoter: Source sequence=SeqID_18266; Location=926..1060; Strand=-; Gene=SeqID_82860
tttaaggtctcagacaatgtgaaaacggccaatcaactttcaccaaccatttttatgcttattttgacaaatttaggcgcaaatattttattcatagccacatctttttacagaatcaatgataacgccattatg

SEQ ID NO: 118195 - DNA, 196 bp, Heterodera glycines
  Promoter: Source sequence=SeqID_25420; Location=1..196; Strand=+; Gene=SeqID_56161
ctagagtccggcgggatcgggactcccgcgggatttttcgggagtcccgctcccgactcccgcttttttcggtgaacgggatttttaacgggagcgggatttttacgggattcccgttcgggacttccgtcccggaaaattttgaactcccgatcccgctcccggaaatttttacccaaaaacgggagtaaaaatg

SEQ ID NO: 118196 - DNA, 127 bp, Heterodera glycines
  Promoter: Source sequence=SeqID_2017; Location=1052..1178; Strand=-; Gene=SeqID_77333
ttacagagtcctagtcgaaacagagatgggacgcgaccttttttatcgtttttttcgcgcgatccacgattcgtgacccttgaatttaaaagaccgtatattatccgcggctttttaggtaaaaatg

SEQ ID NO: 118197 - DNA, 124 bp, Heterodera glycines
  Promoter: Source sequence=SeqID_13201; Location=1252..1375; Strand=+; Gene=SeqID_47114
atgatgtttcaaggttttttcattaacaattccccttgttatgtttagttatattgtttttatgtccggcatttcattagttggcaattttgacaacgatgtccaaacgttttcggcactgatg

SEQ ID NO: 118198 - DNA, 677 bp, Heterodera glycines
  Promoter: Source sequence=SeqID_37266; Location=691..1367; Strand=-; Gene=SeqID_66372
tgcaggtccaaatggaccaagaggaaagtgccaaaatcgaaatgcttacagaagcgatgttcatttaaaacggatgaagagaatgaccaaacggagctgagcatcgaagtgcaaacatcgcgagagacaggggacgaacatacggtaagtgtacagtaggcatatggtaaaaacatggcgttcgctaccgcacgactcaaaaagcgaaattttgaaagtttcaaataccccctccccatccgccgaatatttgaaacttcttatctttcactttacctattcaagtctcaacaaaaatgaattaaccgtcgtttgttcactccgtcgtggtttaatcccaaatttaattcatttttataaaatattatttaggtaacaaggttagacgtatattatttagagcatttaaatttaaatttgaatttaaaataatcccaaaatgtgctgattgctctcccctgttgctgagtgactgtgccgtcccttcccttcagcggcacatttttcgcgcgttcgctttcgtccctctgaaaagggatggcacctcctccgctcccacttccgtcgatgacttttcttccgctgtttccgaaaaaagagacggcggtagaagaagcggaagaatcggcacagtcgcggcgaagcggtggcaatcgatgggcaccaacaaaaccatg

SEQ ID NO: 118199 - DNA, 331 bp, Heterodera glycines
  Promoter: Source sequence=SeqID_20225; Location=1240..1570; Strand=-; Gene=SeqID_85025
tatcaacaaaggtcgtttattgattttattgactgtgcgtggcgaactctcccaatatttgctggcgataaacattcactctcatttactcattttcattcacacaaacattggtccgactgaaaagcacttaactgatcaaaatggccgctgacattggtcaaattcttcaacaattagttaaaaatcagacggaggcttttcaagcccttctccaaaatacccaaacaaatccaaattccgtcaattattccactatttattcgactatcaatagccaacttggccaattcacatataatccagaattggatttcacttttcaagcatg

SEQ ID NO: 118200 - DNA, 52 bp, Heterodera glycines
  Promoter: Source sequence=SeqID_5022; Location=1..52; Strand=+; Gene =SeqID_56601
aagaaattaaattttcctatgtaaacactccatttaaaattttagcataatg

SEQ ID NO: 118201 - DNA, 180 bp, Heterodera glycines
  Promoter: Source sequence=SeqID_13624; Location=674..853; Strand=-; Gene=SeqID_77531
ttaactgcgaataaattttgaataattaataaaaaaaaatttggcgtgaaaatttcctaaaaaattgattacattatccttaaatttttgtttttttttaaattttaaaattttcattacccaaccttgtcaatttgtaagatcattgatggctttttggttctgcgcacgtagcgaatg

SEQ ID NO: 118202 - DNA, 52 bp, Heterodera glycines
  Promoter: Source sequence=SeqID_16073; Location=2011..2062; Strand=-; Gene=SeqID_80432
tcaattgtcgtccttaattgttcttccatttggtccaataatcgctccaatg

SEQ ID NO: 118203 - DNA, 293 bp, Heterodera glycines; identical to SEQ ID NO: 99822
  Promoter: Source sequence=SeqID_3637; Location=917..1209; Strand=+; Gene=SeqID_51216

SEQ ID NO: 118204 - DNA, 305 bp, Heterodera glycines
  Promoter: Source sequence=SeqID_22783; Location=1398..1702; Strand=-; Gene=SeqID_53478
agcatcactttccttctaaaaacaaatgatttgtttttcaatttttatgaaatttaataaatgtggtcatattatttatatcaattttccatgatagcgtaatggtctttacgcttccattctgtagtacaattactagcatatgttcacattcagtatctggcaaattgtaaaatatgatgtaatttaatcccttttttcgactatctttataatccttaatcaattttttttcatccaaataaagtgctttattctattccattttccattgtccttcaacattcatcccacaaaaacaaatg

SEQ ID NO: 118205 - DNA, 73 bp, Heterodera glycines
  Promoter: Source sequence=SeqID_26909; Location=1..73; Strand=+; Gene= SeqID_57646
tggagcatacgtcagcttttttgaagcaattcggcaccgagttgggaataattggttcccaattcgcatcatg

SEQ ID NO: 118206 - DNA, 94 bp, Heterodera glycines
  Promoter: Source sequence=SeqID_1296; Location=6728..6821; Strand=-; Gene=SeqID_71905
aatggcaaccgatattaaaaacatcttaaatcgactgtcttcaattgaaacgttattatcaaacaacaacaacaacactttggcaacgcaaatg

SEQ ID NO: 118207 - DNA, 213 bp, Heterodera glycines
  misc_feature (37)..(38): n is a, c, g, or t
  misc_feature (45)..(45): n is a, c, g, or t
  Promoter: Source sequence=SeqID_26666; Location=1204..1416; Strand=-; Gene=SeqID_57420
ctgtttaggttatagacgatttatttcaatgatgatnntaatacnataaaacattatgacaacaaagaaaacaaagttaaatagaggcactatcttatttctaagtagagtatcaattatttcttaaaaattcattttgtttgattacttaaggcgcatagtgcaactgcgtttagagaatgttcaagcatttttttaaatttataccatatg

SEQ ID NO: 118208 - DNA, 543 bp, Heterodera glycines
  Promoter: Source sequence=SeqID_41825; Location=308..850; Strand=-; Gene=SeqID_69875
tccactctcttgtcacttctctcttccactctcatcgtggtttcgcttctctctctttcctccactctctccgtacagccctttcttctctcatttttctttacacactctgcgacctctttctctcaatgagccctgaaagggtcattggtggtctctctcaataggcttactgtatgtacctcattctttggttcttttatggctaattaactttaattggtgcaacatattaaacgatcgagttgattgaagaggccaatgtataggaatgattgaaagttatagttcaaatttatcgaaatttatttttttttatcgttttcaatcaaaaagtaattaccgtatttactagcccccgggggctctattgttcaattcccctcggaaagagggttataatcgagtgtaaatacggtagtaattaattaattatacagataaaaaactaaatagatttgttttgcgttcctttgaatattttccccttgtgtttctttttgtgcgaccaaaattaataatcaaaacaataagaatctgatg

SEQ ID NO: 118209 - DNA, 205 bp, Heterodera glycines
  Promoter: Source sequence=SeqID_2144; Location=593..797; Strand=-; Gene=SeqID_78071
tattgtccaacccctcgggcccatttgcaacaatttaaggcaaacaaaattcaaaaattgttgaataaaatgtgattttcgttagaatttttggttttccgcttttctcattatataaaaataaagtttccaacgcaattaattcttctgctatttgtgtgacatcattcggaactcggccaaattgtgctaattgccaaaaatg

SEQ ID NO: 118210 - DNA, 548 bp, Heterodera glycines
  Promoter: Source sequence=SeqID_5336; Location=4800..5347; Strand=+; Gene=SeqID_57717
aaaactaacaaacaacttatttagttaatcaaaagggcgcgccacgaaatcaatgcaccaccagcagtcccgaccaatttgaattttgagatcggccaagcatacaggacctacacatcgacgggtggcgctgaggagctgtttctttctattgggcgactccggggtgtattttgaaaatggaaacgaaaacctgcaacggtaatttgtgaaaaaatgcaaaaatttttttcgcagagttttattgtttgggcgcgaatcatttggacgctttgcggacagaatgactgagtgtttcggtgacggaactttctcgctcgcgccagcccaattttatcaaatttatacgatcctggcaaagtctgtttgtcttaaatcggttttcaaatttgtaaattaaaatatttagacgtgaaaaatggattttcccagtgtgccatgccctaatgacttccaaatcgcaaacatcgtacgaaagaatgtttacacttttgcgtgctgcgtggccaaattttgctcccatttctttttccgtggattttgaaatg

SEQ ID NO: 118211 - DNA, 658 bp, Heterodera glycines
  Promoter: Source sequence=SeqID_13883; Location=612..1269; Strand=-; Gene=SeqID_77829
aattaaaagcggtttaatgttcaaatcaacttccatccatttttttcgtccaaaagttttcttgcggatttccatttaaaaagatttatttttaaatttaaattatttaattaattaaataatcaaataacactttttcgtcttctccaattgaatataaatagctcaaatcccctgctgctttttgttcattgctaaatgttctcttttatttgtcgtgtccgggtaacctaaattaccttaattattttttgaaaaatttctaataacctattaatcaaattttttgatgttctgttccgttccatgccataaacaaaaataatcgccagaactgcagcaattcttatgctcataataatgcctttctaaaatgtaatttactataataatggaaatagtcataaataagaagttcttaatcaaaaatgttcacaatgaatttcatcaataaaatttatggatagagaggctaaaaaaaaaaaggtcttcggaccggacccctccctttccccccccccccccgaaaatttttcctggctacgggcttgattgtatgcgaatttgagtcgaatttcgcattcttgaatgtcagttataatacaatttttagctttataatgaagtgtcggctctgtacgcgacctccgaccaaatg

SEQ ID NO: 118212 - DNA, 804 bp, Heterodera glycines
  misc_feature (16)..(16): n is a, c, g, or t
  Promoter: Source sequence=SeqID_19805; Location=1583..2386; Strand=-; Gene=SeqID_84542
agtgatgttgccgccncatttcgcttccaaaattttccgggtgaaccccgagaatggcctttattttggaagctgtttgagacttcagttgaaagtcttcaaattgaagacttcaaaaaacacatttatctcttgggatgtcttcccgagaagtcagttgctcgaagagcaattgatttgtacccgccttcagatgaaaactacccgcgagtggtagaaatcctcaagaaaagatttggggatgagaagtcaattgtggagacactccaatcagagttgctccatctttcaaaaccgtcagattcggttcaatctctgaggcagttttcagagtccattgaaaggatttgtcagcagttgtcagattttggagaaaatgaacaaaataagttcatggcctccacgataaaatccaaattgccatactatctcctcactcaagtggtggagaaggaaatgcgttcaggtggaacatttgattgttccgacctacgcaaggcaatcacttccattgttgaagtgaaggaagaagtacaaagatgtacacaagtcttccgtggggaagaaaaaccccgaaattttcctcctcaaatgcagaggaacaatttccaagggagaggaacaaatttctctcccaaccaatttcgtcagggtcattggcgacccaacaacagaaatgagtctgtggggatgatgtctccccaaatacacagatcatttaacactgttaatcagagggaacaaacacatttttctcctcgagaacgaggaacgaacccactttgttctctttgtagtgacatg

SEQ ID NO: 118213 - DNA, 295 bp, Heterodera glycines
  Promoter: Source sequence=SeqID_28739; Location=179..473; Strand=-; Gene=SeqID_59315
actcaaaatttaaaaaaaaattgggtcgacaaggtccgaaaattgcccttaagaaacggtccgccaatgtccgggacgcaaatgtcgcgggccgcaaaagtccgattttggcttaggccgcaccaaaaaaaaactgggccgaaaatgtccgttaatggatcttaagaaacgggccgcaaatgtccaggattcaaatgagaaaaaattaccaagaaaatccaatgatgaaaatgcaaaaaaaggaaatattaaataaaggaaatttggatttttaaaatcctttttttagaaaatg

SEQ ID NO: 118214 - DNA, 469 bp, Heterodera glycines
  Promoter: Source sequence=SeqID_40273; Location=864..1332; Strand=-; Gene=SeqID_68667
aaataaaatagaaaaaatgaatttaattgcaagaaaacatgaaattttgtttgctaattttattttttgtttccaaaaattgaaatttttgtacaaaaattttcctgaaaaacgagataaatttaaataacgaaaaattaattttttaaaaagcttaatttaaattagcaattcacttaagtaaataaagtcacaataaataaaatggaaaaagaattgaatttgaataaaaagaaaatgaaaaagagttttagagaaaaaagcgggaacttatttaaagaattcttttgaaattaaatctgacaaaattttttagggaataaaaatatatgcgctaaatagactaagaaatgttaaatatgcatataaaactttaaaaaatgcctaaatattttttctaaattgacgataaaaaaattgaaaccggcaaaatgcaatcaaattttgaggaaatatttggcgaagaatg

SEQ ID NO: 118215 - DNA, 62 bp, Heterodera glycines
  Promoter: Source sequence=SeqID_43041; Location=99..160; Strand=+; Gene=SeqID_70807
tggttcgggtaaaatattagcgaatgtcccgaaatgacaactaattattgtggtagaaaatg

SEQ ID NO: 118216 - DNA, 255 bp, Heterodera glycines
  Promoter: Source sequence=SeqID_24862; Location=632..886; Strand=-; Gene=SeqID_55610
tttcttctaattaagaatttaaaaatatattttaaactttccacctaataatacttaatctattctacttccaatttattggaaccccttaaataatatcggttccaaaggtaatggttttcatgaactaaggtgggtattttgttcagacgacatggatttgattgagccgcttttccaattcttttcactctcgaaaagaatgaatttttgctagaatccaaagacttcaattattcacattttttttcaatg

SEQ ID NO: 118217 - DNA, 801 bp, Heterodera glycines
  Promoter: Source sequence=SeqID_9383; Location=1301..2101; Strand=-; Gene=SeqID_71197
ttggctttgtcccctcaaccaaatgtttgccgtaacaccggcaattcccttttctctgtttttaatgcaaatttctttctttgctcagttttgtgcttcggtgttcacaatggtcgcgataagcattgatcggtcgttagtttgagtcaattagctaatcgctcttttttcttcagttactttgccattctttacccgttgcaacgtcgcccttggggtggcaattcgaatgctaaacaattaatgcattcattaagcagatgaactccatccaatcactccttttcaggaaccaatggcaatcgctgctgcgcattaacaatttgtgccatttggacaatttcccttctcttcggggcacccgccctttacgtttatggtacgaccagtttaagaagcagaaagtgcctgccatttgttcagatacggtcgagaatgcctttttggtgcgtgggagggaagtgctcaattcgacgcgaacgatttgcgacgtaattccgtcaaaaaggggcgcctttttgctgtgaggcgtcgcattaattattcattccttaattgcttttaattgtcaaatcccttcgcagttacaatgcttcgcttgtgcttctccaatttttgttgccttttgccattctcattttcacttatgggcgaattgcgcacgaattgtgcaaaaaacaaacgcccgaaaataaaccgaaggaatcatttctgaaggcaaagcgaagggtgggcgaagcaaagaaagcgcaacgcaattagtgctaattggccaattagcatttgttatcgtttcagatg

SEQ ID NO: 118218 - DNA, 125 bp, Heterodera glycines
  misc_feature (80)..(80): n is a, c, g, or t
  Promoter: Source sequence=SeqID_5890; Location=1..125; Strand=+; Gene= SeqID_59577
ttcattttactagggcttgaattacatggaagaatttgcttcttttttggtgcatcatttaattaaatttcaaaatccanaattaatactttaaaataaaatttctcccgcaaatttgaacaatg

SEQ ID NO: 118219 - DNA, 410 bp, Heterodera glycines
  misc_feature (12)..(13): n is a, c, g, or t
  misc_feature (18)..(18): n is a, c, g, or t
  Promoter: Source sequence=SeqID_43279; Location=566..975; Strand=-; Gene=SeqID_70988
ttttttaaattnngtttnggtgcttctagggacgtatttcccatatgcgtatttgcatatttgtgcatacttcgcatagtgcatattttgtgcacatattttgcgatttattatatgtatatttttggacacacaaattccttttaacgaaaatgaattaattgtttttgtgtaaaaaaaccactagaatttcaaatggctattaattaggtacggtactttttttaagaaaatctttgacttttgaaaaatttgggcattttagcatgaaaagacaagcattattttaataaaactttaaattttctaaattatattggtgaactttgaatttaaaataatttttcgccaaattaaaactattttaaaatgggccattaataattcaacacattttctttttcaaaatg

SEQ ID NO: 118220 - DNA, 448 bp, Heterodera glycines
  Promoter: Source sequence=SeqID_2623; Location=1..448; Strand=+; Gene= SeqID_47363
cgtccgagtatgtgcaatttggtggatacaacatttatcgggggttgccctatcagcgtggagcgggagttggcgcagtgttcagaagtcttatgagatacttgctgccgattggaaagcaaattggctccgcaattggacgtcagggaatggaaagcggaaatcgagtactcaccaatgtgctagagggaaaagacctcaaagagtctctcgttagtgagagtaaggcaggactaaagaatcttctcgaaaaagcagccaacaacataaacactcagaagggtcaaggttttgattttaagcgatacaaaaaagactcggctcccaaaattggaaaaataaggcgaaaaaatataaataaacttcaatcgtcagtcgggccaccaatggttgtaaagaccaaaaataaacgtctgcgtgttgactcactaggaacttactaaaaatg

SEQ ID NO: 118221 - DNA, 530 bp, Heterodera glycines
  Promoter: Source sequence=SeqID_16645; Location=457..986; Strand=+; Gene=SeqID_81059
tattgatctcaatttgtctttatgactgcttatcatattgataaactttcactcttgtgcttgaatctaccttactcttgctttctttttccgattacattggctcgtttccttatgtacgacttagaatagatctggtcaaccccggggggttcgacaaggcgtcggtgttaggttattgggcaatggcttcggagtaagaagcccggctagtcttaacggataggccgggtttgtctagcggaattgactcatccgctagttaggggcggttggggaggttactccgaaagtcatgctgagatagcctgtgctgtggcgccgaagctatgagaatcttatctcctagccagatcgaaagtgcaatgagacccgtagatatcaaccccgaggtattgaataaatgcccgggagggaccagtagagtgggtacctgctggtcctgggtagggtaagtgatcggtggtttttccgcagaggcggtgctacaccaggtcgaacgccagaaccgtactgcatagaataatatg

SEQ ID NO: 118222 - DNA, 136 bp, Heterodera glycines
  Promoter: Source sequence=SeqID_12984; Location=1194..1329; Strand=-; Gene=SeqID_76747
gcataaattcgataatttacaaaaatttagcgtttttccacctaatggacgtgggaatgaggacttttccttatttggaataattaatgggcagcgtgttgatgtggtaatgtgccaaaaaatttagcgcaaaatg

SEQ ID NO: 118223 - DNA, 133 bp, Heterodera glycines
  Promoter: Source sequence=SeqID_16448; Location=1472..1604; Strand=-; Gene=SeqID_80851
attatatttgagaaatggtcgttggtctgatgctctcatttgatttgtgtttctttcgtttgaatacaatatacttttaataacaattgaaaagtttaagcctataaaattgtttttggcccggttaaaaatg

SEQ ID NO: 118224 - DNA, 79 bp, Heterodera glycines
  Promoter: Source sequence=SeqID_22821; Location=1252..1330; Strand=+; Gene=SeqID_53531
ttcttccttggaactatctaaaagagagcatagaaaagcaaaaagtcaaatacagtagcagaagggataaggtgctatg

SEQ ID NO: 118225 - DNA, 523 bp, Heterodera glycines
  Promoter: Source sequence=SeqID_24581; Location=1..523; Strand=+; Gene=SeqID_55309
tgcttatgatttggaaacggtgacaaaaaacaaagaaccgttaaaaaaatgtttaattttactgtaatttaaattatttttaaaataaaatattttaatattaaagaaaatatttaatttaaaaatttaagaataaaaaattgtttttttattgtaatccaactaaaattatttatattaaaaaataaatttaattcattaaatgaatggataaaaaaattttaatgtaaaattaagaatttattcaaaaataatttttaaattaaattaattcatttaataataaatcagctagttcaaacttcgtgaaatttttgtacttaaatccgttttctaataatcttttttcctttatttctgaagatgaatgaattggattcggtgtgcaatttcgaatggcgaattttcgatttcagtcaaatggtggaaggacgggttcgccaccttaaaagtttcgcgtggaagttttttgtgtgggcggtaaattttttaaattttgaatttaaaatgattcgttaaaatg

SEQ ID NO: 118226 - DNA, 198 bp, Heterodera glycines
  Promoter: Source sequence=SeqID_28169; Location=573..770; Strand=-; Gene=SeqID_58818
gtgaagaagagggagagaggaatggagaattggaatgaatcaaatgatcagaaaatgggaagactgatcaaagacaaaagagaacaaaaagtgattggaaatcgatggcacggggggggggaacgatggaagaatggcatgaaatgtcaaactgatcagctaaggcactctgatcaaaatccatggcattggcagatg

SEQ ID NO: 118227 - DNA, 200 bp, Heterodera glycines
  Promoter: Source sequence=SeqID_20643; Location=334..533; Strand=-; Gene=SeqID_51194
aattaattttaatttttttaaatttaaatttttgcgttttaaagcgtttcaacttcttctgaaataaccaaaaaaatgattgaaatgaataaacaagtttctcgaaatctgcttgttcagggttcattaatcatttattattgtaaattaaaaaatatatatttttttaatttaattttttgtttatttaggcttcgatg

SEQ ID NO: 118228 - DNA, 509 bp, Heterodera glycines
  Promoter: Source sequence=SeqID_31; Location=2442..2950; Strand=-; Gene=SeqID_50789
tggcgcgaatattcagagaaatgaccagcggagtatggcccgatcgcttaaccccccccccctttcccatccactttagttctccaaatttttgtttcttttgtcaatttgtcgtcttttcattgtccaaatggccatacagatgttatcttcctttgtttggctcggggagtgatcaacaaagattagtactaggaatattggacacaaaagaataagtaactttaggcgccccactgacatgatttggcggcggcaaaatttgaatttaatgaatgtgttataaaatttgttgaaattgtgattaggggacggtcggggaaattttatgtattaagagtcattctaaagtaatttataattctgcaacataagtaaaacaatctgaacccaaatattccgataattttgcgtgaaaaatgggacagatcaattcatagctacctcatttttagttgacttaaataatttgatttgtttattagtgccggcaccgtcaccgagacatg

SEQ ID NO: 118229 - DNA, 1003 bp, Heterodera glycines
  Promoter: Source sequence=SeqID_12142; Location=404..1406; Strand=-; Gene=SeqID_75715
tcaactactgtatttcgtcggtaataattagggcttccaattatatggaaatccatatttttttcctggactgtgggaggtctgaaacgcacgaaaaacatgtttttaacttggtttaaagcttctaggatgggtttccatatccatttttcgtatatttttccatatttcgcgatttatgcagggctcggatcgaaaatttttcaaaataagagcatcaaggccaaaaaataagattttagggtcaaaaataagaacatttcgcaaaattgcttcaaatcagttatttttacaatttattcgatcaaaaatgtatcaaatagtatatttttgtctcccattaacgattttaacaattttggggaggaaattagcaaatcataaaattttagtgcattcaggataaaaaaaatcagatttttaacaattttttgcggcgcatttttccaaaaaacttttgggaagtgcgaggggaggaaaaattttttgtaatttaattctgatttgttacagattttcaccaaaaaaggccaatttttgtattaaaagccaagcgacgactttttttgcctttaaaaatactttttttgcggtgcgttttttcaaaaacttttggggaacaatgggggagatggtccggtgacgccgataggcgacgccgggaaaaactttgtaatttttaatgcgatttgctaacagttttttgtcaaaaaataaccaaattttgcgcaaaccttatattttcttgataaaatagtgacattctgccataaaatttcaaaattttgaatatatttaagaaataagaacaaaataagaacaatagcccgaaataaggacaaatcttacaaataaggacagatacgcgccctgaattaaacataaagttctttaaagtttttcccactttatgtccaatgaatgaaaaagcagaatttcttgtttctcatttaacttaacccattctattctaattttgcatttgctattcagattggccatg

SEQ ID NO: 118230 - DNA, 664 bp, Heterodera glycines
  Promoter: Source sequence=SeqID_15738; Location=1..664; Strand=+; Gene=SeqID_80064
ttgacatttaaaaattattttctgatgaaattaaatttattttaatacaaatatatttaataaaattattaattaattattaattaattttgtaaattttttagtgatgcgtttttttgtcttcgtgtctgtcgcgcctaattaccctaattaccccccccctgcggcgattgttttgtgactgacaaataattgtaaaaattttatgatttatataaatttaaattttttaggctttaggctctaaaaagaaaaacctagaaaataggccctaataactcgaaaagtaccttaacaaccaccaaaaaacaacaacaacttgtttttcgtgtatttcagaccatagggagctcagcaaataaaaattgaagccctagtgatgaagtgtgaaaacatccaatgggacgtaattacgaaatggcatttgaaattatgatgaaattcatggcttttaattattttaatattatttattaatattttattattaagaaaatctattgatgatcagtttcacttattgatcgcatttttggcaatgcttctccacattcattaaaatgaaataaaaaattattttccgaagaaattagcttaattttaatacaaatatatatattaaaaacttattaattaattatttattatactttttttagtgatg

SEQ ID NO: 118231 - DNA, 300 bp, Heterodera glycines
  Promoter: Source sequence=SeqID_36861; Location=683..982; Strand=-; Gene=SeqID_66075
gaatattttattttaattattctaaattacaaaatctttcggacccgtgtaaccctagaaaatattatggacaatgccaatcagcacttcatcatttttttattattttacacataaaataggcatatatttccttccagcatttacatttttagcttcatgggtcgttgcaatggttttcattgcgaaggggcggcgttgggaggggggggggggggggggaaatcgaaaaggcatttcaaaattatattcatgaaaaagccaaaagctttggctacagcaaaatcatagaatccaatg

SEQ ID NO: 118232 - DNA, 534 bp, Heterodera glycines
  Promoter: Source sequence=SeqID_23877; Location=1230..1763; Strand=-; Gene=SeqID_54568
gattttttgaaactcatcttaaaaatcaaaaaaagtttgaaaaaattaagtgattgcttagaaacatctaaaaatatctacttaataataataatgtatttttaaattaatttaatctttttttgaaaattaaaaaaaacatcggtcacttgaaataataaattctaaaattttgtccaggaaaatccaggtttttcgtgttttgcctggacctggacctggattttttttcacattggacctggatttcctggacaaaaatccaggaaaaatccaggttgccgaaaaatgacctggacctggattcaggaaaaatccaggcctggatccagttccaggccgagctctaaacgtttcattaacgcgttttacgcaagcttaatttataaatgcagaataaaagaaaccagccaaaatttaccaaatttttctttgaaattactaaattttagccttattttaaaacgattttcatagcaaaccgtattcaattttacttttcagtcactgcaattactgtacttccgcgcaatg

SEQ ID NO: 118233 - DNA, 1003 bp, Heterodera glycines
  Promoter: Source sequence=SeqID_12916; Location=75..1077; Strand=+; Gene=SeqID_76658
tttttttttcggcgacattgtcttatcgacggcgactttctgatgaaccgaatttctacatataattgatgacattttgctggttttttccaaattaacatgtgaaaatttaaacttttaccaatccggaatccggttccgaatccggcaatttgaaaatctgggttgaccggattttgagagaccggacccagaatccggcacttttagttgaaaattttgggggttttagagcctaaaaatatcagcctaaaagtcataatgcgtagtgttcctataagcatgaaagtaaaccatctttaataattatatttaggaatttaactgcaaataatcaatttaaaattatggaaatgaattttctgaaaacaatacaaataattgcgtcggcagaaaacaaattgatcagtgaaaagtgtccatcatatattaataaagaaagtaataatgattttttcaaattgctcttcacattggcactccgtctgggtttgttcatcggatcaaatgaatttgttgaacaatatttgccggctttattaagtcaattagaattacgcccaaaaaacaataatgataagttagtaaattaaaaaatatataaataatattaaattaatatgagattaattattgggtaagaaaaatacgcaaaatatgtaaataaatattaaaatttccggattaaactcataaatgaacttttgataaagtaaaataaaagattttttaataagtttttgttttaaaaaggcaaaaaatgactaattttatctttaattacgtttttcaatcactcagttaatgtcaaatctggcatcatttgaaatatctaagtgtgtttccacatttacatgtcaaaatataaaggaatttcaatagtaaaaaagttatggcatgtggcgccgaaaaagcaaaaaaaaaaaaagtcaatttttgatgtttttagacataactttttttttgtaaattgacgatgtaatttgtaggctaatagagaatg

SEQ ID NO: 118234 - DNA, 286 bp, Heterodera glycines
  Promoter: Source sequence=SeqID_21820; Location=1584..1869; Strand=-; Gene=SeqID_52451
tgcagtttaacagaagaaagagaagaagcaaattcattcactatttgaatgtgtaaaatgccgggaattaagaaaagtgcgcacggagagaaaaaagaaagaaaaataattgccttttaacgaattttaagcatcgaaaagggccaaagggggggggggcggcaccaaaggcaaaaggccgtgcgcggaattaccaccacccattcgttatttgtgcttcgtatctcatcatttattttgctttgattattcgctttgctctcttaattttatttaaatggccatg

SEQ ID NO: 118235 - DNA, 506 bp, Heterodera glycines
  Promoter: Source sequence=SeqID_28191; Location=1..506; Strand=+; Gene=SeqID_58831
tctagagtcatgtgtcaaaaataaaagtgaaacaataaattgcacgttaatgtgttgccaatttgttgattttttgctgcattaaataaatgcaaactaagtgactcacgattttaaatttaggaaggtagactttaaaatgcaattggataaaaatgaaaataatgcataaataagtcgcggacatacaatgcatccttgacgcaaaaaaagattacgctgttttccggaactcaacgcggtagttacaacaaaatgaatattttactaacaaaccaaaaccccaagaaatcaaatagcattgaatttatatattgaaaattgttaagaactcatcatcaccttttttacggaagtaacttttaagttgcacaagatttatcagcttgttgccgaaaaagagtctttattatagaaaaataatttttatatttaaaatttatagatttgttattattatatttccgtcaagaatttaaatatcaattaaattaattttaatcatg

SEQ ID NO: 118236 - DNA, 191 bp, Heterodera glycines
  Promoter: Source sequence=SeqID_33889; Location=703..893; Strand=-; Gene=SeqID_63818
taattatccctgccggtgcaagttcactcatcacaatttacaatgcgcagggaaattttgcaggtttattcatttgaaaaatattataaattaatttatgttaaggatgtgcgttacgtaagcacgggaagaaaagaagcaatttagcagtaaacgagagaatgagctgttactgcaaatcccaaagaatg

SEQ ID NO: 118237 - DNA, 1003 bp, Heterodera glycines
  Promoter: Source sequence=SeqID_44418; Location=241..1243; Strand=-; Gene=SeqID_71902
gtccctaatttatgtagcgaacatcatgattatagcaacaacggcaaacaatattaaaatataataatttttgtttatttatagacgtattgcaatgtaaaaaatttgtataaatgaataactattaaaattattaaacttatattcacatataatgttggcaaacaactgactgatatttttgacagacacttcttttcacgaataacaaagaatatatatattcaatcgaaaagtttgtataataatattatatcataaaatttaattccaaacaataaattaataagtcatagcgctacttttattaatgagacatcaagtctgtacagcaggattttgcatatttcgtcaatttatcagcaattagatgaattattatattatattactcatagtaaaaaaaagtaaaaaataaaaaaattattaaaatgttaattaaaagaccaaaataataaaggtacttttttcataaatataaatttttgtgtataaattgtcaaaagaaatgcatttgagtcaaaagttcatttatctatcaaatacaacaaaaaatgaatttaaataatttataaaaaatattaattaagtaatttctggataaaggccgcgattttatcaagaaggtgaggatcgttaaaaattttattgaaaaagacggaaatcactgtgataaacccaaattataatatgataaagactaaaaggtctttttacataaatgacatgatagacacaaattaaaagatattttaaataaataatttttcgtgaaactatcagccaataattgattaaaaattatttattaaaattatatataaaattcctttattttttattgtatccaattaaacgggccataaaattcaaattggcagagaatatattaatgagtatttaaaatacaaatatttttttatatccttatttagcattccataaacttaaagtataatcaataaacgaggagatgcacaatttccgcaccgacttcaacatg

SEQ ID NO: 118238 - DNA, 59 bp, Heterodera glycines
  misc_feature (54)..(54): n is a, c, g, or t
  Promoter: Source sequence=SeqID_31780; Location=987..1045; Strand=-; Gene=SeqID_62077
tggtgcaagaagattttgtcaaatttgtgagcagtgaaaaattggcatgcattntgatg

SEQ ID NO: 118239 - DNA, 79 bp, Heterodera glycines
  Promoter: Source sequence=SeqID_11891; Location=2267..2345; Strand=+; Gene=SeqID_75400
ggtgcctatgttcattttttaaaattctttttatttggattttaattattttgacaggtataagccaattgatccgatg

SEQ ID NO: 118240 - DNA, 83 bp, Heterodera glycines
  Promoter: Source sequence=SeqID_2716; Location=6399..6481; Strand=-; Gene=SeqID_81228
aaaaattcgctttttgttctaaaatgaggtaaaataataaaattaatctgaaaccattgaaagaccaaaaaatattcattatg

SEQ ID NO: 118241 - DNA, 233 bp, Heterodera glycines
  Promoter: Source sequence=SeqID_7913; Location=2553..2785; Strand=-; Gene=SeqID_66358
tttttcgcctgtaattgttatttttttcataaaatacattgattttttaaaaagtagacttcaacaaatattggcattggcaacgcaagcagaatttattcaatttatgcaaagatcataaaattatatttgcgttggcaaacaaattaaatttcttcagcgtttttttcgccatttatatttccttattattattattaaataattattattttgttgattgtattcctatg

SEQ ID NO: 118242 - DNA, 268 bp, Heterodera glycines
  Promoter: Source sequence=SeqID_21328; Location=730..997; Strand=-; Gene=SeqID_51923
aatttttttatcccatttctaattttttttttcgaccccctcaacgtgggaggggcattggtaaaatgttatgcccctttttgaagcctcctctgcattttcatgcaatacctcctcctcattgttttgcaattccatcatgttcaggtgcacagagctcgcaacaaatggaaatttactctcaaagatggggtattttattaacaaatttgcacatttttcaccaaatatgtcataattgtaaatttttgtcttttttcaggtaatg

SEQ ID NO: 118243 - DNA, 68 bp, Heterodera glycines
  Promoter: Source sequence=SeqID_22895; Location=897..964; Strand=+; Gene=SeqID_53606
tgtatgatttggcttggttttttctttaattttatgaaaatcgaatttcagggtgtatggtcggcatg

SEQ ID NO: 118244 - DNA, 104 bp, Heterodera glycines
  Promoter: Source sequence=SeqID_29158; Location=1542..1645; Strand=-; Gene=SeqID_59701
catcgcgaagcatagcttagaaaacgcttagaaaaatcttataaatatgttaagctttcaaatgataccaaaaacatttgatttggatatagtgtgaaagcatg

SEQ ID NO: 118245 - DNA, 470 bp, Heterodera glycines
  misc_feature (49)..(49): n is a, c, g, or t
  misc_feature (60)..(60): n is a, c, g, or t
  misc_feature (62)..(62): n is a, c, g, or t
  misc_feature (65)..(65): n is a, c, g, or t
  misc_feature (67)..(67): n is a, c, g, or t
  misc_feature (73)..(73): n is a, c, g, or t
  misc_feature (91)..(91): n is a, c, g, or t
  misc_feature (95)..(95): n is a, c, g, or t
  misc_feature (105)..(105): n is a, c, g, or t
  misc_feature (108)..(108): n is a, c, g, or t
  misc_feature (110)..(111): n is a, c, g, or t
  misc_feature (114)..(114): n is a, c, g, or t
  misc_feature (146)..(147): n is a, c, g, or t
  Promoter: Source sequence=SeqID_10761; Location=1..470; Strand=+; Gene=SeqID_74010
aattgaatgaggtacattcaaagggctaatgctcttctacataggaagncttcatagtangnagntnttcggnaacgctttctcgggaaanttanaaaagatggngangnngtnaaatatgatgaattgattgaggattgcatcannattttttgtctacaatccatgaggcaaaattgatcgaagcaacttccgtgtcatcaaggacagtgaattcagtgaagccaaaccaaagaagggaaagaccaaagccacaatccaagcaaggccaaccaaacgcaactccaactcagcttcaatgttggagatgtgggaaaacgaaccacacccacagagaatgctcgcacaaatcggctaagtgtcccaaatgtcactacaccggccatttggagaaccaatgcgaaaaagtgcaagagtggcgccgcaaaaacttcaaagtgaagaaagttggaacgcttagcattggaatg

SEQ ID NO: 118246 - DNA, 607 bp, Heterodera glycines
  Promoter: Source sequence=SeqID_17463; Location=507..1113; Strand=-; Gene=SeqID_81950
ttatcagttttatagatgataacttttttctttctaaatgaatcaaataatttaaaatattaaatttatcctgtaattggactaattcggtctcgagatttgggactttgttttcgagaatcgtgacaaaaagtattcgtttttttgaaaattctttacataaataaagaccttggctgactttggcactaagacaaaacaaaattaaagccaatggaattttttttgatattattctgtaatgcttccaaacaggaaaaaagactaattgatggttacatttcgtcattaattataagaaattgaatttttacgcctaatttaaatagtcattttccgttaattaatgggcatgcctttcatatgaattaaatgctaattactgcattttcttcttctatttttatgttttacatcgtaattaattgatggactggttccgttgtgtgattatatttacgtttgttgaagaaaaaattataaaaaatgatttaataggcgaataaaatttcgttgaattacttaagcatattcatttttttgttaattaatgtgtttttcatgtgaattatatttgatgattacacgcactaattaacaaagtatg

SEQ ID NO: 118247 - DNA, 1003 bp, Heterodera glycines
  Promoter: Source sequence=SeqID_8894; Location=96..1098; Strand=+; Gene=SeqID_69559
ctggcaaaccactaaaaattgtcaccaccaccaccaacaccaataccacaggaacataaccaccgccaacaccaataccaacaggaacacaaccaccgccaaaaacaacaaaaacagcagcagcaaaatcaccacccctacaacaaaaactgcaaaattggttgtggatgagcagttgccagtcgcaacactcctcccaacattgattcaccaaatgtgcaaggatcgtcccggggaagaaaacttttatcagcaagccatctgttgggcactttttgcgctctatttaatggtgattgtcagtctggtacttcatcagctttgttctatctgttggttaaaaaagaaaaaggagtatggacagcgcgcagatttcgactattttgaggcaaagtcgggaaaccgcacgagttttccggggctgtttcccaagtgaccagctcccagcgccggacacgctacggtacccagcggcgctagttgtgaacaacgacccacactacaaacaaggatcccattggtgcgcgatttatgccccttcaaagacggaggaagcggtcatatattttgatagtctcacaaaaacaattcctcctattgtaaagacatcatttatggataaatttccaaaaggttttgttacaaataagcacccgtaccagtccccactcactaccacatgtgcaattcactgtatagtgttcatttatcatatggccttaggtcacccatttgatgcatttctgcgcatattagacgctagtgaaagccccgacatgtattctttgtgcattttgaataaaatgattaatccgtatttgtgtgtgcgtgccaattttagtctccctcggggaaagggcatagggaatgattgattaatttattataccacggcgcacatcgcgcgctgttggtgcctaccgcatatatacaatgaattgacgcgggaaaggctcactttttcgcaaaaataaattaaatatattaataaataataataatg

SEQ ID NO: 118248 - DNA, 994 bp, Heterodera glycines
  Promoter: Source sequence=SeqID_19243; Location=528..1521; Strand=-; Gene=SeqID_83988
gtacataattagtaataatttaataacaaaagaaaatgccattgctcacccaatgcaacatctgtggacactcaaataaaagtggacattgtttaaattgttcaaattttcatctttttggcaaactgtcgccgcctccccaaaaattgggcatcgtttcataatcaaactataaaaattgggttcttttttctccaccaatatcagcttttccctggttcgttcgttcaccacatcgaatggctcaatcattggcgttgatccaaaaatgataaaagtgtaactggtagaagttgtggcatggagaaatgcctaaacaatcaacgagtaaatggcatgcccaaaaaaccaagcattagcttgtttttcaaggcaaaaaaatgcttaagactcattcaagcagcatattaatcaaacagggctggtcaaaaatatacaagaaaaatggccaaaatatgcgcataaatatgcaaataaaatcgtgaaatatgcaccaaatatgcacaaaaatcgcaaagtattcaccaaatatgcacaaaaacttgaaaattaggggtgcaaaataattaaaaaattttattttttatcagtttttgcaattgaaaaccaaaaatttctcaagattttcggcagtgaaactcactgttgacccactcgcgcatccttcagatttggatttaggtaattttggcataatcaaattttttcctaagggatattcaaatcgaaaaatatttaatgaaaaatggcaaaatatgcaacaaaaaaaaattttgttcataaaatggcaaaatatgcagaaaaaccaaaaatatgcaaaagtcccggtttttatacgcaaatagcaaaaagaagatgtttttcatactaattagactgcgcagaatttttgtagaatttggtttcattttcaaaaaagaccaaaaaatgaacgaaaataaattgaccaaatttcgcgatgttggggcaaacaaaaaataaatcacgaaatatg

SEQ ID NO: 118249 - DNA, 239 bp, Heterodera glycines
  Promoter: Source sequence=SeqID_42413; Location=1..239; Strand=+; Gene=SeqID_70312
ggccctaaagttatggattgagctcacaattaaggcacctaatagcgcaaaatggcactgaaaaaaggcacaaaaatcccgacttaggcatgaaaaaaggcatttaaatttttttattaatgatttttagggagtaaaacacgtaaaaactaaccaaaaaactaaattttgctgatttattgataattcaattttataatgtttttcaataaggaaatttttaatcaagaaaaaaaatg

SEQ ID NO: 118250 - DNA, 147 bp, Heterodera glycines
  Promoter: Source sequence=SeqID_1268; Location=837..983; Strand=+; Gene=SeqID_46740
agtttgttttgctataaacaatttgatagtgttaattcatccatttcaactgcggataaaaaatcaaattctttattttaacattgtcagatcattttcaataacactgaaacttcgtctcgcggcaatttcaagtcgttgtcaatg

SEQ ID NO: 118251 - DNA, 239 bp, Heterodera glycines
  Promoter: Source sequence=SeqID_5822; Location=1067..1305; Strand=-; Gene=SeqID_46131
tttatttgtaataaaaagaaactgaatctatgaataacattaaagaaaataactggactaaaaaattgtttcccaatttttaggcggtcagaaagacaaataggggtagcaaaattttcaattaggtaaaataaaatttagttattaaagcgaaaattactgttcgatgagaaagttagagaaagttaaaaggggatagagacaaagacataagcaaaggaagggaaagaaaggcaatg

SEQ ID NO: 118252 - DNA, 232 bp, Heterodera glycines
  Promoter: Source sequence=SeqID_23088; Location=639..870; Strand=-; Gene=SeqID_53794
ttatttatttatttattccgacaactaaaaggaagtaaagaaaaaattatggtaaaaatacagtttttcatttaattactctgatgtaaaaaatcttaaattgaattacatactgtaaattaatgcctattggctggcaatgacaaaagcatggccaggatttaaacgaagcacttctcactttttttatcacataaattatataatttgaattttaatatgtatatagatg

SEQ ID NO: 118253 - DNA, 350 bp, Heterodera glycines
  Promoter: Source sequence=SeqID_1805; Location=1..350; Strand=+; Gene= SeqID_76084
ttttacaaaaataaaagtcttcaacaaataaaaattttttgaaaatagtttaaaaaactcataaaatattaattttaaaaaccaaaaataaaagataattttataatggagttactttatgtgaaagatggtaagacttggattcaaggggtaaagcaaaaatacgtttaatgattcttaaatggtgtataattaataggaatgaccattttttggcgtaaacccactagttcatggtgaaatgcatttttttcaaagtttaaaaatgtgttgttaaatcttaagttctttgcaataatcctttattttttgcttatatacaagtatattattatttttgctttaaaatg

SEQ ID NO: 118254 - DNA, 99 bp, Heterodera glycines
  Promoter: Source sequence=SeqID_11072; Location=534..632; Strand=+; Gene=SeqID_74409
tctttcctgaatatagttaaattcattctttaaaaaaagagggcggtttttttctttttttaaattatttaataataaattattaattttagagaaatg

SEQ ID NO: 118255 - DNA, 171 bp, Heterodera glycines
  Promoter: Source sequence=SeqID_37940; Location=763..933; Strand=-; Gene=SeqID_66910
tatttttcaataatttttaaatttaatagatactttagaaaaatggctatctatttttttgagaaattttctatgcaacaaacgctctcgaacatgaaacgaagtgcggtgcgccgtggccattttatttttcaaataatttttaaatttaatacatattccagaaaaatg

SEQ ID NO: 118256 - DNA, 320 bp, Heterodera glycines
  Promoter: Source sequence=SeqID_24200; Location=1131..1450; Strand=-; Gene=SeqID_54914
tcgctgctatccgtcattctcaattgttttccgtaattttacccaaatcgatttctttttccacccagcagaacacatcaaaatggtgttgttagtccgcggcgttacgcggaaactctcttctgactcggtttgtgtgatggctgcagggatgtcattaaaaatttttttttgttcataaccaatcagtagaaatactggtttttaaatcaaaattttccattaccgattttccgttaattatcgaccacaattataatttgtctaaattaagggaaaaagcattcaattttttttattgtctttttttgcacaaaatg

SEQ ID NO: 118257 - DNA, 989 bp, Heterodera glycines
  Promoter: Source sequence=SeqID_22173; Location=558..1546; Strand=-; Gene=SeqID_52832
ttattagtgcgtcctatatttcaaggacaaaatcatgcatattccattaaatcactcccgttagctcttggaaaaggcaatttcatgaataaattttttattcacaatcgtggcgcaaatgtaggggcgcaaatgtaggggcgcaaatgtaggggcgcaaatgtaggggcgcaaatgtaggggcgcaaatgttcggggcgcaaatgttcagtcaccctatcaaaatatgttttttatgttgctaaaaactcgctctgattgaaaggaaaacaggtaaaaatgctatttttgagcttttcatgcgatggcatatgcgcaaaaaaaatatgtaaaaacatataaatccgttccctgataataaatttgaatgtttcttttatagttttgttccctcaattaaattacattttttataaacaattttttccaaaattcctactcaatatttttcgttttaagggtgtttttttgtttcccttatgattagagaacgtaaaaaaggcacaaatgtttaataggcataaaaaattgggaaaaagcacgaaaatcccgaaaaaggcatgaaaaaggcatttaaaaattttttattaagtatttttagtgagcaaaacacgtaaaacttaatcaaaaaacttaattttggtcatttaaatggtttttaaattttttttttcgaataaggaaaatttttaaacctaaaattttttatcaagaaaaaaaaaattaaattttggcaatcaatttttgagaaaaattttcaattcttaggggtgtattttctgaatatagctaaattctgggttaaagcaaacagacacaaaaaaatattctttaatatactcaaaaaatactgaatcccggattcttttttcttaatgtcaacatttttttgttgttattttcttgtgacagactttaagcattcgtttgatatcaaaaagttagcattgatcaattaagaaaaattatggcacaagaagctaaggatg

SEQ ID NO: 118258 - DNA, 623 bp, Heterodera glycines
  misc_feature (590)..(590): n is a, c, g, or t
  misc_feature (613)..(613): n is a, c, g, or t
  Promoter: Source sequence=SeqID_6136; Location=1125..1747; Strand=+; Gene=SeqID_46187
tgctttaaattcaaccgtaattggggttttaggtgatcaatttgcagtcgaaaaaagtcattttccttcaaaatccgagaaaaccaagacggtatcaatttattttcgtgatcagtgacctcgataatcccaatatgaatttttttttaattttgtgaggaggaggaggaggtagcaaaacacggaagtacctaatatccatcaaccatcaccctgcgcaaaaatgacaagctaattggtacgaaatcacaattattcagaattttagattggacataaattttgacaaaaaaaaacggatacaaacaaatacatgtaccaaaaaatgcaaatgatcagaggaaaatgacacaattgtataaaaacgtgccttatatacacacccaaagcaattggtatttgcattgtcaaaaacatttgttgcgatggaaacatgttttcatgatttttgaaaacaaaattattttttcaaaaaaatggctgaggaatttgtctataaaagggcgagaatttggcatttccaatcatttcaatcgttccctttattctaatttgctattcttctatccacttcttcgactacaacaacnccatttcaagtgcacaacagcgntggacgcatg

SEQ ID NO: 118259 - DNA, 602 bp, Heterodera glycines
  Promoter: Source sequence=SeqID_9155; Location=1806..2407; Strand=+; Gene=SeqID_70427
aaaaatctctcaacaaatcataattttttacttaaaaaaatgagagacaatttaaagaaactctaattaattttcatttgaataaaacttaatttttttatttataataataaaaatcaaaaattaatcggtgagtgataaattgggaagaagaaataattcgtgtgaatggatcaaatttgataaataataaaatctcatcactcttttaattcccaaaaaatattcaagaatttatctcttttttaaaaaataattaaaataatttaatttaatttaaatataattcaaatttcttttttaatttccaaaaattcaaaattaataaaaattaatataattattttaatacattaatatataattttgaattgtaataattttgttttatcttttaaagaccaaaaattaatcagtgagtgaatgggaaaaagcacattatttgcatggcttatttttttgtatataaaaagacttaaaataattttaggaatttatttactaattatttgcacaaaaataagtatataattttataacaatttttattaatttgccaattttgtcaaggaaaaaagctcaaaatattttctacaaaaatg

SEQ ID NO: 118260 - DNA, 288 bp, Heterodera glycines
  Promoter: Source sequence=SeqID_9224; Location=532..819; Strand=-; Gene=SeqID_70678
aatttttaatggtcgcaattacgaaagccaaggcatatttgctaaaacaaagccaaattctgagtttcaaaatacaaatactttattttccaatgttcggtttttgcccccccattcaattttcaaataattttttctaacttaaaatgtggttttgtgaaccctcatttttatggtaatttggtacttttcttcttttctacatcgttttacaacagcatgcatttccttgccccattttgcgtgttcaatttaatttcctattttttccagcgaacccacgaaatg

SEQ ID NO: 118261 - DNA, 642 bp, Heterodera glycines
  Promoter: Source sequence=SeqID_16383; Location=1987..2628; Strand=-; Gene=SeqID_80776
tttcggccccgagttggcgccaccaatgaaacaatgttgggcataaaaattagtttttatgcttttcatttttagtttattgttagagaaggaagtaattattgattaggtgtatgaccccacgccacttcgccatcttccccctcccattcccctcattcagttgttattgtgcccaccgattttgacctcccaatttatattctctgcatttatttattattttattttcttcggcaaataaacttatttaatttgttatcttcggacataacaaattttggcgcagtcagcagctcaacgacagcgtttattttccaagctttatctcgtgctgatattgcttgtggtgattcatcataaaccgatctttgccatattttacggcacggtttatcaacaatctgtgcaactaaaccgcatctttgccatatcttacggcacggtttatcaacaatttgtgcgacataaaccgaatctttgccgtatctcaaggcacggtttcatcttcgacaagaaccgatttttgccaaatctcgaggcacggttatcgtctatttcaagccaattttacggcacatcatttctccgatttcggcaaattaaagtctgccgtgtgcagtttttcttcaattggccatg

SEQ ID NO: 118262 - DNA, 1003 bp, Heterodera glycines
  Promoter: Source sequence=SeqID_1116; Location=60..1062; Strand=+; Gene=SeqID_46598
gtcctctatgttgtatttgataagaaataatggttttaatgacaattttcgttaagttttttcaaaataatcatgaaatttatgaaaaattttggcaccctcccatagcctgctagccttgcatttcatcatcagcatgctccccagaaaattctcttctccttcattagtgttatagaattgatgagcgtaaatatgttatacacatgtacatagtagccacattattactataattgcaataattaattaagtaataattatcaaaacgtggaaaggcggggaaaggcccgctgagcacgcccaaccgcagttgtaatgcgcctggttttcattttcgggacacgtttgtgcaatttgtttcaattaagggacgtttcaggaaaaaacaacaaccaaaaaacgaagttcgttccactgggccctctctttttttctccgctgccgacgccccaaaaatctgggcgggacaaatttttcgatggtttcgcgcaaagaaattaattaataaaaaataaaaatgaaaggcaaaatcaaacaagacaaaacggaaaattgaaatgacttacgaaggtgaaaaagaagggaaaaaggcaaaggaggagagaaatgggggaggggggacacgtcccccaggggggacaaacagcgcaaaggcacaaaagtgtacgaaaatgcccgagggcaaaatgggccatgcgacttaaggaaaatggggtgatagaagaaaaaagtggcaaaatattcacatataaaagggggcagcaattctcgactccaccaactcagcagcattcattctctcatctgctgaaaattaaacagcttttcttcagtctttccaaaatgtgccttttatttatcaaaaactgaaattaattaactaaaaaactttcaattttttcggcattttaaattcattagttccaatgaaatcccttccctatccccctcaaaaaattggttttgtcttttggaatttcaaatttttagcgctaaaatg

SEQ ID NO: 118263 - DNA, 62 bp, Heterodera glycines
  Promoter: Source sequence=SeqID_7699; Location=1..62; Strand=+; Gene =SeqID_65666
aaatcgtttgttgctgttttcaggaaagcaaactgaaaggaccttcacttttttccgcaatg

SEQ ID NO: 118264 - DNA, 78 bp, Heterodera glycines
  Promoter: Source sequence=SeqID_32027; Location=1165..1242; Strand=+; Gene=SeqID_62340
aggtgaaatttagaattaaaaaaattaactgttaaaaataattagatggaactggaaagaaacaacttgtggagcatg

SEQ ID NO: 118265 - DNA, 60 bp, Heterodera glycines
  Promoter: Source sequence=SeqID_2766; Location=1506..1565; Strand=+; Gene=SeqID_81467
ggtccaagtttaagtcattttacacaaaatcacattggcatagtttaggtgctcaatatg

SEQ ID NO: 118266 - DNA, 979 bp, Heterodera glycines
  Promoter: Source sequence=SeqID_15110; Location=582..1560; Strand=-; Gene=SeqID_79285
ttctccgtttgttttattgggtttctttccaatattaattgtgagatttttatatgcatttgaccttttttatattgaaaatttgaaccgcatctttcacattgcttagctgtttttgaaagttggcaaaatttttattctctccctttataaaataaactttgtttgaacaattgtttcatttccgtcatatgatttccgataatttctttcataaccaacattgaattcgacgctaataactttatgctttgttaatttgataaattttttaatcaatggtaaaaaaattggcgcattataaaagttagccagtagaagttttgtttaaggtaaatcgatcgagtttcacatagcttagctctgagaaatttttttttgtaagttctgaccatagtcttttggccaccaaatttttgaacaaaagttttcagagtggatgaataattagtacatcgtacagggatgtaaaggaagtgagtttggattcaggatggggctaaatttgtgtggagaaagcttttatctacaaccattttttgggattttacacgactttttcttcattgactaggtagggaccgggaccaaaacacggacaactgagtacaactgagtgccggggtcccggttttgaacagttttgaccgggaaattcccggggttattcccggtcttcccagccaaaaaatcccgggttttcaacccgaaaagtcccggtcccggttttgcccaaagttcccagtcccgacctaccctagttaaaaccaaagaatccgctcccgagttattttcttgaattcgctaaaatccgctcagattcacagttaagttctgttgtaaggctattttggcataatacttagaaatgatggaatgaatgtttgtgttgttggcattgattggcatttattgattaattaatgtatttaaattgtaaaaattattttttaatacaaatgtttcttttttaaaaatg

SEQ ID NO: 118267 - DNA, 194 bp, Heterodera glycines
  Promoter: Source sequence=SeqID_14014; Location=441..634; Strand=-; Gene=SeqID_77984
tttttgggcttaaatgacatatgtatatagggaaggaagtaaactaaaagtcaaaaaccctctaataaaagatcatttcaaccatttctagaccaacactgagaaattcgaaaatttgaaatagaaccgaaagaattgtatagaaatggcattttctaaatcaaatatttaagagattttaaactggtaaaatg

SEQ ID NO: 118268 - DNA, 797 bp, Heterodera glycines
  Promoter: Source sequence=SeqID_3509; Location=2709..3505; Strand=-; Gene=SeqID_84975
atttattgatgtttttctccgtccatttccgtgcagtgtcctgctgattaaaatgaaaggtgccgtcccaaaataatcaatgtttttaaaaaagatggaataagcaaatgcaaggaggagagagagagaggggaaaggggcaaagggagtgcaaaggcatggaggaaaaacgaacggaggaaaagcaaatgacccattgccggtcaatgtctgcccttttatgtactttggacccggccgcagcagcagcggtggcagcacaaatgaaaagcgaacagtcaaaaagggagaatgaatggggtcattttggcgccagcccaacttttagggctataacttttttattttcaactaaatcaaaattgtcttggtatcattagaaagcgcttcacatgctcaattagtcttacaaaaagcacaaaatttttttagtaatataaaaaagttatgaagaaaaaactttaatttttttggatttttggcaatttttgtgttataactatttattttggtaattgtctaattgccaaccaatagatacaaaacagcttcttctaaacatgttagagctttcgaatgaaatgagtacaaagcaaaacaaataaacaaacaaacaaacaaacaataaaaggctaacataaatttattcaaatgaaagtgcgtgcacaaaataatcgaatgttttaaaggaatgaatgaaccaatcaaatgcaaggaggagagagagagaggggaaagggaggggggggggggaagtcatggaggaaaaatgaacgaatgagaagcagagaaaaatg

SEQ ID NO: 118269 - DNA, 826 bp, Heterodera glycines
  Promoter: Source sequence=SeqID_7227; Location=1357..2182; Strand=-; Gene=SeqID_64192
tctcgcgccttcttttggcttacaacaaaattcgatcatttgggttttaaaatcataaaaattcgtcaaaatcaaaggacatgaccttaaaaattcaggtaaagatgattgagtggaaaatgctgaaaatggcactatgtaaaattgggaaaacaaaaaatggaaagaaattaaaactttgaagagatggcaaaaaaatacgaagagtcatttgagaatcaaaatttcataattgaaaatgttatggaaaatttgaaaaataaattggaggacttgaaaaaaagtaattttaaggaaaaatggaaaataaaaaaaaggaggagaaagaggaagagaaaaattagtctgaagaaggaaagagtgcggaagaaagttttaagagagaactacgaacggaaacttttcctttttatttaatattttttggcattcgaagtttaacactgtcgtctgaaaattacaaattattgaaaaattccatattattatttttgtttgtattaataggttttattcgtaagtctttcccgtgggagcatttaattgatttgaaatagtcatttaaaaggacaattataataaatattattaacataaattgccctttcccttgtgattttttgccaaagtgtgatcatattcgattttattttgtcatatgaaaaagggcaattttagcaatgatctgtaagcttcataagcttgcgaaattttggagtatttcattacatataaaattccgtattattattatttaaagcattttctgcataaatttttaataatttatttaatttttatttaatttcatattattattaaaatg

SEQ ID NO: 118270 - DNA, 180 bp, Heterodera glycines
  Promoter: Source sequence=SeqID_17827; Location=2643..2822; Strand=-; Gene=SeqID_82362
attgaataacacgaaaagccttttttattcggaatttgttttattaaatttgctcgacactcaattaccgtatcttacccggatcatttctgctattccccattacagtacctcgccttgacttactccgacccttgcgactgtttgtcccccgtttggttggtttacgccgtccgaatg

SEQ ID NO: 118271 - DNA, 579 bp, Heterodera glycines
  Promoter: Source sequence=SeqID_21; Location=7037..7615; Strand=-; Gene=SeqID_78596
ttgttttaattataatttacaaggattatgtttttaggttttactttttattagtttggcgcctaaaaacctgtttcggttgttcatctgctcttttttagttttccttaattttcctaaaaaccttaagaaaatgcaagaaacccgaaaaatttcaccaggggtgcatatcgccaaaaacaacagaacaaaaaattttggccgccaaagtcatcaaaaaataatcattaaacacattgggaaaaatttaaatgatgggtgaatcttttttaattttgagtttaaactagagtagagcgggaccgggactaaaacacggacaactgagtaccgaggtcccggttttgaccgggaccagtcccggggggttttttcccggttttcccagccaaaaattcccggtttttcaacccgaaaaggtcccggttaagcccaaaattcttattggttatttccacggtactgagcacgaatctgccctacccctcaaattcaaaaaatttctaattttaaaaaagaataaatgaagattaaatcaaataatataattatttaaaaattatatccgaggcataaatg

SEQ ID NO: 118272 - DNA, 174 bp, Heterodera glycines
  misc_feature (56)..(56): n is a, c, g, or t
  misc_feature (83)..(83): n is a, c, g, or t
  misc_feature (85)..(85): n is a, c, g, or t
  misc_feature (145)..(145): n is a, c, g, or t
  Promoter: Source sequence=SeqID_44596; Location=1070..1243; Strand=-; Gene=SeqID_72066
ctcaaaatcaatcacataatagcagaggaattcactcctgtgaaatagagaataanaattcaaacaaaatttgaaattgcccncnaactttcaatttaaaaatatttattttcaaaataaatttaattctttaaatgcctcattnaaagttgtttttttaattaagctcaaatg

SEQ ID NO: 118273 - DNA, 567 bp, Heterodera glycines
  Promoter: Source sequence=SeqID_21050; Location=289..855; Strand=+; Gene=SeqID_51638
aattaaaaaatatttaaataaaaatcttaatttgttatcaatacggtaacttttcaatccattataatgaacagagaaggagatttttttgcatgaaaaatcacaaaaatgaacaaaaaattttgtatttaatttgaaaataaaatatataattataaatttccaatatttaaaatcaaaattggtcatgaataaattttatgcattaatttttgagaaaattttctcattttcgtagaggtaatcaaattttctaaatttatttaagtctatatttatcagtatgttttcattttcattgtgtttttgttaagggatttacgaaaattttgcaaatgtcctaaaaaatgccaaaatcggtgcaaaattatgttcagtctaaaactgattaaaaacatacaataaaaataatgaaataaagcaataaaaaagcatttttcatttttattatcgaaaatcttaactgatttttctcaaaaattaatagttttttcaaaaagttttaaatattgaaaaactaaaatataatttcctgaatttttcgttcacctatattcattaggaatg

SEQ ID NO: 118274 - DNA, 178 bp, Heterodera glycines
  misc_feature (93)..(93): n is a, c, g, or t
  misc_feature (110)..(110): n is a, c, g, or t
  Promoter: Source sequence=SeqID_36962; Location=674..851; Strand=-; Gene=SeqID_66157
catgctgattttgcttaaattggtatttttgtgcttaatgctaagaataaaaatgaaaaaaacagccctaagaatcgcataaatatttatatntaaacaaatatcaaatntcgagtttatgataagaaaaattttaaaagaattttagtaaaattattcataatgttagttttaaatg

SEQ ID NO: 118275 - DNA, 211 bp, Heterodera glycines
  Promoter: Source sequence=SeqID_2083; Location=2203..2413; Strand=-; Gene=SeqID_77760
acgaggtccaaaaaggccgtaatttccgtaattacgcccagccctgtttaggacccttcaaaatttatttttgaccgatgaaacgcaacgcattctgtcacttgacgacactttgccaaagtttctgatcacctgccctttgcgttcttatccttcttcctcttctccgtctttttcacacaaatcgtcgccattgcctcagcctacgatg

SEQ ID NO: 118276 - DNA, 85 bp, Heterodera glycines
  Promoter: Source sequence=SeqID_4137; Location=1137..1221; Strand=-; Gene=SeqID_53334
tatgttttagataccgactccatctactacgtcaacaagagggtgggtccgtgtgttagcagagggcgaggcgctggggcagatg

SEQ ID NO: 118277 - DNA, 196 bp, Heterodera glycines
  Promoter: Source sequence=SeqID_24271; Location=1..196; Strand=+; Gene=SeqID_54994
aggtccccccacgaagccgatgatgaccagtatattatgggagagacacgaatccattcgtggaatagcgttccctatagcctgtactttaattctgcgttggatttttgctccccataagtgtttgagtaccccaaacggacacttgaaaaaatcgatttttttgattcataaatatttttttcagaaagacatg

SEQ ID NO: 118278 - DNA, 51 bp, Heterodera glycines
  Promoter: Source sequence=SeqID_36715; Location=1..51; Strand=+; Gene= SeqID_65968
attgacgataaatagtaaaaaattttgtcattgcattttagatttaaaatg

SEQ ID NO: 118279 - DNA, 620 bp, Heterodera glycines
  Promoter: Source sequence=SeqID_6085; Location=1..620; Strand=+; Gene= SeqID_60262
aatgtctgattgtgaccagcgactctgaaaacacacataagcatttttaaaagattttttacggaccaacctgatttgtattactttgtcacgcacacattcttgacaattgagagtttaataaaaaaaataatttccaaaattcttacagctaatccgatttcaggaaattgcgaaatttacactaaaaacaaaatttaatttaatcattgcaacagaagaatatttggtacttcgggttatgtcgccccccctcaaaaaaattccaaaattcgtaatttggggtttccaacttcgctgatcacgaatatgatatttattttaacatctgatgacttttaatcatagatttgacaaaatatctatgattttagaaaaataggcttagaatcacatttgaatattttacaaattaatttttgatatatcattttttgaaaaaatcgattttttagggataaatattttcaagctataaaaaaattatattaagaaaaaacttcaaaaatgttgatttttttagttttcatgttatatcttttttgataattgtcgaattgccaagcaatagcttagaaaaagcttctaaacacattaagctttcgaatgatagcaatatg

SEQ ID NO: 118280 - DNA, 633 bp, Heterodera glycines
  Promoter: Source sequence=SeqID_1042; Location=1..633; Strand=+; Gene= SeqID_66811
atgaaacgggtctggggttcaaatccgcttggctgcggattattttttatgacagccaatgaccgttcgtgctttatttgcgcacatttatttaataatgacatacaatgtcaattgttaaccggataataatacgcaatactctacaacatctgtgcttgagtttttacgctcatttaattttttttaaattttggaaaaaatcaattacttgatgaaaaatcatagataaaatcaatgattttgcaaaatctgagctcagattcgtaatcggcacattttttcgccctaaaaaaactaaaataaaattttttaattaatttttcgtcgggaccgcaattctgaaggattaccgaattccgatttccgaaaatttttggggcctcggaatgccatccgtgccatggacacaaaatgtcatgggacgcgtaaaatgccatgggacgcgtaaaaccgtctagaaccttttttaccctagaaaaaatgctttttgaaattttactatttttccgtcgggaccacaattccacaccattgccctagaatgggtgtcaatcaatcagaccctgaaaacccaggaaaggcgttttagattttctaaaaaatttattttcagaaaataggagggacatg

SEQ ID NO: 118281 - DNA, 392 bp, Heterodera glycines
  Promoter: Source sequence=SeqID_3112; Location=391..782; Strand=+; Gene=SeqID_83248
tctaaaaaaatcaataataattaacaggaaaattttaaaaatattgaaaattatttaaaatttaatttttttttctttattttagagccaaaaagcctaaaaagttttgaaaaaagttatttttgcctattttggcgttatgcctgaaatttaacaaaaattttataaaggaaaaatactctaagaattcgaccctaaaatttcagaaatacacgcttaagaaatgaaatgaaaagttttctcgcacatctccatgattttgcaaaacaaatgtatattcgtgatcagcgtcataaataaccctagaaactttttttccgaaattaaacaacaggcgagacctcccgtgaataaaaaataaaattctttttgcttgttttaggaggataatg

SEQ ID NO: 118282 - DNA, 917 bp, Heterodera glycines
  Promoter: Source sequence=SeqID_20187; Location=194..1110; Strand=+; Gene=SeqID_84980
atttttgccatcatttttctcttaagcgctgctctgttggtacgccactccgttggttctttcggctggcgctgcactgttggaaggagtaattcgaattcattttcgcttttcatttttctccagggattcagaatttcatcttctcataaattagggtattttcgactctaattataaaagattcaaaatccttctcaaaatgcttattcattcgggtctctctctctctaaaacgactcttttatttgtatttagggtaatttgttgtttttctccacaggtttcttcgttggtgatgggtttgggtgcctttctgcgcagttttttcccagaactcgtcgcctcggggctcgccttcttttccgcttacgttttgggcaagaaaaaaatggtcgactgaaaataaaccatcgaacggagacggaaaagagatattatgtgcctatgtaaattttactacaccgaattatgttttttttcaatttattttcatgaataaaatggctaattattttatttcgaatttacaattgggtaccgttccaagttttaatctttaatcatttttaattcgtcggttttgccatatttggtttttatttgtctctttttcttttagcttatgtgctcaaattttctgtttgttttccgttttcaaattgtttctcatcagcctttcctccgttctgccttttctttcacttctcatcaattctctgctcagtatttgataattcaaaatacacaaattaaattaaattaaacgaccataaattggaatgtttaatttccaaaatttaattttcacaactaattcaaaattttctttttctaactgccacaaattgtgcactttcagcattcgtcgcaaccactttgtctgctcatcgttctccacaaaaacgaaaaaaatg

SEQ ID NO: 118283 - DNA, 176 bp, Heterodera glycines
  Promoter: Source sequence=SeqID_25511; Location=473..648; Strand=+; Gene=SeqID_56254
tttttaagacccatgacaatttctgattaccataaccacaagccctaacttttttttgaattttaaaaattttcaatttttaagcagatagggcttacataatcattaaacgctgattagttaattagtgttaataaaaatttgcaattttttcagtttgaaacaatccaagaatg

SEQ ID NO: 118284 - DNA, 52 bp, Heterodera glycines
  Promoter: Source sequence=SeqID_19683; Location=2115..2166; Strand=-; Gene=SeqID_84423
catggggacagaaaaagaagctaatggaagcagcagcccattatcaacaatg

SEQ ID NO: 118285 - DNA, 258 bp, Heterodera glycines
  Promoter: Source sequence=SeqID_22605; Location=1102..1359; Strand=-; Gene=SeqID_53272
tccttcgtctcctttgcgcttcccttctttccgttccgtttttgccaatgtttcgccgttgtccgtcgcttcgtccccttcgcttcttcgtccgtccccctcccccttttctctcccttttgtcccttcttttcctttcgctgctttcagtcaattcgcaaagttacgaatcgtcagaaatgagaattatggaggaaagaggtgacaaaacaaagaaaaagtgaacactttggcttggattaaggcggaaagcgaatg

SEQ ID NO: 118286 - DNA, 185 bp, Heterodera glycines
  Promoter: Source sequence=SeqID_8573; Location=4450..4634; Strand=-; Gene=SeqID_68574
aattagccaaaattgcgaaaaacattttaggttttatgagagtttgaacaaatccacgactttcccattcaaagaaatgcgcgaaggcggggcacaaaagaaacttttgcaggcacattcgattcaagagtcgctgcagctggtcgagactccctctcgaatcccctctctaattgccataaatg

SEQ ID NO: 118287 - DNA, 90 bp, Heterodera glycines
  Promoter: Source sequence=SeqID_823; Location=3938..4027; Strand=+; Gene=SeqID_62117
atccgtcggggtaacaaattatacgaaatgaaaattgcgaggggcgaaaaaaatccggaaatcatcgtaagagacagctggaaccttatg

SEQ ID NO: 118288 - DNA, 1003 bp, Heterodera glycines
  Promoter: Source sequence=SeqID_13337; Location=302..1304; Strand=-; Gene=SeqID_77207
ggggccccccccccccccccccaaaaaaaaaaataaaccccccaaagaggcaccccccccttttaaccccatttttttttttcttggggggggttaaaaaaaaaattttgggactttctcttttttttaacggatttttattttttccttttaaaaaattttttttttcgggggccaaaaccttttttaaaaattttataaaaaaaaaaatcgcttttttaaaggttttttttttcctaaaaatttggattaaaaatttaaaatttttttatccccggcaaaaaaaggaaaattttgaccaatttttgttaatgtttaaaaaaccttaattcgttcattgtccccccccttcaaaaatatttttcatttagggtgttcccgcgttcccggttcttgacgccgatccctgacatttttgggcctattccccgccccgacccccgacatgtcgccccccgaggtccccgaccctcgacattttgcccccccccccgaggggtcggggagcaatcctaaattaaattattaaaaacaaatttcataaataaaagaataattgcatctcattattttcaccagcagagattgaagcccaaacgaaaagtgttttttttattcgtaatggaggaatttaaaatgaaaagggaatggaaaatgaaatgctgatcaattgaaaaataggctttcacaatatgttatgaagttttgtcattaaaaaggataaatatagaagatagatctataaaagatagtattttaaaaatacaagataaaaagtcaaaaagtaattataaagataataaaaaaaaataattcaaaaattaaattattaaaaatattatttacaaagataattttaattgaatatctttatatccaccccaccgatgctcattccttaagtgttaaccgagacagttcatttaaagcattattttataattaattttcgcacatttttctttcatccataatattgtgttttttaggaaaagtaaatatg

SEQ ID NO: 118289 - DNA, 214 bp, Heterodera glycines
  Promoter: Source sequence=SeqID_34133; Location=32..245; Strand=+; Gene=SeqID_64010
gccacatggggaaacccttgaaaaacaacaattgttgtgggaaacggtacagaaaaatgttggaattttgaacgaggaacagagtgaagaattaagagaattgtgtgaaagttttggagaaatttttgcggcaagggacgaatatttgacccaaacatatctggtccagcacaaaatcgaaacgggtgacgcaccgccgatcaaaatcaaaatg

SEQ ID NO: 118290 - DNA, 725 bp, Heterodera glycines
  Promoter: Source sequence=SeqID_2766; Location=576..1300; Strand=-; Gene=SeqID_81468
tttattttaggtttaaagtgttttatgcgctgagtcgcttaaaacaatgttttgaatataaaagaaataaccaaaattaaaaacttaaattgaaaagctaattttatctagaaaattgctaattgtaagagcattttgaacaaatttttcgttaatgtaaaaatttttgatttgaatttatttaaatgaaataacatttcgccataagaaataaaacaaaaagcgctattttaaatcctttaaaaattgcgtttcctcacaattccgggttgccaaaatgctataaatcgtgattcttctgagtaaatttgggggtcgtaattccttacttttccccataaatattaatttgttttttaagattttcattagtccattccatcatgtccaatccgctctcattttccttcctttgccgtaaatgttttcttcgacccgttcattttcattcacaacaaaagcatggcatttcttcacttttgaaagggaatgccgacaattttgtcgtcgttatgtccaacagttatttggccgaaggatttacggaaacgtttaaatgtaacgaagttttttgattttaattttcgaaaaactataatttagactaatttaagggacattttttttggaaaaaaatacatcaaaagtttttaagcgtatccaaattttcaaaatgtcaagaaaaatccataattatgcccaattaatatttgtgccatcaaatg

SEQ ID NO: 118291 - DNA, 803 bp, Heterodera glycines
  Promoter: Source sequence=SeqID_256; Location=4166..4968; Strand=+; Gene=SeqID_79948
ggactgggatttttaagacaaaaaaaccaaatagttacctaaaaaaatttttaaaattaaatttttttgccaagaaagtaaatttttgagaaaattttttttcattgcataggagtatattttgaaaaattttagcttgattcttaggggtgtattttttgaaatttttttaggtagattcttaagggtgtataaaatgaatgcatcattactaaaaatgaggtgacaaatttaatggatgtaacggaacgaccgctcggcgtagaatgttgagaataaacggagaaaatcgatgcaccaagaaaatggcaaaagatgcagaaactacaattaatgtatatatatatatatatgaaaaaaatagatttttctacgacaaaaaaatgtttaaattttttgaaaatccaaaaaaaaatgccaaatttagcagattttcaagaattttatcggttttcaaacaattcagagaatttttcagccctggtacatccctgctgtcccatgatgaaagttcatccaacagactttgttgcctcatcccgaccaatttaatcatggaaattttcaaaaaaaaatttttttttttttgttttccggtgccagtataatgcacaacattcttgagctatttaatttttttttgtaaataaatcagggtatgaatttgtccttgtgtgccattggggaaaaaaagaaagaaaatattccataataaaaaacaattttatttaaaaaattacaaggaaataaataagggacagttaagcaaatgttggaaaaaatctaaaaatgtacaccttatg

SEQ ID NO: 118292 - DNA, 162 bp, Heterodera glycines
  misc_feature (26)..(26): n is a, c, g, or t
  Promoter: Source sequence=SeqID_25431; Location=1114..1275; Strand=-; Gene=SeqID_56168
aaagaaggaaatagtgcactgtctgnctgtctggcttcgcttctaaaaaatttgtcccaaaagggccgaacaaactgaatgagtaccagattcagacccttcaaatcacccatttcctttattttactcaagcttaattttcagcttcgaacataaaaaatg

SEQ ID NO: 118293 - DNA, 1003 bp, Heterodera glycines
  Promoter: Source sequence=SeqID_273; Location=1686..2688; Strand=+; Gene=SeqID_47382
aggggggggggattaaatgccaatgtcagttttatggcgatgattcatcgaaaaaattttcggattagcatacagcgaatgaaggtaatccatgttgggttaacgggaattgttcccttaattgtcgagaattcatgtttcgaaaatggcacaaatcagtttgacctatctatttaaattttgaaaagaatcaagaaaattttaaagaataaaaattaaaaaagggcttgtcaaactcaatctgatcaatgaactataagtgattaatccatctggtcaatggaccgtcagatcaatgttatgatcaataattgatcacttctctctcgattggtgactttagagcagcaaaattaattcagtcctcgaaaatccctagccaatttgagcagtgtgatcagcttcaagtttcgaaaggcagtttcaaatgggataagactgatcagatcagtgcattgatcggctgtttccacccgatcagcggcttccacttacaagcgtcgatttccgattgttgtacatggttagctgcaaaatgtccgttttcaacaacagatttgcttgatgaggatgaacacttgtacagccggcgttgaatgcgcgaaatcattgaggaatcttaattcattaattgattattttaattgaatttgagtaattaaaaaaaaaatttaaaaaaacaatacaattagtctattaaaattacaaacaaaaaaattcattttgttgtcagcaaaatttttcaaaagcgaacaaaatacctaaaaattttgccaaaattctttgtcgtatttttcggtgctggtgcatttcctaaaaacggtgctatgtcgttacttaaaaaaccatcattatgatttgatgaaaaattatttataacttagctgaaaaacaacacaatttttatttcttaatatgattcgatagccctaagtgttctctatcagtctacaaaatttcaaaaaaatttcattaagtttcaaaagagttagggccaaagatg

SEQ ID NO: 118294 - DNA, 354 bp, Heterodera glycines
  Promoter: Source sequence=SeqID_32199; Location=1..354; Strand=+; Gene=SeqID_62525
gaattgtatcgatgcgagcgttgattttgtctatgtttgtcatggcattgtgttgaacttttgttattttcgcaccgtaaattgatttttttaaaattttaattttcgactttttgttcgaattcgggtccggagttcgaaattggtcgcaatggatgtcagattcgtgatcagcgaccccgaaaaccccctagaaatgtgttaaaaaaaaattttttttatggtctgtaaaccacataaataccaatttttctattgaaatgcaaaagttgaagcggacgacttctttaatccagatatctggcagcccttttcatttatttttttattcagacataggtataaactaaaatg

SEQ ID NO: 118295 - DNA, 1003 bp, Heterodera glycines
  Promoter: Source sequence=SeqID_71; Location=3606..4608; Strand=+; Gene=SeqID_62103
aaatttgcaacaaataaaacacattttttccaattatctgctaaaattcataatgttatttaaaaactcgaagaaagctaattaacatggtaaattgattccggagttgagcttaacgacttcgtaattagttggtatgatgatggaaatttccacccggtcaaacattatttgaatgaaatgggaatgatgttctgtattttgttaattgaaaattataaattgtatagtttaaatatgtttctgcgcatgaagaaatgtgctaaaaatagcattcctactttaaaattttgatttggtgagttttgtagtccatataaatccatatttagcgtttttagtccatataaatccatatttagcgtttttagtccagataaatccatacatccctgcttgatagtgcctattaacctgcaaagtttcaaaaaatgagctgagaaacaaaaaagttatggccaaaaaacctcaaaaaattgcattttcctggccattttggcgcagcgcgccatatcttttttaaaacccaatataattttttgaaattttgcaggctaataaagaacatttagacctattgattaatatcaacattattttatttggttgaattaaaaaaaagttatgaatctttaaacttgtctgcgccaaaatgaccccgaccccttagaaaatgcttacaaatatcttctaaacatatagagctttctaatgataaaaagtttgtttgatttggccaacaaagaaaaaagttatggcttcataaagttgtctcagacgcagttgaacccaaccgtgcctatgcaccaatttttcactgccaaatgacacgaaaattcctatttaagcttggcaaattgcattcttcgccccattccttcgatcattcattcagctcgtttcacttttcccttcaattcttaaatcgccatgcttttccaatattaatttttttttttctaataaatttgataacatccttccttccttttaagcctaaatg

SEQ ID NO: 118296 - DNA, 1003 bp, Heterodera glycines
  Promoter: Source sequence=SeqID_4870; Location=2754..3756; Strand=+; Gene=SeqID_56023
atccccagtgccatccccatcggcgaccaatttcctaataattgcttcttctgccattaaataatctacaaaaagttttaagggaaaggatttgttttaaaatttcagacgaagttgtcagtatgtccgtttttcagttaagttatcactagagttcgacctttgtcatggatccaggttcaggtccaggccattttggccatttttttggcaacctggatttttgcggttgtttaaatttaattaaatttatttaaaaatatttggcattctgtcttaatattcaaaaaatgcaagggatcccgcggatcccacacaaaaaatcccttaactatatactaagtcagccgaagccccgcccctatttttgaattggcggttaaatgctgttttgttgtaataggaaaaagaaacagaaaattaaaaaatataattggagattaatagagaaaggatgggtagaagagagagtgcagtgtatgtttctctgtcggcgcggatgggaggggtagagtgggtaacgcgtgcggttgtcacgcaggattgaatgcgtgcgagtttgtttatgtgtgtgatgagtgtgtaggagtgcttgggaataaggaggtagagaagaagaggaaaacaatagagagagatgaaaaaggaagcgagagagtgtacagaatgaagagattctaaaggaaggggagagagagaggactgagagagaaagagaagaagagatagggataaagagaagataaaggagaaaaagcaagaggacaattaaagagaaagcggaagataaatagcgattgagaatggggaaatggtaacgatagaaaaagagtgggaagactgagagatgacagagagagagagagaaagagagagagagatgagaggatgggagagagacagagagagagcagggagagagaaaaagagagaagggagagagaatgagaaagcaaagagagagatagagaagagaaagagctaagagagaggtgagaggatg

SEQ ID NO: 118297 - DNA, 562 bp, Heterodera glycines
  Promoter: Source sequence=SeqID_2870; Location=924..1485; Strand=-; Gene=SeqID_82063
taaatcctaaaaaatttaaaaaatttcagataaatgcgaattgaataactttctaggccaaaatttttactcaaaacactgaaagtttgctcattttccttttctctatcgatatgcaaaatttggggtggatttaacgtgtagaaaaaaagttaaacgtagcgaagtgaatgttgttttttacataattaaaatgaagagatagtacgccaaagtgagagaaattacaaagaaaaagagaaacgacgagatagtactaggcttttctctgcacagtggggcgtacccatagtgttctagtgaaaaatgagttcgaattttgttacaattcggggctggtccgaaattgatcgaaatagatgtccattttgtgatcagcgaccccgaaaccactcacaagaacatgttttacacgtttttaccaaaaaagtggggaacaacctgactattacccttttttccaacagtgtagtactgtcaggatctatattatgaaaatttcaccatttggtataactcatattcagaacctttcttccatttgaatcttttttcaaatatg

SEQ ID NO: 118298 - DNA, 79 bp, Heterodera glycines
  Promoter: Source sequence=SeqID_33481; Location=1297..1375; Strand=-; Gene=SeqID_63532
attttaatatttcttcagctacattgactactctgtgctcgcatttctccgttccaacaagccaatttgggacagaatg

SEQ ID NO: 118299 - DNA, 148 bp, Heterodera glycines
  Promoter: Source sequence=SeqID_14898; Location=607..754; Strand=+; Gene=SeqID_79062
cctggcaaaagaagaaaagggatttctattccaatgccatgccaagggattttcattccagtgccattcccttcctcctccgctttctcaccctttctcgttgaagaaagacattcatctggagcatgtcagtgtcggcaaagccatg

SEQ ID NO: 118300 - DNA, 1003 bp, Heterodera glycines
  Promoter: Source sequence=SeqID_868; Location=1325..2327; Strand=+; Gene=SeqID_62989
gcagtcctctgctccgtctgccttttcccccgaacaaacacctcccaggctgctcctcacagacacaattcatccccttcccaattccacaaagaagggatggtaaatgggggacgcggtttcccatggcgattcatccaaaatcaaattcaccccccccccgtccgccgctcgcgtcccttccgttctttaccctcctccccccgtcattatattcctgaagaacgaagactgacgactatggaaaagggtgcaaagtggggggaaacggggaaaaacaacaaccgatgaattcttgcaaatccaatcgatcctctgagaatgcattcaatatgtatgtgaaatatgcgacgggtgtaactgaaaaggaaaaggggaggggcaaaaatgaactgaccgatgacgccaaattgacgtcatcccattaattttgcaaaggaaaaggacatgacatgtaaagcagaaagggaaatgttgcgtttccattcatttgcaaaatgcgcgtaaaaggaaaattggattagaaaaagctaaatttgaaattggaaaaaaggaagtgtggaaagcaagtgatgcggaacacccatccattgagaggaattagttccaaccaaagcaattaggaaatccataaaggaaagggtcgaaattaaattgaactattttaaataaaattggcgttttgtaatttaaattaaatttcggaataaaaaattgttaaagttaggtgtggtggtgccaaataagtttgttacagtatgtctttttatttggtcactttgcgagtgctgagatgggtgcagtcgaagaaaaggaacccataaattatattaatttcggcgccttacacttacaaaacaacgaaatttattgttgtcgctttcatttattctatctttgcatttcttgtcgcgctttttaacctctttttgtgatgccatttacattggatcacttaattgaattcattttcctccctttttatagcacttaattaattatg

SEQ ID NO: 118301 - DNA, 1003 bp, Heterodera glycines
  Promoter: Source sequence=SeqID_5532; Location=2532..3534; Strand=-; Gene=SeqID_58363
gaccacgataaaaatctctgatttaaaaaagctcaaaatgatatggggaaattagaagatggagtgaacagagcttttcgctgcctgaatcgttccttgaaccaaaaagtcaattgggtgaaagatgtcgtggccaatacaaatgccaattttgagactctgaaagtccaattcgagaccttaaccgaaagagttgatatgttggaacaagacagtgattggacgaattcaggtggggctgttagtattactgcgccgtttgtgacccaatgggcaatgcacagcccaaccaagtcgtaccgaaccaagtgccaattcatcaattatcaagcgaagacgaagatgacaggccgactctttttggcctgaacatgctctcgagcggacccacagtgggggcaggtttggaaatgttctgtgaggagtctgtttttgcatttgatgattgggcagaacgtttcaaggactacctttccgtgtcaggcaaggcttacactgaacaagaaaaagtcacgagactcaaattggctctgagggacactcctcgggcactgtttaaggagttattaccagcacaaacggacactcttgactcagcattgagtgaacttcgacagaaattggactcccctcagcgtcgggaaattgcaaaacgaactttatcgctgtgcaaacagagggaggatgagacggtggcgcaatttctgagacgcttaactcctttggtggatgcgacaaattcgtcattaaccggtgtaactcgaaaagagaaaatttgcgaagaatttttggatagattgaagccaaacattagttttcttatccgtctggtgggtctatcacgagcaaaagacttggacttggtaagagcacaagcagaggagttggaggctttactattgatgaacaagggcgatgaagcatcacgcctttcaggcagtcaatgcgctgaacaatcagtcatcccagtcccagtggtctacagaagcaaaccagaataatg

SEQ ID NO: 118302 - DNA, 1003 bp, Heterodera glycines
  Promoter: Source sequence=SeqID_1563; Location=1694..2696; Strand=-; Gene=SeqID_74475
attcgtactgctccaatttgccgattcgtactgttcgacaaaaaagaaactgctctattccagttgtccattcaaagtttacgcgtccaatcagtgacttcctttgtttcctaggccatattttttttttacttagtcaatgcctatgtgatttgttgtgatttcacagaaatgttctaatttgagggtagtgaccaaatttagttctgatttcttaaacaaactcttaattttgaaattatgtggcatattgtataacaaatttaattgacgcaaaattagggggatcatatacacagcggcccaattttgggctacccgacttttggggatttgcaacttggggacccgacttttggggatccgacacttagggatcctgacatttggggatcccgacatttggggatccgacacttagggatcccgacatttggggatcccgacatttggggacccgacttttggggatcccgacatttggggacccgacatttggagaccgaacgacatttgagcaaaagacacttaagaaaaccacggacatttggcaacccgacatttagggacccgacatttggggatttcaataaaacaaaaaaaaattaaaaaatttaattctaagccacaaaattagaaaaattacgtctgctttagtcgctcgttgtcgaagcaagtaaaaagctggcacaactcgaatttcctccagaaaagagagcgcagccaaactccgaaccaagattttgtattcattatttgttgtgtaatagtggctaagtttcccggtcttcaatctacgattaattgcctgtcctaagtggaacaagcaaaaacgaatttgtaggctggcacaaataattcccttccccccccccgctctcgttcgttcgttcggcggcttctcaaaaacaatgttcaattagctgacgcgacggctggcacaattctcttctcccgtttttgtcattgctttacgaattatgaatatattttctagaaaatg

SEQ ID NO: 118303 - DNA, 312 bp, Heterodera glycines
  Promoter: Source sequence=SeqID_9855; Location=4983..5294; Strand=-; Gene=SeqID_72878
tcaaacacggacacaaagcgccggaggggtagaaactttcgtcccccacttttttggcactttctgagttttttctgatcgtgttttcgtccttaaaaatttcgtttttggttttcaaaatttaaattttcatttcgtttttgttagggtttccaaaatttaaaaaaaattgtttcttttacgtttcgtttcggtttttgaaaatttttgatttcgttttcgaaaacattttcggtttcgtgccaagtctcggggcatcaattttgtttacgctagcgggcgctaaggtaattagtacttattgtacatatg

SEQ ID NO: 118304 - DNA, 87 bp, Heterodera glycines
  Promoter: Source sequence=SeqID_763; Location=2262..2348; Strand=+; Gene=SeqID_60652
tctaaaaaagcagaattttgtcacatatttcatctgcctaatacaagtgggctatagaaattttatagactaatttaatttaccatg

SEQ ID NO: 118305 - DNA, 92 bp, Heterodera glycines
  Promoter: Source sequence=SeqID_19816; Location=566..657; Strand=-; Gene=SeqID_84555
ggtgaacgacaattttaaatgcttaatgattttatgagtccaatcgtcaacaattgcttagactttgtgctttcaattcgtatccaaaaatg

SEQ ID NO: 118306 - DNA, 483 bp, Heterodera glycines
  Promoter: Source sequence=SeqID_7378; Location=1308..1790; Strand=+; Gene=SeqID_64656
ggtgaaaataggtgaaaaggaaacaggtgaaaacaagtgaaaataggtgaaatttcacctaaaaatatatagggacgtgcatttaatggggcatattagagaatgtctcaactagtatcaataaaaagtgccaaaggaaaattttgtgatggttatcgctattacaaacataaaacgaccaagttcaaaatttggtggaaatgtgaacttaattcacatgggtgccagggctggggtttgaaaaggaagggttttttacaatgactcgccgacacaatcatcatccagacactatattgattgaaatcgaagaggatataaaatatcgtaatttttctgcgggggcaaaatgttttttgggtgacaacaagaattagttgatgatgctaagaaaaagccgagactccaaactgaatttagagacaaatttattgcatataaaatataaaagaaaaatttaataaatgaaaaataaaaaaaatg

SEQ ID NO: 118307 - DNA, 70 bp, Heterodera glycines
  Promoter: Source sequence=SeqID_12741; Location=498..567; Strand=+; Gene=SeqID_76448
ttccgatcagcataaaaagtggattcgggacgctgatcttgtaaaagagcgcaaagctaaataaaaaatg

SEQ ID NO: 118308 - DNA, 1003 bp, Heterodera glycines
  Promoter: Source sequence=SeqID_2707; Location=274..1276; Strand=+; Gene=SeqID_81186
taagaaaatggatgtatttttgggttaaattttgaaaaaaaaaacttaggaaattggtggccagccgatgagcgctgccggaaagatatctatctatccgagaaaacagagttagccgacatttgagtcgtgacgcttgaggcacagactattgcggcgctgatatttgcagcgcccacttttcaggcgcccacttttgcggcgcccagttataagcgacatttgcggcgccacacacgcggcgccgacatttgagtcgtgacgttaaggcgccgactattgcggcgccgacactcgcggtgccgacatttgagtcgtgacgcttgaggcgcagactattgcggcgccgacactcgcggtgccgacatttgagtcgtgacgcttgaggcacagactatgtattgcggcgcggctgggcggtaaaaaaacgcgtgatttttcggtgatgcaacatttgcggggatggtgccgcaaatttcggcacagatttaaaaagttctttttaatctgtttttatttgtttaaaactaattttcaatttttaattattaaaatacaaaaatagcgaaaaataaaattgttctttttgcagaatacaaaaacaaaaatttcttttgccattatggccaatccttcaaaaaatattgccatgctgcgcgaagcgcgctcctccccgtacattggcggcggcggaagcggcggcactttgccacctgacgcgctgcctgtttcaggcccgatgcacacgcgcctgcaacgcaatcgtcgaccggattcggccaccgcgccctacactgcacgactgcagaacgctgcaagcgctgaacattttgagcaggtgggggagaattgctaaatggttgggtgaacaatttggggagggggggggcaaatgatcaaccaaacttgaacaaatgatcaccccgaatgttgtaatttatcacccaaataaggcaactgatcacacacaggggacgattgaccaattaatctccaaaaaatg

SEQ ID NO: 118309 - DNA, 154 bp, Heterodera glycines
  Promoter: Source sequence=SeqID_14965; Location=1..154; Strand=+; Gene=SeqID_79122
tggccattacgattttgaaatacggtacatcaacaccgcatcatttggccaggctgacgttctctcgcgcctcatcgccaattatccccgaccagaggaggatattttgatcgccaacatctgcaccgaaaccgagtgctacatcagcaccatg

SEQ ID NO: 118310 - DNA, 308 bp, Heterodera glycines
  Promoter: Source sequence=SeqID_7943; Location=3286..3593; Strand=-; Gene=SeqID_66451
ccccccccccccccccctccccctaaggtcggtgtattcgtcctccaacccgtattcctactggccctaccgttaccttaccgatccgaattcggtcagtgttcgaatttcggttccgtccctctgctgaaccagtcccttccgaactcagcacgaggtgttttggcacgacgtgcacagccaattctcggcattgcgccgcctcgatttgttcggcaagcacaaaccctcagtgtgagtgcagcgtgccgtgccatttcccattcggaattcaattcactgttcgttccattttcagggattacatg

SEQ ID NO: 118311 - DNA, 109 bp, Heterodera glycines
  Promoter: Source sequence=SeqID_24873; Location=130..238; Strand=+; Gene=SeqID_55622
agttgagggaagcggctgcgcatcagctcgaccagttagtggtggttcattttggttttatttgcctttcctttccccctttagggccaatttggaaatacaaaggatg

SEQ ID NO: 118312 - DNA, 296 bp, Heterodera glycines
  Promoter: Source sequence=SeqID_24628; Location=770..1065; Strand=+; Gene=SeqID_55368
aaaaagtattcaatcgaattaaatgcttccattttaaatttaaaaattaatccgatttttaagctactggggggcaattgtcaaagattttggaaaaaattggtgaaatggaaaaacagaacgaaaacacggacaaaggcgagggaattttagcgaagaataaattatcacttattaaaaattctttttttttgaataagtttcttatatgaattaagaatttcatttaaataaattataacatttttaatttttgaaaattaattttaggaactttggagcaattttcaaagatg

SEQ ID NO: 118313 - DNA, 684 bp, Heterodera glycines
  Promoter: Source sequence=SeqID_18871; Location=194..877; Strand=-; Gene=SeqID_83575
caacaacatttcgtgaattgcacaccaaaaacattgaattgtcggaggcattggagcgaatgcaggagaaccaggacaaaatcatcgccaattatcacaacaccgagtaaatctaaaaatgaatcgccccttttttcatcactaaatttcccatattttgttttagaattgagtcactgaagcaagccaatcaccaatcacaggttcattatacatataattttgcataaatggttcatatttgtaatgaaaagcgattttatcgtgaaaaaccaattcaagttttataatgggttactatttttcaaaaaaaaaaacccctacaaaatcaccgaaaaaaatttgttaaagaaatttcggagagggggggggggtgaattgcaccccaaatttgtgtataaaaacgggatattttagaaattaatttgttcagccccgtttttttgttgtcaggatgatttgcgactgctgcgtgacaactatgctaagcaggagctgctcatccgtgagctgagcgagcagcgcgagcagtaccgacagctgtacgaacagcagcagatgatgggtgacaacacaacgccagcaaccacggggttgacggcgcccagcgcaaattcaaacgcatcgtcgctgtcctcggcagcaacaacgaccaacgctgtcgaccaaccgccgcaacaaatg

SEQ ID NO: 118314 - DNA, 640 bp, Heterodera glycines
  Promoter: Source sequence=SeqID_2661; Location=961..1600; Strand=-; Gene=SeqID_80954
tttttttgggaaatttcgttaaaaaatcaaaaaattcaaaaaccaaaaaaaccgtatattaggcctagctcgaaaaattttgaaaattttcgaaattttaaaatttggaaaaatccagctcattgatctctacaataagtctgctggccaccctacgctcaggtcaaagcctaatgagttattcaacggggactgaactggacaaagttggtactgaaaagttctagaagcacccagcccagggggttagagctagaggcctagaattttttttaacttttaggcaacattctcacttagggccctcacagcgggaattttttgatccgagttttagaaaaaaagttatgggctaacaaacgcaagaaaaagtgagaaatcggtccccgggactcagtcgtccgcgcagaatttttctctatatttttcccggatgcgcctcaaaaagttgtaagacccttccaccactttcagggcgctcccggccttcggccgggagaaaatggcctaatatttctatttaaattatataataaaaaataaattaaatgcttattttcaccgtaggtttgcctaattaatgagctgaacgggagccgaacactgctttcttcactgggcaacaaacgttggcctaatg

SEQ ID NO: 118315 - DNA, 56 bp, Heterodera glycines
  Promoter: Source sequence=SeqID_22634; Location=1..56; Strand=+; Gene= SeqID_53307
attaaactgccaatttataagtttagcaaaataataatacatttaagaagaaaatg

SEQ ID NO: 118316 - DNA, 1003 bp, Heterodera glycines
  Promoter: Source sequence=SeqID_533; Location=108..1110; Strand=+; Gene=SeqID_55521
aaattaatcttaacaatttttagattggattttttaaatttaaaaattttttaaattaaaaaaaatttttgaaaattacggattacgtattacggattacgccaaattacggactttttggacctccgtaatgacggattacggatggccgtaactgaaaaaattgccgtaattacggatttgaaaatcagttacgtccagctctggtgccaacaaatggagaatgcaaagcagagaaaaaaaatacaaaatttttggcattttttgagggttaaaagccatttttggcagttttttaaggaatattatttcgcgatttttgggaaatttattaacaaaaatgcaataaaaacgaaaaatacaccccctatttgcggaatttttcaaaggattagcgacaaattttaaggaatttgtctctttttaaaaaggattttataaatcttgttccaattttcatgttttagtctatattttcatgaactcccagaccctttcttaagcaaatgcaaattttcaaagactcgcaacttttttttctggtgcttcaagatgcttaacatttacattgaaaaggtttctcctcaccaagagactttgaatgataccaagaatgttcaattgcttcaaataaaattttaagaatgttcattgccgtggtgcgggctcgaacctgcacagttttcgctttattatcttacaaaatccacttatccatacgcaaattttcttggtactgatgttaattttcctgacgctgtatagaaataaaaacaaaaaattaaaatgtaaatgatatgatcggattaataaatgaatcatattgacaaacatccctatccaactgcgttttagcaatgctaaacggaaaaaatcgggtgagtaattaattcacttcaaacgcacaaattggacggactaaattggttagggtttcattgctttcatttttcatatcattattatcatccacttttgaattttccccaatttaccaaaaatg

SEQ ID NO: 118317 - DNA, 149 bp, Heterodera glycines
  Promoter: Source sequence=SeqID_7784; Location=731..879; Strand=+; Gene=SeqID_65951
aaataataattactctgtcttattgttagtcggacggggaagtgccctccgccggtggttacgctcagccatcgacggaaagttcggcctgtacagcaggcgagggttgttcagagggagaaggagccccccagcctgaacaacaaatg

SEQ ID NO: 118318 - DNA, 373 bp, Heterodera glycines
  Promoter: Source sequence=SeqID_3898; Location=2878..3250; Strand=+; Gene=SeqID_52344
tttggttgctgctcacttgtgcttgaagaattgtgcggcaagtagattaattgttgttgaagaaataatgggggaatgaaaatttagcgaatatttcgcttatttatatgcaatttttgtctcattatcgccagcaaaaactaatgtgtatataaagaggaaaggaatttctacgaattctcattccctgcttcattattcacattcatttttccatcgccaccaattgtgtgcacgcgtaatttctgaggcatgtttttttgttttgttttttgcaatttttctgattttattttatttttcattttacagaaaaccgacagttgctcacgttcaacaacagcgccattctcaacaacatcgcaccaaaatg

SEQ ID NO: 118319 - DNA, 87 bp, Heterodera glycines
  Promoter: Source sequence=SeqID_10142; Location=1765..1851; Strand=-; Gene=SeqID_73239
gctgagaatttaaaactcttttttctgttggtttttgagtttctgatcaatgatcataatttgaaggtgtgcaaaaagtgggaaatg

SEQ ID NO: 118320 - DNA, 270 bp, Heterodera glycines
  Promoter: Source sequence=SeqID_13644; Location=1188..1457; Strand=-; Gene=SeqID_77546
tgtgtaagtggcacaaaataaagctaattaagaggcaattaggctcattagtcatgtaattttttaactgtgaatttccctgcttctctctgtcatcgaattggcaaattcgattattattttccccgttcgccgttcaggcgccgtgcccagctgaccatcgttgccattttggtcttttccgtgtgctacaatttgatccgtttttgggagtaccgtatcaacaattcgtccgatggcgacggcaccgacgccaaaaatgagcaaatg

SEQ ID NO: 118321 - DNA, 51 bp, Heterodera glycines
  Promoter: Source sequence=SeqID_7813; Location=281..331; Strand=+; Gene=SeqID_66049
ggtgctcccccctgttggcgccgctttttttgtcccaatttccagcgaatg

SEQ ID NO: 118322 - DNA, 879 bp, Heterodera glycines
  Promoter: Source sequence=SeqID_19985; Location=1..879; Strand=+; Gene=SeqID_84752
atgcccaaatatgcactaaaatatgccttaaaactgccaaaaatagcttttaaccctcaaaaaaattccaaaaattgtgtaaaaattcagaattgacttttaaaactccaaaacataggttaaggagcgttttttagacaattgtaaaacattttggttttcaaatttataaatttttcttatatgctaaaacaaaattatgtttttatataaattaatttttttcaaaaaagcttacaaagtttaaaaatttctcgatttttaagggtgtatttttaaaaaaattccaaaaaagtcgatccgtagggggtgtatttttcgtttttattgcattttcttatgaattttgccaaaaatgaccgaaatatgctctaaaaacgcaaaaatggccaaatatgcatttattctcaaaaacccccaaaatatgtttatatatgcactaaaaaccttcaccaaatcaaaaattttaatgcagaaatgctattttgagcccctttcttcatagcatatgcgcagaaaaaataagcaaaatcatacaaattataaccctattcataactagggcatccaaaaatatggatataaaatcgcgaaaaagaaaaaaacacgatacagcttaaaatttactcattttagcgaaaaatcaacctgaaaagcgaaattttcgcttttttgcttatttttaatataaattacgcaatttttaagaaaatttaaatttaatcaatattttcgacaaaattttgctaaaaatgtctttttctgaaattttttaggggtcaaaaatgccaatttacctgatggggccgttatgatagaggttttttggaaaaaatttaaaatatggacataaaatatggataaaaatgccaaaatatg

SEQ ID NO: 118323 - DNA, 677 bp, Heterodera glycines
  Promoter: Source sequence=SeqID_34305; Location=1..677; Strand=+; Gene=SeqID_64128
tttattttttttgtgttatttgataagttcagcatttttatgcattaaattaattaacggtgtcttttcttcgtcctctgttttttaaaagctctttttaagcatttttattccttaatttaatttttaatacataatataacccctaatattacttaagattgattgatgattgatcgcttaatatattttcaataaactcactttcattttcatttatcattcattatacatatatctctcctccctttttccttatcatttaatgcctaattaattgtaatttaaattctttaaaattttgtgtctttaattctccggataaaatttcgtgaatcttttttcaattttaatttttccatttattacgtcccattctcataaattgccatttccatttccatgccaaagagttataaacttttattcctttttttttgactttctttcgtcaataaaaatcacacattttgtggttctgtgctgaaaatgcattggcaaaagaacggcgaaatgagtcgccgcgtttaagcgaatcgataaaatgcacagaaaatgagcaaaaaaaaaagcattttgcttcataaatttaaaatagacaaaaattattttgtttatacagttaatttatttagctaaatatatttttaattaattaattttttcgacttaaaatg

SEQ ID NO: 118324 - DNA, 155 bp, Heterodera glycines
  Promoter: Source sequence=SeqID_2909; Location=1..155; Strand=+; Gene= SeqID_82288
aaaaaaaaaaaaaaaatttttttttttttttttttttttttttttttttttttttttttaaaaaaaaaaaattttttttccccaagggtaaatggggatttggggaggccaaaatttccatcaagccctcccattggcctttgtttggcccaatg

SEQ ID NO: 118325 - DNA, 645 bp, Heterodera glycines
  Promoter: Source sequence=SeqID_25857; Location=614..1258; Strand=-; Gene=SeqID_56627
cacagtcgcctttggccagttgtggaacgaaaaaatgggaatatcagatggggtgcgctcttttctaaaaattcctcttttcgtctaaccatccctcccttttgtgcactatttcgtttcaaaattgaatcattttttttggctttttgaaataaattgtgaaaaatatacgaaaattattttcggttttaattatgctgtacaatgcttttaagccccgccgtgcggcggctccccttttgtgcactattttagtttttaaaattggttccggactttttggctttttgaaataaattgtgaaaaatatacgaaaattattttagcttttaattacgctgtacaatgcttttaagccccgccgtgaggcgggacagttccaaaattttgtaccacattttactgtggaaagtccaagtaccttattggacaactacgtgtcaatgagcacagtcgcctttggccagttgtggaacggaaaaatgggaatatcagatggggtgcgctcttttctaaaaattcctcttttcgtctaaccatccctcccttttgtgcactatttcgtttcaaaattgaatcattttttttggctttttgaaataaattgtgaaaaatatacgaaaattattttagcttttaattatg

SEQ ID NO: 118326 - DNA, 90 bp, Heterodera glycines
  Promoter: Source sequence=SeqID_12166; Location=1..90; Strand=+; Gene= SeqID_75739
ctatacgaccaaagtggcgaatttttgccccacgttcggctggccaaagatttggtggagaagtacgaccaccgtgtccgacccgtgatg

SEQ ID NO: 118327 - DNA, 475 bp, Heterodera glycines
  Promoter: Source sequence=SeqID_23700; Location=1..475; Strand=+; Gene=SeqID_54395
aatatttaaagatttaatcagtataaatacttctataacttcatcactagtcaacatcaggtccttaaactacaagtttagtgaacgagaaagaatcaatatataaataaagacaattaagcaaaataaagtccataaatagataataaatggaaaaatttatatttattaagtaaacataaatttgagaaataatgtcaagaacggattcagatttttaagcaaaaataaatcaaattaataaaattaaatgactttcaaattttcattaagggataaatatttattttttatttgcattattaaaacaaaataaaaagtagatgaattatattattcattaaattttcaatttttgataaaagaatatttctcaccattttcgaagaaataagaaaaatttggaagactggtttaaatagaaaagcttagctcaaattatattaatctttcagataaggatgaattaaatatg

SEQ ID NO: 118328 - DNA, 266 bp, Heterodera glycines
  Promoter: Source sequence=SeqID_4981; Location=2285..2550; Strand=-; Gene=SeqID_45950
ggttcgtccccgttagccgttaggggtcacattttgaaagctttgttgtattcaattagcggagagcgattagagaaggggagggtcaattatttcgaaactttgcattcaggtttgagaatttgagggtaaagatggaattaatgaaaccgtttagaaaaaaagccaacaatactttaactcgcgccaatcccttacatttaaatttctccaaatggcacttccccttacatacatacccatccacccaaataagtcaaattatg

SEQ ID NO: 118329 - DNA, 604 bp, Heterodera glycines
  Promoter: Source sequence=SeqID_15756; Location=1..604; Strand=+; Gene=SeqID_80082
attttactttagaggggttgaacaatagaaggcccccccttggtagaaggcccccttctaattaaaggccccttttttggaggggttgaacaatagaaggcccccctttggtagaaggcccccctctaatttaaggccactttttggaagggttgaaaaatagaaggcccgggccttcaaatacaggaaatacggtatattgattttcaaaaaagcatttgactcagtgccccatgaattacttttatacaaattggaaaaataggtataaggggcaaacttttgcggaccgggtcggttgggccccgccgattgggccccgccagttgggccccgccgattgggccccggtacgattgggccccgccgattgggccccatagagcacatggacaagggggggggtcagaataaaaaagttatattgtcaaatgttattgttttcgtgtttcattgcatatttgtaaatatatttggtttcatatttgttttctaatttttttatattttcccttttcttgattgcctaactaaaataccattaattcagcttattatttaatatattaatatcacgatggaaaataatatcttatcgaagatg

SEQ ID NO: 118330 - DNA, 401 bp, Heterodera glycines
  Promoter: Source sequence=SeqID_13964; Location=1260..1660; Strand=+; Gene=SeqID_77922
aaattgaaaataaatttttgtaaatttaaaaatgagcaaagagaagtttaaggcgtacaacacattaacaacatgcagcagaataaatacaatgagcaggaagaaagtaatgaaaaaaatgaaaaaagaaaaattgaaattgaaaatacaattataaatttaaatttaaatgcctatttaggcgatgagttgggaagaataggcagaacgggtgccaaaaatgtgaagaaaaataaaaggaaaaaacaaaatgccaaaaaaggaaaaggacgaaacaacggtaaacagaagaaaggtgataaaacgataatcaattaataaaatcgaaagattttgaacggattaaaacttaaaaaaaaattaaaattgaaaattgaatcacagattttcagataataatg

SEQ ID NO: 118331 - DNA, 270 bp, Heterodera glycines
  misc_feature (85)..(85): n is a, c, g, or t
  misc_feature (110)..(110): n is a, c, g, or t
  Promoter: Source sequence=SeqID_35587; Location=1159..1428; Strand=-; Gene=SeqID_65119
gaaaaattttttgcagatatttttgtcgaaaacactcaaaatgggaagaaaagtgctgcacagacaaagattttgtttaaaatancaatgtaggtgtaatttatttaatntaattaattttcctaatatattattttttggtaaaaatgccaaaattagtgccaagaccgcgaaaaacccgcaacttgctacatttgatttaaatagttataacttttttgttaattgtttaagcgcaaagcaattgtttggaaatagcttccaaacatg

SEQ ID NO: 118332 - DNA, 159 bp, Heterodera glycines
  Promoter: Source sequence=SeqID_26677; Location=247..405; Strand=+; Gene=SeqID_57436
aacattcaggtttggtttgggggaagcaaatggactagcaattttatcgaatttgggaggggcaacaattcaatagtcgaaaaatttgttacttattacactcaaacagtcctttttcccttctcatccgtccgatgttctctcccttttcatgtgatg

SEQ ID NO: 118333 - DNA, 190 bp, Heterodera glycines
  misc_feature (9)..(9): n is a, c, g, or t
  Promoter: Source sequence=SeqID_8213; Location=1..190; Strand=+; Gene= SeqID_46569
acggattgntattagggattttaagggtcggagaatccaatacaatctttgtaccagagccgcaaatagggatgaatttatagattcgtttattgtacaaaaaatcaatggatatttgtttaataggctgaatctctgataaaattcccttttaaatgtttttcctttttaaattcaagatgttcgaatg

SEQ ID NO: 118334 - DNA, 298 bp, Heterodera glycines
  misc_feature (261)..(261): n is a, c, g, or t
  Promoter: Source sequence=SeqID_10801; Location=2317..2614; Strand=+; Gene=SeqID_74063
atttgctctcgcacagggcacggcaacaaaaacacacattttcttggcacctttttaaatattttgttgtttgtcctacactttgtgctgtcctcctttttgatctgctgatgacacacaaatgacttgttgaaattgaaatgcgattgactgccttttttaattgtaatttttgttaacaattttttattcgcataaattagtgcaatttgtttaattagtcaatcaaaatgtttttggaaaaagtgatcccgccccccntaaaatgttttgttgtcagttgagtgagcgaataatg

SEQ ID NO: 118335 - DNA, 465 bp, Heterodera glycines
  Promoter: Source sequence=SeqID_25787; Location=1766..2230; Strand=-; Gene=SeqID_56530
catttgatggttttttgactaacgcccattttgttggtttttgactaacgtcccagcaccattgagatcattcgagcattattccctttggaatttgttcatttcaatgtttatgttttcttcttttctttctcagctcatctaataaaaatttatttttaagtttaagaattgagaattgggtcgttttgtttttttaacttttgggatattttgagcctggggtaaacttgcaacatccctgatgcatatgattaataaaattaggcattcatattaagcaaaatgaaaaaattatggacgtcataaatgaaaagcctttttttctcgcttaaattgattttacttaaatccattctataaaattacaattacgaattcaaagaataatcattgctcattttttgaacgaatgagcaaaacaaagttacattttacctattcttaagcataaaaataaatatg

SEQ ID NO: 118336 - DNA, 304 bp, Heterodera glycines
  Promoter: Source sequence=SeqID_20487; Location=610..913; Strand=+; Gene=SeqID_51029
tttgacaatataattttttcttaaaaaattaattaattatttatatattcatatttatctttataagcaaaatattgcttaatttcttcatataaatatttttaatttactttttatgtaaataattgaattttgaccattattaaagaaaaacataatgttttattctttttctattatcttttttcatattattattatacatcaatttttatttcacttttcaatgcaattgcatcagtaagcttattaatcagggtaattaatttgtctaatcatttttaattaggaagacgacaacatg

SEQ ID NO: 118337 - DNA, 174 bp, Heterodera glycines
  Promoter: Source sequence=SeqID_45224; Location=1..174; Strand=+; Gene=SeqID_72565
tgagctctgtgcttaagcatttgatttcaaccctttttattgcctttcaatcgctttaaatcggaaaatacgctatttttttacggatgtttaaactgttatatctcgtcaaatgttgtttttaatggggtttacactatacattcagtttttagagagtgaaaacaaaaaatg

SEQ ID NO: 118338 - DNA, 165 bp, Heterodera glycines
  Promoter: Source sequence=SeqID_17234; Location=270..434; Strand=+; Gene=SeqID_81701
tgttggcaagggaactttgaatggatcaacaatttcaaggaggtgtggccataatctcgaaaaatcactgatttttgttttcaaattgtttagcattttcttcgtgccaatgccatttcttccgtcagttaccaaattcatttttctgttcatgtgccatcaatg

SEQ ID NO: 118339 - DNA, 182 bp, Heterodera glycines
  Promoter: Source sequence=SeqID_19013; Location=2729..2910; Strand=+; Gene=SeqID_83749
atggcacaatgaacggcaccaccagcagaagaatttctttgtcgtctgaacttttgcaggcgccgaatgtttatggcattggcgatttgcgaatggaacaccggtggaggggggagacgacgccgcaggggcaatcggaggagggaaattgccaaagagtgcaaaagttgctgagaaaaatg

SEQ ID NO: 118340 - DNA, 77 bp, Heterodera glycines
  Promoter: Source sequence=SeqID_5997; Location=1653..1729; Strand=+; Gene=SeqID_59966
acggcgcccgctggactcaaccacttggccgaatcagagaagaaaaagtgggaagaagcgtccaaggaaacgccatg

SEQ ID NO: 118341 - DNA, 627 bp, Heterodera glycines
  Promoter: Source sequence=SeqID_14617; Location=1202..1828; Strand=-; Gene=SeqID_78698
tcactattttggcgttttgtcactatttttcactatttcgacattttttggaaaaattccttaacaaaaatgcaataaaaccaaaaaatacacccctaagaatcgagctaaaatttttcaaaatatactcctatgaaatgaaaaaaaattttctcaaaaatttactttcttggcaaaaatttttaattttaaaaacttttttaggtaattattttgggttttttgctcataaaaatcccagtcctactcatttgcaactgcaaatagtgaataaaaattatttttgctcaatttttggctgaaaattatgtcactattcgtcactatttcggactttttgtcactgtttcttcactattttgggatttttactcactattttagttaactatttcggtatttttcgtcactaaaagttgcggccctaataattacgtataaaagaaaaaggattaaccagaggccatcatgccaaaaagcagttgctgatcctaacaaatacaataagtgggattaaataatgccaaattaaaaattgtagaaaaaataaataaaatcgaaatgcctatgctttgctaagaaaaattttttttttcaaaaaaaatatacaataattcagctgaaatg

SEQ ID NO: 118342 - DNA, 68 bp, Heterodera glycines
  Promoter: Source sequence=SeqID_4792; Location=2104..2171; Strand=-; Gene=SeqID_55735
ggcggtggtgaaggcgtttcaattggttcgcatcggagccctttgaaggcccaaagtctgttcaaatg

SEQ ID NO: 118343 - DNA, 174 bp, Heterodera glycines
  Promoter: Source sequence=SeqID_16958; Location=1..174; Strand=+; Gene=SeqID_81385
attggaaatcgattgggtggtgcaaaaagtggtaatttgtatgacataatcgaccgatgaataatgaaatgaatccaaaagtaaagccccgcataaaatgttggaaaatgtttgctttgctgaccaataaataacattaatatttattcacgggagaagatcataagaaaaatg

SEQ ID NO: 118344 - DNA, 501 bp, Heterodera glycines
  Promoter: Source sequence=SeqID_8533; Location=698..1198; Strand=-; Gene=SeqID_68417
acaaaattagcccaaaatctcaaaatttgggcattttttagtcaaaatctgctagcaaatggcactaaaaatacaaaattttccccggcggcgcctatcggcaccgccggctcccgcgttcgcgaaatttttttgagaagaccgcgccgcaaaaaaaagagattttaaaaagcaaaaaaaaaaaaaggtcgtcaaaaattttggaccccgtcataaggaaaatcgcatatgaccacccccccctggcccgatcgtacgtcgtatgacccttggaagtgaccaccccttgtacacgtatgctgtgcaggtgtgtgaaatgcgattttttggaaaaaaattttgaggaccggcggaagggtgccgataggcgccactggaaattttaaaatttttccccacttttgtagcccgtgctgatgctcaacgccagcaaatggcaatggccacacagtgtgcgacgaatgcagcgactgttaacgaaagcgaccactgccaccaatg

SEQ ID NO: 118345 - DNA, 110 bp, Heterodera glycines; identical to SEQ ID NO: 98226
  Promoter: Source sequence=SeqID_5873; Location=408..517; Strand=-; Gene=SeqID_59510

SEQ ID NO: 118346 - DNA, 623 bp, Heterodera glycines
  Promoter: Source sequence=SeqID_26185; Location=1..623; Strand=+; Gene=SeqID_56932
atgtcaatggacgacagtaataaatcaattttattgttttgtttattgctggaaaatttgtccattttcagctacattttattatatatttaaaacattttcatgacaatttttattttattttcttttttatagctaatttattattttttctaatttaagctttatttaataaatattgctttgataagatatattatacattggctttggaccatatgatgaatgcttacaaaattttgtttttctgactataatccgaatatagcttttgcataaatatcggggcctagagagcaaatgtctaataataagctaatttaattttagtttttaaattttttcctaatttattttatccaccattaaagcagcaaatgtgtgcgtaaacaaacaccaatggatttgttttcccgtttttacgaatgaatcactcattcataaaaagcatttgtgctttgctttttttctttgtttgttatcgtcatcccattaaattccacgtaaaatttaagcatttttaattatttcaaagaaaattaagagtttaaatggtaaacatatctattcctcttcattatttgaacaatatttttatataatttcataataaatttagaatg

SEQ ID NO: 118347 - DNA, 645 bp, Heterodera glycines
  Promoter: Source sequence=SeqID_11997; Location=1..645; Strand=+; Gene=SeqID_47005
attaccggtttttaccggtaccggtaccggtaccggttgaaaaagttggtaccggtaccggtaccggtttttgcagtaccggtcagtaccggtaccggtttttttgcaattaccgattaccgctcaactctagttaatgctaagcgattagaaaatttacaaaaaaaaagttatgccttgaaaacttgaaaatattaatattttgcgaaatttattggtgtttcatttttttagtggctgataaagctttcaaattgccatttctgtaaaattagggcgaatttgaaaaaaagttttccgaaaatttgacttataaattgacggattggtcctcttcggaaaactgaaaaaaaatttttttttttttgctattcgttaaattataaaattattaaaattttatgagtcataagaagtgaaaaaaagaacataatgtcatgatttatttgccttctttctacctttactatataaacaaaatgtttttttttttttttttgttaatatgggaattcattaaattaaacattacagtaatgtccttcttccattagccctacaatttactgtagctacaatgtcaaatatagcggcatgaattatttttgctagtgaacgttttgtgtaattttcagtgcctttatg

SEQ ID NO: 118348 - DNA, 153 bp, Heterodera glycines
  Promoter: Source sequence=SeqID_6960; Location=1..153; Strand=+; Gene= SeqID_46337
aaggttaaaattggcgaagaattgtcagaaagtttcagaatattttcaggagtgccccagggaagtgtcttagggccattactctttttaatttttataaatgatctgccgtccgttattacaaatgaagcggcatcagttggcataaaaatg

SEQ ID NO: 118349 - DNA, 682 bp, Heterodera glycines
  Promoter: Source sequence=SeqID_4224; Location=2224..2905; Strand=-; Gene=SeqID_53667
ttatctgctggaaatctctttctgattagtgctgtctctgcttcaccaaacagattaatattaaatattcacccaacaaaaatatatatggatatatttcaacaaaaaattatttatttaaattagggttaagccccgtcccaattgtccccgacttttccctcacgagagtctaacatattaattagttagccacttcctgcaactctcagctttttctgtttcaattctcgcttaaataatgataaattccattcaattctcaatcatgatttcccgattttcttaaacagttcaatcgagacttaactatgccgataatttataattaaatgttgcaaacaagcaccagcagcagttgacaaatgcaagttaaagtgtcagcttatttcaccatttgacattcattttagcgctccaattattcgtcatccccaacaattgacattttctgtccgattattaatattcatcatgcccagaaaattttttgcccatttacataaatgaattaagtatcctttattaaagcattagtgaaaatcttactttaattgtaaaaataattaccgaattaaattaataaaaattattgttttaattgtaataaaaaattgtcgaattaaattaataaaaattctttttttatgtaaaaataattgcaaaattaaattaagaaatg

SEQ ID NO: 118350 - DNA, 263 bp, Heterodera glycines
  Promoter: Source sequence=SeqID_16139; Location=1..263; Strand=+; Gene=SeqID_80501
aatttataggtaaaattttgaaaaattttatgggaatttaatccaattcttaggggtgtaaaagtcgcgtttcgcgccaaaaagcgaaatgcgaaacgccaaaaaatgcgaataatgcgaaaggcgaaatgcgaaaagcgaaacctaggcacatctctgctacaaagtagggtgtttttgtcgctttgcccctattttttattcattttaactttttaaaaattcttaataatattgaaatactatataaaccaaccataatg

SEQ ID NO: 118351 - DNA, 1003 bp, Heterodera glycines
  Promoter: Source sequence=SeqID_7904; Location=2428..3430; Strand=+; Gene=SeqID_66330
tttattgaatgatataccataaaatcctgctgggccgtttcgtaaaactgccaagcttacagatttttcgagaaaaatcgtcataacttttcttaaccttacaaaataagtttttctcttaaaatctgtaaatttggcagtttttatgaaacgatctagcaacccataaatattaatttggttgaaaatgagccaatatacgaagccaatgtgatcataatatattcataatttagcttctaatttttttttgtttaaataatttttaatgaatactttttttttaaaattatattattcaatacaaaatttttctcaataggtatcaaaatttgagcaatattctatagagcgaagcgaatttagtttgtgcatttttctatcggcttctccatttattcatctatttcttttttaattttaattaaaatacaaaataatactaaagaatgcaaaaagaattatattaaaacaaatattaataaaggattaaaaatattcgaatggcaaaactcattagaaataaaatataaatcaatgatgacaactggtgaaaagagaagacaaatatttgtcatatctttaaaaatgttgaataaaactaatttatatttaaatatattttcaaagttaattttttttttgaaattctttatagcttcttacaaataatcaaattatatattttcaaataatatatagacttattactttataagtttccaaaatgttatacaaataatatttagcaaagttttttaattaaattcacttgcaaattaaacaagaagagaatttaattttcgatttttggaactattttttataaaaaaatcagctgccataatttgtatttaatctggattcgaaattaactgaggatattcaaagacaaaaaaaaattaaaagaaacaaaaataagatgcatttgtaaacccattccatcatacctatttaataaattttttaataaaataaaaacttattatttttagtttttatg

SEQ ID NO: 118352 - DNA, 1003 bp, Heterodera glycines
  Promoter: Source sequence=SeqID_2; Location=17264..18266; Strand=+; Gene=SeqID_50782
acaggtaccattgagcttttggaggagttcactgtgtgcaagacggttgaccaactgtccgcggaccagccccgcattttgaagcagttcggccacctgttggcacaattccgcatccgtctggtcgcctggtaaagcaaaaagaagggatttgaacagattgacggaggagcagatcaattgaatgaataattgatgtgtttttttggttggatcaatccacaatttttcttttttttaaatttttttttaattttaattgatttcatgcgattttaatttaaaattaaacagtttggtggttttttagaccgacttctatttaatattccaccaactttggaccaacaaaatctcaaatttaaggctaaatttctcaaaatctaattgaccaaaagcagaaattgtttattgaacaataagaacaaaaaatataattgttttccggaaaaagtaaaaacatgtttcctgtcttgttacagaaatacacctatttttcggttttgacagaaaagacaattgttttccggttactgtcgaaggttttgaatgtgttgaaatacaatttgttgcagtcaaacatccaatccaatccaccactttattttgttatttttttctaatttaaattggttttatgggattttaatttaaaatttagttgctggtggttttgcaagaccgacttctattcataaaactatggtgtattttgatggttttacgaatacattattcattttcttcaataaattgttcttgtcctcagtagtttctcattaatttcccaatacattataaatgacgattttgattacatacaaaatggtaaatagatagcaaaaattggaaaattgagtttttacggctgatcagtagggggtcggaaaaacatttgatataaattcctgaaatattgcaccaacaaaatctcttatttatggctaaatttgcacgaaatctcttcaaaatcattaaatttcagttaaaagcctacggaatg

SEQ ID NO: 118353 - DNA, 327 bp, Heterodera glycines
  Promoter: Source sequence=SeqID_33725; Location=272..598; Strand=+; Gene=SeqID_63702
ttccgatcagcataacaagtggattcgggacgctgatcttgtaaaagagcgcaaagctaaataaaaaatggatgaattttatgtggtactacgatccaattcacctggaccagggaacacgacctcaaaattcactgtcaggcttccacacacgcttgagctggacgcaaactggatggtggcactttcatcaattatatacccatattatttccatccgtcggaattgatgatgacgacttcattagcattaaacttgtaaatccaaattttacattcgcggatgacaaacgttttgtggatattgaactaaaaataccgagcatg

SEQ ID NO: 118354 - DNA, 339 bp, Heterodera glycines
  Promoter: Source sequence=SeqID_20199; Location=1054..1392; Strand=-; Gene=SeqID_84995
ggttcgtccgcgtgtccccccccccccataaacttcatggccaaaatgaataccattttcgtgataagcgaccccaaaaaaatactattttctttaaaaagtgaatggcggccgtacggagggattcgatgaaatggaaagatttttcgactttttgtttgaatctgagttaagtttcgaaatgggtcaaaatttatgaacggtgtcacagctagagggcatgcaacaatggttttgtactgcctttttctgacaagcgctgtataaaaatggagcccataagctcgaaaaatcgagcgtcttctctcgaaactgattaacttgaccattttgggtatg

SEQ ID NO: 118355 - DNA, 535 bp, Heterodera glycines
  Promoter: Source sequence=SeqID_10485; Location=34..568; Strand=+; Gene=SeqID_73697
atttcccccctggttcttcaattaaatggaaattcattttttgacgcattaaaatgatttttttctgattaaaaaactgaataaatcattattttacttaataaaataaggaaatcctgtttaattgcaaagaaataataataataattttatcttaatgacaaaataattgccaattggtaaattaatgattaaataaaattttattactttctactggagctcatttgaaaataataaacatattttcaataaaaataaaataaattcacaatgtaaagagattttagaaaaattaaagagattttatgaaatttcattatatcagaaaattggtgtaaaattccaaaaatgaaattttagcgccaaaaatgtgctgttcacgaaaataatagaaacttgaatatttgaatgctttgaacacctgtgggtttccacaacggttagccgacttttgcgccgcagacatttgcgccgcgccatttgcgccgcgacacttcccaattcttataagcgaggacggaggctgtccatg

SEQ ID NO: 118356 - DNA, 228 bp, Heterodera glycines
  misc_feature (81)..(81): n is a, c, g, or t
  Promoter: Source sequence=SeqID_9253; Location=1217..1444; Strand=-; Gene=SeqID_70766
cagggtgaaacagagagtgatcaatctccgggattcgggcaaaatagagacatttattgtatttataaactgcaatgcttnttcggtcactaaactaattgtaatctgtagcgttttttttgcatatgttttgaaaaagctttctctattttttaggcgttgctttggaatttatcatcgacgcttgttcaaaaagtgtcgccctttttatggcgttgacaaaaaatg

SEQ ID NO: 118357 - DNA, 263 bp, Heterodera glycines
  Promoter: Source sequence=SeqID_18570; Location=1..263; Strand=+; Gene=SeqID_83200
cattcttccgacgaatttgcgcatttgcattaggaaaacggggaaagtgagcagaagagtttaattgtgagcataaataacttaatttgttttaaaagtgagtaaaaaaataattaagcgaatgatttgaagggatttgtcatgggcaaaatggacaacagacaacgcacgaagaacgaaccgaaattcggactatgacggcgaaaatttaaaagcaaaaattataaaaatataatttaaggcaatggaaaagacggacaatg

SEQ ID NO: 118358 - DNA, 79 bp, Heterodera glycines
  Promoter: Source sequence=SeqID_27098; Location=891..969; Strand=+; Gene=SeqID_57807
tgttccaatttgtccttctttgtctttaatccatgccaatttgccctaaggcgttggcattgacgacgcttttctaatg

SEQ ID NO: 118359 - DNA, 1003 bp, Heterodera glycines
  Promoter: Source sequence=SeqID_3037; Location=5002..6004; Strand=-; Gene=SeqID_82878
ttagctggggaagggtgaaccgattcgtccggggcaaatagggggagagggggaattggaagagttcgggattagccaattcccccctctcgaaagagtgaaagagtacaatgtgctggagggcagctaaagacttaaagtgggcggggcctacatgatcagcttaggcatactgtacttagtaaatggtctacggtaaacacaaaataatgagctaagtcaaactaatagagagaatgagaaagaaaagtacatttcttttgcttcaaattttcataccgatagaaaaatatatataaataataatttaattcaaattaaaaaaaatcattttgtttactaaaaaaaattcaaaatttttcatttgaacggcatttttcgtcactagaaatcactattttggcgctttgtcactatttttttcattttttcgacattacagtaaaaccaaaaaatacacccctaagaatcgacctaaaaattttcaaaattcactcctaagaaatgaaaaaattttctcaaaaattcatttcttggcaagaatttataatttaaaaattattttttaggtgcctattttgggttttttgcccttaaaaacccagtcctactcattttcaacagcaactagtgaataaaaattatttttgcttaatttttggctgaaaaattatgtcacaattcgtcactatttcgcaccttttgccactattttggcacttttttgatatttttttatcactattttagttaactatttcaagatttttcgtcactataagtcgcgaccctactcctaacttttttttttcctgatacatatggattagaatttacttagaaaaagcttcccctcttcatttttttctgattccaatatcatttcaattttaaacaaacttttcataatggttttgtccattttcttaagttttattattttagcattttaaaattaaagctgataattatttaatccggcataacattcgtgttctaaatg

SEQ ID NO: 118360 - DNA, 565 bp, Heterodera glycines
  Promoter: Source sequence=SeqID_3810; Location=640..1204; Strand=-; Gene=SeqID_51972
tcccgaactttgacataaacacagcaacctccgtctctatctcgtcaccgcaagtagaaaatccgccagtctgtcccgagcatcgccttttgttgccccccgccccctcaattcgcctgggagtgtttttcccccaattgctcttcttttgaatcgaaatggccaggccacaataatttatttgttgttaattgtgatttatccaagtttatttatctaaagtagcgtgattagcagtgaaattggcaatgaaagtccgtccttttgtgtgggtttggctcgtcggtccttttttctttctctttctttttccactgatagtgagcgatcagaaagtcaaacatgccaagtcataaagggccgtctttggccattgaatgggcattgattgagccgagagaatgtcgccccctccccgcccattgttaaaactgaacggttcttcggctcgccttgttccgccctttttgctattcatccgttggtccttcgcccgttttggccattcgctcgcccttttgttcctttgattggctttcgctataaaaggtgtcccatcggaatg

SEQ ID NO: 118361 - DNA, 497 bp, Heterodera glycines
  misc_feature (53)..(53): n is a, c, g, or t
  misc_feature (109)..(109): n is a, c, g, or t
  misc_feature (111)..(111): n is a, c, g, or t
  Promoter: Source sequence=SeqID_15340; Location=1..497; Strand=+; Gene=SeqID_79598
atcatttttcaaaattaatttcctttaatgcttctttagtctgaccagtgttngagtgaggtgcaaacgctgtgccaattgttgctgtgcgtgccgggcatttttcgcntnaaggaatttcaatggtacggtcaaagaccgatgcgcacatggctggtggattaaaattcaattatttaatttgttaacaattttaaataattttaggcttactttccctttttgaagggtgtaatattccggttctaaattggtacgatcctcccacgcttaactttccgcgtgacatcagagcgcgagttggccttccgttgtcaaaagatgcgccaaattatgtaggcccttttttcaccgatggaaattgggaaaaaaattaggaaattaaaaattttttagtcaagaaaaaggaaatggctttcaattttgaccttttttattcccttaaatttatttaatccaaaaagtggataatgcacgatttataggtgaacgaaatg

SEQ ID NO: 118362 - DNA, 1003 bp, Heterodera glycines
  Promoter: Source sequence=SeqID_1188; Location=4686..5688; Strand=+; Gene=SeqID_69542
ttcgattatatccccccccctcgattagaacccccctctcgaataaagcccccttttgaggagggttaaacaatagagcccccgggggctataatcgaagaagtacggtattacatatttattcacaaatcgaaacaaatgtgaagaaaagtattattattaggaagaagatactaaaactgattttatagaattgtttttttatatgatgggctcaatgttctcaaataaatattgtaatttgcgcctttttactgtatcaaattatgattttgcggtatgttacataataagcaaattgccacggcgaaaggcctgcttacatgatttttttaactttgttttttcactcggaaaaattctaaatgtgaaaaatgtcatataatttcttagcactctctctattttttgttttacatttcgtgaatttttgtaagtgaaattttggctctaatgcattttatgagtccaatcgagttttatgagtccaatcgagttttatgagtccaatcaaatatttgtgaataaagtacattttacaattttattcaacttaggagatttttcattccacaataagatgaataaataaaaaagttcactttgtttgcgcaagcgctagaagacattgtgtttgttctttagataaaagaactaacattcgttcaatgcatacgatcatagatttttataacttttatagagatctttgccaagtgtggcagaaagacagcaagcagaagggcggctgggtggccaaggccttgttgtggaaatcgatgaaagcaaattttttagagcaaaatataacaggggggagaatgataaatagagcctacgattgggttttggtctattagaaaggggcactaacaaagttagattcttcaacgtacagcgtagagatgccgacactctcctgcctataatagctgataatattgaagctaactcaattataataagtgacggatgggctgcttatggagggataaataacatg

SEQ ID NO: 118363 - DNA, 68 bp, Heterodera glycines
  Promoter: Source sequence=SeqID_6455; Location=2315..2382; Strand=+; Gene=SeqID_61649
aacggtggggaggaggggaaaatgaatgaatggtggcggaaaaagcggatgaaaaatgaatgaaaatg

SEQ ID NO: 118364 - DNA, 133 bp, Heterodera glycines
  Promoter: Source sequence=SeqID_9634; Location=878..1010; Strand=-; Gene=SeqID_72146
ttggtggttaaattgctttaaaaaattttaaatatttattttaaaaatttaattgataatagccgatggatgtgcgtgccctgctgaaaagccacaatcaccgcatcattcctcctcatcatcaccagtgatg

SEQ ID NO: 118365 - DNA, 64 bp, Heterodera glycines
  Promoter: Source sequence=SeqID_32210; Location=903..966; Strand=-; Gene=SeqID_46289
ggtcagtttggctgtttcgattctcaaacataaataaaatagttaatttctttacagccacatg

SEQ ID NO: 118366 - DNA, 276 bp, Heterodera glycines
  Promoter: Source sequence=SeqID_45396; Location=1..276; Strand=+; Gene=SeqID_72694
acggtactttcgggttttgtgtcaacaaaatttttctctttgttaaattgattttaaattaataaaaagtcgtttctatgggttttcggggtcgtagaacccgaatatgatgtccgtttcgacccatttcgaactccgaacccggagttcgaacaattatcaaaattcaatttttttttcattttttctcctaattattgtatcatcgagagaactcacatcatattgccgttgccggtcggtgtgggcactatgtttggttcatggagggtaatg

SEQ ID NO: 118367 - DNA, 671 bp, Heterodera glycines
  misc_feature (9)..(9): n is a, c, g, or t
  Promoter: Source sequence=SeqID_4173; Location=1..671; Strand=+; Gene= SeqID_53466
gggataaanttggatgaacaataaacaagcactatattatttttaaatgttaattagagtataataaattaaatgggaggggaacataaattatgtaatgtcatggaaatgaagagaaattaaaatttgagaaataaaaaataatttttaatatttaaaaaaatgatttttttaatgatataaaattacataaaattaattttttttttttcattatgaaatttttatattcataatttaatggagagggaacataaattatgtaatgttagggaagtgaagagaaatttttgaaatacatatacaaagaaaattttgagagcgatcaacaattaatgcgaaaaaattctctcgggattttttgatttattaaaataaaatgctattaatgctaagcaatcggttaaattatatcctcaaaaattaaagaattttaaggtcttcatgatatacaaattagtgaaattaaatttttgagattataaaattttatagaaataatttaatgcagggcaaggaactgcgaagcctcgatgcttttagtgaattttctaacccggatttcggctccaaatattaaaaatattgccttataatttaattagtgtgtgccataattcaaataaaatttaaataaatgaaatattttatttagtacgaggctgaggatg

SEQ ID NO: 118368 - DNA, 485 bp, Heterodera glycines
  misc_feature (88)..(88): n is a, c, g, or t
  Promoter: Source sequence=SeqID_16625; Location=1471..1955; Strand=-; Gene=SeqID_81035
gttaaaattatattttaatacagtcgatcagtttcttttcactttgccgttaaacattgtgtatatttggataccacaactccgtcgncacagtaaagagctattaaaatttaatattttatttccattgttcaaactaataaagcatttattaaaatttaaaagtattaaaaaaactaacaaaaaaactagatttggatatgtttttatgaaaaatgtttcaacttaagaaatgttttacaaaatcgagaactattaaaaaaagtcatgaatttctcaactcaagagttgaaagttatgaattttttattttcttaacataatcccaaattgtcaaaaacaaaatttgtgaaagggtgacctaaattcccaattaattaccaaaaaagcctcgtccaccaagcggacgtttctgctacgataaccacgagtgttgtacacagtggaccaccaggggcgcgtgttggacagcgccgcgttacatg

SEQ ID NO: 118369 - DNA, 293 bp, Heterodera glycines; identical to SEQ ID NO: 115397
  Promoter: Source sequence=SeqID_174; Location=1010..1302; Strand=-; Gene=SeqID_47056

SEQ ID NO: 118370 - DNA, 119 bp, Heterodera glycines
  Promoter: Source sequence=SeqID_2724; Location=2987..3105; Strand=-; Gene=SeqID_81279
tcttcaatttaaatttttttaatcgttccacctaaactataaaattgccaaaaaaataaaaatcgaattacgaaaactaaaaaaatcttttttatttttagtcgcctccctccccaatg

SEQ ID NO: 118371 - DNA, 320 bp, Heterodera glycines
  Promoter: Source sequence=SeqID_14277; Location=1..320; Strand=+; Gene=SeqID_78292
gggggggggggggggggggttaaagggggccgggccaaaatattcgcccccgaaataaaaaaattttttcaaacctagaaatttttcataaacaattcttagggaatttcttagtaagaaaatttcaagaaaaaaatttttgaaaaacatttcagcgattcgaaattttatgaaaattgctaagttttttagaaaaatttgaatttttcaatggtttttcaggaaattttcttttaaaaaatttcttaagaattttttcttgaaaatttctaagtttgaaaaatttctttttaaatttctgcggcgatatttttaggatg

SEQ ID NO: 118372 - DNA, 1003 bp, Heterodera glycines
  Promoter: Source sequence=SeqID_1368; Location=5791..6793; Strand=-; Gene=SeqID_46834
gagactggcactgaaatttttaaatttgtttacacaaaaagcaaagggaaagcggcggaaaattggtgggagacaaatgagtgagtgactcattcattattcactgagtgaaatggacgaagagataaataaataaaaaatatttatggccagcggattatttttggttgagtcattatgaaatttggagtcgggggcgtttgggccccagtttttgggcccccgcgtttgggcccccgtttttgggccctcgtttttgggccccagggtcgtttgggccccagggtcgtttgggccccaagtacagaaaaatgaaaaatcacagtaaaaacaactttttaaatttcagcataaaaatgtaaaataaacattttaaaaataaattcaacaataatttgcaattaccacaaaagatttgattaattaagtaattgctgattattttcgtttgtaactttcttgaaatgttagaattctcttgttttctcgtattattacattattcagactttgtgctttcgaatgataccaaaaagatagggtttgttcgaacatggaaaaagttattgtataaaaaccatggattgtcaattgattggactcataaagtgcattagagtcaattttactttttgttttttggttgcaattgggttagccatttctgaaaaatgtccaaatcagaatgtacatcaaattggttaactattaaaaaataataggatttggaataagtaaaaaatgagcgaatgtaattaaacctaacttatgccaagtggcgagggatccctcaggcttagtttttagaatcttaatttttaaaaaagcacatttttctatttttgggttggggcccaaacgaccccgggcccaaaaacgggggcccaaaaacgggggcccaaacgcggggcccaaaaacgggggcccaaacgctctggtcccgtttttatgtgcgaaaacgccaaattgtgtatcatttaattgcagaataataaaatcaatg

SEQ ID NO: 118373 - DNA, 96 bp, Heterodera glycines
  Promoter: Source sequence=SeqID_11478; Location=3642..3737; Strand=-; Gene=SeqID_74882
actgtccattgccttgcctcgtattttgctggtgcgttaattcgctgctttttaggaattcgtgagagggattcgcgactgtccgacgagggaatg

SEQ ID NO: 118374 - DNA, 676 bp, Heterodera glycines
  Promoter: Source sequence=SeqID_5974; Location=660..1335; Strand=-; Gene=SeqID_59876
gttgcactggttcaaaatcaaaaaaggaaaaatttattcgttaaaacattaattatcagggatgcaaaaaacatgtaaatgcatattttttttcctggcttctcaatgctctaaatagcaggaaaaacactttcttttttgtgtttgcgtataaaaatcgggacttttatttgcatatttatgcatattttggctttttctgcatatttcatgcatattttgccattttttgtgcatattttcagattcttttgcatattttgccatttttcgtcaaatattttcgcggtttttgggcttcgaacttcgaatttcgtgcttcgaaaaaaattaattcggcttcgagtgctaagccgagcttcgcccagccctgctccccgtagccagaaaagcatgaaaaacatgttttttatggttgttaagctatttacgagtttttaaaacctatttttagcacctaatttgggtttttttttagaacctaaaaagtaactattattttggcatttttttgcaccaaaaaatcttatccctggttataatatgctggaaaattcttttcatattaaatttatgaattagggagttgttgaatttttttctgaaaatactaatttaattttaaaaatgacgaaatttgtggctttttttctagaaaaaaatttgaagagatatg

SEQ ID NO: 118375 - DNA, 112 bp, Heterodera glycines
  Promoter: Source sequence=SeqID_1177; Location=2438..2549; Strand=-; Gene=SeqID_69400
ggggttaaaatatgggactatgcaaaatttcaagaaattctcaactgtagaaaaattttttcaactgagtgaatatttcaataaatttccttcacttttacagttaaaaatg

SEQ ID NO: 118376 - DNA, 517 bp, Heterodera glycines
  misc_feature (345)..(345): n is a, c, g, or t
  Promoter: Source sequence=SeqID_13360; Location=1..517; Strand=+; Gene=SeqID_77233
tgcaagggggagacgacgaaggaggggaaggacggtgaagcaagcatggaaatgaagagagagagagagaggaagagagagcgatggcaccactcactcgcccattgatcattcatcccatttcgaatttgcaaattttgtccagttttgtaaaattttaaatttccattattacaaaaaatgcaaatttcgacacgattaagaagctttccaatatttgaagtgctcgcccaatctctcacgtccgcattattgttgtgcaactgaccaatatgggcaaaagcgaagcaaaagttgtcatggatacggacgcggagagggagaagagaatgcccgggggggggngggggggagtgaccaattgccaaagggcaacgaaatgtccgaacagcacgcactaattccatccgatgtatacacttaagtcacttattaacgccttggggaacgaccggcgactaacggcgatgagtgacgaatcaaaggaaaaccgacagcatcagcacatccccaaatg

SEQ ID NO: 118377 - DNA, 329 bp, Heterodera glycines
  misc_feature (7)..(7): n is a, c, g, or t
  Promoter: Source sequence=SeqID_11500; Location=1..329; Strand=+; Gene=SeqID_74926
caattcncaatataaaaccattcaattcttccacaattaacactaaacatttcttacctcccccctttgggagattatctctttcttccctttatcccttcgcccaattaatcaacacaattcttctcgcattagcatgcacacatcaaagaatgtattcccttcgcatttacgcgtaattatttccctttttaattttcatatgtctaattttgaataccacactaaatcaccacttttcgcccaattaatcaaactcatggccatttcggctctattctatcaacactttattgcttgattaatcatccaatttagaaaaaacaatg

SEQ ID NO: 118378 - DNA, 129 bp, Heterodera glycines
  Promoter: Source sequence=SeqID_14674; Location=2101..2229; Strand=-; Gene=SeqID_78783
aaacgcgttctgttctatgcgtccagcaatttggacgacgaattcctgttcaggtaccacgcacaaatattcatgccaagttttccaaatggttaattcacacatttcatgtctgaactgcagcagatg

SEQ ID NO: 118379 - DNA, 103 bp, Heterodera glycines
  Promoter: Source sequence=SeqID_4310; Location=4347..4449; Strand=+; Gene=SeqID_53994
ggtattatcccttttctcatttttgccgttttctcaattcgccgttaggactgagttggatttcaccgtcgccattgacttcactcgttccaatttgcccatg

SEQ ID NO: 118380 - DNA, 214 bp, Heterodera glycines
  Promoter: Source sequence=SeqID_37288; Location=1152..1365; Strand=-; Gene=SeqID_66394
atttttgtctaattcgcaaaattacagctcactcttcgcgaaatataagctgaatcagtgtttgcggaatgaccgagctgattttcttatatccaaatgtaatctgtataagtttacagtaggaaattgtaatttgggggttattggcgatttcaaatcgatccttccggaacactgatgctgtttatatttagagcgtaatgagctgaaaatg

SEQ ID NO: 118381 - DNA, 71 bp, Heterodera glycines
  Promoter: Source sequence=SeqID_19129; Location=1..71; Strand=+; Gene= SeqID_83871
aaaattttgaaataatttcccaattttcgatttttttatatcaaactttttttcccgccaaggttaacatg

SEQ ID NO: 118382 - DNA, 819 bp, Heterodera glycines
  Promoter: Source sequence=SeqID_22290; Location=458..1276; Strand=+; Gene=SeqID_52964
tgccccaccccaattaaacgacgactaattaggcacccaattaataataatttagcccctcgcgcagaaagaaaaatgggaaaaaattggacaaaataataaaatccgttgcggaagaggagaagccgaagaagcaaaatgacaaaaataatgggaggaaaaggaaggaaaagaagaagaaatcggagatgggaaaaatgggaaaatttatgtgagtgaatttggggggaggcaattcagagccaaatttgagcaacaatcaaacttttaagcaaatttaattaacagattataatttgaaaatttacggtggagtatttttcgggtaaaccggagaaatctgaaatcggaaaaacccaatgaagcccagggatcccagttctccacctggtctggagaatttcggccgaaaatcctgtctagtgcctttttgacgaaaattcatgaaaatccgagagttttaattaattcaaaattttaaagtgtcatttttgtacaaaatctgctaataaataataaattaaaacaaaaattcttaagaaattttcctccgcgattgactgactctccattgtcaaaaattggaaaacatttttaaaataatttttcgtataaatagaaaaaattgaaaatttggtcctcgtctgctgggcatgaaaaaatgttggccgcgtattcagcgtgtacaaaatttgctagtaaataataaattgcaccaaattcataagaaaatttcttaggcgacggtccctgaaattattttgagaaatagaaaaaatttacaaattttgtcctttgtctgctggacacattaaaatg

SEQ ID NO: 118383 - DNA, 179 bp, Heterodera glycines
  Promoter: Source sequence=SeqID_24603; Location=1687..1865; Strand=-; Gene=SeqID_55341
ttctttcttttccatacagctcttcttttctgctctggctgatgtcttcaattgttttggccttttattgcgctttctccaccaattttcagcttcgttttgaagataacgtacaattttaatccatttgtcttttcgatttcatttatataattcagagttttgttatcttcaaaatg

SEQ ID NO: 118384 - DNA, 96 bp, Heterodera glycines
  Promoter: Source sequence=SeqID_18798; Location=1642..1737; Strand=-; Gene=SeqID_83477
gctaaatgaatggaaaaaaagtaattaattaatatgtgacaaaatttaatttgtaaaaataaaattaaaaaatatttttaaaaatatttagaaatg

SEQ ID NO: 118385 - DNA, 222 bp, Heterodera glycines
  Promoter: Source sequence=SeqID_4326; Location=3965..4186; Strand=-; Gene=SeqID_54069
ggtaaattttaatggtaaaataaataaattattattccaataaaaatgctcttaattctttatcttttcattgcacttttattatttcaatttaatattaaatacttttctttgacctttaccgaatcagaaattgtttttttaattcagcaaatgtccctttttaattacccccccccctcccctctcattaccaattaggctcctttttctgccaaaatg

SEQ ID NO: 118386 - DNA, 198 bp, Heterodera glycines
  Promoter: Source sequence=SeqID_108; Location=959..1156; Strand=+; Gene=SeqID_70623
ggttatgcctgtatcagccttagatcgtataggatgccaccagggagggtccaggcacatatccagaatcggaagacgaatccgaaaacctttttttttgctctggtctgaaaattttttctccgatgctatttttcaaaaattctgcaccaaggcgaaaaaaaaacaaaattttacgcccttttacaacaaaaaatg

SEQ ID NO: 118387 - DNA, 308 bp, Heterodera glycines
  Promoter: Source sequence=SeqID_3700; Location=1452..1759; Strand=+; Gene=SeqID_51521
aagctatttaaaattatgaaattaaaaactatctttaataggggaatggtggtaattaatttggtgtatcttatttttcccgaaagtcacttgggctgaaacctacgaaaagcaaattgtgaaatgctgttgtcaactactactcgttttgaattcatattttacgaatttaagttctagaaaaatatgaacacaaatctagtcaaaaagaataaattaagcggaccaaataagttttaattttctttacaaatcaaatattttattagtcaaattaaaattgtttttaatgtcaggaatcgaccatg

SEQ ID NO: 118388 - DNA, 122 bp, Heterodera glycines
  Promoter: Source sequence=SeqID_21376; Location=3030..3151; Strand=-; Gene=SeqID_51983
aaaatctgttttattttttcaagatttaactcaaaaatcacgggcatataagctatctgttcggttaaggttttttgatctgacttacaaatttttaattctgtttttttgtttaaggcatg

SEQ ID NO: 118389 - DNA, 811 bp, Heterodera glycines
  Promoter: Source sequence=SeqID_14340; Location=1275..2085; Strand=+; Gene=SeqID_78371
aatagtatatttaaatctttgcaaattcccaagtcgcaacggtgtatgacgtcactcaaaaactaatgaataattttctgtcaaaaatttttattttgatgattctttgagcaacgatccggcacatcatttaaaaaaggaaaaaaaataattaaaaaaaaataattaaattttaaaaaactcaactgcgcaagttttccttgcttctgcctaggctctccttttcgttttgctttgtggtgtaaataatttagatggtagaatatgaaggtctgagtggagacaaaaagaatttatttttaattaatttttgtgggaaataattcaattgaaattttcggttttttttttcttgggaaaatactcggttggtcccatttgaaaacccagcagctctctgtactggatgtcttagtcccggttttgcccaaaattatcggtcccgttctatactaaattaaccaaaaagctttattatttttcgcttgccaaattttatacaattttatttatttacaaaaaaattaatttattcttcatttatgaattttcttttctctcgttattggaaagtcaataaatgcatttgatggacagcacaaatcacttacatatttagtcattccaagataataataaatgtgatgattcagaaatggatagcaaaatgtgtggggaaatcattcaatgaattaatttaatttcgttatttcgcattcacaattttgaaataacggataattactataaaatttgcttcttcaaatttagtcacaaatttcaaaataataccaaatttatttctaaaatg

SEQ ID NO: 118390 - DNA, 551 bp, Heterodera glycines
  Promoter: Source sequence=SeqID_19602; Location=1239..1789; Strand=-; Gene=SeqID_84344
tcgcttggtagggctcttgtgtagtttaagccccatacataaaattatttattttttacacttcagaataaaatatgccaaacaaaatcatttaaaccttttttagactaaaaatgaaaaacaaaagttttaatttttcgacttcttgttcgaattcgggtccgggatttgccgaaacgaatactggattcgcaattagcgaccccgaaaacctatagattggcttcttttattctgaaatgtaaaaatatttgtatatggggctacactacacagcccttggtagtactatcgatctcccctcatttgaagaaaattttatgtcagattaatgatcagcgaccctgaaaacatttataaacatgttccgtgaatttctgaacgaaaaattttccaaaaagaggcatgcatcatcgatagtattttacacatctttttcttttttgcaatcattgatctacatgaaatttcacaatcagcagcagcaaaatgccggcacggatcccgccgccgataatggaggcgagcacgaagaataagtggaggcaatg

SEQ ID NO: 118391 - DNA, 277 bp, Heterodera glycines
  Promoter: Source sequence=SeqID_10028; Location=573..849; Strand=+; Gene=SeqID_73079
ttcgacaacattgttgatcaaatttcccattattaccccgtgaatgcgtgatcaaatgatcgcttatatgcagcaaatcacatttatttaggcatattatatgcacaataaaaaaaaattttttgtttgaaaatatgttcgaatccgggttaggggttcagaatttgtcaaaaataatgccggattcgtgctcagcaccataaaatagccctagaaaaatttttccaggcttttcaaataaaaaaaacgggaccagtaaactagtttgccgcaaatg

SEQ ID NO: 118392 - DNA, 678 bp, Heterodera glycines
  Promoter: Source sequence=SeqID_14914; Location=757..1434; Strand=+; Gene=SeqID_79078
tttgggcactgtcggccaccgcatttaagcgctgtccgatcagcgaaaaatcagtcagttcacaaatttcataagctcctaaccaaaaagcactaactaataagctggggaaggaaaaaggaaaagccaaataaaaacattttttgaaaatttaatagcgattaaaaaagatttaaataatttttttggaaactatttaaatttctttttttatttcatttttaattagaacacaaaaaatattttttggtttaatatccaatattttgtatttcattgtaacattttaggaagagatttttcctctatttctgatcccaaatcccactccaaagcaacccgtctcactctcaattttgaacatgaacaagtggcttgcacttgtgtaagttaagggagggaggaggcttgaactctggccaaatattaactctctgtccactttcagtctgttgatcgccctgatcagcgcgcaggccagcgctttttcacttggtaattaaaaatttgattaaaaaagttttttttttttgaatttctccaaggctagtagcttttttaaacagagtttcgagtctataaattcttcgctctcgggtatcacttaacacgaatacaccatcatacacaggtgatgcaagcatcattttgccggacggaaaacttggcgacacgatg

SEQ ID NO: 118393 - DNA, 230 bp, Heterodera glycines
  Promoter: Source sequence=SeqID_15285; Location=1051..1280; Strand=-; Gene=SeqID_79507
gaattggcaaaatccaaacagtgtcaacccctttttttttcaaaatccagaggaacaggaaaatgcctgtgtatgcgccaatttttcgtggaattaaatgtggcaagtttggttcccaaattgcagttcccaagttgattcggaaatgaaaatgttcaaaggccaaaaaaaaaatttttacaaaattttgtaaataaaaaaaaaaaaaatttattttagcatggaaaatg

SEQ ID NO: 118394 - DNA, 855 bp, Heterodera glycines
  Promoter: Source sequence=SeqID_11596; Location=183..1037; Strand=-; Gene=SeqID_75046
aataaaaactggaagcaagaaacaattcattaatttatggatctaaattcgtataaattgttgttgggcagaaaattgttacacattcagaatttgttagagtaaatttgttaaaaatttggtttttctaaaatattttgtgcattttaaaatttttccatatttttattccatagatgaagctgaataacgtagaattttttgcgttttagtggaatttgatttattttacgactaattatacataatcagcgataaaaattaataaattaatgaaaaataaacctatgccgagagcaattgtttttagtgaaaaccccccgactttgcagacttcgatccaattatgggcggtctataaaaataattaaatcagtcaaaataagaaaaaattaattattatataaaaaagaatttcaaaatttaaatattgacatattgttttaataacattttaaacgtgcaaagctcctacgcattattagctgttgctgattgtctgagccaaagattgtttcattatggcccaatatttaacatttttgaaaattaatcattttccatcatttggaattgtcaattaattttctgtccaacaatgaataattcttaaaaagcaatttgttcaattaattggtaatacaaatgcacaaaaaattgcttaatcatcgcatttaaggccaattcggcccatttatgactttttgagttttaatcttatgaccggacaaaaagactatttaaggccaattaacttttaacgaagcaaccactaattcagcaatatattttaaataaattcaattaatttaattataatataaaatataattatatttgaatttagtcaaaatg

SEQ ID NO: 118395 - DNA, 378 bp, Heterodera glycines
  Promoter: Source sequence=SeqID_9031; Location=527..904; Strand=-; Gene=SeqID_70051
ttctccaattttattgtggcataaagccaatcgatattcgcctctctccgtcaccaatttattattttattttcttcaataaactttattgtttatatttgttgtcgttcctttgggtaaggacacaacaaatttggcgcagtcagcaacaaaagcctaagcggctttcattggacattttaaaaaactgatcacctgggtggtgtaagtttccgctgggtgcggttttcatcgacaaaaaaaactgatcacctgggtggtgtaagtttccgctgggtgcggttttcatcgacaaaaaaactgatcacctggggggtgtaagtttccgctgggtgcggttttgaaaattcaacaaattttcgacaaaaattcgacatg

SEQ ID NO: 118396 - DNA, 140 bp, Heterodera glycines
  Promoter: Source sequence=SeqID_17551; Location=92..231; Strand=+; Gene=SeqID_82060
ttacgggtccttttcggcattttagccgataaaatcgggtaatgtttgcttttatcagtgtattaattgcctttaattactcttttttcattttgctaattaacttttctttcagttgtgctagtgaagtgaacaaaatg

SEQ ID NO: 118397 - DNA, 160 bp, Heterodera glycines
  Promoter: Source sequence=SeqID_19330; Location=1..160; Strand=+; Gene=SeqID_84068
ataatgaaagcagaggtgcgcaacgagcaactgaaactcagttattacatcgtaaaattaaaaaaaaaaattaatatttttgaaacgattttactgtatttaaaagaacggtacatggaacggaacaacaaattgtacggctgtgaaattgacggaaatg

SEQ ID NO: 118398 - DNA, 402 bp, Heterodera glycines
  Promoter: Source sequence=SeqID_13921; Location=1535..1936; Strand=-; Gene=SeqID_77875
ttcaaaagctttaaatgtttaatagtcgctattgaatgcaaatgagataagccttaatgagagctctaagaatacttgtttatctttaaactttcaaaaaaatttcattgaattttctatactaaaaaacattttttttaaaattcattaattgataaatttcccttttacattttcacaaatgaatcataattaatttactaaattccttctgaatttcccaaccgattgattcatttttataaaatatgtgaattaatttttcaaaatattaggctaaagcactgccctttttttgtacagtgaaaagaaacaacaaaaatgtcttttttattatttcatttttcaattttccctttttaactattattttccaacttcaatcatttttaaataaaaatg

SEQ ID NO: 118399 - DNA, 81 bp, Heterodera glycines
  Promoter: Source sequence=SeqID_28761; Location=1..81; Strand=+; Gene= SeqID_59333
aaaaggccaagatgcaatggatcaacggccaaagggacaaaatacaatggaaacggccaatgggacaaaaggcccaaaatg

SEQ ID NO: 118400 - DNA, 1003 bp, Heterodera glycines
  Promoter: Source sequence=SeqID_1368; Location=6016..7018; Strand=+; Gene=SeqID_73064
cacttggcataagttaggtttaattacattcgctcattttttacttattccaaatcctattattttttaatagttaaccaatttgatgtacattctgatttggacatttttcagaaatggctaacccaattgcaaccaaaaaacaaaaagtaaaattgactctaatgcactttatgagtccaatcaattgacaatccatggtttttatacaataactttttccatgttcgaacaaaccctatctttttggtatcattcgaaagcacaaagtctgaataatgtaataatacgagaaaacaagagaattctaacatttcaagaaagttacaaacgaaaataatcagcaattacttaattaatcaaatcttttgtggtaattgcaaattattgttgaatttatttttaaaatgtttattttacatttttatgctgaaatttaaaaagttgtttttactgtgatttttcatttttctgtacttggggcccaaacgaccctggggcccaaacgaccctggggcccaaaaacgagggcccaaaaacgggggcccaaacgcgggggcccaaaaactggggcccaaacgcccccgactccaaatttcataatgactcaaccaaaaataatccgctggccataaatattttttatttatttatctcttcgtccatttcactcagtgaataatgaatgagtcactcactcatttgtctcccaccaattttccgccgctttccctttgctttttgtgtaaacaaatttaaaaatttcagtgccagtctctctcttatcgttgtcattattcgttcattctttacgagtaaaaaacgaaatatttgcacatataaaaggccacaaattcctcggaaaagtgaagtcccaaccgaaagataagacaccaaagattcaaattttcattttctgacaccatttctaaaacattcgttgcttaaattccatttttaaaatttaattaatttaagccattaaaaaaaatctgacaaaatg

SEQ ID NO: 118401 - DNA, 584 bp, Heterodera glycines
  Promoter: Source sequence=SeqID_23863; Location=465..1048; Strand=-; Gene=SeqID_54553
tctccaactataacaaaattggtatctgaaatttatttttgaaaaaaagaatttttttctaaacaaatcctaaacaaaagttgctcattcgttgcactgttttgctttttattcatgaaaaatttgcgataaaatgtattgatacgactcagaatgttccaaattgggtcggacaaatgaaaattgttagagaaggaagtaattattgattaggtgtatgacccaacgccacttcgtcatcttccccctccgattcccctcatttcaattgttcattgtgcccaccaattttgacctcccaatttatattctctgcatttatttattattttattttcttcggcaaataaacttatttaatttgttatcttcggacataacaaattttggcgcagtcagcaattaactgcacatcaccggcaaagcaacaattcaagctttatctcgtgctgatattgctcgtgttggaaaattagaaatctcgtgttgatttctaattttcgcagatcaaaaaaaaaacaaaacttttctctccgtgtgagattaaagtctgccgtgtgcagtttttcttcaattggaccatg

SEQ ID NO: 118402 - DNA, 543 bp, Heterodera glycines
  misc_feature (24)..(24): n is a, c, g, or t
  Promoter: Source sequence=SeqID_2744; Location=1..543; Strand=+; Gene= SeqID_81373
tgattataaatttttcgaaatcanaaatatttcaatccgacttcaaaaagatttcctcgctggaatcgttcgtaatggtcattctatctcagccgtcatgttcttgttgcatattgtcgctaccaaattgtccgaagtatggaaattattcttatcattatcttgtattttttggatcggttactttgcatgtttttttctatttagactcgtttcactttccttggtctgctggctgtcctttcatggccggccttattcttcgtacattatgaacagattcacaaccgagattatctgatcagtcgcttagcactttctgcctttacactgctcatcagcacagcacttctctttttaccaaaaaagccgaaacgcaagaaaagaccgaacactttttacaggttaacgaaccaagacgcgccaataatctggtcataatttagtgccttttccgttgccagcactcctctctcgcaacgttcacgttttactcgggactcatctgttacagattttgtacttgataattcaaaaagaatg

SEQ ID NO: 118403 - DNA, 1003 bp, Heterodera glycines
  Promoter: Source sequence=SeqID_7968; Location=840..1842; Strand=+; Gene=SeqID_66537
cacccaaaatgaaaccaaattttaaaatattgatatcattcaataggcccaactgttttctattagcctataaagtttcaaaaagttccgttaagtttcaaaaaagttataacttgagaagctcaaaaaaccaagttttttacaacatttttggtcgtaactttcttgaaacttaacgaaacctttttgaaggcacgatgacatttcgcctactaagccaagatcggagtttcgcctactaagccaaaatctgacatttcgcctactagacatctcgcctactgacacttcacctactggacatttcgtctactaagccaaaggcttcacatccatggaaaacaaagagtgattaagaagctaatggagatgcgtcactttctgtgttctttgaaaaatttatttgctttttttggctaaatttcattagcattataaatatagcgaattatatgtcaaattagaatatatatttggtgaaatttgctgtcgaaagagctaggtattttaggttagcaggcgagatattcaataggcgaaatgtacagtaggcaaaatgtcagattttaggtgagtaggcggaacgtccgattttggctgagtaggcgaaatgtcagtaggcgaagtgtcagtaggcgagatcgtccagtaggcgaaacgtacgcacaccctttttgaaattttgcatgctaatagaaaacaactagagctattgaatgatataaagaattaaaaatttggttgattttaagtaaagatattgaaaaaaattgctacaattgatggttttttgaccaacatcatagcaccgaccgaagaaacggcgagcagaaaaagggaatggcacagtgaattggaatggaacgcaacagaggagaggaggaccactaaagagaatatttttcaaaattatgaccatttgccgggcgttttaccttatccccccacccacaaatcaatcaatcaaataatcaattggacggatagagagagggaaaggatg

SEQ ID NO: 118404 - DNA, 1003 bp, Heterodera glycines
  Promoter: Source sequence=SeqID_14980; Location=967..1969; Strand=+; Gene=SeqID_79133
ttagtaaataagcttgaacaatttgttaatttatctttttgaatatttcaatttaattttttgcaattccttgcgggacccgcaaatttgaaatgcgggattaatcccgcgggatcctttcccgcaaaatttaattcaaaattcgcattggaatctgcaaatttgaaattgctgagctctattaacatactatgtttcctgtaatagtatgaaacgggtttatcattccccttgaaaatgtcttttaatgaggggggggggggggttctattagggaaaatggcaaaaaacacttattttttttctcactttgtcaacgcttttacaaaatgtttctttcccaacctttccctcattcatttattgtttttattttgacaaaattggctccaacagtgacgacccctaactttttcaattcgggtaattgtaattttgaaaagtgcaattagaaataaactccaattgttttttatttgttaattgattattgctaattgactatcacattttaatttgtttgattgccttttttcctttttcctccaattgttgtttcacacaccgtccgaaaaaacgagatgtgtaccaataaatagagcggtaggggtcaactccgtcttgccaactccgtctcgccaactccgtctgggccaactacgtctaggggccaactccgtctcagccaactccgtctcgccaactccgtcttagtgtataaggggccaactccgtctcagacaaaaaaaaaatatttaaaaatttttttcgacgaatttttcaaaaaatatacccctaagaaattaaaaattttctcaaaaattcatctgcaaatctatttatttattttcatgttctgatttttaaaattattcatcaaaatatcgctttggcttaattttgttacttttaaaaataaatttaccgttatcatttattagtatatacttacctaacagtttaaagtaccattaattttttagccttgcgaaaatggaaaatg

SEQ ID NO: 118405 - DNA, 779 bp, Heterodera glycines
  Promoter: Source sequence=SeqID_20459; Location=1..779; Strand=+; Gene=SeqID_50991
tcggttgccatgaatgcttagtaataatttgaccggtgacctctcccctccgggcacatcgttccgcccttttctttactgtttctcctttatttagttatttttctggtgtttttacattagtttattctttttgtttatgttttcatattttgtgctcaacacattccctccttttcactcaaaaattcactaattgttcagtgttgaatatgtcgctttggcgcgtttaattgacaagaaaaacctttttttctaatttctcgaataaaaatttgtacaaatcaaaacaagcgattcgtgcaggtactgaaacctttttaaaaagccgattttgaggatatttgacggtgccgaaccaagccttaaccgctaaagatggtaataaaagcggacactagcattttgaatgccttttcaaaaagcgccatcagcgaacagtcaattacgcttgtattaacaattcagtccttaacattgttaataccaacataaatctccatcttatttcaaaccttaccttccctttcctaattagctttttcccttttttcataatccattttcctattattggcgtcgcaatttgactatctttccaccttcaaattttttacatataatctccattattgttgaattttaaaaacattttatttgataaaatgtttgaatgatgaataaaataattaaaaggaattgcgctttaattggttttatcgtttaagcttggttcatcatctatttgcagtgttaatttcgcttaatttgtgtgaatg

SEQ ID NO: 118406 - DNA, 347 bp, Heterodera glycines
  Promoter: Source sequence=SeqID_31487; Location=785..1131; Strand=-; Gene=SeqID_61819
gtgctgagacgaatcgaaaaaatagtctcagtgtcaataaaaatatttaaatttaatttacaattcaagtcggtctcgaaaaaatattaatttaattagacaattatttttaaaaataaactaaaaaataatactataaaagcattcgatctccgaaaaagttgaaccgaaatgattaaatttaaatatttatcgacattgagactattttcggttcgacctaacaccacagaaaaaagtgccgaaaattcatttaaatttaaaatataattatatttagaaacaataacatttaattttgtgtttttatattttaattaataaatttttttgcaaaaagtgaaatg

SEQ ID NO: 118407 - DNA, 51 bp, Heterodera glycines
  Promoter: Source sequence=SeqID_30552; Location=1108..1158; Strand=-; Gene=SeqID_60968
aaaaatttccatttaatttacgattatttcaggccatctctgatcataatg

SEQ ID NO: 118408 - DNA, 165 bp, Heterodera glycines
  Promoter: Source sequence=SeqID_17160; Location=968..1132; Strand=+; Gene=SeqID_47419
ttttatatgcattttctgttgcactttttttcagtgggaaatttgaatataaaaaggcgtgaaattgagagaaatttcattctcttcacattcttaattctattctctgcactattacatctaatttctgctgctcaccgactccatcgacaacgacacgcgatg

SEQ ID NO: 118409 - DNA, 787 bp, Heterodera glycines
  Promoter: Source sequence=SeqID_2694; Location=1..787; Strand=+; Gene= SeqID_81123
tgctgcttcatttgcctgaaatgccaacgctggctaaaaaaaccaagggtcagttttttttggggggggggaaacaaaggggtaaaaagaaaaagctgagaatggacaaaaataagaacatgagaaagtgcattttaattatataaaattattttgttaaaattgaaaaaaaataattttcgttaggacatgtttttttaactaacaaattaaaatatgaattaaatctttttttaggttccctttttcactgggcttttgtaaattttaatgaactctttcctaattgcctttaaagtgcctttgcccatttccttccttttgttatccgttcgttgcccacggcaccaaaaatcgattgacccctttttccccttcccctttttccccttcccctttttcctcccatcccttttccctttaccttttcccgacacaatgtttaagccatggcttttcctattttttttaactttttccgttcaaccgaaaaccaaatgttacaatgagaaaagaagggaattaaaatgaagaaagaaatggcggagaaagagaagaaaagagatcaatgggagagaagggaagggaattaatattaattgcatttcttttcgtttcgtttcgccttttctttctttcaattattttcttcaaaaacaatagtccgttttaatcggactttttcaattttcctttttaattaaattaaaatccctccccttttttcccttttttaaacttttgccaattttccccctcagaaaggcttccccccgagttggagatg

SEQ ID NO: 118410 - DNA, 509 bp, Heterodera glycines
  misc_feature (495)..(495): n is a, c, g, or t
  Promoter: Source sequence=SeqID_15502; Location=1034..1542; Strand=-; Gene=SeqID_47298
ttcaaatattttagatcagctgtaataaaacaactctaaaatctcaaaattgtaaatggatggagaagcgaagtgagttattcggactgcatgaaaaaagaaaaccaatggcaatcatctttcatatgtaggtcccgaaaattttttgtttgaaacttaaattcaaaattaccaaaacttacttttatgttgtatctttaagaatgaccatttcttgatgttgcaatggttttgacttacaaaacacctggggaccttcttttgttaggaacaaaagaagaaaaaatagaaaattttaaacttggcaaaataaagtgagattcaaaaaaaaacaaacaagtcccgtttcggtaactgacggactggcctaatctgtgaccaaatagcccagttggcttgtcacccaatagcatcgcccaattgacttccatcgcagagggggggggggggggggaattgaaaaaaatggcggtccatttttgtgaaatatttatntaagcaacaaaatg

SEQ ID NO: 118411 - DNA, 228 bp, Heterodera glycines
  Promoter: Source sequence=SeqID_28865; Location=1..228; Strand=+; Gene=SeqID_59443
ttttgttttgtaacctcctgaatttgttttaaccaaattttagcattttttacgcctaaaaatcttttgcgttagttacataggtaggtattgaaaatttaagtgataatagaataaaaatttaaaaaccaaaagttaggaggggtgacaaaacaaaaaatatacgtataaaattggtaccatttgaagaaaccacaaatgacagtcttttgaacattgctagtaatg

SEQ ID NO: 118412 - DNA, 279 bp, Heterodera glycines
  Promoter: Source sequence=SeqID_35426; Location=821..1099; Strand=-; Gene=SeqID_64980
tcaaattcgttttgtttggaccaacgccttgactttatggcacttacactaaagaaaatgaaatatatgattttttcaaaattggattaattaaatgttcgctcaaataaaaaagcgataagtcaaaacaatatcacaaatttttaatttctaatattcaagtccaaaacttctaaacaatttcaaaactaaataacaacggtaactgtagccaatcatggcaggtaaaacaatctttaaaaacaaataaatataattatttttagatttcaaataatg

SEQ ID NO: 118413 - DNA, 233 bp, Heterodera glycines
  Promoter: Source sequence=SeqID_10166; Location=1..233; Strand=+; Gene=SeqID_73271
ccgaagtactaacgaagtaccagcaagtgattgaagagcaattcggagcgggagtgatcgaggagacgacaatcggcaccggacggagcgagtatttcattccacatcaggcggtgatcacgccaaagaagctgagggtcgtgtatgacgccagtgcgcacgctaagggagcgccctccctaaacgactgcctgctgagaggcccagtgtggctgccggacttggcaggcatg

SEQ ID NO: 118414 - DNA, 492 bp, Heterodera glycines
  Promoter: Source sequence=SeqID_45092; Location=1..492; Strand=+; Gene=SeqID_72469
taaactttatgtaaacaaaaaaaaaatgcattcccatgaattaatctattaaaaatattcaaattacatttagactatttttaaagccaaaaatgtgctaatagatgaaatcggagtgtgggaaaaagtgtggggtgggcgggataaagacaagggggagaaaaacaaataaaaactgctcaaaaatacgtgaatttctcaaccatttcgctagaaaaatcgtaaaccaaaattatttaaatgatttttggcgtaaatctttttaacccaatgtcaaatgaaagtaaaatctgatttgagatcttttggcatctgtgagaataaaaattaagctttaagtttgactcaattgtacatttattttttaatttcaacacactatcgatgccgatatgaatcgacgataagttttgatcttttacaaagatattaattacaaaaaaaaaggtgataataaaaattttaaaaatttttaatagatttttaggtatg

SEQ ID NO: 118415 - DNA, 460 bp, Heterodera glycines
  Promoter: Source sequence=SeqID_14758; Location=1820..2279; Strand=-; Gene=SeqID_78889
tttcctgcaataaatgttttcatataaaggtttaaaaaattcgatcgggtttagaaacgttcaacaaatgcatagataaattttttgaatattatacaatcgtgctttttgctctctatcaatttattataaaaaaattttcttcccttcgaaattgaaggcagaatgctcatttgaagctacgcaaatataaattaatatttgctataagaaccgactatttagtcaacagaaaacaaataaatcataacgaatttctgttggtcccgggtcgtggcaccacttttgtcgttctgacgacggcaaaaaagtttgaatgggctgggcggacgtattcagagcgagttgacaaaaattaaagaccaaaggcgccaaaaattcactttattttgtaccctcaaacttgggtaattaaaccataattaattaatgaacaaatataatccgacatgataaaatg

SEQ ID NO: 118416 - DNA, 121 bp, Heterodera glycines
  Promoter: Source sequence=SeqID_25868; Location=1139..1259; Strand=-; Gene=SeqID_56642
agttattaaaatttttattttcaaaagaggatactaaaactgggataaccccattcagagactagtcaaaaaaaataataataggcttggactactatactaaattagaaattttagaatg

SEQ ID NO: 118417 - DNA, 147 bp, Heterodera glycines; identical to SEQ ID NO: 100432
  Promoter: Source sequence=SeqID_18526; Location=1128..1274; Strand=+; Gene=SeqID_83153

SEQ ID NO: 118418 - DNA, 70 bp, Heterodera glycines
  Promoter: Source sequence=SeqID_8292; Location=388..457; Strand=-; Gene=SeqID_67595
actgtctctttttaagttacataacaacagattttaaagggaaaagtgtgctaattgagcctccaaaatg

SEQ ID NO: 118419 - DNA, 83 bp, Heterodera glycines
  Promoter: Source sequence=SeqID_16960; Location=2350..2432; Strand=+; Gene=SeqID_81391
atattttttttggataattttgtctcatgtttatagcatttaatattttaaattaatcaaatttgtttcctatttttagaatg

SEQ ID NO: 118420 - DNA, 500 bp, Heterodera glycines
  Promoter: Source sequence=SeqID_31630; Location=509..1008; Strand=+; Gene=SeqID_61951
agtaggatttatattatttatattcattatcaatatttattttgttttattagtaatgatttttaatttatcttaaacaaattgagttttattttttgttgtggctgttagtgcttttttcttttaagataattcaattcaattatctctttttttgcctcagctttattattgttaaactttcgagttttaactttatacagtcatggtcatatgtttaacaacactcaaaattttctaccaaatttgatttaaattgattataaaatctcaatatgactatattgtgtttatatgttttatatttcttgtagcattttttgtgggctttataatgataccattcactatcccttgtaaaaatgttattattagttacaaacaattttaccaactgcactccctttttggggtggtcatatgtttaacaacactacccatatattttttcatagcattaaaaaaatctaaaaaaattcaggtaagcataactttggatg

SEQ ID NO: 118421 - DNA, 123 bp, Heterodera glycines
  Promoter: Source sequence=SeqID_25029; Location=286..408; Strand=-; Gene=SeqID_55760
atgggagacgcactttacaaaatccgttttccaattatcgcagaaagggacttttcggactatatttgtaacaaattattaattagatttcgttttttttgtgtgacatgagtccaaaaaatg

SEQ ID NO: 118422 - DNA, 140 bp, Heterodera glycines
  Promoter: Source sequence=SeqID_4407; Location=1806..1945; Strand=-; Gene=SeqID_54342
ggtattatatcatttaattggctttctgttgtgacctcgttccaaaaaaccctaaagaactaaatgttaggaaaattctgcttcaatcccttatttggacgactgagtaacatttgctttttcagttggacttggccatg

SEQ ID NO: 118423 - DNA, 935 bp, Heterodera glycines
  Promoter: Source sequence=SeqID_2238; Location=3180..4114; Strand=+; Gene=SeqID_78645
tgtagataaatggactttctcttaaggccctttccccttatcccatttgccggtgcattgtgaaaatcggcaacaatgtgctgccaacgttcaaattctttaagcattcgcttaacaaatttgctgaacagtgggtttggttcaagaagggccccccaaatgttatgccacgcttctaacgaattgttgcttcttgaaagaccaatttcgaggcgatgagtcagattccatagctaaattacagaaatatgtaaaagtagatagtcaagaattttttaccgctattggaaatagcatttggggaattacatttaggcactcatgtttgggaaacgagaaattttgacgtccattaaaaattttttacggtgatcactgatcagacactccaaaatttcaaatacataactttatttaaaaaaaaatagttttcactaataaataattctttattttatttcagtgacgaaaggttcagtgacgaaaagtttagtgacgaaaggttcagtgacgaaacgttcggccacccgaaaaagctttctttctccgatcaaagtgtgtgtgtatagtttgtgataagtagggcgtcaaattatatggacaacaaatcgcaaaatatggacataaaattgcaaaaatctcaaaatatggacataaaattgcaaaatatggacatacatttttccaaatttagtgtataatttctcaaaatttcttcaaatttattggttgaaatgcatataagatacatttccaaattttgagctgaaaaactcattcgattgtcggcaaatttaaatttattcaatatttttcgtgaaaattttgctaaaaaattattttttggaaaattttccggtttttgaggtcaaaaggccaatttgcctgttgggggccgttctattagaggtttttttaaaaaatgccaaaatatg

SEQ ID NO: 118424 - DNA, 147 bp, Heterodera glycines
  Promoter: Source sequence=SeqID_2215; Location=1..147; Strand=+; Gene= SeqID_78520
atgcgctttgtttcagttgcatttgcttatgccgtgccactttggacgatttggtgcccttagtcggcagtacttccggtgatttattatctgtcgaatctgctttctcaatgtgttttaattggtgtcttttgctgtttaggaatg

SEQ ID NO: 118425 - DNA, 558 bp, Heterodera glycines
  Promoter: Source sequence=SeqID_26611; Location=428..985; Strand=-; Gene=SeqID_57355
tctcaccataacaataaagaattttttcaggcgatggttcaattagattcttatgatgttttaaaaaccgtaatagccaacgggtcttaccactcccagtagcccccgagagaattagagtgaacggaccgcgaaacatttttaatgcatcttatttatttgacctatttatattttcatagggaacatgtttcgcgcatttggggcatagccagaaattatcaaaaaatgatgtaccgaaatgcaaaagactgtgttttttacatctgttacacatctcgtaatgacaggggcagtaatgacaacacttaattttatgtggacagttcatttttttcaatttaattttatttttggttgctatttatagaaggggtatataaagggagtgaaaggaccatttgattggtacattgtatcaaaaatgcaaaaaccgataatcgtaaatataattgctctcgctaatatcggtaccggaattaaactaaactctctgacgatcaccgaatgcgaatttaagtataaccctagaaaattcaatgccgcagttatcaaatg

SEQ ID NO: 118426 - DNA, 330 bp, Heterodera glycines
  Promoter: Source sequence=SeqID_17249; Location=773..1102; Strand=-; Gene=SeqID_81719
tttcgccaacaaaatttgtcacttgagcaaggggtcagaacaaaaatttttcaaagccagaaaattgggctgaaaaaaacaatcgaattttgggctcaagaatcagaaaatctttttcaacaattttggggtcaaaagaattatttttcgtaaaattttttgtttttcaacgggccgggcacgacgtgccagaagtttattaacacttttgcacaaaaatgaccgatttgtgattctgagagaatgggagtccaagtgaaaaaggggttcattggtgccaattggaataaccggaagaaattttgaccatttcgtttaccaattgaaatg

SEQ ID NO: 118427 - DNA, 270 bp, Heterodera glycines
  Promoter: Source sequence=SeqID_2209; Location=1126..1395; Strand=+; Gene=SeqID_78486
aaaagccgaaatggacattttaacactttttatcgttgtgtatttatgtgcttttggtacttatcattctttgtttatggttgtttacgaataaatcaattaattattaattaattaattaattatggtcactttatcagtcaaacgtcctcttccctttgtatttgtttgttttgcaaatcatttgctgtgactctctttttcgtttctctccgttttcccatgtttacccctggcgacgatttctgcgccgcctgcggttccatcatg

SEQ ID NO: 118428 - DNA, 274 bp, Heterodera glycines
  Promoter: Source sequence=SeqID_16006; Location=1..274; Strand=+; Gene=SeqID_80358
aaaacatttccggcgtttctgcacggaaagaaatttgtggggaggggaagccattgaaaattagctagagcaatttatgaaaaaagcatatgaaatgcataacattatgccaatagttttcacatttgtgcagaaaattaatttgcatataaatattgaaaaactcacataaatttttatattaaaacatttcgtgaaactttgtgcctttaaatattttacatttttgctgcttttcataataagcattgatgatgaagcatcattagcaatg

SEQ ID NO: 118429 - DNA, 1003 bp, Heterodera glycines
  Promoter: Source sequence=SeqID_1479; Location=3463..4465; Strand=+; Gene=SeqID_73799
tatttaattgtttaaattaatttttgtttcaataatgttattttttgtttgtgtgatcacaattctccaccaccccaataaatgataaagattcgaagttgattaattaattttaaatggttttttttatcaggcgccgctgggaaattttatcaggttttggcacgaatgcataatgagcgaattgaaaaagaagtttaattgaaaaattcgtcctgaatttcaataaagaaaaaatttgactctcatcagacttgatcaaattcctaccctatgacattcattttatctatggacctattaaggagtattaaataggcttaattaaaaatgaaactttatattttataaatgaaatagaaagcaaaacagacacaaacttatttgttataatttgaaataataatgctttacaaaacatttaaataaattaaaaatttcctaccttttttttagtcactagttttttcccaactccgccgatttttttcccgggtttgcaagcatatgagataattaaacagccaacctaaaatttctatcaaaaaaaaattggtcattagtgaacaaaggaaagctgatgaggaagacatcattttttttataaaatttgcaaaaatttaaatattttgtattaattttggtattttttaataaaaaattgaaatgtacctaaacaattgatatgcatttggcattttccggctttttcatcaatttttatgcccgtatttgtcaattaaaaaaatcttaaatcttttaaacttaatttgatttttattcatatgattttcttggggtctccctcatcccattgaatcgcatcaaaattttgttttgactattgaagctttgccacgtttattcataataaaattcgccatgaattcataaaaaataagtaattttcattatttatttcttttataaattatatatttttattttcaagaaatatatgaaaatataaatatttatgtttagcttacttctcaattaaatg

SEQ ID NO: 118430 - DNA, 129 bp, Heterodera glycines
  Promoter: Source sequence=SeqID_39709; Location=262..390; Strand=+; Gene=SeqID_68211
tgttcgtttatttgtcttttttttttgttcggagtttgtctttgtcttttaattaagtagggaatttcgaattaatttataattttgaatttattattgctgaaccctcttattctcattgaaaaaatg

SEQ ID NO: 118431 - DNA, 1003 bp, Heterodera glycines
  Promoter: Source sequence=SeqID_1283; Location=211..1213; Strand=+; Gene=SeqID_71485
caaacctattgcgcgacttttttcttgcaaacccaaacctattgcaggggggtgcgcgacttttttgactacgcgactttatgcaaattattttaattaaatttatttaattttaaattattttaaacgtcttaaaggtcaaagacgttgaatttaaattcatttaaaattctccaaaaattccccgcaccaagcggatccgaaccccaggggggcggccagactgacgcactaaccactcggccacattggcaatggatgataaacattaatttgctctcataaagggaaaaattgacgtcaccagcggcgggaggggggcgagagcaggcggcgagaagggggagggggtcaaataaacaaatcaattattgaattcacaattttctcttttaaaagcaaaaagaaatgggggaccgtataataaaatataatttagaaattaaaataattaaaagggtaattaattaattattattcctaaaataaattttttattacttctaaaataatataaatatttttcagtgaattaacaaatacatttaagtttaattattgatttgtctgttaattttttatctcctcaaaaataattacagcaccctttcaggtgttgggcgtttgtttatttgaccaataatttttaatttcacatctttacgttgcccctccctcacacctgctcatttgtgtaatttgacaccgtttcttttatcttttcgttaaaaattaaaaagattgtctggaatttgtcttgcgccaaaccgctgtgccattcatttatgtaatttgacaccagtctgataataatttcgccaaaatttatttattatttgtccatttattacgaattattttgcatctatcactccaaattttgttaaaaaaaaattttttattgtcccaatttttaccattttgtgttttttcaacaaaataaatatttgttcaaaatttaaagaattaatttttaaaattttagacacaaaaacaaatcatg

SEQ ID NO: 118432 - DNA, 540 bp, Heterodera glycines
  Promoter: Source sequence=SeqID_10806; Location=535..1074; Strand=-; Gene=SeqID_74071
cccccccccgaaacgcaaaaaagtaaaaattttcagtaaattttttgaaattttcaacaattttcttaacaaattgcattaaaatactcaaaaaattttcccggcggcgcctatcggcaccgccgggacctccaattttaccaaaatgtcaaaaaatagtaatctttggcgaaaaacggctaaaaatcttgtaaaatataccccataattcgggatttcaaaaaacgaaaaacacacccctaaaaaccaaatttttgaacttcagccccctccgaagccaagggtctggctacgcccttgaaatgagaccatcaggagcatttcttttttgctcaaaaggggttccaaaataagaattgaattcagcacaaaaattgattaaaaatagttataatttattttcattaaaaagtgtaagatttaatttaatttaatttcaaacagattctctacattccatgtttgatagcaatttggaaacaccgtgcccaaccctgctacaagtttctgttcttcatcggcatcactgatgtgctgatg

SEQ ID NO: 118433 - DNA, 109 bp, Heterodera glycines
  Promoter: Source sequence=SeqID_18612; Location=2393..2501; Strand=-; Gene=SeqID_83267
tgtattgaatactcaacaataattcatgaatttatgcacgtcgttggattgtaaaaataaatttaaaataaataaatttaaaaaatatattttttttttagtatccatg

SEQ ID NO: 118434 - DNA, 743 bp, Heterodera glycines
  Promoter: Source sequence=SeqID_8940; Location=1798..2540; Strand=-; Gene=SeqID_69739
cggagatttgtcattggccatgtcctcattcggcttgccatactcgcatgtgcaatgagaatttgtcaaattaagctcatttttcataacgttttggaaaaaaatgggacagtattcgatttctttgatccaatgacattgccaataagtgactgcgaaagacggattgccctctaaatcaatttgtaattaatttaaaaacgggctgatccgcttgttttgactcttgtcatgaattcacgagtaacttttggagtctcagctcaactctcatgggaatattctcgatactgatttggtctcaagctgaggagtttagctgtttttgatttctcgtgaaaattttgcttcgctaaaaacggatttggcacaacaccagtatacgggggacatgatctgaccctgttgaacgtacaaaattctggcctccacgtcacctattgttacatatagtcagtcttactgtatcgtattttacaaaaggacacaccatttttcgtgatcttcccgtaaacagataaaactgaaatttttacaaatcgagctgagttctaaaaatattaagacaaagtagatgccaatgacaagccgaatattcagtcgaaaaattattataaactcagattttcaaatttttcaagcgcctgtctttttttataaaagaaactgaaaaaatgataataagagccgaaaagattgaagagagtgaaaaataaattaaggacatgttgtgacatgacatg

SEQ ID NO: 118435 - DNA, 127 bp, Heterodera glycines
  Promoter: Source sequence=SeqID_6497; Location=882..1008; Strand=-; Gene=SeqID_61792
ccttaacagatttttagaacaattttccattagatatgtaaagcattttaaaatacaaatttaaaatttttttaatttaaaaaacaaataaaattattttacaattttcctcgcctcgattcaaatg

SEQ ID NO: 118436 - DNA, 910 bp, Heterodera glycines
  Promoter: Source sequence=SeqID_6213; Location=5055..5964; Strand=-; Gene=SeqID_60746
agatcattcaaaagagtaatcaatgtcttacgctctcactctttttctctctctgttcaattagccgcattctccccccactcccttccctctctctctctctctcttctattagccacagtctcttccatcactctttttctttgtcggctttgtccctgtggttttgcccctttctttctcttccgttttggcgtatttttcttttctgtttagcattttcaatttccgatctaatcggatggatattcatatttactgctaaaatgtgaagatctgaacagttctttttcatgtggcaattaatgttagcatcattagcctaagtaagcacatgaatttctcgagtaaaatcagctgaatttatttaaaaaataaactaaaaatagacattatttaaacaaattcgatttgcgaaaacaaactcatataatattccctagtaaattacaaaaattaaatgttttctcaaataaaaaatttgataattttctccgtcgtctttttttacattctcttatttgtaataatatcggttaattcgcatgttgacagaaactccaacgacgctgtttcgaatgtgcacaattcacttaccgtacatccgattagttcggaaggtatttttaattaccataattaacaaatagccataatagcattttgtttctttctgtttgaaagtataaaattttagttagaatccgaatgcattgtcataattgttctttgtttttcggggattcaaacgcttttctcggaagtgccgactttaatttttaaattgtctaaattattttttccttaaattttccccaaaaaacgaacttgagttgcgtcgggaacctcctaattttaagaaagtctcgaggcagtgaatccatcggatgagaattcgtggccaaatatg

SEQ ID NO: 118437 - DNA, 483 bp, Heterodera glycines
  Promoter: Source sequence=SeqID_16154; Location=1747..2229; Strand=-; Gene=SeqID_80518
ttctcgctgattcggagtcccaccgtttccttcaaatttaggcccccaccattctttcatccaagaggaacattcacctggtaaattttggaaattttaataataaaaacctttccaaaagcgtggagtgtttcttacacagcaccgaacgacggtcggaaaaatgtccgaccatcgcatcgatacgtttttcaaggagttcaattcgctaagccacccgacccacaaagcatatggcaggaacagctgaaccaactgaaacaaaaagacgcacaaagcatggaattgatgggaaggacggaaatccctcaggcaaaaaaaggaaaaggaaaaaaaggaaaagaaaagagaaactaatcatcgaaacaactataggcaatccgcaattacttttcgttggatttgccgcccgaaaaagtgatcaaagaaatcatcggcgtcgatttgcactctctcctcggcccgccttttgacaaattcatg

SEQ ID NO: 118438 - DNA, 156 bp, Heterodera glycines
  Promoter: Source sequence=SeqID_21656; Location=2611..2766; Strand=-; Gene=SeqID_52259
tggtcgttggtgggttttgttggaaatcaaaaagaaactttttcggaattcatctccccctgctattcagtgctgttagctagggaggatggcggatgggaagaagtttttttgaatcagacagagagaataacgtcgtccattgactgcctgatg

SEQ ID NO: 118439 - DNA, 1003 bp, Heterodera glycines
  Promoter: Source sequence=SeqID_4015; Location=2978..3980; Strand=+; Gene=SeqID_52822
tcgagacttcgattccgacacaaaatttattaaagaagcgatcgacgaattaaaaatgcgtaaaatggtgaaaaaaattgatcgaaaagtccagcaaaacgaataaaagaatggttgggggtgaaggaagcgaagagagcgaccccttgggcagggccgcttaaatagacattcgacaaaatgggcggagtgacagacggcccgataatgcgatgagaaaaaatgggacaaaaaatgggcagaaattgtgatgtgaaaagtgtgaacaaagaaatggcgcataaaaataaaatgtaaattggcagatgtgaaaagttaaagaaattgaaaagaaagaactttgtgcaaaattgttttgcacaaagcttgggccggagattagccagccgatgagaaatgaatttgtaaagaagtgaaaaatgggacaaaaaataggtgaaatgataatggctggtacgattaaatggagaggaacgtgatcaaaatcagcgatttaggaattgatgaatcgggaatccgcccgaacgtctcgtcgcctttttgctctttttcttccggtatttcttcgtatttgacggtccggcccatgtgctcgtgcttggtcccgagaaaacggactccccgtaacggtcctcctcgtctgtgtcaagttctttcccgattcgctgcccgtccgcgccctggttgaacgcgagcactcgcgcacgccgtggcgggttggcaccccccttctcgtcgccaatgagaaaattggcgacaaattaattcgtcacatttttctctccttttgtaaatcaattttttgttgtttcttcagttcatttgtattaattcacaaagtgataaaatgggctcagagaaggggaaaggggggaacaacagcatcaaatcatcacaatataatacaaaattaattatgtattatattaatttgttaaacttgaaagggcatcaaaaagcggggaataaactcgacttttggaaggccggcactccgaacatg

SEQ ID NO: 118440 - DNA, 1003 bp, Heterodera glycines
  Promoter: Source sequence=SeqID_3267; Location=887..1889; Strand=+; Gene=SeqID_83972
taaacatgacatatttttttatattttgatggatcgtcctttattcttaacatagattctctaattcttgaaacgagccgcccagaagagagggtaggataaggcgagaataaaaacatttattttaccatacattaaatttatattcaaatttattttttttaaaaacttgtgctttgaacatcgaccacttcgccttttttgcatttgaactgctttgagcactaagccgaactttgccaaaccctttatccatgtccctgttcaaaatcagatacagatctcggctttcctggtccaagtcaaagccctttaaccggatgataaaaaaggtataaaaggaaaatttaaattttatttttaaaaaatattttttggctttcttcaatatcacttgcttaaattatattttattagaatggaaaaaaccatttttaaagacaaggacaacctaattgtattgattgccaataaataattgatttttattgcaacattctcttatatcttatatttacaattttatttaattttatttttatgttttagtaatataataacatttaataatatttaattattgttaccctttcttataaactttcttgtaattagccattttatttcttgaagaaaaagaaaacaaaaaataataattaataaatagcaaataaccaagactaatgtaattaaaatctttttggcatttatttttggcaactttcataaaactcgaaaaaaacacattctggtaaaaaactaaccatttgaaaaattaattttttatgattaatttttgaagtatcgttggaattcagaaattttttcccttacgtcctttgaaatcacaaatcacttaatcgttattactattatttataagacaagagattttaatacttatgccatgtttgagaatgctttcatttgattctcaaattggaatgaaataaatgaaaatgaaaatggttattttttacctaataatataaattttagaatg

SEQ ID NO: 118441 - DNA, 151 bp, Heterodera glycines
  Promoter: Source sequence=SeqID_522; Location=156..306; Strand=+; Gene=SeqID_55203
tcggtaaattacttgatcaaaaaatcataaagtgaaaatttaaacccatagaactcgccgaagcgcaagaccaccctgctgctgctgctgctgccgaagcggaagcagttgtcgactctgccgaccctgctcacgatgcgacaacgtgatg

SEQ ID NO: 118442 - DNA, 341 bp, Heterodera glycines
  Promoter: Source sequence=SeqID_7341; Location=1..341; Strand=+; Gene= SeqID_64520
cgtatccgtatacggatttttacagatccgtagtccgtaatccgtatttttttgggccgatacggatttttacggagtacggattttccggatttttagtccgtaatccgtatgtgtgcctagtccgtagtccggatcctgatccgtacaattttttgatacggattacggattttttaaactgaacttttgttgaatattttttttgaattttcattatatttcgccaagttttgataataaatttgaatttgataactctttttctcaattcttaacttattttcaacaattaatgaattttttgtttgatctttgaaaaactgaatttagcaaagatg

SEQ ID NO: 118443 - DNA, 350 bp, Heterodera glycines
  misc_feature (15)..(15): n is a, c, g, or t
  Promoter: Source sequence=SeqID_12640; Location=607..956; Strand=-; Gene=SeqID_76315
tcaaaaaattttacngcagaaatgctatttttagcccctttcttcatagcatatgcgcagaaaaaatatgttaatccatataatttacaaccctacatataatatatgtgggtgaccatggcaaaaagcataacatatttaatgatttatgctttttttcttaagcaactaaattatattttcttttttgggatttgattcccttgtataatctattaaataaatatttcaaaacatttcattgtttcaaaaagcttatggccaaaaaaggacttaaaattttttgaattttataaccaatttttcaaaaaattataaaattaatattaacatccaggagctattgaatg

SEQ ID NO: 118444 - DNA, 53 bp, Heterodera glycines
  Promoter: Source sequence=SeqID_23711; Location=483..535; Strand=-; Gene=SeqID_54406
ttctttaaaaattgcctattttagaggatttttttcctaaattattccaaatg

SEQ ID NO: 118445 - DNA, 391 bp, Heterodera glycines
  misc_feature (98)..(98): n is a, c, g, or t
  Promoter: Source sequence=SeqID_15778; Location=504..894; Strand=-; Gene=SeqID_80102
atggcgaccatcaacaaatccgtccgagattgtgtgatagcattgagatggcgaatttcctgggggattactggtgaaaaaaagggagggaaagtggnccagccccgaagattagcacgaaatgtttatggtgaaatttccccccaatttttacggattaacattaataatatttttttgaatttttttaggcctcccgaattctcgaaggccacttcgagccgttgttgtacattgcggtggagtactgttttgccaacaatttcaagctggccgccgactttctgacagacgcggcccaagtggggaaataattttttgataaaaattcacagatttttaaatttatatttaaaaaaataccaaattgcccataaaaacagttgctatg

SEQ ID NO: 118446 - DNA, 152 bp, Heterodera glycines
  Promoter: Source sequence=SeqID_5575; Location=2558..2709; Strand=+; Gene=SeqID_46072
tgctaacatagattttttacaaaataaaaaaccttaaaaattaatttaggtatttaaattttcaatgaaaatagggatttttttctcttccatattaatttttttttttaatttagcatttttttagttgcccgagcatttttgcctgcatg

SEQ ID NO: 118447 - DNA, 329 bp, Heterodera glycines
  Promoter: Source sequence=SeqID_18833; Location=3186..3514; Strand=-; Gene=SeqID_83526
aattaagtaattagcttctatttatttatatatagtgtccctttttgtttggcagcattacataaatcattaggaaggagaaccatgatcatgatttttataaactttattcgtcatagcatatgcgcagaaaaaatatgttaatccatataatttacaaccctattcatcaccattttcatgtattataattattaattatttcgtttcacttgacattgattccaattagaaatgtttataattttttcacagacattgattccaattagtatttttataattttttcacaatcattttctgcaatatattcaatagtttgaaaatg

SEQ ID NO: 118448 - DNA, 168 bp, Heterodera glycines
  Promoter: Source sequence=SeqID_33736; Location=1..168; Strand=+; Gene=SeqID_63710
aaaacggaaaataatgtcttaattcactacgttggagcattcgaaagtttaaaacctcaccatagagcaaaaagggaaaatgagaatgggataagccaaaaaagagggaatgccccaagagaaagaccaaacaagaagccaaacatacggcgaggacaaatcacaatg

SEQ ID NO: 118449 - DNA, 582 bp, Heterodera glycines
  Promoter: Source sequence=SeqID_1672; Location=3478..4059; Strand=+; Gene=SeqID_75231
tcttgcgcagcacgaaattatgccgttaaaagaagaaattgaaattaacacacaacatagggaggacttgaacctgggaccccccttttggtgactaactcacagaccactaagacgaaaaaaccaacttaccgtatttgctctttttatataccatggtatattatttttcaaccttctcagaagggggtatataattggagactggcagactaatggagactggcatataaaaagagcaaatacggcaattgtacttggagcccaaaattgaatcgccgtgtggaacaaagtcaccaatttacgcttgactgttccgtttgcaacagccgatgagcagccagtttggggtgttattatgcgtaaaatttggccaattttttcggcaaacattcgccacttgggcgtttgcaatggcatcctttttgacaaattgcgtcgtctcacttcgccttcaattctcaccgatctcgaccaattgaattcaatctattccggtgatttgttgcccgaggcgattggtgatgatgattttgatgggccaaatgccacaatttctgctggccaaatgttgtcaaaatg

SEQ ID NO: 118450 - DNA, 177 bp, Heterodera glycines
  Promoter: Source sequence=SeqID_6193; Location=742..918; Strand=-; Gene=SeqID_60671
ggtgacccggaacaaccctggtgcacacacatacactgttgacccctcatttatttttgcataaatacccctcctcttcctcccttcgttcactgttcactttgccatttttctcctcatttcctctgtgacccatttccaatcaatattttggctattacttttgattttcagatg

SEQ ID NO: 118451 - DNA, 351 bp, Heterodera glycines
  misc_feature (35)..(35): n is a, c, g, or t
  Promoter: Source sequence=SeqID_7383; Location=1153..1503; Strand=-; Gene=SeqID_64664
ccccccccccctccgctttagtcctcgttagttanctgtcagaccaactccttcccctctatttgataaatgaaaaatttgaaaatttttgagtggcttagaatctaaactcacaaaattaaatgggaatcgattttttttttgttgaaagcgcttaatttacaaaaaatatttaatcggctacttttttagctcatatcaatttgataatttacaaaaagttacatggcaatacatttttttaattgcataatgaaatttattagtgagagactcgaattttaatcaaaaaaatttaaatatatttcacaaaataatttattaatttatccctttcagaattacttgatg

SEQ ID NO: 118452 - DNA, 56 bp, Heterodera glycines
  misc_feature (21)..(21): n is a, c, g, or t
  misc_feature (47)..(47): n is a, c, g, or t
  Promoter: Source sequence=SeqID_45550; Location=1..56; Strand=+; Gene= SeqID_72826
cttatgtatcaaaatactctntagctaattatcatacctttcattanccataaatg

SEQ ID NO: 118453 - DNA, 1003 bp, Heterodera glycines
  Promoter: Source sequence=SeqID_3015; Location=103..1105; Strand=+; Gene=SeqID_82794
caataaataacatttttaaatttattttgagtgttattaatgcaaattttaatttttttttagcctgaagcggggaaaaaggtgcgaattcaattcaaaagtttgagcaatttgtttgaatgcacatacaactgctcatcggcgtatgtcgaggtcaaataccgagacgacaaaagggcccaaggcaaaaagacaaataattaattactgattaattgcaaaaggatcgtttataaggtgccaaactttgctgtccccgtgcactcactgatctgaacggaaatcaatacaaaaattggattgcggcggaaaagccggacacggacatagtcatttccgcgcacctttcaccaaattggaccgtaccgtctaccgtattcgagctgacgtatgaatcaggcaaggaaattgtaaaatatattttatttgttttttaattcttttttaaatatttattattttaatttgactttattttaaaatgctttgcatatctaatggataattgttcaaaaaatattaaggcaacgtcagaatctttttttcgagcaaatgcgtaaaaatcgaaaatttgtttgccgagaaaaggaaccccggcaccggcactttgtattgttatgacgggatcaataagaaacgttatgcctgctcctgtaacggtgataagaaatgcctcactgaagaaaaatatgaacacgacagctttatttgcccaataataaaggtgatgaggtaataataattaaataaaaactcaatattaaaggtatttaattaattaatcagacaccggcatagaaaaattttaactatttcattaacaaattattatccattcaacattcgcaagtttatgaagttttaggctaaaatataattaaaaatataaacgaacgatgtactgaaataaggacaagagagaagataattgataaaaagcccatctattctatataagttcaaggtcaatggaattcaaatcaaaggaagccgacaaacaatg

SEQ ID NO: 118454 - DNA, 246 bp, Heterodera glycines
  Promoter: Source sequence=SeqID_9280; Location=1423..1668; Strand=-; Gene=SeqID_70854
cgtgggttcgaatcccaccgcaggctgatcctttgcacttacgccatccgccaataataccacaacattttaaattttgctaatgtttattttatttttaaatctttacccgaatatctattttttgaaatggcaaattttattccagttttattctctttttgaaagtacaataagttccagacataattggcccccacgtggcaaaaaaaaatatagaaaaaaccccaaaattgtcacgaaatg

SEQ ID NO: 118455 - DNA, 170 bp, Heterodera glycines
  misc_feature (20)..(20): n is a, c, g, or t
  Promoter: Source sequence=SeqID_36017; Location=729..898; Strand=-; Gene=SeqID_65458
cattattcgcgtcgcgcctnttattcgttttggtcgcgtgccgtgccttaatgttacttttcgttccttaattaattaattttgttatttttatttcctcctttttgtgctttcggttttgtcactttagtttattttctatttaggtacaatatacctaattcagtatg

SEQ ID NO: 118456 - DNA, 97 bp, Heterodera glycines
  Promoter: Source sequence=SeqID_2393; Location=1..97; Strand=+; Gene =SeqID_79498
ctttttaactctccggattgttatttatatgtctccccattaagatacgttctttgggtgaactgaacttggtcgaacgcgttgtccttcaccaatg

SEQ ID NO: 118457 - DNA, 187 bp, Heterodera glycines
  Promoter: Source sequence=SeqID_18160; Location=1..187; Strand=+; Gene=SeqID_47499
cacagatttattagatttggatttttaaaattatacatttatttaaattttttcagataactcaaactcaaaaaaaaaattgccttttgtttcctcgattcctcgtcattttgcttcatatacaaaaaatttatacgcccttcgttctttcgtcaacaaaaaaaacacatttaaccaaacaattatg

SEQ ID NO: 118458 - DNA, 171 bp, Heterodera glycines
  Promoter: Source sequence=SeqID_9659; Location=1370..1540; Strand=-; Gene=SeqID_72224
atcattgattaattgatcatcgattgattgctccccttttttgcccttcacagatcatttgcttcaagcgcttcatctatgaaccatttgagcgccgatacatcaaacagcacgtgcccgtttcgttcccgttggacaacttcagcctgagcaaatacttttcgcccgatg

SEQ ID NO: 118459 - DNA, 138 bp, Heterodera glycines
  Promoter: Source sequence=SeqID_17859; Location=1..138; Strand=+; Gene=SeqID_82402
tcttcttccgtcgatggatatatcggcttcaccacagtgtggggctgcagcttaaccaaagaatcatttatgaacaatccaatttggtcaaaaacttccaaatgtaattattttattggggaaaaaaatgacgacatg

SEQ ID NO: 118460 - DNA, 231 bp, Heterodera glycines
  Promoter: Source sequence=SeqID_36984; Location=1..231; Strand=+; Gene=SeqID_66172
taatacaggtaaaaaatactgactaattctacagtagactattacagtataattcaggaagaagggcatttgaaggtccgaacctaaccaaaaaatatttacaaaaaaaactttcgacaactattgatatcgaaaaatattttaaaattttagcgaaattattaaaaaaaatggaaaaactttcaaaaaaaagcaatttaatcatgaagcttatcattaatgtttaccatg

SEQ ID NO: 118461 - DNA, 67 bp, Heterodera glycines
  Promoter: Source sequence=SeqID_13130; Location=1229..1295; Strand=-; Gene=SeqID_76932
gtcaactcattaaacaaaattcaaattggctatgttcattggcgaggactaaatcaagtaaaaaatg

SEQ ID NO: 118462 - DNA, 1003 bp, Heterodera glycines
  Promoter: Source sequence=SeqID_461; Location=5719..6721; Strand=-; Gene=SeqID_53331
ccagaattttgggactcagaaaatccaagattcccccccccccgcatgaaaatttaaaaaaaaatttctatataatggaaaaattcttcgaatgcctcccccaatgagtacatattttaatataggcaattttcgtaacaaagtgcagtcaaattttcaaattttttttcaaaaaaactttcacttgggaaaattttattgattaaattgaaaattttgataattttgtttttaaatgcgtggtccgcggccgcggcaatttgaatgcgcgatgcgcggtgcgcggccgcggttttttttttttgcgcgatgcgcggtcgcggccgcggcaatttgaatgcgcgatgcgcggccgcggtttttttctgtgcgcgctccagccctgctccgagcattgtaaacatttaaaaagttcaatcaacaacgaaggagggaaagtgttggactttttgacctttattttattttttatatttgtttggcattatgtttaattatttgtgaccgtttttcccaccttttcttgtattcgaatttaattgcattagttttatgttttgtcttctccaaagaaaattgattgtttctttttttaatttggaataaataaactctctgagaagccttgacaccttccttgaatcccgaaccaaaagttgaagaaaaatcccatttggcgctcctgaggaagcaggtaaaaacgattgggggaggtcggaaaaataggactaagcagacttcgccgtgtgagttatcgatccaggacggacgataattaacgaagtgtgcaacaaaaagcttgacccaggaaagggcgagtcgcgtcttacttgaacaagaaaaaaaaaaaaaaaaaaaaacgacaaaagttcgggtcgaatctcgcctatttcttccgttgttgacaccgggtcggtgctacagcataaagttggaaactgcagaaaagtgaattgtatgaacatatccgggtcggagtgttgtaaaagataaattggaaatg

SEQ ID NO: 118463 - DNA, 630 bp, Heterodera glycines
  misc_feature (34)..(34): n is a, c, g, or t
  misc_feature (114)..(114): n is a, c, g, or t
  misc_feature (125)..(125): n is a, c, g, or t
  misc_feature (172)..(172): n is a, c, g, or t
  Promoter: Source sequence=SeqID_44830; Location=1..630; Strand=+; Gene=SeqID_72248
cagacttttggaaaaatatatttgcaattatcanccaattttgagaagtgagatagaaatgataacttcacgattcaaaccaattttcggtgctctaattaaccgcgataaaanacatccgaatncaattaaatagcttctgagataataaggtttatcataaaatttcatntaaaaataaaccctcaattattggtatgaacgatactttccaaacatgcacgcgttttgcgctcgagctatttatcatcgggcttgtcaattcaaagcgaaacaacaaagatagtgttttgaacgaataaagggcataggttattttgaagaagtgtcaaagaacatgcagcaataagcctgcaaaatctaataagtggaaaatacatgagtatagaatttattttcagaaagtgtcaacagacttttggaaaaatatatttgcaatttatcaacaattttgagaagtgagttagaaatgataaacttcacgattcaaaccaattttcggtgctctaattaaccgcgataaaaacattcgaatcaattaaatagcttctgagataataaggtttatcataaaatttcatttaaaaataaacactcaattattggtatgaacgatactttccaaacatg

SEQ ID NO: 118464 - DNA, 638 bp, Heterodera glycines
  Promoter: Source sequence=SeqID_16643; Location=948..1585; Strand=-; Gene=SeqID_81052
tcaggggtggagcgcgaccgcaacggatacttgattcgtgatgcgcgacccgcgaccacgggtttttttactgcgcgacagcgactcgcggctttttggttctaaatttttataaagaaaatttatgaactgattgttttatttaaatattcatattagaaacaaaaaatttctggaaacggattatttttctcaaaaaaccattcgacgctaacaaaaaattttaaattttctttaaaatattggctcttaatcacaaaaaagtcatttttagacataatcttttaaggaggacgagaaggaaaatgagaaagacgataggcatatcggaaaaaatccctgtctaagtaggcacgaaaaacatggatattcgaatttagcatttttgatccaaaaacggcctaaatgatcttttattacatggttgatgactttcagtttgtttcagtaatatgctaatttcgaaaattttgactttcgactttttcttcgagttcgggtctagggttcggaattcagaatgatgttcttaagaattttacttttatcaacacatatacaaaaccgaggccaaccaacaagcgccattgtttgaatttaaatattaaagaattaaagtgcaagcgtttttgttaatg

SEQ ID NO: 118465 - DNA, 467 bp, Heterodera glycines
  misc_feature (14)..(14): n is a, c, g, or t
  Promoter: Source sequence=SeqID_28314; Location=1..467; Strand=+; Gene=SeqID_58941
tatccagaaaaaanatttcggggagggcacctgaagagctttttttttgctcttcgaaggtgcaaacatttcagaaaatttggctattcttgcttgaaaaaatttttgatttttcatttcggggggcacgtgccccccccccctagatacggtcctgatgtacttatacccagggaagcaatatatgaatgtagaaaattaagggggcatcgcaaatgaaatggcccactacggggaaaaaaaggaggaagaagtgatcgcgaagcgtatatgactgccgcgtacacctatgtaagcaactgaattttaaaatttaatacgaaacaacattattaaatagattaaataagatttccttagataaaaaggcaagtaatacctaagacaacaacaaaaggttcgttcgaaactgtgccagcaattcttgatgcagaaactgagacgagaattacacaattaatcgaatg

SEQ ID NO: 118466 - DNA, 255 bp, Heterodera glycines
  Promoter: Source sequence=SeqID_8084; Location=1958..2212; Strand=-; Gene=SeqID_66932
ttggaagaatttgcagaaaaaatgtaaaaagaaatgaatgagaagggcattctcgtcgtcgttgacggcatatgtttgctcttctccgttcgcgtctcgatctactcacaatatttattacgctgataagaaaaaggggccatctcaaaaaattatgcaaattatataaagctaaaaaaaggatgaacggtccggtatataaatggggacaaacaaatttagtttcattttgatcagattttcaaaaaaaatatg

SEQ ID NO: 118467 - DNA, 359 bp, Heterodera glycines
  Promoter: Source sequence=SeqID_31906; Location=205..563; Strand=-; Gene=SeqID_62216
tttgcgttatttcgaacattccgcagctaaagaagcgctccgtgaagcttcagaattgtccggcattgaaaaagtcgaatttggcggagcattgggtaaaagcaatgcaagaaattaaatttccatttgtctatttcacaatttataattcaattttttaggtcgtcgcacacgctttcaacaaaaagaagtcccacaattgtttttacaggtgtaatttctgataatttgtgacttttatttgcatttttttaaaattcctttttttgttgtttcattttgaattagtgtgtgtgtttagactgtcacccattttctaacttccctctttcaggtgactctttcctcctctcaaaatg

SEQ ID NO: 118468 - DNA, 748 bp, Heterodera glycines
  Promoter: Source sequence=SeqID_14930; Location=1881..2628; Strand=-; Gene=SeqID_79095
caaaagaaaaacaattaaaaaataattacaaattcacttattaaaaacttaataaagaatgataattgattgcattcggcatcataaacataagagaatatgtagaacgccaaaatttattacataattaattaattaaaagataaactttttgaactgaattagaaatcctgaaataaattttgtgtacagaatagctaaatgaaaatatgtattaaacgaagagacaatataaaaaatgtaaagaaaaattaaaatataccaaatacgttcaaaacagttgtaagatgaattagtacaacctttattttgtttaataaaaaggcaattgcttcaaagatttataaataattaataattaaaagaaacatataatattttatgtattgaaataaaaaagaaaggtacacatcggaacattcgataattttttatagttaatcaaaagaaattaagacaattttatataactgaaaataacaaaaagtttattgattgataaattaacaaattcaaaatatagaatattataaatataataaatatttaataaacaaagggcgacaaaacataaatattccaacattcacagattaaaataaatatatatttcataatgtgggcattgttcacaagaaaaagcctaaatatacaaaaatggagtcataaaaacttaaaattaaattacaaatatattttcataaattaaataataatattataaattttgtttatttaagctaaaatg

SEQ ID NO: 118469 - DNA, 61 bp, Heterodera glycines
  Promoter: Source sequence=SeqID_43479; Location=848..908; Strand=-; Gene=SeqID_71128
tcagctgatgatgcgtcagcgcatttttcatagacagtaaaaatacgaatatatttagatg

SEQ ID NO: 118470 - DNA, 563 bp, Heterodera glycines
  Promoter: Source sequence=SeqID_33188; Location=245..807; Strand=+; Gene=SeqID_63329
ttgggttttgcaatggactaacaatttagtttaatttcattttataaaaaatgctttttatttattttagtgtgtgtgtgggattttaggcgctaatttgacatattatgttgaaaatttattgaatgcaaatacgtttttatgcgaaaaattatttttgaaaaaaaaaacatttctcattccgtcttccagaaataagaatttatttggtacttatccttttttaccccctcttgaaaaaaaatttacttctaaatgggaaaattttattcgctttggtcagatttttgcaaatttgactccaagttaatgcgcattagtcaatctttcgtcatgattttttttttatatatataattttttccgcacactttttaaaggtcaaacaaatttctgtctctgaaattctgccccgcacttccgacctgatcttcctgaacatcaaaacgtacgaaggtatggggtaggcaggcgtaaaaaaagttacaaattttttttttgagaaatttaattttgtttatgttagaccatccttacactttggaattgaccatgaaaggatg

SEQ ID NO: 118471 - DNA, 358 bp, Heterodera glycines
  Promoter: Source sequence=SeqID_3628; Location=2272..2629; Strand=-; Gene=SeqID_51186
tattgagaaattatgattatgaaatttttctttaacagattcctcgttgacagatagtgaacaagaaaacagagtgcatttaacaaaaaagagattaagagggattttcaccaaaaaagatggcccaaaaaatggtaagaatggagcttgaatttgagtgagaggatggaagaaatacattaatttttaagtaaaatcagttgagtattatatgaaattgaggtaatttcctttttttatgaaaaatttgctcaatatttagcgattattcttaaaataatctacttttggaaaatatccttattttcggggttctttcgtctaaaaaaaccttttagccaaattgttccgaggaatg

SEQ ID NO: 118472 - DNA, 465 bp, Heterodera glycines
  Promoter: Source sequence=SeqID_4708; Location=1274..1738; Strand=-; Gene=SeqID_55464
aaaaaatttcgacaaaaattataataactttttttttcagaagcaaactaaacttatattttttggtattttgatagacctatttttttttattagacagaaaaattttaaaaatttggcaaccgtattaaggcctgaaaaattaaaaattctcgcttttctagaattttttggcgccacaagttctttgtattttgtccaaatttgaaattttgcttgctaaaaaactaatcatttcatgctatcgaatgatactaattatataagatttggcagaattctaaacaaaatcattatatgaaaagaatgcatcttctttttatgcgaggaaaatggaagtaattattgatgataaaatttttccccttttttctcactgtgttaatatattttttttattttggagtgatttctgtttaaattttattttcatacggtatcaccaccgtatcagacttaaaaatg

SEQ ID NO: 118473 - DNA, 71 bp, Heterodera glycines
  Promoter: Source sequence=SeqID_24470; Location=234..304; Strand=-; Gene=SeqID_55197
gctaaaaataatttttgtaaaatatttaaaaataaaaaatattatatatttatacagtggcgccaaaaatg

SEQ ID NO: 118474 - DNA, 282 bp, Heterodera glycines
  Promoter: Source sequence=SeqID_1136; Location=1..282; Strand=+; Gene= SeqID_68455
accaaattccaactcctcttcggtattcatctccgatctgccctaagtggtcctctattagcacgtaaaatttcgaaaaatttcactaagattcaaaaaagttattatcaatatcgttcagaaatctggttttttgaataccaaatctaataatcttgctaatagaggacacttagagctatcgatcatatcaagattgttggttgatttggttgacaatgaaaaaagaaaacgaccccgactcattgtcagaatttttaatgtcaaatttcagcatttatg

SEQ ID NO: 118475 - DNA, 146 bp, Heterodera glycines
  Promoter: Source sequence=SeqID_10202; Location=3924..4069; Strand=-; Gene=SeqID_73322
ctgagtatgcttttaatttcaatcattgggttaaattctcatcccctccatttttcagaaggatgctcttccgactttcgtctgaacagagttgaggtgagaaactttttttaaaattattataattatttagttaaacaaaaatg

SEQ ID NO: 118476 - DNA, 872 bp, Heterodera glycines
  Promoter: Source sequence=SeqID_8474; Location=224..1095; Strand=+; Gene=SeqID_68203
ttcttcattcattccattcattcttcggccgcccgttttcttatgcttacattcactcatccatccgtgtctatttgtttattgtacatgtgatcgatcagtggtggtatttttctccctcctcatactactcgacaccattctctcaccactatatgtgttgatcagtgatgatcatattgattgatcggggcgggggcaaaaagattacacagacaaatttttttgtcgcccattattttcctcatttgttgcaaacaaaatgcattagcattagctatcaatctatttaatgggaggggatgataagcaatctctcgtcgatctcgaagaatgaaaatctcgattttgtttttttctaactacaaattcgactgtgatctctaattgtagggtgagaattcggctaactaattaaccgggcggggggggggtcatttacaatcgtttaattgatccagttttacaccgtgagaggtatttaacactcccaatcgaatcaatgtgtcaccaccactgactaaggtattaatcgctacttaatgaccttgctgtcagagagggtacttaacacctctaattgaaccaacacggtaattaaactcaaatgttttatgtttaattgacccaatttcgtcccggcggaaacacacaccctaaagcacattttatgtgcaccattcaattaataaaacatggcctggagcccaaaattagcgcgcgcacacttcaaacacaactttcagaactagcaaaaacaaaaaaacaatttcctcctgtgaacattttgccacccgttcttcaacacatttccacattcattaattcacaacatcattctccgccaatgaaaaattgttgttgccaaaatg

SEQ ID NO: 118477 - DNA, 147 bp, Heterodera glycines
  Promoter: Source sequence=SeqID_3188; Location=759..905; Strand=+; Gene=SeqID_47549
aaacatttgtgtagatgaaccagacctatatactctatacacttttccggattccacctcgaatattataagtcctttctaaaaaatcagttggtcggtgggctcgccgtgcgtcgtgcgtgctacggtgtgctgcgcttcatcatg

SEQ ID NO: 118478 - DNA, 281 bp, Heterodera glycines
  Promoter: Source sequence=SeqID_24592; Location=1985..2265; Strand=-; Gene=SeqID_55331
tttatggggtctaatgagcgggcactttggcaccttaactccacgtttggttcatcccacatcgccagttctgcttaccaaaaatggcccacttggagctcaaacattcaacgcctgggttcagagtcaagcaaccctggcttcatacccatttagagtttgagaataggttaaggacatttcgtccccaagtcctctaatcattcgctttaccgagtataactgcttaacgagctccagctatcctgggggaaacttcggagggaaccagctactagatg

SEQ ID NO: 118479 - DNA, 52 bp, Heterodera glycines
  Promoter: Source sequence=SeqID_28457; Location=1235..1286; Strand=-; Gene=SeqID_59071
tgcacagctgcgactggagcagtgccgggtgggccaacagaacagcaaaatg

SEQ ID NO: 118480 - DNA, 491 bp, Heterodera glycines
  Promoter: Source sequence=SeqID_15862; Location=1..491; Strand=+; Gene=SeqID_80194
taatgaattatgttcctacatatctccccttattacatagtaattatttcacgaagaaactctcataattcaggatttctaatatcaaataatactcgtttaaaaatctcctgaataaagaaaaatacgcactttaaaatcgactgaaaatagaataattcgtctctaataatcgatattttgatttcaaccacttccgaagacaagggtctggctactgccttgacagagacttcaaaattcaggaacaatttgtatatcaagggcttcttagatttttcagatggtttccttataatttaagttatatctgaataatcaggtctctcgggatgattgtagttataacaatacctttggatgtcataaatctatatttgtctcataaaactcgattggactcataaaactcgattgcactcataaagtgcattagagccgaaatcggtacgtagaagcgcttccaattctgaagtcattatgaagcgatg

SEQ ID NO: 118481 - DNA, 177 bp, Heterodera glycines
  misc_feature (49)..(49): n is a, c, g, or t
  misc_feature (64)..(64): n is a, c, g, or t
  Promoter: Source sequence=SeqID_40271; Location=772..948; Strand=-; Gene=SeqID_68666
ttaattaaaaattgatgatagacagaaatgttattaataattttcttanaacaataattagttntaaattaaaataatcaactaaaaaaattaaaaggccttattaatttatttaattactttattttattaattataatattaaaatgccaatttttagcactgaatatcacaatg

SEQ ID NO: 118482 - DNA, 719 bp, Heterodera glycines
  misc_feature (12)..(12): n is a, c, g, or t
  Promoter: Source sequence=SeqID_7238; Location=3429..4147; Strand=-; Gene=SeqID_64228
tttagcagatanataatccgttcattaatcataaaccggttagttttgtcctttttaacaatggtcaaatagttcgttccattcgaatccagtttcataaccctgaccagaatgtttaggtttttatttgggattaaattactgtaataatatattttcattcggatacgtaattttttttatccttatatcgtattttaaatagaatttcttcggaaattgaaagtattatttaaaatatctttgatcaattattttttgtcgtttatgtttataaaattcgttgttcgtccattctttatctacgattagatcgcttcgattggttcgcacatttcttttttcgtgttattttaaaatcgttaatttgagttgtctttcttattcctgcacggctctatcattattttaccagtattaatatttttcataaaattcaaatttaatttaaaaatttgtaccccttgtttatacttagaatatgtttttatttgaccttttaaatttttgacttatttttcatatcgttttttacaaataccttttttacaaatgtgcaaatttaatttctttttcaataaaaattatcgtaaatttcaggtattttgtcttttaaattgtttaaaatcaatggcccgtctcgaacctgcaccatatatatttgtgcgtttctgtttattaaccatttaatttttaggggtaatttctaaatttagatg

SEQ ID NO: 118483 - DNA, 82 bp, Heterodera glycines
  Promoter: Source sequence=SeqID_10874; Location=1437..1518; Strand=-; Gene=SeqID_74154
cggccccgggggaagaagcagtgaagatggacgaagcggccccgggggaaggaatgaatcccccaaaagtttccctaaaatg

SEQ ID NO: 118484 - DNA, 1003 bp, Heterodera glycines
  Promoter: Source sequence=SeqID_10610; Location=1761..2763; Strand=-; Gene=SeqID_73843
attttatttttaatttaatcgatagaaaggagaatttgttattatttgtgcaatggcttgctttttagaaaaccaatgaatagggatgggatttttagtgataaaaaatctcaaaataattaactaaatagtgaccaaaaaatgccaaaatagtggtaaaaatagtggcgaaaaagttccaaatttaggggtgtaattttttaaatagctgttttttaatttgaaaataatttaaaattaaggaaaaagattttattcactgattgcagttacaaaatattttcaatgccaaaatagtggcaaaaataatgacgaaacgccaaaatagtggcaaaaaattattttagtggccaacttccgaaatagttttttttagtggcaaagctccaaaatagtgattcctagtgatgaatagtggcactaaaaatgaaaaattttcgaaaaagaatgtgtttttcgtgcatttctcgtcgagttaaagccgcagaaaaaatagttaaaaaactaagaatcccatccttaccaatgaatcagcaacaaccatttatttagttatgtccattctcagcccgttaaatcggataaatcattcgtacaattcaaaaaccattaacatttatttttattttgttctcatttatttttttagtgtttttattgaaaaatatttatgtgtaaaagtaaaattaaggaaaataaaaaataaatataaattaataattaaatgctgggattatcgatcacttttttctccgttggatttttgtacacagcctttggtaaaaaataaaaatataacattaagaattttctgaaactctttagcattgaaatgtttcgtccagttcagtcccaaaggcaaatttgaccctgaagaccaattggacctttatgaatgccctgttgctggccatcaatgcgcttatgtccgatgcattgacaaaattaggaaaagtaaaaatataataaataaaaaataataatataaaaatttaaaaaaatg

SEQ ID NO: 118485 - DNA, 293 bp, Heterodera glycines
  Promoter: Source sequence=SeqID_41712; Location=1..293; Strand=+; Gene=SeqID_69783
attttgaatttgtgccatttggcgttttgtttccaattcgcattccgtccctttcagcagttgcgccgtgactcttcgtccctccggcaacgctttccgtcgcccgcggcggtgtgccaccgcactttcttctccaatcagcccaccgggcagcactgttccggcaaagatgccgcctcttcgactgcgcgtctctgctgccaattgcgcttccgccccttccaaaatcggcacttcaccgccctgagattggaaaatgcggtcacttcggcactgattcaatactcacaatg

SEQ ID NO: 118486 - DNA, 54 bp, Heterodera glycines
  Promoter: Source sequence=SeqID_22301; Location=1006..1059; Strand=-; Gene=SeqID_52976
atttcgtttactgcgtttttgtgacttttcccactggcatttaatttaagaatg

SEQ ID NO: 118487 - DNA, 1003 bp, Heterodera glycines
  Promoter: Source sequence=SeqID_1642; Location=722..1724; Strand=+; Gene=SeqID_75028
atttaaaataaattttaattatttttttcattttcaattttgaagcgcaacttcttattgttctttattgaccagaaaaaggattgtaatgaataaacaaatttctcggaatctcctcatccaggtttaatattcattaatttaataattgtatatatattttatttattattttctaattttttggcttttaatttattaggctttggtgcccgtcatcatttattttgacgttctttttctgctgattctttctttatttaaaattgacacaaaagggtgggaacatttgggtatgtgcaaaactcattaactttttattgcaataattttttgtccatttttaaatttatttattttacaggaaagtgctttcttaaaactgatcatcaaattagcactgtaaatgtttagaaactgcagcaaaagaaacagcatccagcaaaatgggccatcagtgttataaaaagagaaaaagtcgatttacctaattagcctctaattattttttagatttcacttatcacatacaccgttaaggcctcagaatccctgcgtaaactgggattctgatcaccttggattccgctgggggctttaaaaaaaaacgggcgcgaagcgcccgtccgaacccaataagatttaataaaacgggcgcgaaacgcccgtccaagctcaacaaaatttaaaaacgggcgtgaagcgcccgtccgagaaggaaattacgcgaaccactttatcccagctaaagaaccgactgttcacacacccgctagttatacataaatttaattttatttaaagaaaagaaataattgttgtataaatttataagaaaagattatcttttgatgaggtaagtgaattgaatgattggtgccacgttttccttttgcatttccatgtgattccaaaatgggcacttacgaaggccttttcaattgaataatataatacattaggaaatatttcaaatcattgccttttctttgctccaaaaatg

SEQ ID NO: 118488 - DNA, 137 bp, Heterodera glycines
  Promoter: Source sequence=SeqID_8741; Location=2602..2738; Strand=+; Gene=SeqID_69050
acatggaaagacaaaatttgacgaataaaatataaaatatttgtgatttttttaaaactgtctcaaaaacagtttatcatattttttttgaaatcataatatttttatttgtgtttcagctaataaaaaagaaaatg

SEQ ID NO: 118489 - DNA, 244 bp, Heterodera glycines
  Promoter: Source sequence=SeqID_1325; Location=4276..4519; Strand=+; Gene=SeqID_72561
tttttaggaaaatggaagaataataatacaaagaactaaaaattttgcattttatacctttcaatgtttatttaacccataaaataaatttggctcattcgaaatcattataaatagcatttatacttgcttaattttttcattttgttgtcttcatctcattaatattgcatttttcctctataaattgcactcttcctttcgttaatttttccaaaattgtagcttccaaattctcaaaatg

SEQ ID NO: 118490 - DNA, 849 bp, Heterodera glycines
  Promoter: Source sequence=SeqID_21389; Location=1..849; Strand=+; Gene=SeqID_52001
tgaaagtgtgcgtcttcgaagcaaagaggaagcggcgcgtgaagcggcgcgaagggaagcggcggattcgcctgagtcggagagagccgcggaaggaatgcgccattttgtgttggaggacaacgttttaacagtgccggaacgctttttggaggcggttggtccctttgctgctttgctttgctttacctccgatcactttttccgctgctattcttctgatctttttccgctttgcttttcctctaatcactttttccgctttgcttttcctctgatcacgttttccgctttgcttttcctctgatcactttttccactttgcttttcctctgatcacttttcccgctttgcttttcctctgatcacgttttccgctttgcttttcctctgatcactttttccactttgcttttcctctgatcacgttttccgctttgcttttcctctgatcacttttcccgctttgcttttcctctgatcacttttcccgctttgcttttcctctgatcacttttcccgctttgcttttcctctgatcacttttcccgctttgcttttcctctgatcacttttcccgctttgcttttcctctgatcacttttcccgctttgcttttcctctgatcacttttcccgctttgcttttcctctgatcacttttcccgctttgcttttcctctgatcacttttcccgctttgcttttcctctgatcacttttcccgctttgcttttcctctgatcacttttctcttccctttctcttttccataatcatttttcaattaaatatcaatctcttttttcctgttcaagattagcaaatatgcgggaagtgaccagcagatg

SEQ ID NO: 118491 - DNA, 1003 bp, Heterodera glycines
  Promoter: Source sequence=SeqID_26448; Location=428..1430; Strand=+; Gene=SeqID_57182
acgagcgagccaccagcagttgaattgccaacgattaaattggatatacatatttatatgttgtttaaaacaaactatttcaacagctttctaacccatagaaatctttaatttttccattgaattgtttaagaaacaaaggcaaaaaaataaagaaagtataaaagaatttttggccaaaaagcagccatcaacatttttaaattgcgtataaatctcgcaaaaatgaacaaattgtttataaattagagtccggaggaactctcgactcaaattttaatttagaaaataaaaagtccacaagaaataaccaagtttgtcaggttttttgtaaaaataagtacagagttaaatcatagaatagaaatttctgcctggataaatatttttgggtggaagagacgcaccccataatcttgtacaaaattctctatctgttgcacattttgatattatttttttattatatataaaatggagattaaattattattttttgggtcatcgttttgcctttaattattattttatgccctcgccaccccatcataaatataagtgaaccatgccatctttcttcatttaactcttctgcaattacttttttgttcaataagttcccttttaaatatatatttgttaaagaattgttatttaaaaaagagaattcacaatttggcaatttgtgattttagtccctcaaaataacccggcaattcaaatgttattttggcttgttccaatttcataattcgaatattatttttactggggtttgttgctcatcagtaaaataaattcattttaaaggtttgttacaaattttgaacatgggggaaagtttattttctgatgatctgatgggcttcaatctcgatttccattttcaaatttccacaaaaaatgaactaaaccggaattttaaataatttatctcatttagtttccaattattttattgcataaaatagataaattacgaatttcacaattgtttataatg

SEQ ID NO: 118492 - DNA, 1003 bp, Heterodera glycines
  Promoter: Source sequence=SeqID_12475; Location=359..1361; Strand=+; Gene=SeqID_76107
ttttaatcgttccctgttaatggtatgaataatcagtctgaacaagtgcatcatctccttatccgtcgtcccaatgcatctcttcccccttcctttccccctcccttccgttttcatcatccgccattatccgtccccccgggggcgtcttcttccgttagtgctcatcccttccaaagccgtgccaatgtttaccaaatccattagacattatttgcgcaagggcctctccatatcagcaaattcatttgcgttaaatgctccgaaaatccaaagcgaaaaaataagtcaaacaatttgaaggtttaaaattttctttaaaaaatattaaaaatgtataaaaatagttaaaagcatttatggaaatgattgatccttgattgccattttcctctatttatctgctaattagatttattaaaatttttataacaaatattttcccaccatttagagcgagtttttaaattcaaataaaaaaatgaacggcacaattattcggcaccaaattgaaaaggaggacgtggaaagtgagcgcgagttggtcgactttgtggagattgtgtacctttcgttgagcgtttgcattggcactttgctcaattcggtggccgtcgttcgcctcgtccgttactcaaagtcagtgacacggctcattaacgacaaattacacccaaatttaaaatggctaaatctgtttaaaaaaaaacattttttaccgacagaagtccctcgtcccaggccaagcaccattgcctggtccgacccctgcacatgaacccgttcgccatgttcaaattcaacttggccatcaccgactttgccattctgttcattcacgcacttggcaaggcgagtaaatattggaaatgcattttaatgccaaaaataaatgaaataaaacgatctaaccaagtccaaacctaacatttaccgagccatcgcttaaaataatgtttcttgatattctatgtactgtaatacagtaatcctccttcagatg

SEQ ID NO: 118493 - DNA, 1003 bp, Heterodera glycines
  Promoter: Source sequence=SeqID_1418; Location=2053..3055; Strand=+; Gene=SeqID_73442
ttttttttttttgttactatcatgccaccgcatcagcagcatgggatgcatttttcgtaatgagttgtgttttaaatgaaaaagcatcaatcagcaattggcaccacacacccacctactaaacgccccctcctctcctgaggcatttaaaaccggtacaaaaaagttgcccgagggatttattaatgggcaaattcacaatttcacggacaattagctccagccctatgctggaccacaccacaaccagaagcaagagttgacgttttgcaggcccatcacctcattttcatcaagcgccaaatagcagtcagcagttagcagaaaaagcgcgcggcgatgtgatagtgtaaataatcccccccgcggggcttcaaacggcaccctcccccctcccctctccgagttcgtcctcgttgtcatatccatttaccgcacagccgaccccatcggtgccatcaatagtagtggtgccaatggaatttcacaccccttttagcctccccccacatcagttgagcagcagcaataatggctccacccctggcgggccggacaagtctccccatcatccattttcattattggcatcttcccagcccccagtcggagaatgtggcaaaaatggaaatcccatcccccacccgtaggcgaaatttcagagcaaaaatcagtgaccatgcgcttctgctcgaagagcaccaaaaattgtttcattagcgaaccacaattaaatttctaaatgcggcgtgaaagtttttctgtctgaaatgataattaaaataattttaaagatagaagaaccatttcaatttgttggcaatgctcgtttccgcccccccccccactccatttttaatgtcatttgtacaaattaaatccgatttttagatgagcggttcccgagacatttaaaataattggatcactaatatgctcataataaaactaatttaaaaccgttattttagaacagaaatttgcttttttccattttaaaatg

SEQ ID NO: 118494 - DNA, 502 bp, Heterodera glycines
  Promoter: Source sequence=SeqID_36160; Location=1..502; Strand=+; Gene=SeqID_65553
cgttaattttatattttatattttcttttttcattaaaaatatttatttaccataccttcaacaggactctcgtgctgttagaccgaaacggaaaaatttgtaatttgagttttgtccaaaattttgaatcccggacccgaactcgaacaaaattcgaaattttaaataccaagttatccttacatgaaaaatttatttaaaactctcgttacttgatggaaaatcatagacaaaatcaaagattttccgaattctggactcagactcgtaatcagggtatttttaacactagaaaccccgaaagaaaaatttttaaatttttttttcgccgggacaccaattctccagtattaccaagcatcatgtgctgaaaatgctaatgcgcagagttaattaatcgattatttttttaaatgttaagtatatatatatataacgcacttattctatgaatttatacaggaattgcggtccattttattggatccaaactcacaaatg

SEQ ID NO: 118495 - DNA, 58 bp, Heterodera glycines
  Promoter: Source sequence=SeqID_38266; Location=759..816; Strand=-; Gene=SeqID_67136
ttctcggtttaccgttctttttttactgtttttaagacggtgctaaactaccaccatg

SEQ ID NO: 118496 - DNA, 222 bp, Heterodera glycines
  Promoter: Source sequence=SeqID_7588; Location=1416..1637; Strand=+; Gene=SeqID_65323
ggtgtgtttaagtgaaattttcagccatattttaattttagaattcacatttttggctggctttcattcggaaattgggctttcgaaatgaagtatatttagctgacggaaccttcgcaagtgcaccggagctcttttcgcaactttacgtcattttggggcggtacttttttggcaattttgatttcaatagttttctcctaatttcagtcgtggaaaatg

SEQ ID NO: 118497 - DNA, 92 bp, Heterodera glycines
  Promoter: Source sequence=SeqID_15301; Location=1..92; Strand=+; Gene= SeqID_79534
ataaggaaaagccggaggaagcgcaaggggagcagaaggaagagaaggagacccaacgggagaaggagaagcagttgggagagaaggaaatg

SEQ ID NO: 118498 - DNA, 371 bp, Heterodera glycines
  Promoter: Source sequence=SeqID_43964; Location=1..371; Strand=+; Gene=SeqID_71526
atcaaaagaatataaaattaaaatatgaataaaattgtatatatttttatcatttgagcaaatatattacagtcgagatttctctagttgtttgtcaagaaaattaatcgatgaatgttatgcatatattttattatgtgagaaaaatttgcttaataatattttaaaaaaattaattataaaattttgcggttttcgcgcaacgcccttttttgcggttttcgcaaaatagctatttttgcgggtttcgcgcaacgacgcggcaccgaaagcgcaataaaatcagaaataaattaaatatgcaataaaataaaaccattaaaaaaaaatttatgtccttatttggtgtttttagataaactctaataatg

SEQ ID NO: 118499 - DNA, 282 bp, Heterodera glycines
  Promoter: Source sequence=SeqID_11621; Location=571..852; Strand=-; Gene=SeqID_75068
ttagtttaataataaggatccaactgggatttttccaaattttttttgtttttaaaatcttatttgcttggaattaacgcaaaaactttaattaataactgcaaatcccgatccgctatagccataagaactcaaaatattgagtctcgccgtacggtatagtatactttcttttgttgacaacctctgcttgttccttggcccgcccaatttttaaatacttattacaaaatgcctttgtttttcaggggatgggatgacctgaaactgagcatcacaatg

SEQ ID NO: 118500 - DNA, 1003 bp, Heterodera glycines
  Promoter: Source sequence=SeqID_29596; Location=274..1276; Strand=-; Gene=SeqID_60073
gtaagcattaattcatgtaaaacactgaatttaaaaaaaaattttttttttaacccaataagcgttgaaattttcaggttaggctagtcctgtaccggggagtaagccgataaaatttaatgcgaatttttattaattatagaaagagttcagttcagtaaaactttgctttaccgagcactttctttaaaaatttatgaattaattttgcaaaaaaacggaaaactctgatttcgaaaattttttaaaaaaccaatacgcataaatatattttcaggttcaattagaacaatacaaatgtttacaaattttacacagaatttttcatccgaggaaaaatttttttatgcattcaccacttttgcataatttttttgtttcttttttgaaaaaattttccacctaggaaattttactaacattttcatagttcagttcaaaaattgactagatcaatcaaaagataaagttacctaatggaaaaaaatcccagaagcagagaatttaattaaatccaatcctcgggggtaataggaataattaaaaattcataaaaaatttaaaattcaaatggaacctcaacaatcctcattgacctatcaaaaagccacaaaatgaggataaatcctcagatctggctaccctgatattagtgctttattaaaaaaaggaacaattatcaaagttgaaggctgaacacccgggccatttaattttttcgtttgatttaattaattggctcaaccgttttggtttaatttttgcgaaaaaaatcactgagtttcatttaaaaaaaattcacgtaattttatatatttttaaaatttattcattggaaaaaatcaattacacgtggcacattagcttcaattttctgtattcatgaaagaattggtaggcatttaccttaatttattcgttgtgaatattaataaatcataaatatttttatattaccttttttacaattttttaaagaatttttagaagtttttgaaaaatg

SEQ ID NO: 118501 - DNA, 200 bp, Heterodera glycines
  Promoter: Source sequence=SeqID_31326; Location=545..744; Strand=+; Gene=SeqID_61693
ggtatttatttttaagttcaaaaataatattttaatttagactaatacaattttggacgaaaattcgctgagaaaagagactgtacataaaccgaattttattagtgcccgatttacctgttcattatgtgagggagaaataaaggattgtgaaatttgtgggaaggaaccgcgacatttaaaatggtgtagtaaggatg

SEQ ID NO: 118502 - DNA, 642 bp, Heterodera glycines
  Promoter: Source sequence=SeqID_12779; Location=1122..1763; Strand=-; Gene=SeqID_76490
ctaattactattctccgttaaaaatggtgcgaaaacaaccatgactaattagggagtggcaattaataataattaattaattacaatttgccgttaaaatggtgggaaaacaattaggaaaccaaattgtaaggctcgaaatatatgcatattttggcattttttcaaaaacccctatttaaacggccccctttattaaagaggccctgttgagctttaaggataattttttgattttttttctcgataatattaatataaaaaatgtaatttatgccataaataagtacacaaaatgaaaaattttcggggttttttactcaatttttttttacaaaccaatatattttagctttatttatttttattttcgtcaaaatgatttttcataccatatttagcttttttcgagatttttagcttagatttaacgaaaagattttttggaaaaattcatatgcatattttggcagttttggtgcatattttttcgtgctctattaattagggaacggcgtcaattaatacgacactaattaaggagcggcaattaattgattaatcccctaattgtttaaggtcaaatcttattttgagttcaaacacaatgtgacggtccaacgagtggagttcccactgatg

SEQ ID NO: 118503 - DNA, 1003 bp, Heterodera glycines
  Promoter: Source sequence=SeqID_2067; Location=801..1803; Strand=+; Gene=SeqID_77651
gtcattgccattttttgcgaacttttctttttttaaaaaagaatttttttgaaattttggcaaacttggaaatattttttatacgatggacgacaataaaaaaaatttgcatttttatgttttaaatccatttttggttgtttattgtttttttaagtttatttaagcaattattgaacacaaacactttttttggaatttttgagggtttaaaacacatattttgacagtttttgtccatattttggtccatatttggccatttttgagctttttagtccatatttcgggcttttttagtccatattttatgtccatatttgacgttttttagtccatataatttacaaccctaattattacctatttattttcttaccaaaaattaaaatactgatttggcttaattttgttacttttgcaataagcccacaccgtttcaaaaaacgagacatgaaccaataaatagagagtgcagagaaaaaaacatctctctttttggcgtactatttctttatctctgttaatagagaaaaaccgaatttacttcgctacgtttaattttttttctatacgttagatccactccaaattttgcatatcgatagagaaaaaaattacaaacaaaatgtaagggtttttaaacgcaaaaaaagggttaactaaaaagttattcgagaaacaaaatttcgaaccctcatatctttttcctaatcaatccaattgcttagcagttgcttagaaaaagcttctcctcataaagagctttcgaatgatatcaagtttttccaatttggttcggaaaaaccttcaaaaataattcccaaaattcgtcattttttaatattttggacaaaaataaataaaaatattcatgttgcacaacggactcgaaccaccaccctttgttcctttactatcttacaaaaaccacttcgccacacatgcaaatgtttttggaactgagaggccaaaattgaaacggtgtgaagccctaacaatg

SEQ ID NO: 118504 - DNA, 832 bp, Heterodera glycines
  Promoter: Source sequence=SeqID_20473; Location=1..832; Strand=+; Gene=SeqID_51009
gggctgatcggtctttctcttgctaatctttgactctttctctgatcactctctttgggcttatcggtctttctcttgctaatctttgactctttctctgatcactctctttgggctgatcggtctctctgctaatctttgactctttctctgatcactctctttgggctgatcggtctctctgctaatctttgactctttctctgatcactctctttgggctgatcggtctttctcttgctaatctttgactctttctctgatcactctctttgggctgatcggtctttctcttgctaatctttgactctttctctgatcactctctttgggctgatcggtctttctcttgctaatctttgactctttctctgatcactctctttgggctgatcggtctttctcttgctaatctttgactctttctctgatcactctctttgggctgatcggtctctctgctaatctttgactctttctctgatcactctctttgggctgatcgttctttctctgctaatctttgactctttctctgatcactctctttgggctgatcggtctctctgctaatctttgactctttctctgatcactctctttgggctgatcggtctttctcttgctaatctttgactctttctctgatcactctctttgggctgatcgttctttctcttgctaatctttgactctttctctgatcactctctttgggctgatcggtttctcttttccgtccgttttcttttaggagggcgtttctcttcgtgagcccatccgtgacacctttttgcaccatttcgacgtgaatacggtcggccccgtcatg

SEQ ID NO: 118505 - DNA, 309 bp, Heterodera glycines
  Promoter: Source sequence=SeqID_31498; Location=1..309; Strand=+; Gene=SeqID_61831
tttgaatacggattcagtcagagaaattggaactcccattttatttaatttgaacatcaaaatttttgtgaattccaaaatcaaattcccccaacgaattcacaaattatcccaagtcgaaattgccaaaatgaattttatccagttcggaaaattcaaagtgaaagttttccaaatcgggcggaacacggaaactggaaagagcaaaaaacagttcggtatgctcaaagtttccgacaacaggacaaaattctttaccatcctccgcccgcaaaacaattgggcgagcatccacaaaatttccaaatg

SEQ ID NO: 118506 - DNA, 52 bp, Heterodera glycines
  misc_feature (39)..(39): n is a, c, g, or t
  Promoter: Source sequence=SeqID_30563; Location=1..52; Strand=+; Gene= SeqID_60978
ccaaaacggagtacagagacaattctatccaaatttccnacacaatcaaatg

SEQ ID NO: 118507 - DNA, 1003 bp, Heterodera glycines
  Promoter: Source sequence=SeqID_1766; Location=2711..3713; Strand=-; Gene=SeqID_75832
gacacattttcacataaaatttaacggaaattacatgaaaatttcggaaatggataagtttcaaattaatattttaatttgtttggggcaatttttaataataagaaagaaacccattgaaggctatctttttatttgcaaaatatcaaaaaaagaattagggaaggtaaatacttgtaaatttgaagaagcactgattttttcacattacaaaaaataaaaataaatgcggaattcttgcgaaaaataatttatgtattaaaattggtccaaattaggaggaaaatacatagcacagaaaatcattttgttgacatgtccaacacttatttaaagtaatacatatttgataagtgattgattattcgggaattttttgcgcgaaaatattgaagttctcctttgaaaagtgccacgttatcaaatgcgatggttgtggtggcagggtcgatagttcagttggtagaacattggtccgcaaattcacagacgatggttcaaagcccactctaaatcttccctaaaagtttccctagaagtctaaataaattaaaataacatttgagcacttttacatttaatttatgatctcatttttattgaaaaaagagattttttggctgtctttttaaaaatattttaatttttcataagaaattcctataaattctcaaaacttcaaaatatgtataaaaaatgaaaaaagcgaaatattttgggttttattttgaattgtatcttctaaatcagtgaattttttattcttaatttcttttttgttttttttaatttgattaaaaacatttgaatttttatgaaattaaatattaaacttttctgttaattggtgattttttatttttggcttggcaccttgattgttataatcattttttgttattgataggaaaaatgcttttcacatgaattttaaaaaataaaataaaattgtatatataaattacattttaatttattatttatttcagttttgcaaagaatg

SEQ ID NO: 118508 - DNA, 256 bp, Heterodera glycines
  Promoter: Source sequence=SeqID_24651; Location=579..834; Strand=+; Gene=SeqID_55388
ttttcgaaaagaatgccaactaaataaacaattaaatgaccttttttcaattaagctatgcatacatattacaaaatataaatattaatttatttgtgttgttacagccgccgccgttgccggcggaatcgaaaagtttggcggttcggccaaggcccttcacctcatcggcacgcgtaaaatttataatttaaaattgaaattaataattaatttttttaaatatatattattttttagttttcatgttacaatg

SEQ ID NO: 118509 - DNA, 97 bp, Heterodera glycines
  Promoter: Source sequence=SeqID_17176; Location=1358..1454; Strand=-; Gene=SeqID_81617
gagaaaagagagttcagagtttagatgaaagaggagcttagtgatcaacgaaagtgctcaggagaagtgatcagagttgaataaagttgcaaaaatg

SEQ ID NO: 118510 - DNA, 53 bp, Heterodera glycines
  Promoter: Source sequence=SeqID_628; Location=1097..1149; Strand=+; Gene=SeqID_57749
cctgggataaattggtaattataattttatttcagcagtgtcttgtgagaatg

SEQ ID NO: 118511 - DNA, 229 bp, Heterodera glycines
  Promoter: Source sequence=SeqID_29739; Location=276..504; Strand=-; Gene=SeqID_60205
ttgtaaaatttaatccgaaaacaatgcaaaatttgaatgaaaatggaacgaattttgctatttagtaaaaaacgagcaaagagaaaagcctaaaaatataagccctatataaagtgccaattcatttccactgtttgtcacagaagagcctttatcgtttattatggtagagcaaacataattgagagacaacacatagcgattaaatcgacaatacaacatcagaatg

SEQ ID NO: 118512 - DNA, 220 bp, Heterodera glycines
  Promoter: Source sequence=SeqID_28876; Location=1..220; Strand=+; Gene=SeqID_59453
gggggggctgtcggacatacaccgtcggaaaaaacaaatgaaatttaaaagaaataagtcaacacatccaaacattcgccaaactgggattttaagttgatacttgaaaaaattaagtaagatattgtggcccgacaggcaccaaattatttttagaaataattttaaaaaataaaatgaaaaaatctaccattttcggggttgaacccaagcaaaaatg

SEQ ID NO: 118513 - DNA, 54 bp, Heterodera glycines; identical to SEQ ID NO: 118486
  Promoter: Source sequence=SeqID_22301; Location=1006..1059; Strand=-; Gene=SeqID_52977

SEQ ID NO: 118514 - DNA, 1003 bp, Heterodera glycines
  Promoter: Source sequence=SeqID_101; Location=7941..8943; Strand=+; Gene=SeqID_68299
gtcgacgtgccattgcgaaaacggcgagcgaattgatgtgaaggacggacggacgaatgaacgatgagaaacggcgatgaggtcgcttttgaagtgttgttgttattgcacaatgaagggatgatgatgataaacgcaaatagttctgttctaaaaaaggaaaaaacataaaaacaatacataatgaaatgaattataaatttaaaaatagggaaattgcagtttttgtaaaaaaaaatttgataaatttaggttcaaatttggtagtataggccagggaaactctgataaactttcaggtcgatgtcgataatttttggaattcgggttgggtatttactggttaagataagaaatatgtctttttgaaacagtgaagtttatgaaattcacaaaaaacatagtaaaacactcataaaagaaaaatgagtgaatgaaaagggaggaaaagggggcacaatatttatagtacgacgcaacaagggagggcaaaagttaggtagtaacgtaggtaggtaccattgcccaaattccaaggttttctctctatataaggaggtgtttttctcattggactgacattttttgcattacgcctatatgctttgcttacttgttccctcctctattcagtccttaatgttctgatttaattttttgtgttacagagtacgcaaaatataattaacccgaatttttccaattgttttttcaatcaaaattgactgtttctcacagaattttcctgctggacaatctaaacttggaatttaatcaaaaaaacccaaaaaattgcttttccctatttttaaaatttataattcatttcattatttatgtttttatgctttttcattttttagaacacaactatttgcgtttatcatcatcatcccttcattgtgcaacaacaacaacacttcaaaagcgacctcatcgccgtttctcatcgttcgttcgtccgtccgtccttcacatcaattcgctcgccgttttcgcaatg

SEQ ID NO: 118515 - DNA, 1003 bp, Heterodera glycines
  Promoter: Source sequence=SeqID_1073; Location=6484..7486; Strand=-; Gene=SeqID_67239
attttttattttgatgatttttaaataaacgacatagcaccatttaatccgttgttcatcattgaaaatatttgaaaattcatttattgaaaaattatatttttagaattctgagctaatctgtacatattggcgaacgcccttattgatggtttttatataacgacatagcacccaatttgtactattctaccttgtggtcacaaccccactgcgccatttatttgtaaatcgtggcccacttgaaaatttactttatttaatgattttttatttttatttatttaaaataaatttttgttttactatattatcaattctagaattttacaattttttcaataaaactttctaatagttgtatttaggttggttagttttaattttaaaataaccattttcgtacgaaacgaaacgaaaaaccgaaaatttttcaacaaatttcatttttaattaagaactttaaaattgtatcctctaatagagcccggcgcgggattttgcgggataccgtcctaattaagagcttgtttattagctataagactttaaactttttgaaaatttgattctagcttaataataatttatgctcaaattttcatcggaagctgcgcggtgaatttcacgtaaactgacttaaaaaataaggtaaaaattgttaaaaattccccaaaaaatattatccaacaaatataagaaaaaatggtggaaaatatttacaaaatttttaataaataattgtattacctcacttccacttttcacgaatgcatgtgaatgaatgtaaattgacaaataaaatgagttaaaatcgttaaaagtgaattgaaattttattttgtcaaaattataaccacaaattgattttaactatggaaaaattaactcaattatccaatgatgtaatcaaataaaaaaatatttatgagtatttaaatgctttcttagcaaatggctttttcacatttatctaaagaattgttatttcttttttaaaatg

SEQ ID NO: 118516 - DNA, 249 bp, Heterodera glycines
  Promoter: Source sequence=SeqID_20009; Location=1..249; Strand=+; Gene=SeqID_84782
tttgccaagttgggctggacttggccggcccctttccatttcactcaaaaagggaacaaacacattttaaatatcgtttgttggttcaccaaatacgtaatttctgtcccagtccccgacacaaaagcacaaacaattgcccacacttttctcaccaattgttacttaaaatacggcggttgtgttgaattgatcaccgataatgcctctgccttcacttccgaatttttcagagaattttgctccatg

SEQ ID NO: 118517 - DNA, 199 bp, Heterodera glycines
  Promoter: Source sequence=SeqID_362; Location=4741..4939; Strand=-; Gene=SeqID_84438
ttagtgcatgcgcaagctgaacaatcaaaatgtttggcgaattcatcaaaattttaaattgtcaaaatttttccgtttcgtcgccctataaatactcgttccaaaatcagttttggcaatccaataaaatttctcttaataaaaaaatactattcaaataaataatcattcctagctgcttttggtttgatcacaaatg

SEQ ID NO: 118518 - DNA, 1003 bp, Heterodera glycines
  Promoter: Source sequence=SeqID_15413; Location=3650..4652; Strand=+; Gene=SeqID_79678
gatttcagaaattttagggtccttgaaatctcacccgagacaacgataagcgtgttttaattggagatgaaatggaaaacccggcttttgtgacacctgacctgaattttttttcgggccaacagatatttcgaaatgagataagatacggaaaataaaatttaaaggccactatgaaagaaatttagccctagaaaaaaagaaattaaaaaattacacattatttgagtcgtggccaacccagtcccacccattcaaccaaccccgccgccgctcaatgtcagttgctgtctgttcgcggtgccgggcgataataactatgacatgaatattttattgaacggattaaaaatattttatttgccctttggatttcaaaattaagatctggaaataaagtttaatggccactaggaaatcaaacctagccatagaaaaagaagaaaaaaatcccgcgtcaggaccaatcagatggggggggacccatcagtcgaggacaactcagctttcgacaatttaataaaaaataaataaatttttaaactaaacatattttttaatctttaaaaggcaactcatacaatgacttaggctaggaggctaggatgaagcttttttaggctaggcctaggcttgcttggacctaggtttaggctttatttggtaatccatcagccgaattcagttgagttgtccccagctgattgtccagaagtcgaaaaatatatacatatttttctaaaaaatggctaaggcgcccccacaaagtgtccaagccacgaaatgtccaaaagagtaaaaacccacgaaatgtccaaaatttttcaaaatttataaaaacaaaatgagtctaatttaggatttttagggttttcggggtcgctgaatacgaatataccctttatattaccccttgcctaaccttaggcccatctgaataataaaaaactcaaattcgagacttggacatttcgtggcctggacattttgtgggtcagcgatg

SEQ ID NO: 118519 - DNA, 912 bp, Heterodera glycines
  Promoter: Source sequence=SeqID_8319; Location=805..1716; Strand=+; Gene=SeqID_67677
attgcgattccgattacgattccgattcggcacatccctgctttgtaccccccccccctcccctttttggaaaagaaaattttcaaaaatttttttcgaaataaagttgttttatgggttttctgggtcgaagaattcgattcttatatctatttcggcccatttcgaaacactgacccggactcgaacaaaaattcgaaaattcaattttcgaaaaattctaaatatgcaaccaaatacatgaaataaaaatgagaatcgattcagaaggcaagataaaggggtcggggtcactttggcgcgggccattttggcgccgcgaactttcaagtgttataacttttttcttatccaaccaaataaaataattttgataccattaaataggcctaagtgttctttattagcctgcaaaatattagaaaaaataaattctgtttgacaaaagatatagcgtgcggcgccaaaatggccagaaaaagtcagttttttgaggttttttggccataacttttttgtgtgtcaattaaattttttgaaattttgcaggctattaggtactatcaagcgctttaaaatgatatcaagcttatttaatttgaatgagaaataaaaatgttatagcgtttggcgccaaaatggctggcgccaaagtggccggttcccaagataaagtatttcgtgcatttgaaccggttttgctgcatatttagaattcgggcaccgaaccgtcccctaccgcactggggcgtacccatagtgttgaattcaaattcaaattttcaacgcttatttttttgaagctgaaacggaccattcccgagagatcccaactcacatgctaatttgactcatgaatttcatttttgaacatttagaattacaccatagttgctcttgaatttggagatg

SEQ ID NO: 118520 - DNA, 776 bp, Heterodera glycines
  Promoter: Source sequence=SeqID_44279; Location=1..776; Strand=+; Gene=SeqID_71782
ttaagttgtaaataaaatttggtgcgctttagagctctttctgaaaaaaatatttatgaaacaaaaaaatcgattttttcaagtgtccgtttagggtactcaaacaattatggggagcaaaaatccaacgcagaattaaagtacaggctatagggaagctattcccgaaggattcggtctccccataaatctgggcgcatcggctcggggggactgccccgaaaacaaaaaaatcgattttttcaagtgtccgtttggggtactcaaacaattatggggagcaaaaatccaacgcagaattaaagtacaggctatagggaagctattcccgaaggattcggtctccccataaatctgggcgcatcggttcagggggactgccccgaaaacccaaaaaaaaatttttttggataaaaattatttaaatgaactgactagataatatttaaaataggttattactcttcctttcagtatccctgcaaagtttggtgcgcttctgatcagtttctgaaaaaaaagttaagcctaaactttttggcctgtttaaaaaggaattaaaaattttattcatctccctttttgatagaaaaagcatcagagtgcctaaactaacctgtaaataaagttttgtgtgtttcagagcactttctgaaaaaatacttatgaattaattttgcaaaaaataaataattaatgaaaaagtcagaatttcgaaaaattttaaaaacaacaagcgttggcattttttcaggttaagttagtcctttacaatg

SEQ ID NO: 118521 - DNA, 449 bp, Heterodera glycines
  Promoter: Source sequence=SeqID_23723; Location=569..1017; Strand=-; Gene=SeqID_54419
tcatgtcggtgtgaattcgccctcgacattcgtcccttcgttcgcatcgccagaatttcaaactaatatcaacattaaatttgtcgaaaatgtaaaggagtccatcgttaattaatttatccttgtgacgatttgtttcaacttcagacattattaataagtaaccaaatattgcttaagatataaagatagacaatatagatttaataaattatggtacacgagaagtataacaaattttttttggtggccgaacgtttcgtcactgaacctttcgtcactgaaataaaataaagaattatttattagtgaaaactatttttttttaaataaagttatgtatttgaaattttggagtgtctgatcagtgatcaccgtaaaaaatttttaatggacgtcaaaatttctcgtttcccaaacatgagtgcctaaatgtaattccccaaatg

SEQ ID NO: 118522 - DNA, 305 bp, Heterodera glycines
  Promoter: Source sequence=SeqID_13351; Location=800..1104; Strand=+; Gene=SeqID_77218
tttactaattttctgtaaattttttttggacattattctttttaattaaattttataaaaagctttacaaaatttcaattaaaaaagtcaaatatatttgtttgttataccaatatttcttgtaaaaaacttatgcggaatgttctgaacatggattttgtacagtgccgtgccaagcatttcccgacgatttgctcccgtaatttctttgccatttttaaggcactgattgtccgcccaacggagtgccttttaaaattaaaaaaaaaataataaataaatgacaaaaaaggctcctaattatg

SEQ ID NO: 118523 - DNA, 94 bp, Heterodera glycines
  misc_feature (36)..(36): n is a, c, g, or t
  Promoter: Source sequence=SeqID_31641; Location=1..94; Strand=+; Gene= SeqID_61957
gtctggcccgaaggcggtccgagtgctatcgaaatnttattggacggctgagcaggaggcgcgtcctgttagccgttactttgtgcaacgtatg

SEQ ID NO: 118524 - DNA, 123 bp, Heterodera glycines
  Promoter: Source sequence=SeqID_25040; Location=987..1109; Strand=-; Gene=SeqID_55771
tggattagacaaacatggacttggcctttttattctcccatcctcaagtcgatgtgtttgtgctccgaaatttaattccaaaattatacattatttttgttttagtttgtttgttaaacaatg

SEQ ID NO: 118525 - DNA, 721 bp, Heterodera glycines
  Promoter: Source sequence=SeqID_10047; Location=698..1418; Strand=+; Gene=SeqID_46836
ttttctatgtaatttatgtacctaaattctcatcagatattatggtaataatgtaatggtgggctcccttttcgaaaaaaaattttaaattatgagttttgggccgccttgatcagtgatcatgaccttgaaatctagaatcccgactcaaattcgattatacaagtattgacatgaattcgaaacccaacccggtttagcgaaatttttacggcgtaaaaaagtcattttacacgggtgccaaaaggacacaccaaagcgaaaaaagttaggtatgcacctagtcgcttatttgttagccatattatgtaacaacattatgccatttttttggatttaaattccaacaaattaagaaatctttttaatcttaacaaataaaaaagctaaattttaattttttcgtcttagactaggggacgattaaaaattagccgaatgctttctggtcgatgatcatgataacaattttaatccctaattttatggtaaaaattgcatacaaaatgcatcaaaaaggttaaatttctctacccttaagctatggaaaagaaaaattgtaaaaatgattgaaaaacataatttcatcccatgaaaaacacttgtagaaatttcaccccattctcggttttttgtcggccctttctctagagaagtgccaaaatgacaaaatctaaatttttaagcgaaaacaaatttgtttttctacgagtaagcaatg

SEQ ID NO: 118526 - DNA, 268 bp, Heterodera glycines
  Promoter: Source sequence=SeqID_35609; Location=630..897; Strand=-; Gene=SeqID_65129
tatattttttgctctttgaaaaatacgattaattaccatgccataaataaataattgcttttggaaattttcgaaattgttgagttttaaaatggcttgttataacattataaaaccgttgaattttcttttggtgcttgcgcttcgattttgattattccctgtttcttatcacaatctgtgcattttggtatagtaattacaattcctttctttaaagattgaaaatattctttttgttcaactcgaaaaagagaggcaaacgatg

SEQ ID NO: 118527 - DNA, 829 bp, Heterodera glycines
  Promoter: Source sequence=SeqID_8263; Location=1..829; Strand=+; Gene= SeqID_67487
aatgattttatttttgagatgcttgtaccagaattcgccaaaaaagcccattaaatctgatgggccgaagtgccaaattaactgaatgcgcttatttgcaaaatgatggccatcaacgaatttgcgttgagaagaacactattcagacagttaatcaattttattcaattaaaaatcattattttttaaaatttattaattttttaaatatttataaaactttgaatttttgcgaaaaagtaatcaaggacataaaggacatgtgcagggtttgtccttgaatgcttaaattcttttattttcttagggtgatagcggcggtgcgttattgggcagcaacggcacaaattttgtccaaattggcgttgcaagtgtcactttatgtgaccccttatttggcaaaagcaattttaatatttataaaatttaaattagtctaaattaacgaataattttaattaaatttttatgaattttaaattattcaaaattaaagaatttaaatacaaatttgtttatcataaggtttggtgagcatttactctccgctggacggttgttggattgagcgaattactggtgttgaatgtggcacctaattgatcgatctctattaattgcttttaatgccacaaattaattactaattaaaattgtcataaaatatgtgcaaagataattgaaatgaataaaatgatgcaattttgagatggataaaaaagcacaaattaattcgttgtcgccataatcatttaatttaataaatatttaagtatattttaattcatagtcaaatgggatgaagccaaatttaaattttcagaaaatg

SEQ ID NO: 118528 - DNA, 586 bp, Heterodera glycines
  Promoter: Source sequence=SeqID_27734; Location=1..586; Strand=+; Gene=SeqID_58405
tgaaaaatttggctaattcctaacaaaattcattaaaaatccttaaaattttctcccggcggcgcatatcggcaccgccggctcccaaaaatctttttttttctaaaaattggattagtataaaagtggttggcttctcctccgccacttcattattataattattcattggccatttatttgtattcgtctctctctcttcgacttttcgccctaacaatgtccttaaaagtgatttcggagtccgaaatgggtcaaaatggatgtcaaaatcgattttcccaatcttaaaaactcaaaaaacaaagtttttcttagaaaaaacaaattttgaaagataattataacaagtacccatttttacaaggcatcaaaaattgctaaaaattagtataaaagtggttgctcctcctccgccactttcattattattattttccattcgccatttatttgtattcgtctctctgtcttcgaccttttctccatgacaatgtccttaaaagtgattctgtacgttttttgcatttcttctcgacatttaccattttccttctcattttttagtctgatcgctgtaccaatg

SEQ ID NO: 118529 - DNA, 435 bp, Heterodera glycines
  Promoter: Source sequence=SeqID_21857; Location=2285..2719; Strand=-; Gene=SeqID_52488
agtaattttacattgagttttaacccgtttttgagatacgtgtccacccttttcaggtacattgacgtggccgtcatccaatttctccgcctcaatcagcaaatttgggacagaggcaccaatttgcgtttgaattttcgccggatatcagccaacactaacaatgtccagccaattttggatgtttttgtccgtcaaatttggcccatttttacgccaacagcaacaaatgtccaccatttgggagttgaccatggcgccgatttggacactttgcttcgtcttacatcgccgacaattctcatcgatcttaaactcacttcagtccaatgcaatggtggactgtttccggaagcgcttgctgatgacgacgacgatgatgggccaaatgcaacaaattctgccggccaaattttgtccaaatggttacacatg

SEQ ID NO: 118530 - DNA, 552 bp, Heterodera glycines
  Promoter: Source sequence=SeqID_12544; Location=2480..3031; Strand=-; Gene=SeqID_76190
tgcgcgcactgataaaacaaattgtattgttaaaaacgatcagtgccgaattcagcaaaattattcatttgaggacagaatgatttttggcaaacaaataacaatcaaattctatcttaaaatgggtaactaatagaaaattttttacttcaacaatttttttcagaattaataaataaatttttttgagaagaagtttttaactagcgccaaaatttttgtgctaattgtgaatcgattcgtaaaagtgccagaatgggcgtccctcaatatttctatattttcatgaccaaatcaaattcattcaagcaaatacaaaagattaattaatttttggaatccaggtccaggtattttttgctacttaacgagctttaataattaataacagactattgattttaaattcctgacaaaagtaataaaaaaaataatatataccaccattctcaatgaatcaacctgccaaatttgttaaacaaacccacagaacaaaccttttaattgtctattttctaacttttggaatgggatttttaccgaggcaaaatg

SEQ ID NO: 118531 - DNA, 943 bp, Heterodera glycines
  Promoter: Source sequence=SeqID_881; Location=1455..2397; Strand=+; Gene=SeqID_63218
tataattagttctaaattaacatccaattcatattaagagaaaatttaaagaaaataaaaattttatttttaaaattcttttgaactttccttaagatctcaaaacttacgaaaaaattatgaaattttctatttttatgcatttaagaaaaatttcattaaaaatcccaaaaaaataaataaataaaaagaaaaactgcaaaatttgtacgaaaaaatgtaaaaatgtgccaaaaatgtaaaaaaaaatatgtaaatcccaaaatatgtataaacataaaatcgcttttattaattaatttttaaaaattaaagaaatttgaaatcatcatcactttctgtgctttcgattaaaaatgaaaattgcacggaaatttttgtgatttatatttaataaaccaaaagcagtgaatgcaaaaataaataaaaatcagccaccacttttagttaatgtgaaacaaaaaacagaaattcctatgctaatcaaaatgtgtaatatgttgggacaaaatatctaaataaatgaagaaatatatatatatatatatatatatatatatatatatatatatatatatatatatatataatatatatatatatatatataaagattaatttaataaaccatttacattattaaatttttttcaataaataaccgaaaaataatttgagagtccttttgagcatagatttacatttaagcattagcatttgttttcaaaatgtgtgccgaactttgatgatgccaattttgttgatgaatcactgctttttgtgccaattactcaccaatcggaaagtgcaaagagattttagagaagcgcaatgaaaagcagaaacaaaagtgccggatgtgataaagacggaaaatgggataattaattaattaattattaattaactaaaattaagtaaaatttttaagggttttcgaatg

SEQ ID NO: 118532 - DNA, 229 bp, Heterodera glycines
  Promoter: Source sequence=SeqID_33432; Location=1..229; Strand=+; Gene=SeqID_63505
caggaaaatcgaaaattttcagcaaaaatactttttccttggttttgtgaaaataatgggccaaaaagaagttggggatcgggggtctatttggatcagggtcccactctaaaaaaatatacgttttcgaagaatgccaatgttcacttcctcccccaccaatggcgatttcctttttgggtatactgttccacttttgtaaatacagtaaccgcccagcaaattcatg

SEQ ID NO: 118533 - DNA, 252 bp, Heterodera glycines
  misc_feature (43)..(43): n is a, c, g, or t
  misc_feature (139)..(139): n is a, c, g, or t
  misc_feature (245)..(245): n is a, c, g, or t
  Promoter: Source sequence=SeqID_13213; Location=2275..2526; Strand=-; Gene=SeqID_77040
gccgttgatcattctgatcattgtgggcacaattgcggcattngatacggtgaaagatgatgacacacggagggcggagaagaaggacatgtcaaagcaaaaggcacttatcaaaacgtacttttgcgccaaatgctgnagggatggaattgcagcgaagaatcatggaaaaaactgatgagtgggatgcaggtttacactggcgtaaacgttaaattgttagaagcgcgttgtgaatcttgaanaaggatg

SEQ ID NO: 118534 - DNA, 217 bp, Heterodera glycines
  Promoter: Source sequence=SeqID_3530; Location=1669..1885; Strand=+; Gene=SeqID_85052
tcttcaggtactgctccacaaggcgcggatcagcgacggtttcgcattggcgctgaacaaaaggaaatgtgcgaatggattggcaaggaaaagaagtgaatgttgtttgatgcggttattaatttcatttaatttttagctttttgggactgaaaaacggccgatttcaaaaaaaatcttttggcattttttgtgttcgttcgctttgcacatgatg

SEQ ID NO: 118535 - DNA, 177 bp, Heterodera glycines
  Promoter: Source sequence=SeqID_1491; Location=3655..3831; Strand=+; Gene=SeqID_73909
ttttgacaaaaattggtaaaatgattctgggtttttggcaggcaaaatgttttggcttttagtgggcgtgtctaaaaccgtgactgttttcaaatggtgtgtgtaggcgtggccacacttttgcgcatataaaagtaaaatttttcaacctcattccaatttcattctcctgccatg

SEQ ID NO: 118536 - DNA, 444 bp, Heterodera glycines
  misc_feature (55)..(56): n is a, c, g, or t
  misc_feature (63)..(63): n is a, c, g, or t
  Promoter: Source sequence=SeqID_17267; Location=1..444; Strand=+; Gene=SeqID_81733
attaattaaattgatgcaattttttaatgatttttaactccttttcaacatatcnnttgtggntttaaaaaaaaagttcttggctttcccccctccgaaattttttctggcaactgaatgaatgttcgttaaatatcgtcgagatgccgattttataccccaaaaattttaatgtagggcccaatgagtgctaattaaattaattaattattttttttcaactttcactaaaagatttaagcctagaaatagtgagaccttttcttattttaagcgaccagttgctttgatcaacagcagacacaaatcggtcaccgtttttcatgcggactttactcaaagcgtaaatatttatttttgatttttatatcacaaaaattcgaaaatttagctaaaattaaataaataaagatttaaaaaatggcttaattaattttcaatatg

SEQ ID NO: 118537 - DNA, 818 bp, Heterodera glycines
  Promoter: Source sequence=SeqID_5; Location=1839..2656; Strand=+; Gene=SeqID_50785
attaagtgtacggaaatgaataattaaattgattaattgtatttgagaaatgaattttcgattgaaacgattatctagagaatttggaaatccattaagtagttaagggttcactcatccccccgcttagaaaaaaataattaaaaattcactagggtaataagaaaggttgcgatttttagtgacgaaaaatctcgagagtttttctaaattttctcgcatgagagtcaatttcaagtacgtacttgccattcaagtacatacgaatccgagctaacaaataagcaagcaacattcaaatcaaaggcaagctttcgtgcatttgaacgtgcatcgatcggtgagaattaccaaatccggaaaaccccgatcagagagtccgcctcagtttcctagcaattaacaatttttcaatcatcgatattagcagggaacggatttttaggttttcacctacttttttggggggataacatatgctgagataagcgcaaaaaacacattttcttcgatcacttttcgatttagagcgacttttaaacaattattatgacttgtgaaatttttaaaaaacttttaaaatatttctgctttaacagaaacattattatgaaaaagcaataaaaaaacaaaacaaaaaattggcgttactttttttcaaaaaatgcacccctcagaatcgatttttcaaaaagcaaagatcctggacccatgatttggcggacgatcgaacatttttacgcttgaatactacatatcttcaaatttcagtacttcttgaaagggaaaagtgtgctctaaaattgcagcaaacaatg

SEQ ID NO: 118538 - DNA, 1003 bp, Heterodera glycines
  Promoter: Source sequence=SeqID_15575; Location=1011..2013; Strand=+; Gene=SeqID_79865
cactattataaataattgcataataattacataataatatatatatataattttattaagtaaaaaatagatttggttaatcctacttatggtcaatcaccattttcaaaaattgcatcataattaaataatatataaattctattaagtaaaaaatagattcagataatcctactaatgatcaatcccaatttttaaatattgcatcattatttaatataataaacaaattatattaagtaaaatatagatttggataatcctactaatgatcactcccaatttttaaaattttcaccatttataaggcgatgagatattctttttttatttttaataattactttgctttttctcatatatgaaatagtgtaaacttaattttctttaaattttcaaattttaccaaaacccttaattcaaaaaagtattttatttttttatatcccttttttaaacactttttagatataagaaattttatttttaagcattaaaaattaaatggttacattacaaagatttttgcagaaaatggaaatatttcaaaaatgcgaaataaaattgtattaatgaatttcagtctttttttaaaattcatataatatgtagtttttattataaataagctttaaatagagatgcaaattccaataagttcatatttctttccctgtttaaacgtgttcaaaaagtagaaaaaaatttcgtgtttcagaatgaaagttgtgatttctatttttttaaattttttggtttttctgcatattaattatttacgtatttttctaaataaattcaagtaaaaatgtcactatttaatataaaaataaattaaaaaataaatagaaatttggatgattcttctaaaagcaatctatttaataataaatgcatcaatatttaatgtaaatcttaaagaaagaaggaatttaattatttaacgcattttcattttcattttttgtatggtaatttatatttcagaaagaaagacataatg

SEQ ID NO: 118539 - DNA, 1003 bp, Heterodera glycines
  Promoter: Source sequence=SeqID_97; Location=2036..3038; Strand=-; Gene=SeqID_66807
ttcgctccaattttggcaattcaatgaaattttatgaaattaattaatttaaaattggatgaattttgattattttcgaattattttagccaataatcccttccaaataattcaaaattaatttttgtatctttttaatactactttaagacgcaactccaattttgtcatttcaatgaattttatgaataattaattcatttaaaattgggggaattttgcattattttcaaattattttatgtcataatccattctaaataataaccttattatttggtttatttgcacattttccaccaccattttgttccttctcatatattatttgcccgttgtgttgtgctgctgtcgggtcatgttttgtttgcccacacaaaacgtcgtcaagtcgctcaaccaccgcccgactaaagtccaacgattaatgaatgaatgagtgaccaataccaaaataataatcaatgcacaacattttaacactgattttgcgttaattgaaaaataaatatttatgttgtaattattttgattaattaattaaatttaattcgtttcattttttgtacttatttattttagtgtaaaaaaaaaaatgaaaaattggaaactttttagcaaaaaattttgtgaaactctcttctattaattactgtgaattcagtaatagtttttcaaaaaatttctcggcagcatcgcctggtgcccatgaaaatacctgaaattatttcttggttcacattaagttaaaaaaaaattgcttaaaattcgtcacaaaataattaatgcttcctacttcaatttgggttaaaaattattttgacactaatttgattaattctaattagcattttatttgttagacaccaactgttttttttaatatataaaacaatgaaaaattaatttttttgtgaaacaaaatgtgtgtaaatgggagggagtttttattcttttggtgtctaaaattctaaaaaaaatctattatcataactcaacaatg

SEQ ID NO: 118540 - DNA, 371 bp, Heterodera glycines
  Promoter: Source sequence=SeqID_13106; Location=136..506; Strand=+; Gene=SeqID_76900
ttttagcggcaattcgccgaacaataaaagcatcccggcaaaatgcttcttctccgccgagcgctgcttactaattcattagctgcccccgggcgaatgtgtcgctataaaaggaggccatcaccgaacagtgccagcattcagttcacaaatcattttctaatcgagcttctttctcgaacaatttagcattaaatctccttttaatccgccctttcttttaaatttttgaaaaatatgccttaatgataatttattcattattcagaaattttttttaaaattatctttaatagaatttcttttatctattttttgtgtgctaaaatgaaaggattttcaggtaaaattctaaatttgattttgtgatg

SEQ ID NO: 118541 - DNA, 53 bp, Heterodera glycines
  Promoter: Source sequence=SeqID_14649; Location=954..1006; Strand=-; Gene=SeqID_78748
ggggcttaaatacgatccaaaattggtggggctacaattacttataagaaatg

SEQ ID NO: 118542 - DNA, 418 bp, Heterodera glycines
  Promoter: Source sequence=SeqID_39720; Location=1..418; Strand=+; Gene=SeqID_68215
aaagggcgattaagatttttcgaatgggtcataaaaagagatcggaatcacatctgttaatggtcaataaatttgactattttttgcttttcaaaaatgctttttttcggcgcaattttttcaaaaactagaaacaaagaggtccgtctatgccgataggcgccgtccgaattttttttttttgaaaatttttatcaataattaactgaatttgaccaaaaaatgacaaaatgtcacaccttttgactcaattctacaggattaatgtctatccagtggtgtcgatagacgccgccgggaaatttttttgcaaattctaggtgaaatttgagatgaaaattgaatttattttgattgattttatcataaatttattcaaaaattttggcattccgtcttttaaaattttcaaagaatg

SEQ ID NO: 118543 - DNA, 278 bp, Heterodera glycines
  Promoter: Source sequence=SeqID_23542; Location=855..1132; Strand=-; Gene=SeqID_54234
tctgagcaggagttagttacacgaaaagtgaatgcgtgctttttgaaagaatgaatggtcgaatcactcactacacatcctcaaaatttgtattcaaattttgcgttaaaaaattcgcttcaaaaaatcgtacatagcagcctatttaagtgcagattgtatgcttaagtatacactttaatcattcattaaaactaattttttgaaaaatggacaatttcattaaaaaaagtgaaggagtttgtatgaataatcagtttcagcatgaggacaaaatg

SEQ ID NO: 118544 - DNA, 1003 bp, Heterodera glycines
  Promoter: Source sequence=SeqID_8961; Location=642..1644; Strand=+; Gene=SeqID_69824
ggcacccacaataattcgttgcattttgagggcaggggcacatacggcacagattagtgccatggcccattgccgatggaggaggattgagtgatgatagccccgaggatgggttgtgggattgaaagtgagtggatgcagagatgaggagaagaagaccttcgagaatttaattgcagttttcattcgccctgaggggacggaccgacggacggggaaaatggcattttgccgggcaatgagttcagcggtggggggcggatgggacagataatccaccattccccgggggtgatagcaatgaaaaccaatttgtggcacattaccgtatgaatttaatgggtgccgattggttagcacagcgcttcgggacacgccccttttgccttgggggcatggaaaacttcaaaatgccttccttttaagtgcaccctttcaccattggcactggttgagatgcttaaagccataatttagtggtgccaaggacgaggtgtgtgctggtggatttcaggaaattttagagtttccccctagggcatccttttcccgggagtttcaagaaaatttgagagcttcacctagggcatcctttttccggtggcttcaaaaaaattcgagagcttcccctcgggcatccttttcccgaagatttccggaaaatttagacctggggcatacttttctctgtggtttcaagaaaattcaagccctctctttagccagaaaataaagaaaaattcaaagatttccggaaaatttgaaaatttccccgtggaaatcacaggcaaaaaagaggtcaaaaaatccattaaaacattcaaaaaaaaaaatttcctccgtcatatccttgagggattttcaacaggaaatacattttggaattttccttcatttgtcagagaagcaccgaaaaatttgcaaaattttgaaaaatttctaaaggaaaaaattaaaaaaccctcgagaaaatctcgaacattaacaaggtttcttgcctatg

SEQ ID NO: 118545 - DNA, 110 bp, Heterodera glycines; identical to SEQ ID NO: 98226
  Promoter: Source sequence=SeqID_18586; Location=768..877; Strand=-; Gene=SeqID_83222

SEQ ID NO: 118546 - DNA, 862 bp, Heterodera glycines
  misc_feature (17)..(17): n is a, c, g, or t
  misc_feature (48)..(48): n is a, c, g, or t
  misc_feature (53)..(53): n is a, c, g, or t
  misc_feature (129)..(129): n is a, c, g, or t
  Promoter: Source sequence=SeqID_2927; Location=1..862; Strand=+; Gene= SeqID_82361
gaatagaaataattaanttttcagtgatatattttaaatattttccgnacgcnaattcgtcttaatttatgactttacacagaataagcgccctaacaaataagtgttctaactattagcttgcatttntaaaaatggaaaaaatgaaattaaattttgattcgacgcagcaagcaaaaggtatcaattttttgtttaaaaagtgtccatgatgtggcattttttgcgggacatagtttatgctggcaccataatttccacatatttttgtgtacaaatattgtctgatcactcacaatttcacatgatctctgttttgatcagatcccgatttttttccgctgggcggtcgcttttctgcttgatctgatcagtccccagctggcggtcattgtccgctcgtacgtgcgcagtgcggacgacgcgcgccaggcgcacgccgagttggacgcctacgtgcacaaagtgcgtacgtgtgcgtgcaacgcgagggcgcgctgcaaaatttcaaattaaatttttgcctaattacagtagcttaaccagggggttacacaaaatgtggatttctgccaccaaatttgtttggccaattttagcattttttcaattcaaaaatttaaaaaaaacatttaaaaatcagttcaacgagcattggttggagcagaagttggacgcgctcattgtgcccgcttttcccgtcccagccgttgggcaccaatggccaagcgatttagtgagagagaatatttgttggcacagaaaataatgtcaagccgagtgccaaaatttaaaaaatcaaattttcgaattttgggttgcctgcgctttcgccactgggatgtacaacatgttggacatg

SEQ ID NO: 118547 - DNA, 502 bp, Heterodera glycines
  Promoter: Source sequence=SeqID_11186; Location=671..1172; Strand=+; Gene=SeqID_74533
atatatataaatagtcaatcattaaaaaaaatattaactaaaaaatatggagattttacaagagggttcggcggggggggggggtggattcaaattcgattttttagggagagatttttttttttgtgtaaaaatgtcattcttattgggttaaggggggttttatttttctttttttcagaaatcccgaattagatgtgttttgcaaagatttatagctgttttttgccaaaggtccggcggtgacattaggcaccggcgggaaaattttggaaattttaacacaatttgttaagaaattatctaaatcttcaaaattgaaatttttttttgttatttgtatttcgggcaggggctttagcccatcagctgctccccatcctaagcccttgagatttgattgccctaattcccattgaatataatagtcggattcttaattaactttgaaatagcattttacattttaaatccttagaaacaagaacagcccagcgaaatg

SEQ ID NO: 118548 - DNA, 533 bp, Heterodera glycines
  Promoter: Source sequence=SeqID_31917; Location=489..1021; Strand=-; Gene=SeqID_62228
tttttcttatccattgattattcatataatttacaaagctatccatttcctcccttaatcttccttcaaaatcatttttgaatgaaaccaatatcggccacatttttgtagcttcatctttacgaagaaacggaagagcaaagattcgacgtatctaacaaatttttaaaaacataattttattttacccatttccacacgtcttgttgttgattaaattcattaaataaatttgaaaaattcgatttgatatgatgaactgctgcgcgtatgtagtgcacaatgcagccatgaactttattaacaccaaaaatttttattaaagcattaacttctaatttgattttatttgttaatatatacaattcataactgagataatgttggcaataatgttgacaaatatttattaaattttcgtgaaaaacaaacatttgctaataattatgtctagactgatatttgtgcatccgacaaatgttctatagataaaattcaaaaatataatttttatgaaaattttggcctaaatg

SEQ ID NO: 118549 - DNA, 132 bp, Heterodera glycines
  Promoter: Source sequence=SeqID_37543; Location=1..132; Strand=+; Gene=SeqID_66593
agcggactgaaaattccgccggagcgtcgccgtgaacttctcgcgctctccggcgggggtggcgaatcggaggacgagcgaacgtcgtccatttctgaacaaccaccagcaaaaaaagcgacgacaacaatg

SEQ ID NO: 118550 - DNA, 200 bp, Heterodera glycines
  Promoter: Source sequence=SeqID_9845; Location=3631..3830; Strand=-; Gene=SeqID_72867
gagaaattttttaagaaggctaaagaatattcaaattctattaccaaggggaagtgaattttcagcaaaaatatgagactcatcttggcattatgcatttgatgcgaaaaaattggcaatgtaataaaattgcggatgcatatgaagaatatgaactgaaagaattccaaaatatcgtaaatatttgaacattttatatg

SEQ ID NO: 118551 - DNA, 88 bp, Heterodera glycines
  Promoter: Source sequence=SeqID_16171; Location=1929..2016; Strand=-; Gene=SeqID_80535
agaaaaccaaacaaaatgttgaaaatggaaggcattaattggcagaacgcaattgcttgcctttttggatgacttgcagaacaaaatg

SEQ ID NO: 118552 - DNA, 137 bp, Heterodera glycines
  Promoter: Source sequence=SeqID_566; Location=1..137; Strand=+; Gene =SeqID_56334
tgcaggtcctggttcaattgggataccatttataatcaagttggttgctccaaatttgacaatttttggatgaatttttattgaaaatattttagggacgaattttgaagattttttaatttcagataatttcgatg

SEQ ID NO: 118553 - DNA, 182 bp, Heterodera glycines
  misc_feature (14)..(14): n is a, c, g, or t
  misc_feature (36)..(36): n is a, c, g, or t
  misc_feature (130)..(130): n is a, c, g, or t
  Promoter: Source sequence=SeqID_40687; Location=1..182; Strand=+; Gene=SeqID_68942
gcatcagagagccnttaattacctgtaaataaagtnttgtgtgtttcagagcactttctgaaaaaatacttatgaattaattttgcaaaaaataaataagtaatgaaaaagtcagaatttcgaaaaattntaaaaacaacaagcgttggcattttttcaggttaagttagtcctttacaatg

SEQ ID NO: 118554 - DNA, 301 bp, Heterodera glycines
  Promoter: Source sequence=SeqID_12663; Location=803..1103; Strand=+; Gene=SeqID_47069
tgcgtgaacagccaacgacgggcttttgaattgtaaatgagagcgccaccgaatgacttaaatttcatttttcggtgcccaatgactcatcaaccaattaatgaattaatattataaacggtaattccttggcagatagatgactatggttttacgtatttgggtttattccaataaaacacgcttttcttacaattagctgatcggcaaattccccgcctcactgttaccaccggcggaggaggcggaagcgtcgtcaacaaatgctgtcaacgacgacggcaaaagtgccacaaaaatg

SEQ ID NO: 118555 - DNA, 201 bp, Heterodera glycines
  Promoter: Source sequence=SeqID_18375; Location=1..201; Strand=+; Gene=SeqID_82977
cgcaatcattgaaagatgtagaaaaataagcagcgaaatatgtgaccggaaatccgtcatcacagattatcgcatttgttactattttttattaaaaaaggttggcaaaattcaaaaaacaatggcacgccccaaaatgcgcgaaatgggcttttttaaacgcgccaaagtatagccaaatgcctctcactccatcaaatg

SEQ ID NO: 118556 - DNA, 156 bp, Heterodera glycines
  Promoter: Source sequence=SeqID_11037; Location=2869..3024; Strand=-; Gene=SeqID_74368
tttatattatacatatataaaaattagattattctaagcaatatgggttgaaaaattgaaattcttcataaatgttgtaaacacagatttctgaacaacaatgacggcgaaaatgcaaaaaattctgatcattgtgagcaaacgacaacaacaatg

SEQ ID NO: 118557 - DNA, 401 bp, Heterodera glycines
  Promoter: Source sequence=SeqID_18846; Location=1342..1742; Strand=-; Gene=SeqID_83540
aaaattacatataaagatataaattgccctcttcacttttatccttgttttttttttgtatatttttcattttttaattactaatttttattttttatatttttaatttcaataaattcaaaaaattttttttttgaaaataccctaaaaacgagaaattaaaaaacttacttacaactcaaaaaaataaaataaaatatttcatttggtccaaaaacaggctttccaaaattaaaaatattaaaattaaatttccaaaaaatttcctatttttaaatataattttacgtggaaaccttgaataaaaactaaaaaaatgaattcatcatgttaaaataaagtttgccaatttaaagccatctctgctggtcggcaaattcatcgacgccgacaaaacaatg

SEQ ID NO: 118558 - DNA, 613 bp, Heterodera glycines
  misc_feature (13)..(13): n is a, c, g, or t
  misc_feature (74)..(74): n is a, c, g, or t
  Promoter: Source sequence=SeqID_9769; Location=61..673; Strand=+; Gene=SeqID_46811
ggtttttgtgttnaacaaattgtgaaatgttccatctgtttttttgtttgtttgttaattacaacttgtgagcncagatgataatttcaaaataaagttgctatgtgcacaaaaactattaatttggaaagttcattggcattagaatttatactaaatcaatttggttgattgtttgttgatatttggttctcacgaaggtaacttatggcgcaaaatactgcacaaattgaagagttcgttcgtttggtgctcagttcatggccttcatatcaatttgcgattaaaaatcagttggcgggatcattaacaagtgccaaggcaaaaaaattttggcgcaattgcaacagatttatggaaaggcgctatttaaaaagagtaaacttttgaattctatcaaaaacaacaggggggacctttttgttttgcaaaatttttttgaaataaaaatccatgaaaatttgttatccggggttttaaaggtcgctgatcacgaatctgacatccaattcgaggtcatggaccccaagaaccacagggaataaattttcatgactaaatattaaaaaattttcggcatttccttcccggataccaaacagttgaagcaatg

SEQ ID NO: 118559 - DNA, 1003 bp, Heterodera glycines
  Promoter: Source sequence=SeqID_6882; Location=197..1199; Strand=+; Gene=SeqID_63197
tcggaaatttttttgttttcatttcttagtggtgttttttcgtttttattgcactttttcgaatcataaaaattggcacattaagcacaaaaagcccgaaatatgcaaaaaataggccttataaaagtcattgtagacactccaaaccaagcggaaaatgcgtttttcatgcttatctgagagtatcatgtgcgttgaaagttgagcaaaaatattcactggttgcagttacaaatgaggtacattttctttctaatatttttcttacaattagcaaatatttggaaaataattgaaaataatgaatgcaataagaaaaagcctacaaatatctctgaaaataaacaatcccgatttgcaagaaatttttggaactttttggttttaatttttttttttgaaattctgagattttctattttttttgcaaaatgaatttctaaatatttttccagaaagtgctcagaaaagcacgaaattttattgtcatgccactttgcactcggtgtcctctcaaaggacccacaaaaaataatgttaattaaaaaataaataattaaaataagctatgagagaatacctgttattaaatttattcaaataggattatgagaaaactgctatatggccaaaaaatcactaatcttaatgagaaaaattttatatgaccaaatgttatgaccaaacatcactattcttactaatgagaaaatgctattgaccaaaaatcactaatctgaacaaattagaattaaatttcgtcaatggattgccccgaatagcctgaaagaagttctataaaaggctgaactaaattacaaaattcatttaattcttttttttctattatgatggctaagttttttccttcacaaatgggcggcaaactcgtttttgaaggccatatgcatcaaaaaaagaagcacgtagggaattcatttattggcgctgtgaccaaaacaaaacaataaagtgcaccggggcagcaaaaactatcgggatg

SEQ ID NO: 118560 - DNA, 56 bp, Heterodera glycines
  Promoter: Source sequence=SeqID_17621; Location=1777..1832; Strand=-; Gene=SeqID_82148
agttaggcattttctaccaattaagccgatacaattccaaaatttatcaaaaaatg

SEQ ID NO: 118561 - DNA, 187 bp, Heterodera glycines
  Promoter: Source sequence=SeqID_32060; Location=1..187; Strand=+; Gene=SeqID_62370
ttgactaaattttaatgtaaatttttaaaatgttgatatgcatatttatttatatagataatgaaaacaaaaaaatattttttaggttttatataaagtttttttgcagtgaaaagtgtatatctgatggaaaataggtccggttagcaccgcgaaaaatttcttcttatttcttttcttcaggatg

SEQ ID NO: 118562 - DNA, 348 bp, Heterodera glycines
  Promoter: Source sequence=SeqID_25222; Location=1594..1941; Strand=+; Gene=SeqID_55965
attaagtgtgataatgagcgtaataaaatggggcacatttcgaaattatgcttaagccacaaaaaaatcgttaggggggcaacgaaaaaattataatttaaatgtcccttttcattaattgtttataaatttaagaaacaattagcaaacattggagcacgttgaaggagatgactttgttcataagcattctctccattcattttcaggtgtttttttgaaaaaaatgtttttttaaattaaaatgagtaaaattaaattttgcaaaatttacaatttttgggcaataatattaaaaagggcttacaattagttgaccttttttagcttggccgtatcatcacaatg

SEQ ID NO: 118563 - DNA, 646 bp, Heterodera glycines
  Promoter: Source sequence=SeqID_1491; Location=9394..10039; Strand=-; Gene=SeqID_73910
tattggtcatgaaatttgattgaatgaatgaatgaagagtgaattaaaatatttttgtgcccggttctcatgggctcattaattattcaatagttaatattgacttcaaaagacatttgaatttgccgacaatagtgaaggagataacttcaaaggaaatttgaatttgccgacaataaggaaggagagttcgagaaaattaattggtattcggatggggacaccccgcccctaggcttcataaatactcagtccaaatcacatttcattcacatctgctcatatccttactcactttaataataaaattgtaataaaatttttattttattgctgttaaccagggcggttgctccaattattgggctccgtttatcctggcagcacttgtgtgtcttttagggcttggggttgtgcgcgtgacctttactaattacccgagccgtttaggtgccctgtcgtcttgtgcttcatgggtggcagtgcgctgctcttcagggcatagttggtttaaaatttttaaaattattattattatccattaatttgcattcacaacgacaatttccatgcctcaaaaatatgtgtcaagattgttcattttatccattcaattcattatttttccctgtaaaattagataatg

SEQ ID NO: 118564 - DNA, 305 bp, Heterodera glycines
  Promoter: Source sequence=SeqID_20135; Location=1..305; Strand=+; Gene=SeqID_84923
atgatgggccaaatttaaatgctggccaagcgttggccaaatggttgcacactccgcgcactgatccgaagcgattgcattatttcgaggatttgaacggacaatcaaatttcgattgggtcaacagtttcaaagaggtggccacattattttaaaataataaaatttttgagtttttctaaggttaaatttttgaaaatttcctatccatatgacccgcggcatttgccttttgatttgcttaggcttttctcagtgccaccaccaccaattctccagtcaattactgtatttgttttgaaatg

SEQ ID NO: 118565 - DNA, 62 bp, Heterodera glycines
  Promoter: Source sequence=SeqID_28153; Location=416..477; Strand=+; Gene=SeqID_58804
agtccagcagtgattagaagaggtacaacagtgattagaagaggtccaacagtgattagatg

SEQ ID NO: 118566 - DNA, 202 bp, Heterodera glycines
  Promoter: Source sequence=SeqID_5725; Location=1..202; Strand=+; Gene= SeqID_59032
gctttcgttcattcatttcgtctttttttggtgccttcgccgatttcattcgccacaatttccaatttccatgcgtttttcctcagttttgccaatttttttctcccattttttaataatttttttcgctgttaattcgctgaaaatccgagaattcgttgcccctccaccgaacgaagtggcaaaaaataaaggcaaaatg

SEQ ID NO: 118567 - DNA, 228 bp, Heterodera glycines
  Promoter: Source sequence=SeqID_18176; Location=1177..1404; Strand=-; Gene=SeqID_82760
ctcgccgcggggcagagagttctgagtgacatcgctcttggccgtgatttaagggatgccgtcagggaacattcaagacaggggctgactaaccttaccgacaagttacaacaatgtggtaaaggaaaaaaggccctgatcactaataagaaccgaaaacgggtatttgatcagttaagtttcatctaaaggtataaatagaacaaataatataaaaagttaaaaatg

SEQ ID NO: 118568 - DNA, 72 bp, Heterodera glycines
  Promoter: Source sequence=SeqID_8541; Location=1164..1235; Strand=-; Gene=SeqID_68462
aatgcaaaaaaatgttcaaattcaaatttacagtacaaaaaaatcaatatcctacccctgtctctaataatg

SEQ ID NO: 118569 - DNA, 228 bp, Heterodera glycines
  Promoter: Source sequence=SeqID_97; Location=7759..7986; Strand=-; Gene=SeqID_66808
ttaaatggcttcgacttaattatgctaaaaatgccaaaaaagttgtcaaaaaatttggtaaaaaaacaggacaaaaatagtgaaaaaattttttcaaaaggggtattttacttttgaaacgcctaaatataaattcattattatttttaaaattttcgtttcgttttcgatttcgtcagacggtatttggaggaaaaaagacgaaacaattttacacccttaagaatg

SEQ ID NO: 118570 - DNA, 260 bp, Heterodera glycines
  misc_feature (6)..(6): n is a, c, g, or t
  misc_feature (23)..(23): n is a, c, g, or t
  Promoter: Source sequence=SeqID_9461; Location=2315..2574; Strand=-; Gene=SeqID_71503
attaanttttaaaatattagtantctcgaaaaaaattgttatttaacaaaaccaatatttcaaaaaatggattttaaaaaatgaaatttggaatgtattcgaattcattcggctccgggctcggaatgggataaatctgaggtcacttcgtgaccaacacactataaccgcagtaattgattttgagcctaagataaaaagttgaatttggatcctcaattcttttatcgaagatattcagcaaattacttttcaaaatg

SEQ ID NO: 118571 - DNA, 1003 bp, Heterodera glycines
  Promoter: Source sequence=SeqID_17873; Location=1161..2163; Strand=-; Gene=SeqID_82419
caaaagcacaaagataccactgtagaattcttgtattaatacgcaattaccactcaggcaattaccgcgtgtcaatgttgaaaaatttaatccacaaaatattgattttcttgcccgtgtttgacataattatgtgatgaaccttgaattttttttcggcttttgttaattttatatgcattatcgaataatatagaaagaaaattaaaaatttgtcaattatgaaattattcatatttacccagacgattttcattaaatgtgcataacaaaaatttttttatacattataaaaaatggaccaattctcatatttttttcatgatacgttttcttaattaaaatattcattttgccagaccattaattaattcacatgaaaaaaagcttgctatttgcctgaatggagcaattttcataaacttttctaataattttataattatgaaattattcctagaattacccagacgattaattaattcacatgaaaaacgcgtgccatttgtctgtttttaatattaaatagcaaaaataataataaaatttttttatacattatggaaaaatagagcgtttcataatctcttcgtgatacctttattaattatgtggtaattaacttacccagacgattaattaattcacatgaaaaaaatttgccatttatttgtctattttttagaataaatacagcgaaattttctaatttcattcattagatgcgcataaacaaaaaataacattaagtttcatacattttgaataaactatatcgaagttaaacaaaatatttcaaaaaattagtggacgaccaaaataatattttaaaaatttatttactccaatttcatatttagttttttcaaattttgattgctgtttgattttcaatctggcaaaaaattgcattaatcaatttataattatgcaaaattgattttataattaagaaatatattattttccaatgtttttattttttaataatattttaaagatg

SEQ ID NO: 118572 - DNA, 1003 bp, Heterodera glycines
  Promoter: Source sequence=SeqID_17518; Location=1373..2375; Strand=+; Gene=SeqID_82025
tataaatttaatttataaattttaaaaataaatgattaaaaatgttttttttaatttaaaattacggaaaaacaaaggaatattgtcgagaagaaaaatgtgaatgaaaatcaatatgtggtatgtatgtacgcgagcaaatgttggcgaagtgaagttgaaggaaatgggaacgggtcgtttcggcgccgccgattcggcgccgccgattcggcgccgccgtttcggcgccagggtcgtttcggcgccaaaaatcaaaaacgcagaaatagtaatttttttttgttttgtttcagaagatgaagtcaataaaataatagtctatattaaatttaatttcttcattttcactttcatcttttgtgatcttgcataattttgtcggtaatagttagggcggggatttatatggacataaaatcgcaaaatatggccataaaatatggaccaaaaatcgcgaaatatggacataaaatggcaaaaatatggacataaatttttccaaattggggtgtaaattttaaaaatttcttcaaattcgctcaatgtaaggtaaaactttcaaaaatagctaaatatggtattaaaataccatttttgaagaaaaaacacgatacaccttaaaatttactaatttagcaaaaaaatcaacctgaaaagcgaaattttcgcttttttgtttattttgacataaattaaccaatttttaagaaaatttataattcatcaatattttcgtgaaaattttgctaattaaatgattttttgaaaatttttccggtttttgttgtccaaaaggtcaatttagctgctaggggccgttctaatagaggttttttggaaaaatgcaaaaatatggacataaatatggaaaaaatcccaaaatatggacaaatatggatatagaaatccatcctagaagaacagatcaagctaaaaacatatttttcgtgcgtttcggcccaaaaaaaatggtatccaccagttaattgactcgcaaatg

SEQ ID NO: 118573 - DNA, 81 bp, Heterodera glycines
  Promoter: Source sequence=SeqID_9989; Location=721..801; Strand=+; Gene=SeqID_73038
agtgggtttcatggcattttcaaaacaattctttcgttttacttaataaggtaaatttgtcacaattacagtattttgatg

SEQ ID NO: 118574 - DNA, 1003 bp, Heterodera glycines
  Promoter: Source sequence=SeqID_8974; Location=1780..2782; Strand=-; Gene=SeqID_69880
atccacttccccccttccccccccccaattattgtcttctcgtcaagtgggcccctcgggggttggtccggtggggatgaaagggatgggatgggatggatgaattcatttttgtaggatgattttgtgcagaagaaggatgagaggagatggaaaatttggaagttccggaaaattgggaccaaagattacaaaagagaaaattgaaaaaaaaagattttgtttggaaaatcgaacacaaaaaaaatgaaaaccaatagaaaaaatggacattttttaaaaacattaaaaaaatttaaaacgaaaacaatttaaacattaggcactcaaaaaatatttaaacagttggggaccaaagaacgaacgctggtgacggattttgtggtgtttaaagtgtgagatttgtggcatacaattgggattttttggggtgggatagagatggatattttctggggggggggggggaggcggtgacggattgatgcgattcggcggtgcgtgcgggaggggggcggtgttgtgaaataatctaattagcggtcatttgccccgcctgcgggcggcaaaaacattgcattacattacaaattacactcgccactcattcactataaaaatgaaaatcctggaaaaaagccaatgttagcctattattccccaagcagtgtgtttcaaagtagaatttaaaaaatatatttttaaatatatttaaaatgtatttttaatttattatcattaaattaataatatttttaaatttgtttgctgaaattgttcgcctattcatcagaacatatcagaaaaatcagtacatttaacgatttttattaataccagtaacattagaaaaaaatgggcaatattcgatgaaagtaattattctaaatattttgcattatatgtaaaaatgaatttgtggtatttattatattttttaatatttttgtattgaatccggcaaaatccgtccgaattttgaagaaatatttggcgatggatg

SEQ ID NO: 118575 - DNA, 172 bp, Heterodera glycines
  Promoter: Source sequence=SeqID_43556; Location=776..947; Strand=-; Gene=SeqID_71204
ttttctgtaatattaaccaattaatttttttcttaatctaaatgaatccaattattaacttttgctcatgatcattgagcaacataaaattttgagccaataaaatatttttaaattcttttaaatttatattttttaatcaaatttaaaattcttcataaaataaaaaatg

SEQ ID NO: 118576 - DNA, 384 bp, Heterodera glycines
  Promoter: Source sequence=SeqID_10829; Location=204..587; Strand=-; Gene=SeqID_74096
ttcgaaatggtacttcataaaatacatatttacctttagacctccattttttcatatttctaaataaaaaacgagtaatgaataagtagaaaatagaaaatttatgggattcgttcataaggatatgacagtgatctttcattccttagaggttttttcgccttcgagaataaaaaaaattcaccttttgttcggattttgatccggggtgcgaaaaggatgcttgattctgattagcgactatgaaaacctactaattgtcatttttaattttaaaaagtgcttttaaatttatttcaaattgaacaactgtcagatttttaacagcaaaaaataggacgaaagcgacgtcgagggaggaaatccggtcgccgtgctcgaatg

SEQ ID NO: 118577 - DNA, 1003 bp, Heterodera glycines
  Promoter: Source sequence=SeqID_8114; Location=1808..2810; Strand=-; Gene=SeqID_67001
aaaacctttaatttttctttaaaaaattggctctaaatcacaaaataggtcattttttacaaaactttaaccaaatggtactcaaattttattcatccagaatttagttagacccaattccaaaagtcttcaagcattatcacgccggcctctacttctcacaaccatttactgatttattccattaaaattgaatagaattgaaaataattgaaatataattttttaaaataataataataaaatacaaaattattttttctgacctatttattatttgaattagaatttattcatttttattcttgtggggcaaccgctgaagaagaactcacacaaattaatttgaacaaaaatacaattattattcaaatgtcaattgcatttttcatttcttttattaaccattagatcttgtctaatacatattatgtgaaaaaattaattatttaattttttaattaattttatttttgaattaaacaattaaaaattaatgaaagacatcgatttcagtccgaaaaattctaacccatgaaaaatttggatgggcctaaaaacataagttccgcattcggacgtcaataaacgcgcataaatcctttatacttcgtgattgagcatacagaaatgaatagagaggaggggggggggggatttttgcccacaattctgaaaatttctaagggaataaattttgaggacagctgagtaaaaaaaggtctccggattccctaattttcttattcgattttttggttacgatccttcactgtctgatcgattcaagtatttttgcaaaattgtgtccgaatattatagcttatcattgcaaaatgaggcttttgcaaaatcataaaccgaaaaatttggatttctatcaagcgatattcgagcattatattagttacattttcaaaattaattttttaagaataatttattcaccgtaattcatcgaataaaaataatattgaagtaaaattcataagaattttaaatg

SEQ ID NO: 118578 - DNA, 454 bp, Heterodera glycines
  misc_feature (28)..(28): n is a, c, g, or t
  misc_feature (78)..(78): n is a, c, g, or t
  misc_feature (108)..(108): n is a, c, g, or t
  Promoter: Source sequence=SeqID_5579; Location=1..454; Strand=+; Gene= SeqID_58545
aaaaataaaattatttatcgaattttgnggaatcggaattccgtgctaaataatgtccatatataaataatcaaaatntcaaaggaaattaaaatgttccaaagtgtntaataataaaaaatttgaaataatgataattttattaatgatattgtcataattgaaaaaagtattattaatttagatgtttaaattaaaatttctaatgcaaaaaaggacgaaaaacattttttaaatttttaaaaacttttttttaaatatttttaaaaattttatgtaattcaatttaaaataaagaagaagaaaaatagaagaaaacaaaccctttttaagtgaaattctatttttcattaaaaaccagaaaaaaaattttcaagtaatttcattaaaagagcttttttttattattaaaaaaaaatatttctcaaaattataaagggtagagaaagtgatg

SEQ ID NO: 118579 - DNA, 171 bp, Heterodera glycines
  Promoter: Source sequence=SeqID_2244; Location=1923..2093; Strand=-; Gene=SeqID_78669
tggtacgcggaggagaatggcgttgtggtgcagacggtgcattcggcaggcggagagaagaaaattgggcagtattccgtggatggctgggtggaggaagaaagaagagcaatcgaagtcaatggatgtgtatggcacggctgcaaggactgcttccccaacgacaacatg

SEQ ID NO: 118580 - DNA, 135 bp, Heterodera glycines
  Promoter: Source sequence=SeqID_11646; Location=1175..1309; Strand=+; Gene=SeqID_75097
ggtaaatcaaaaattatacagaaaccaattacttaatatggttggtcatcttcttcattatttcactttatcagttacattgaccattctgtactcacatttatccgttcaaacaagccaatttgggacagaatg

SEQ ID NO: 118581 - DNA, 1003 bp, Heterodera glycines
  Promoter: Source sequence=SeqID_19191; Location=77..1079; Strand=+; Gene=SeqID_83939
aaaaaattaaatgattatttaggctttattctgtcttataaataggtggccataaaatttttttttcagcttgagtcaaatttataactatttcaagaaaatttgattctctaacaaattactacaaatttatatttgattagaatatttatgctgatccttctcttgaattgtttcggtgttactaggccattattaaaagaaattatgccaatctgattataatatcaaatagcatatctaaatggtcgacacattctgaaaaagtaatgcaattcatgtttaatttgtacctacaaatttaaaatcaatatcaaaatgtaaattccaaaaaattgtctaaaatttacattttcatccaatttttttaatggctaaaattaataattcataaaataaaaaattaatcgattatttaggctttattctgtcttataaataggtggccataaaatttttttttcagcttgagtcaaatttataactatttcaacaaaatttgattctctaacaatttattataattttatatattttttttgataattttataaaataaaaaaattaaacaattattatttctcttcaattgaatgaacaattaattcaataattttttcgttaactttaaatcgtctaggcttttaaaacaaacagttatatgtaataaatttattcatatattccattcaacggtcgactttgatttggcaaattaattccaaatcgtctcttaaattaaatttctaagcatttaaagatggttaatttttagcaagaattatttcgttcaactgacgactttgattgggcaaattaattccaaattgtctcttaaattaaatttataagcatttaaagatggttaacttttagcagagtaattataaataattcttttcatcaaaatatgaaccttacagaaaaattgtttttaattattttgtccaaaaattaaaagatatttaggtggtgcatattacatatattttattcctcaatg

SEQ ID NO: 118582 - DNA, 486 bp, Heterodera glycines
  Promoter: Source sequence=SeqID_6839; Location=1916..2401; Strand=-; Gene=SeqID_63069
attgccctgccctccaccttcctcctggttaaaaagtgtcaaaacttacattctttgttggtaaaaccaaacaaatttggtgtcatttgaaagctttgattggttagaaaatagatatttgtaagctaatgctaattgtaagcaattgtgtggctcacaaaaaaattattgtttgaaaactgcaaaaatgaaaggatttttgtagtttttttaataaaaacattaattgggctagagagcatgttattaaagttttcgatgataccaagattgtgatggggaattgttaatcaaacaacctataaaattatgttgaatcaatttcgattctgacggagttggtcagctccccactcaattcatacgatttattagggatttaaataatttttttttgtttttccctctaaaaactaaattttgtaaattaaaaatgactgaccaatttacttaaaaatcttaaaattccttttttagcgtgtcatg

SEQ ID NO: 118583 - DNA, 147 bp, Heterodera glycines
  Promoter: Source sequence=SeqID_18071; Location=1044..1190; Strand=-; Gene=SeqID_82661
tttaattttattataagcatttttttttaatcataaaattcaattttcctcattttttatggccttatttggcatctctgatcattatttaattatttttctctatctattagtaataaaagttaaattaagcaatcagttgaaatg

SEQ ID NO: 118584 - DNA, 160 bp, Heterodera glycines
  Promoter: Source sequence=SeqID_7459; Location=189..348; Strand=+; Gene=SeqID_64890
tcgttgcgcccgcacacttaacaattcaatgataatgctttttttgcacaattatatatattttttttgcttaacgaattcaaataaaaattattgaataaatgttaccgaaattaataagcggtttttactttggcttaatcaatggcacttataaatg

SEQ ID NO: 118585 - DNA, 54 bp, Heterodera glycines
  misc_feature (47)..(47): n is a, c, g, or t
  Promoter: Source sequence=SeqID_42836; Location=827..880; Strand=-; Gene=SeqID_70645
atggggggggggggggggaagaaatgccccagaaaaaaaaacatttntaaaatg

SEQ ID NO: 118586 - DNA, 1003 bp, Heterodera glycines
  Promoter: Source sequence=SeqID_13399; Location=190..1192; Strand=+; Gene=SeqID_77284
tcattacaattgtctacaaaatttttcccggcggcgcctatcggcacccccccccccggttccccaaatttttttttttaaagcgtgccgtaaaatagtgttttaaaataaaacaaaaaaagccgttgcgtgcttgacctatttcccaagctaaaatagaagactaccaatttttattagtcaacttatatcaatttttattaatcaactttccacaaattaaaaaaatccctgtccctggcggggcaccggctcaaaattgggacgggagtcccggaaaagtgggagtccccgtcacggggtcccgcctcggtctattttcgaagtcccggccccggtcccggctatttcacaattccagtctctactaaaaatacataagcgcgatttttgtttgcgggatcctacgcgggactcataatttaatttaggttaagaattttaaaaaatcatacggagtctggtactatttgggataaagaataagccttgcattacggattgggatcacgcaaaaatccgacgcggaacgatcccgcgccaatctctagattagtaaccacaaattttttgcgtctaatcaaataaagcaatttcaacggcgccaaaacaacgtgtcccgttctaataatgccctttctgtttaacttttcctaggaattggcactttctaccaatccatatttaccacaattaacattgacttcaaagcacatctctagcattcaaagcaatccttgtcatgtttaagccatattcattttacgctattttatcaacccaaaaaatttttttcacaatttttaataatatttaaaaaatatattagtgattattggttaatttttataaaacataatattgactatgcaatgatttttttttaataaagactaatgcatagcaaaaatgaataataatatgaaatctcagaaatatgaataagtaatgacatatacattttacttaaatttcatttatttttaagcaaatattttaaatg

SEQ ID NO: 118587 - DNA, 79 bp, Heterodera glycines
  Promoter: Source sequence=SeqID_6686; Location=4074..4152; Strand=-; Gene=SeqID_46286
tggcatggggatgcacttgaaaagggtaaaagggacaattacttattttgtttcttcttaaaataaactaacggaaatg

SEQ ID NO: 118588 - DNA, 130 bp, Heterodera glycines
  Promoter: Source sequence=SeqID_28468; Location=1230..1359; Strand=-; Gene=SeqID_59082
gcaaagcaaataaaacgtaaaaaaagcacacagcaaacctttcaaacaaaaaaggaggcacaatggaatggacaaaaatggaaaaccacgatttttttaaaaatttattggcatttaacctaaattaatg

SEQ ID NO: 118589 - DNA, 242 bp, Heterodera glycines
  Promoter: Source sequence=SeqID_42589; Location=799..1040; Strand=-; Gene=SeqID_70444
tcacgctttggtgcacgcgcatatagaaggcccaattcattccgttcgatgtggtgtacgatttgccggttcattgctttttccgtttgaaaaataagtctcgagtgttcaacataccctacggcgacataccctcttctgacacgcacaccactaaacggccccgcaccaatgactatcatcaacatgagctgaagcgcaaagcaaaggtagctcttgacttagtggaggccggactaatg

SEQ ID NO: 118590 - DNA, 99 bp, Heterodera glycines
  Promoter: Source sequence=SeqID_34166; Location=1..99; Strand=+; Gene= SeqID_64029
aattttgttttcccttttttcagcttcatctccgccgattgttggctttgtgtgttcgatttgattacgccttcacaacttggccttggaattgcgatg

SEQ ID NO: 118591 - DNA, 62 bp, Heterodera glycines
  Promoter: Source sequence=SeqID_4589; Location=1..62; Strand=+; Gene =SeqID_55000
ttcgcgcagtgcaaaatgatcagaaggcattttggaccgaatcggtgatttgagaacaaatg

SEQ ID NO: 118592 - DNA, 1003 bp, Heterodera glycines
  Promoter: Source sequence=SeqID_18322; Location=68..1070; Strand=+; Gene=SeqID_82920
ccccggcggcgcctagcggcaccgccgggcccccgaaacttatttttcataaaaaatggctctaacgcaaaatttatcatttttagtgaaaatcttttagcaaattgcactcaaattttcaaaaattttcccgacggcgcctaccggcaccgccgaccttgttctgaaaaaaattttttttggaaaaaatgcgcctttttattgatttttttcttcatttgtaagaaattttcaaaaatgctgattcttgaccccaaataatgattttttgtttgaaaaatgatgattttgaaaattttcatttggcaaccctgatttaaatagttgttttccgttttattagattacttaaattacctttttaacattttattgcatatattatttcatatataaactttacatttttcttcgcttatctttttgctgtatataaataattgttatataaaaacatgataattctcacgatattttctaactattttaaattatcttttataatatttgttagtttattaaacttattttaataattatttaatttattcttttatattggtttttttaattaagtaaaagtgttaatattctttagctataattttatttatattttgaatcgatttatttttgacgaagtttgaaaattcttattcttcttttttttcataggtgccagaatatttgaatttcggtttggttttcttggtacaacgattaatatggacattttaacaaatgaacatatgataattttatttctattctttttttaatattttaaaatgattaatgttatctgattttttatgttcctcaatttatttttattgtcacatttatgaattaaaatatgttagtttcaatcaagtgaggaagtttataatttgatttcatctctttttcacaaaaatttgaaaaatttgttattgaattcatatatatataagaggtcttaatagttggtttaagtatttcattaatttcagatccttaaatg

SEQ ID NO: 118593 - DNA, 1003 bp, Heterodera glycines
  Promoter: Source sequence=SeqID_16716; Location=2096..3098; Strand=-; Gene=SeqID_81117
attttaactgataaactttgaaactttctattataatttcattaaaaaatccttccttttttcgttttatttttaaaattagacatttaatttgccttcgaatttactataataattttattggacataaatttgtgaaaattcacagtgtaaacattttaaaattataaatttgctttcataaatttttttatttaaaaatttaactcaatttttgagaaactttttgtctgcagttaggcgttaattgtttattctatgatcagcctgtcacctgatttcgttaaacagttgggggctgaacgaacgtgcgcgagaaccttccacaattgaagctcgccaattttcgaggaaatccaaattttaactgataaactttaaaactttgttttataattgcaattttttttttcgtttgttttaaaattttattttgttgtagtatttgttatgcataaattgaggtgaatttaaaaatgtttcttattttatttttgtataaatttcttttcaatttatttttgtgcttattcatcttttcattctttcttccgacattttaattatttttttcattctttggctttttcatcttgacattaacacattgttaaaataatgaacataaaaaatgttttcttcttttttgcttattcatcgctgtaaatcaactgcaaattgttcaaatttttaaagatgaataatttctgaatatatattttttctatttaacaaaaatcatttcaattatttgcaattaaataattataattttattataataaggaattaataatagattattttgtatttgtgtaaaaattatgcattgataaattaagtttatataaagtttgttaagtgtattatgtatttattatttattaatttcttcacattttttaccgtactattcaactccgtcaatggccaatgcttcttcccctctgaagagtaattttacattattaatttttattttaagtaatgttcaggtcgaatg

SEQ ID NO: 118594 - DNA, 90 bp, Heterodera glycines
  Promoter: Source sequence=SeqID_29435; Location=1..90; Strand=+; Gene= SeqID_59936
ttccaacctctccctgttttgtcattcctgactatcattcttggaataaaccagaggttgggccaagggcagcaagcttacttgcaaatg

SEQ ID NO: 118595 - DNA, 720 bp, Heterodera glycines
  misc_feature (114)..(114): n is a, c, g, or t
  Promoter: Source sequence=SeqID_35133; Location=1..720; Strand=+; Gene=SeqID_64766
cttggaaaatcaaacacaactccgcttaaaagacagatttctgtctgcaaaagaaatagaaatgtgaaaaaagatttgtctttcttatttagcttattttatcagtttcttttnggtagttattgagatttgattcgtttttatcaagtgtctctattttaaattaacacccctttttcgggaaaaaattcataaaattttttattattttcgaaacaaatcgacaatttttaaatttaaaatttaaacaaaattatttgtttttgaagaaaaacatatttatcattattattttattataaaaaataattttaaaaaaacaattaatccaattaattgcgttgctttatttgggcattttattatttttgaaacaaatcgacaatttttaaatttaaaatttaaacaaaattttgagaatatatttctaaaaatgatgttttcggacaatttccgatctttgggggtcaatagtctaatttagctgatgggagccgttctattagatcttttttggaaagctgccaaaatatgtacataaaatatgtaaatatggatataaatcgcggattacggaaaaatatggatatagaaatccatcctagaagcttcaaaccaaactaaaaaaatgtttttcgtgcgtttcagggctcgcacattccaattccatataattccaagccctaattataacttcacaggtgttggatacaaacaatg

SEQ ID NO: 118596 - DNA, 81 bp, Heterodera glycines
  Promoter: Source sequence=SeqID_202; Location=1627..1707; Strand=+; Gene=SeqID_77385
agtgcgtttttctgaaaaacattcctccttcgttcgttttcagaagtgtggcaccaatactacgaaattctcagccaaatg

SEQ ID NO: 118597 - DNA, 55 bp, Heterodera glycines
  Promoter: Source sequence=SeqID_19635; Location=1..55; Strand=+; Gene= SeqID_84378
ttttaaaagattgaaaaagtgtctgaagagcaaaaatgaagcactcaaattaatg

SEQ ID NO: 118598 - DNA, 103 bp, Heterodera glycines
  Promoter: Source sequence=SeqID_14685; Location=1023..1125; Strand=+; Gene=SeqID_78798
atcggataaattgccgggcgtttccgagcacttttttgcatcatctctgtgaatatcggtggctaaaaatgttctcgctcgtctcgaccgacttgaaaagatg

SEQ ID NO: 118599 - DNA, 429 bp, Heterodera glycines
  Promoter: Source sequence=SeqID_12818; Location=1363..1791; Strand=-; Gene=SeqID_76544
cctaaaaccatttaggggcggtcctttaatgggggcatatagagaatgtttcaacttgtatcaataaaaaggtgccaaaggaaaatttttgtgatgattatcgctattacaaacataaaacgaccaagttccaaactttggtggaaatgtgactttaattcacatgggtgccagggctggggttttgaaaaggaagggttttttacaatgacgcgccgacacaatcatcatcctgactctatattgattgaaatcgaagaggacataaaatatcataatttttctgcgggggcaaaatgctttttgggtgacaacaagaaatagttgatgatgctaagaaaaatccgagactccaaacagaatttagagatgaatttattgcatataaaatataaaagaaaaatttaataaatgaaaaataaaaaaatg

SEQ ID NO: 118600 - DNA, 809 bp, Heterodera glycines
  Promoter: Source sequence=SeqID_3664; Location=1..809; Strand=+; Gene= SeqID_51339
ttggagttgagcgcacaatttatgcattaatcttctatttatgaatgaatattaaatcaaaaacgaatttattcaaatttaaaaaatttttttttgataaaatgcaaatattagcattcgttatatactgggaattaaatttaaaaaatgcgcccacattctcataatttgaatgacattttttaaaattatgagattaaactttttacttatgaaattttttttctaatttatcactttttataaaatttggtttgactaaaagttagggaatgcaaaatgcaaaccggccccctggtccccaaatcaccaacatttttgcctacggtatcagttcggtgccgactgtttcggcgccgccaactttgaaatgccacaacatttttctttgccagttcacgtagcaaatctgggcaccatttgatagcacaatttgtgctatttgtaaaaaaaaagttatggcatgtagcgctgaaaaagctatgaaaaagtcaattttttcaccatattttttttgtaaattgatgaaattttttgaaatttagcttactaattgtgaaccttaataactatcgcatcatatcaaaaatttaatttggtttataatgaaaaaagtcattaccaactgcgccgaactgggcgtttcccttccatccacccggtctttctattcctcagttttttaaaaaaaatttttaaatttttttaagctctccaccctcttaatttcttccaattttccctcattttcccctcaaaaattgaccccccccccataaattgttttctgatgcccattgatcacaatg

SEQ ID NO: 118601 - DNA, 148 bp, Heterodera glycines
  misc_feature (43)..(43): n is a, c, g, or t
  misc_feature (55)..(55): n is a, c, g, or t
  misc_feature (83)..(83): n is a, c, g, or t
  Promoter: Source sequence=SeqID_24487; Location=1885..2032; Strand=-; Gene=SeqID_55217
attaattaaatccattaaactaattaggctgttcaagttaatnaatactcaaatnaaggaattaattcaggctctaaatcatntattctactcaatcaattaggcactcaaatgtacctggaatgccaatgtcgtccgcgccgcgatg

SEQ ID NO: 118602 - DNA, 254 bp, Heterodera glycines
  misc_feature (67)..(67): n is a, c, g, or t
  Promoter: Source sequence=SeqID_22476; Location=1325..1578; Strand=-; Gene=SeqID_53149
gctcgagaccgagactcttgagacctacatctgaagctaggtcccgagactcaagacctgctctagnctagattccgggttttggtgtctaggctcaggaccgagactcttgagacctacgtttgagctaggtcccgagactcaaaacttactaggctagattccgagattcgagatcgagattttcgagacctactctaggctggcaagaaaaaaaggttcaatgcgcgccattaggttccgcaaccagcatg

SEQ ID NO: 118603 - DNA, 93 bp, Heterodera glycines
  Promoter: Source sequence=SeqID_13960; Location=453..545; Strand=+; Gene=SeqID_77918
agtacgggagggatatggtaatgacaccattttgatcaatctcgacaatgccaagactcacccattttgctgattcaccaggacacaccaatg

SEQ ID NO: 118604 - DNA, 84 bp, Heterodera glycines
  Promoter: Source sequence=SeqID_21222; Location=3008..3091; Strand=-; Gene=SeqID_51813
acagcaggataaggatggtcaacccttctcgacagtagcggcaaaaaaattgatctgtttgcgttgatgaagtcatacggcatg

SEQ ID NO: 118605 - DNA, 379 bp, Heterodera glycines
  Promoter: Source sequence=SeqID_15015; Location=267..645; Strand=+; Gene=SeqID_79170
ttttcggattgaatttggccttcaatttaaaccaatagccaacgggaaaattgtgaatatgttcaactgggaaaataaacagctgagtggcatagtttggcacgtaaacaaatttgttgaatgctaaatggatgaggaacaaataattttgtatttattataataccctaatgcgataaattaataaatgctttttattttggtggttgaaaaatgcaaaaaaagcgaaaaatataccttaaggaccgctttttgtaaatttttttaaaatactccattataatataaaccgaaaatttttgaactttttgtaagaacttttgaaaaaaattttgtttatattaaaaagtaattttattttagcatataataaaaaatg

SEQ ID NO: 118606 - DNA, 475 bp, Heterodera glycines
  Promoter: Source sequence=SeqID_5470; Location=1..475; Strand=+; Gene= SeqID_58171
agaaacaaggggggggggacaccatctaatagtatcaaaattacaaagcaaaattgaagcataagaaaaaaagaatctctgtacaacatggcttaggacaagtcgtaaaactcctaagggaagattatcattaccttgccagatatctacaggaatcgaatgtcaaggtcaatcgcagttaattccccacgttcatttggcacaaatcttcggtcggacatgtcgcatatgtttccaagtaacttttaggtaggtaccttagaggcctcctcccccaccccccccccctctaatcattaattctttttgtttttaaccctttccctaatttacaggctttcaaaatggcaattgtggcgcggcgtctgctcaaaaaccgggccattcaaaaacagttggagcgccgccaaaaaagtcggttgaattttgggcaaaaaattaaaaaacaaattttttttttttgtttgaagacatg

SEQ ID NO: 118607 - DNA, 477 bp, Heterodera glycines
  Promoter: Source sequence=SeqID_44942; Location=1190..1666; Strand=-; Gene=SeqID_72351
ttaattaattaatgtaaaatatgttaaaaattttaataataatattttatatttataataaatttaattaaaaaaaaaaattaaaataaagttcaaaaaatattgtttttttaataaacgaaaattcaaagaatttttgaatatttttaaatttatctaaattttttatattaaaattaaaaaataatccaaaagtgaaaaaaggcaatggctttattgtaaggcaaaatattataatgctttttatgaaattaattaaatttaaaaaattctgttatagtcattaaatttttaattttattatgtatttttttaatgcataaatatatttaataaattgttgtaaatttatttttttaattttaaataatttataaattcgccaggaaaaacactgcttggcgcgcgtggaaggatgtaatgttcttcgatttgcgcacaaattcggagtgccaacgattgtgcgtgtgcacaatg

SEQ ID NO: 118608 - DNA, 86 bp, Heterodera glycines
  Promoter: Source sequence=SeqID_16824; Location=1001..1086; Strand=+; Gene=SeqID_81240
tcggctatgaatacagaagatcagttccaagttcccactgtggcccaattgcatgcgatctataaggaggacatgataaggcaatg

SEQ ID NO: 118609 - DNA, 526 bp, Heterodera glycines
  Promoter: Source sequence=SeqID_5240; Location=2843..3368; Strand=-; Gene=SeqID_57403
ggcgatgccagaaaattttgattttcattgaatttagttaagaaaatgttgcacgcactttgaagtcataaaacgaaattttttgcgatttttcaaaaaaaaatttgtttgttttttgaataaaagtttttggtagcagttttgcataaaaatggccagattagatcattttaacaatcattctcatacatatgttttccttttttcacataaaattctcttcttatttcggttttgattttagcttacaaattttctacaaaaaattttcatggatttggacgcatttcttcgtttcttcgctggggtttgcaatttattttaatgtttgtcttaaacttttttttgtccagccgcagcagcagccggcaccaatgagtatttacgaacgctttaacaaggaagtttgcgaaaaaaacccttgagcgtaaaactaaaaatgtacatttagttgaatgtttgttgtttttctatttaaaaataatttttatttgcacttttaatagcacctcttgcgtgcacgatg

SEQ ID NO: 118610 - DNA, 128 bp, Heterodera glycines
  Promoter: Source sequence=SeqID_36272; Location=861..988; Strand=-; Gene=SeqID_65633
aaaataaataaattaattaattaattttcagatgaaagcaaatgggccagaggatggggccaattaacaaatgttttattttttaaatttcgaaattcaaacagtgcaaacaaattcaggatggcatg

SEQ ID NO: 118611 - DNA, 1003 bp, Heterodera glycines
  Promoter: Source sequence=SeqID_15539; Location=462..1464; Strand=+; Gene=SeqID_79819
tggtatcattcgaaagctcttaacaagctctatcggcttcccaaaaaacataaagatttaccgacatgtaaaaaagttataaattaaaatatgcaaattctgactttttttggttttattgttgcaacttttttatacataagttgttcaatcgcttagaaataccttaccaaaagcttctaaacatgtagaacttttgaatgatgccaaatttgaccaacaaagaaaaaatttgtgatattttatgcttgggtcagacgcaactgacccctactggggggaaacaccttaactactttatttccaaattcactagacaatcgttccattgaaataataaattgttcaacaaaaataaccaataaaataattgtgtatacatattatacactggtggaaaaaagtctttgaacaaaaatgcaatttttgtaaattggtttataaattgaaataaatgaaaaatcatggcggaaaaaagtctttgaacacatttaaaaaactatttcaaaaggctcttaaaaatctgaaataattcctgctaagacgcatttttattcggagtaaaaacgaaaaggacgaaggtgtctaaaaaagaaaagaccattgtttttacgggaaccggccattttggcgcaagactctatatcattttgatttcacagcaaaattaaataatcttggtatttttgcaggctaataaagaacatttagacctattgattaatatcaacattattttatttggtcgaattaaaaaaagttatgaatctttaaacttgtctgcgccaaaatgaccccgacccgttttttacaccactgcccagtcccagtattttatttattatataaatgcgaattttggatgaatttctgtttttgcgttctttttgctctctcatttttcccaactctctctttttaagttacataacaacagagttttgcattgccttttgtgacacaccaatcaattggaaaaacggcaaattgagccacaaaaatg

SEQ ID NO: 118612 - DNA, 184 bp, Heterodera glycines
  Promoter: Source sequence=SeqID_1892; Location=4976..5159; Strand=-; Gene=SeqID_76602
aaggaaatcctaggtaatacaaatgcatgaattaaaaattattattaattattgattaataaagaattactaattaataattattaaaatattaattaattattttcagcagaaggtcttttttcttttcacaacaaatgacaaaattaaatgctgacactaataaagagaagcagcaaaaatg

SEQ ID NO: 118613 - DNA, 63 bp, Heterodera glycines
  Promoter: Source sequence=SeqID_27602; Location=752..814; Strand=-; Gene=SeqID_58286
tggaacaatttatgaaaaattaatgagaaaaataagcaactttcaggcctaaaagagatcatg

SEQ ID NO: 118614 - DNA, 224 bp, Heterodera glycines
  Promoter: Source sequence=SeqID_10638; Location=778..1001; Strand=-; Gene=SeqID_73875
acaatagcttcaaaaaagatttcggtatacgttaataaaatgtatgttttctcgtgattgttttatgtacttagatgaaggtctcctcttttttctttgattgcatttttcatatgaatttctaagaaaataaagcctatttaactgaaaaagtgccgaaaactgtcttaataatttgctgcaacaaaatgtcagacaaccgaaaagaagccgaataaaaaatg

SEQ ID NO: 118615 - DNA, 76 bp, Heterodera glycines
  Promoter: Source sequence=SeqID_9694; Location=2857..2932; Strand=+; Gene=SeqID_72382
tctataaatatgattttttgggattttagaataaattttataattggtggtcggcagtaataatcggacagagatg

SEQ ID NO: 118616 - DNA, 213 bp, Heterodera glycines
  Promoter: Source sequence=SeqID_3111; Location=5305..5517; Strand=-; Gene=SeqID_83246
agagtaagttgcacaaatgcaattcgtaatatgtttttattcaaaacctagaatttatcatttttttgctaatatatactacaaatataaaaattctcaattggaaatcatttgaaattttactaaaatttagggatttattgaagattttaaaaagatgcacattctcattgcatgaattgtttaactttaacatttaagggatgcagcatg

SEQ ID NO: 118617 - DNA, 269 bp, Heterodera glycines
  misc_feature (40)..(40): n is a, c, g, or t
  misc_feature (64)..(64): n is a, c, g, or t
  misc_feature (82)..(83): n is a, c, g, or t
  Promoter: Source sequence=SeqID_21679; Location=1708..1976; Strand=-; Gene=SeqID_52289
ttatttttatgaaaatatgtttattatttcgaatgagctncagtagaaagtaataaattttatntaatcattaatttaccanntggcaattatttgtcatttaagataaaattattattattatttctttgaaattaaacaggatttccttattttattaagtaaaataatgatttattcagttttttaatcagaaaaaaatcatttaaatgcctcaaaaaatgaattgccatttaatttaagaaaaataaaataaaatcttgaaaatg

SEQ ID NO: 118618 - DNA, 1003 bp, Heterodera glycines
  Promoter: Source sequence=SeqID_5639; Location=5476..6478; Strand=+; Gene=SeqID_58740
gtattaatcagcgaaagatgtgatggacaattaaatgtttctttttggtattaatatgtaaattgttcagcattgttgtgatcagtgttgaaaaaacggtgatcaaaaatataatatttttatgttctaaaacattccatttcattgacatttttagtgacgaaataccgtaaatacaggggtaggtaccgtaaaaagttccaggggatgggaaattttttttttaaattggctcaaaatcgtaaaattttgtcattttttgaacaaaatcgttaagaaatcgcattaaaaattacaaatttttcgccgagccactgtccccaaaattttttggaagcgtgccgcaaaaaaaagcatttttaaaagcaaaaaaagtcgtcgtttggcttttatttgcaaaatttggtaaatttttggacacaatttgttagcaattcgcattaaaaattacaaatttttttccggcggcgcctagcggcaccgccggactctcttccctcacacattctcaaaaagttttttggaaaaagtgcaaaaaaaaaaatcaaaaagttttttacgaaaatttcaagattaaatttttgaaaaaattttcagcgattttttctaaatgttttcgaaaaactattaattcctataaaaaattgaaaatccgtttcaaaattttttcaactttttttttttttacaagtacatattaaaataattttttttggtgtgattaaatctattatttcaactgaccgatgttttttcaagttttcaaaaaatgcttaaatggttttaaaatacattcttattataaattagatatttttagacgttcccaagcaattaattgattttttcaagcatttgtttgttttttaaaacaaatttaaaaaaatccaggtccaggcctggatccaggtctcgaggagcctggatttttcctggacctggattttcctaaattttaggcaattaaaggaaatgcacgacgattttgaaacaaaaattgatg

SEQ ID NO: 118619 - DNA, 419 bp, Heterodera glycines
  Promoter: Source sequence=SeqID_40383; Location=147..565; Strand=-; Gene=SeqID_68736
ttttaaaaattggaaaaaaattttaagaatttggggtaaaataaatcaaaaatatgactaaatttgtatcatcaattgagcagaaaactcttataaaaactgtgattgatgttcatttctcctataaattgatgataagtgacaaaatgtcatcgcaattccttatctttattctcaaaaaataaaaaatatttacccaaatttacataaaatgaataaaaacaaaataatatgtaaaatatttaaataaagatccaccaaatacagctttatattgatcagaaaaacaaactatttaaatcatttttacaaaatcaatcaaaaaatttgagtcgcttttttgagttcaatcagatgccaatttttcattgtaaaagcgattggcaccgtttggggtgccattcttcggctggacaatg

SEQ ID NO: 118620 - DNA, 618 bp, Heterodera glycines
  Promoter: Source sequence=SeqID_14633; Location=1..618; Strand=+; Gene=SeqID_78720
tccatcttttatttttgagtttttaattttagtttattttaacactttttctcgccaattagcctttgctaaatgcactttttcgctccttttgcgatgactttggccacttttttggccatatcactcgtcctctcctcaattttcccttgccaatcagccgaagaatcaatttttcgctcatttctttttcatcgtcgggaaatgtgaaaacggagggcgggggaatttccgattcattctttcgttgccttttcggcgagtgttgcataagaatgtgaaaagacgaagaaaaagacaaaatcttacgatgattcatgcttttcctgctcttttgcttaaaatttaaaaaagtaattattgaattatatttttgaataaatatttaatttttttttaattaccaagcttaaatggacatttcagcaaaaggtgcaacagttccgcataattttctgctgctaccgattgaccaaattattatattatttctgatgattctctggcgccctttttctttgataatccattcccaaaaacccattaatttggcccattaaagtgactttggccatgaccaatttatttattatgaaagcgtcttaagtgtcgactatg

SEQ ID NO: 118621 - DNA, 134 bp, Heterodera glycines
  Promoter: Source sequence=SeqID_15316; Location=1617..1750; Strand=-; Gene=SeqID_79553
actgaaaaatttgttcataaaatattaccgatctaactttcgaatttattgttattctatttaatttaaaatttaaaaaaaacagaattccgatacacaaaatttgctttttgaatattttttgttgaaaaatg

SEQ ID NO: 118622 - DNA, 244 bp, Heterodera glycines
  Promoter: Source sequence=SeqID_37173; Location=215..458; Strand=+; Gene=SeqID_66319
attagccactattattatttataatcgaggataatttttgtcgaaatttgacccaataatctcggacatttttgttctcgaccatttcgagaatttctcgagacgtttttaggtttttggtaaatttattacaaacatcaccaacatagaatattctattgatgtcatttagtacagttttgacgccatttttagtttggaggcacagtttggtgaccgtttcggctccgattgctgtcccatg

SEQ ID NO: 118623 - DNA, 62 bp, Heterodera glycines
  Promoter: Source sequence=SeqID_29030; Location=1204..1265; Strand=-; Gene=SeqID_59600
tgggggtcgtcgtcgccctaaatggatcccccccgaatgtgcggagcgtccagctgcgaatg

SEQ ID NO: 118624 - DNA, 406 bp, Heterodera glycines
  Promoter: Source sequence=SeqID_26882; Location=647..1052; Strand=-; Gene=SeqID_57626
tccttgtgtgttttgcgataggcacaacagggaaaatatccgcaatgttgacgctgccatttgtcgattcgtcaaaaccgtgaatttttagggagccgttattattttgaacaatactaaaattgatcgtatttatcattatgactagggcttatatttatttgaatatttttaacagttttcatttttgtgagaatttccacaataactcgtttttggtcggaactatcttctttttagcgttaatatccgtaaatacaaaaatttttttttatagataaaatgttgtaaaaaatacaacgttaagaaaaactgttgaaaaaattcgaaactggtagaaaattttaaaaaattaaaattaaaaaagattttaaaatagccatatttacattttacgcgccaaatg

SEQ ID NO: 118625 - DNA, 284 bp, Heterodera glycines; identical to SEQ ID NO: 98949
  Promoter: Source sequence=SeqID_33443; Location=69..352; Strand=+; Gene=SeqID_63510

SEQ ID NO: 118626 - DNA, 604 bp, Heterodera glycines
  misc_feature (66)..(66): n is a, c, g, or t
  Promoter: Source sequence=SeqID_45257; Location=604..1207; Strand=-; Gene=SeqID_72586
aaacttttcgagagaaggggtggttcgtggtgccgataggcgccgccgggaaaaatttttgaaatnttacttcgatttgttaacagattttattaaaaaatgaccaaattttgtggttttatccaatatgtttacagaatttctaccaaaaatgttcaaattttcaagaaatatagggttaaattttcaaaatttcttatggggatattgcaaaaaaaaattaaacacctgagaaataccaaatgaatccaacataatatccactaggccacaggagcaataaatgaattacttttacaataaaaattaaatattctttttaaaaaccgggtccgggacccggacccgtctaaccctacttttttcaattgaaatttatttatttattttcttttgttagtaaatttattaattaaattgttattcatttaacaaataaggttctaagattttatataacatcataagtagcatactcctttaggactttatattatttgtccatatttcgtatatattttgggatttttgactcttctttttccttggaccgattcatttgtttaaccaaagtcaagtcttctcatcatatttcaagacaatg

SEQ ID NO: 118627 - DNA, 299 bp, Heterodera glycines
  Promoter: Source sequence=SeqID_3142; Location=1..299; Strand=+; Gene= SeqID_83383
tatataaatgaaataaaaaaaaactaaaagttataaaataattatttttaatttttaacatataaatgtctgaacagatatataaatgacaaaaattaactgtttatttcaattatcaaagagatatattttaatttataaatcaaatttatttataaatagaaaaaaaataaaattttaatattgtaaattatatttattcaatattcattataaaggatgaattaagcgactaaattctcaaattattttttaatattaataatatttaaatttaggtgctgtatgtgccctgtatg

SEQ ID NO: 118628 - DNA, 1003 bp, Heterodera glycines
  Promoter: Source sequence=SeqID_4194; Location=953..1955; Strand=+; Gene=SeqID_53549
ttttgggggaggaccataccatacgaagcatactgtcccctattcgtactgtacatgtgtgtctaaactgtactgtctaacatgctactactctctgtgtctgttcatctcccatgtgaaaacagtacgaatatggacagaactgaatcggcctcgtagaaactgtttttttttacgatttgattctttggaacttttatgtgttagtaaggaaggcattttttaaaagctctatgagtcattgggttgtttttattcttagataattaagtagggaggatgataattttaagtgctaaaaactgccaaaatagtaattttttaaattcaaaattcttttcaagaaataaataaattttgaggatgaatttttgataaaaatttttccattcttaggggttttagaggtgcgccgtgactatagtaaagaaggcatttttcgaaatcaatatgagtcactgcttttttaaaatttattttttattagataatagtgagaatagaattatttttaatgagacagaagaaacccttaatagggacccaaaaataaaaaataaatttaaatggtaaaaattgccaaatcatctttttatttacgaaagtctaaattttgcagtaaattctggattaatgcccattttttatttttttttaaatatacaaattcttctgctgatttcgtgactagaaaaataaggaacaaaattatgaatttcaaaaaagctaaataaatatgtgcatttgtaaataaaatttgatgcaattttattaattatcgaaagatttaagttagaaaataattatttctaaaaattaaataatcacaaaccatttgtatgcagtaatatgtaaaaaaacaatacaaatgtttaaaaattttcctagaaatttttcacttgaggaaaactcgacaattttggcactatgtcttgaaattcagcatcgagaaaagccttttgaactcattagtgggcaaaaagcgacaacaaatgcgccaatg

SEQ ID NO: 118629 - DNA, 102 bp, Heterodera glycines; identical to SEQ ID NO: 99198
  Promoter: Source sequence=SeqID_5240; Location=6677..6778; Strand=-; Gene=SeqID_57404

SEQ ID NO: 118630 - DNA, 381 bp, Heterodera glycines
  Promoter: Source sequence=SeqID_14670; Location=181..561; Strand=-; Gene=SeqID_78772
taatcggccaaaacggaaagccattcactgtgtgggggctgtcaaaaaagcaaaacatattagtttagcttaattgggtggccaaatttaaattgatttttactaatggcccaccggttttattgtcattttgttttgttcgggcattggccaaaatttcgtcgcgaatttggccaaaagttcaaagggtcggcttctcattcgctgctgcattttgccaccgtcgccagctgatgaaaacagaatttggagcagtgcatgtcgcgtcgccactgtgtccttttcgggaaggacggcgaaccaaaattggaagtccctttcctccaattgcatggatacggtgcgcgtgttgcgcccgagtacggtagtgggttcaaaatg

SEQ ID NO: 118631 - DNA, 795 bp, Heterodera glycines
  Promoter: Source sequence=SeqID_14257; Location=2044..2838; Strand=-; Gene=SeqID_78274
aaattgtattttgttatttggtattttttttattcaaatgacgcaataataaagtattaaaaattttaatattgtaaataattttaagactcaatcaaagtcttaaaaataaaatccaaatcattgtcgttacatcatatttttttaggtgttttttctcgaaaaatataataggaaaataaatttataaaaaattggtaatttatgcagaaataagtcaaaaatggaaaatttccgatttttttatctctcatttttcgccaaaatttataaatcttcgctttattttgtcaattgataaattttcttttggtttgttcccaattttttcgctatttttgaataaatttattccattttttattttgaatattttcttcctctttcctttattttttcttttatttttgtaaggattattcgacgcatttccctcatttcattatttcctattggccattatcaattcaatcacatttatccatttcacacgtttttccttttctcattgtaatgtttctccgcccattctcttcgcattttctccttccccagtgatcagttagtcagttatttatggaacagacttaaattattattccaatttctcgcttctgtaaatccaacaacgaatgaataaacacatctttaacagtcaatgagtcgtttgggggttcggggcttggtcaaaggcgccttggcttttcctcattccctcccaaattccatccgggataaacggtgcatagttggtcttagggcacagtgcgcatccctcactggtagcaccggatg

SEQ ID NO: 118632 - DNA, 256 bp, Heterodera glycines
  misc_feature (37)..(37): n is a, c, g, or t
  Promoter: Source sequence=SeqID_1353; Location=1..256; Strand=+; Gene= SeqID_72986
aaagggttcctgagagttttcaggctattatgatcanaattcaggatccattatctcaagtccaaagaaaattgagttatgagttcgacctgtacttggatttcttgattttgagtgatttattttattttttattttacaaccaatattatagtaattgttggcttgttttcagaatgatgatgacgtggtgattgtcggtgaaacgtgcactgtgatgtcgagttcgcccaccttcggcttcaactcggacatg

SEQ ID NO: 118633 - DNA, 564 bp, Heterodera glycines
  Promoter: Source sequence=SeqID_10847; Location=700..1263; Strand=-; Gene=SeqID_74120
aaaaaaaacaaaaaaattgttaaaaatggtttaaaaaaataggaaaatgaatgcctcggcatgggtttttttgaaaattatttttttctgcttttcctgattttttgttcatttctgttcataattttcttatcatttgtcaaaataagaccagaaagttgattgtattttgctttccgctatttttcggttaataatttacattttttaaacaattattttaaaatcgaattttttttttaaatttctttttgcgcattttttgcaaaacataaatttcagtcagcccatttcatatttaattatttattttttatttcgacgtttccacacatgacgaaggaataaacgtggtttttttcataaaaatattatgttttttatgtctcgggtgatataaaaaaggaatgttttccataaattttcattattttccaatattttttctccaatttttgaatgccttcgtcagtttcggcaatgatgccattttttgtgttattcaaaatgctttttcaatttgcccaactttgcgggggcgtcgatgaatatgaaaaaataatg

SEQ ID NO: 118634 - DNA, 56 bp, Heterodera glycines
  Promoter: Source sequence=SeqID_29750; Location=696..751; Strand=-; Gene=SeqID_60212
ggtgagacaaagtcaaaagagcagcgatcgcttatctgttaatcaccaaggacatg

SEQ ID NO: 118635 - DNA, 344 bp, Heterodera glycines
  Promoter: Source sequence=SeqID_1019; Location=10700..11043; Strand =+; Gene=SeqID_66209
tttctcggccaaaattttcaaactctcattcctattcactaaaactggataagtgcggttttgattttcagccatttcattcacattttgctgggcgtttgcatttacagcctgagggcggtctctttccaatctccgaatttcctgacttatagcctcatcaaattcattctcaatttctgcccaatttcgccgattttgccggtctctcaaatcgtaccgtctctcatccggcacttgtcctccatcattctctcttgcatttaaaccttgacgccttcccgacatcctcggatcaaatgtgcttcttgtcgcttcggtacacagttggcgtttcccgaatg

SEQ ID NO: 118636 - DNA, 705 bp, Heterodera glycines
  misc_feature (140)..(140): n is a, c, g, or t
  Promoter: Source sequence=SeqID_27025; Location=392..1096; Strand=-; Gene=SeqID_46023
ttttaaataaataaatatgcttaaatttattgaaaatatattttgtcagttaactcataagtaaacaaaaaaaaagtgaccgggacaaaaaggagtcacaatccatgttgaagatcctggccccggtcccgggtttttanaaaattcccggtcctactctatcctatgtagagcccggaaatttgaaaaagtcgggtaggattactggggttaaaatcccgcttttgccgggattccgggaaaatctctgcgtaattccgatcacgttccggttcggttcaaattctcaaaggatctattattagaatttttaaaaattgaattataaaatgattttcattcgctttaatacattttctcgattattgatttaaaactgtatttctgttaaaaaaatgaaaatgtggcaagttggggatattcactgcggagagggcgtgttcgttttcggcgttggactagtgaaacgaattggataggagggagattttatcttttcattagtccatcctttttttcgaaaaaccaaaattgttattgttactttaggatgttgagttctgccgagttctgccgaaaaatttgtgtaaagaattttcgtaaatgaatgtacatgcacttgcaattattttttgttttttaagctaagaaaatttgtcttgttattcgttcgtctttcacacggtcaaacccgcaaaagaaatg

SEQ ID NO: 118637 - DNA, 121 bp, Heterodera glycines
  Promoter: Source sequence=SeqID_12060; Location=574..694; Strand=-; Gene=SeqID_75589
aaatgttggcaatttcattcttattgacccattaataaatatataaactggcatttaaacgaaaaattatataataaatttaaaaggcataaaatattatatatttttattttataaaatg

SEQ ID NO: 118638 - DNA, 814 bp, Heterodera glycines
  Promoter: Source sequence=SeqID_38839; Location=344..1157; Strand=-; Gene=SeqID_67556
tgtttaacaaaggtgagcttccccgattcggagcggggaagggagggggtcgggatccggatccaacggccaggtaaggaagagagggtggacaaaggaaaagcatatacaagcatattggggaggagacaaagggaaggaccgccccaggcaaattgtcatatggctataagcaaagaagagggagagcagaaaaagaatagagacagtgagaaaaagagtaaatgattaaatattagtcatcattaaacataaagatgtaatagatgcacaaaatatcatgtcgggctgactggcgcactaccggtacaccattggacattcgaataaagcgaagataaatatttaatttatttattcactaaaaaggtttggcacgtcataactcggcacttgtgcttatggggaccttcctttgtcagtaaaatgcagttttataccattgaatcaagttttaaatgtaatttgcaaatttcgatgcgatatattatttaagcaataattagggttaacaattttagtgactatttttgcggctttctttctaccaactgtaaacgaagaatatatgaaaatggaaaattaaattttcctaaatatttagtttttgctaaaaattttcttggaatatcctatttattcattcacacaaacaactttaaatatgtaaagaaataaacaaatgttgtttacctttttatatctggcagtttattttttattactttacccatcagttcaatacttttgttaattctaatttctacatatttagcatttttaaatttaatttaaaagcatcacaaacaaaatg

SEQ ID NO: 118639 - DNA, 216 bp, Heterodera glycines
  Promoter: Source sequence=SeqID_17485; Location=2013..2228; Strand=-; Gene=SeqID_81988
tacgcccttgtcacaacacttactgctccacggtgatcagaccgtcagaacaaagcgggaaaaattcccgcgagaaggaacagaaaattgtcctcctctaaaaacgggactaaccaaccccagaggaaaagttcgtgccaaagttaattacggatttttaaattaaattcaaataatttattattcattcatccaacaaaagcaatcgaatgcatg

SEQ ID NO: 118640 - DNA, 540 bp, Heterodera glycines
  misc_feature (10)..(11): n is a, c, g, or t
  Promoter: Source sequence=SeqID_16190; Location=1..540; Strand=+; Gene=SeqID_80552
tgcaggtctnnttcgacaaacatttgagaaaaaagtgacaaaaggccacctctaagcaaacgaatgaattgggggggggggagagggcaaccttcattcattcgttaagggatagaatgccaaaatcatgcccaaaaatatacacactaaaaccgttgaattatctaattagtcggattgcttttcgtgactttaaattcaaatttgcacaaaagtaatgctaacttgtcatttatcaagctccttaaaatgcttaaaaaatggcattatttggctttcaaatcctttttgttaatattttcgatgtcaactcctcgtttaaaatcattttgttttttcttataaaatgcatttcaatattttaattaaaacaatttaaacatcatataaaaaatgcttaattattaatgaaatgatgttgctcattatttttctgtcatattcattgattttttagctccgttaatttggtaatggagttggcacatcatttctgaaaaataagaaaaatattatataattttaattaaaaacaaaatg

SEQ ID NO: 118641 - DNA, 133 bp, Heterodera glycines
  Promoter: Source sequence=SeqID_4076; Location=3348..3480; Strand=-; Gene=SeqID_53069
tctgaaattttcagcttttacctgataaagttttatttttaattttccatgttttgcgactattttcagtaataggtcatcaaatcaaatcttttctacaattatttaaagaaaatcttattttttcccaatg

SEQ ID NO: 118642 - DNA, 141 bp, Heterodera glycines
  Promoter: Source sequence=SeqID_14584; Location=701..841; Strand=-; Gene=SeqID_47217
ggttaaataaactcattttacaaatctgtttttatttatactcccgcatttttagccggcttcttgcaacaactgcttgacttcttaagtgccgaaaactatggcgaattggcaaccattgttggtcgttattatgccatg

SEQ ID NO: 118643 - DNA, 332 bp, Heterodera glycines
  Promoter: Source sequence=SeqID_7395; Location=559..890; Strand=-; Gene=SeqID_64693
gcaacatctaagcacagcgattgagctagatgggatgcgatgtgatcagaaatgggggactgattgattgttgtgattgattcgctctattttccgtatttgtcagaaaaaaaaattttttatttggacagacgcaaattttttgtttattccaccaaaatcattttaactattagcggtaaattttatttttcaaaaatttctttgaatttcttcgcttttcttcttttgctggtctcttcacgctgcaccttctttccacggctcattcatggctgaaaaaattgggcaattaattagcaataattccaatatccacccctcacatcatg

SEQ ID NO: 118644 - DNA, 349 bp, Heterodera glycines
  Promoter: Source sequence=SeqID_15175; Location=1..349; Strand=+; Gene=SeqID_79375
tttattaaagtatggggaaaacgacatcagtgtccctactcaagtttatttaccggacatgaattttaaaaccgccgggggcctgggaaataaaattaatgaggcattcacacatcattacaaaatcaaaaaacaacgtggaaagagagaagccaaggctgaagataccaaagattcaaaaattgatgtcgcaaagagggccgcagaacgcgccgggagagacgtagaaagacattttaatcagatcaacaatatatcgaattccatccaaacccaactaaacacactacgagaaacaaatcctcaaattttagaagagcctgatataaaaatttggtttgacaaaatg

SEQ ID NO: 118645 - DNA, 119 bp, Heterodera glycines
  Promoter: Source sequence=SeqID_40698; Location=606..724; Strand=-; Gene=SeqID_68953
tcactcaccccatataaaagctctccaaattcacccccaatcagttcaaccaaaagttggattttgctaaaataagattgtgcgtaaatatttagaaattattaaatattattaaaatg

SEQ ID NO: 118646 - DNA, 1003 bp, Heterodera glycines
  Promoter: Source sequence=SeqID_4727; Location=24..1026; Strand=+; Gene=SeqID_55536
actcaaacattggcatgacaaaacagcagagcaattgcgatttcaaaatgattgaactccattaattaattgaaaatggcaattaatttggcaattcgtatatatacagcgaaataaccttatagtaaactgcgatcacaaacaatccaatcgcttcacaatgtcatttttgtacacaatgattgatttttcgattaattttcactttgaaagaagaattaattgataggtttaatttaataattttcacgcttttttaagggcctaaattttttctataaaatgacagtttataatatgccattatataagtaattctaaaagtcaaatcgtaataaacagttccgctgggaaattttaaaatttttttcgtgcttttttgaagtcaaatttgaaatctttgggtgccaccatgaaaaattgttgctagaaaatcgttgtaaaatttgtatgaaaattttcaaaatttctccttattgagaaaattaaacgtttagagtgtgcctgttttttttttttgttcaatttaaaacattcattcaattttctctcgttccatttgatcaaaattaattaaaacataaagaaagaaaaaaagagacacaatatttttattatttttcgtaaaaagaaagtgcgacccaatcgtatgaccgattaattaataacaaattttgttgaaagaagaagattttctgaaagttcgttaaatgttttttttattataattcaaatttcttattaatctaatgatgttattttaaaaatattaaataatttagaagatctttataattttaaattaatcttatcatcaaccattcccgaaataggttaattgcgccaatttaaacgccacgaaatgaatgaaatgggaaaataatttaaggattcgaataaaaaaaagtataataaattaaagaagcaatgaacccaattccaccaactcatatttaagcagccaaaaagtaattgcaaacacttcaatagaaagtgtaaaatg

SEQ ID NO: 118647 - DNA, 418 bp, Heterodera glycines
  misc_feature (229)..(229): n is a, c, g, or t
  Promoter: Source sequence=SeqID_35867; Location=329..746; Strand=-; Gene=SeqID_65328
actagaaaaatgggggagagagagagaaaggggaaatgagggtaaaggaaaagaaagaggaaaaagaatggaagagagataagagaaaaaagaaaaagagggggagagagagggaaacaacaaaataaagaaaaaagaatgtgaaatgaaatgagaaagaggccaaattggagaggaaggagagaggagcagaagatgaacgaatatccgaaacagagaaagtgggggnggggggggggtgactcagacaacggtgctctcgcctctctcattcaatcatttcaccaacggacggatcgacgagaagagaccgactgactcaatgctgccattcccctccccctaaacaaaggcaaaagccaaacagatcaacaaataaacacgtcagattagggtcgattcggaatggcacaatatg

SEQ ID NO: 118648 - DNA, 314 bp, Heterodera glycines
  Promoter: Source sequence=SeqID_12683; Location=1529..1842; Strand=-; Gene=SeqID_76361
aaatttttcagcgatttttttgaaattttgtaatgaactactaagttttttcaaaaattttccaataaatcgctgaaaaactttaaaaaaaaatttttttttttcttagaatttcttatgaaaaaatttcctacgaatttttttatgaacaatttctaggtttgaaattttaaaaaaaaatttttcggacgggaaacgacggggggggggcgacctgctcccttttttggcatttgcaaattatggcgaatttacaaaaactttttgtgaaaaaaataataatattttaattgtaggaagttacacagtcaatg

SEQ ID NO: 118649 - DNA, 651 bp, Heterodera glycines
  Promoter: Source sequence=SeqID_27197; Location=196..846; Strand=+; Gene=SeqID_57885
ggtgagcattaaaattgccttcggagacctttggctgggttaaaatgccggaaatggttctttatacggtaggagtgagtgcacattactgtaaaatcctgtaatggccaagtttgcttaagaatgtttctaatttcaatcgctttttgtcaggttacgtcgcccccgcgccctttcattacgccgcgttaggctgccccgcggcgccgtccgcgctcggcatggacccgtccgcttttgcgcactttccgcccgcttattttcccggcaccgccccgtccgaccattcgctgggcaccaaattggacccgtccatggcctacgccccttacgacggttatgcggcggctgccgcgttcgccggcggtggcggcgcgtattcgcacttttacggaggccaattcaccagccaatgacaacaaaacgaagcggaaaaaacgacgacaaagagggaaaaatgagcgaaaagggaaaagcgacgaacgattcgacggagagaccaccgaacttcggcggactgatcaacttctgctcctgcacctctgttggccaaactgtgttcactcactctttcccctccccacctcacaattttactttttgtgccgcccgcgggtctccggcaatccctcccaatggcaggccaaaatg

SEQ ID NO: 118650 - DNA, 197 bp, Heterodera glycines
  Promoter: Source sequence=SeqID_2319; Location=2821..3017; Strand=-; Gene=SeqID_79104
tttttgtagatagaactatgaatgatttgcaaaatttggcggaagttcaaaagcgtgccgattttatatgttttcattcgattaggctccgcccacttttcgacagttcgaagctccgcccatttttcgcttcccaaccttcacccacccaaaatcaggattcatttgcaaaattttcaaaaaattctattgaaatg

SEQ ID NO: 118651 - DNA, 162 bp, Heterodera glycines
  Promoter: Source sequence=SeqID_1754; Location=2910..3071; Strand=-; Gene=SeqID_75723
tctacgctctcactccaataaatgcagagacgcaaaatatatttttatttcccaatgcctattgttatttcattgcttttttcttcttcgcgttttcttattatcctacatttctaattacttattcctttatttaaaataaactttttagcgggagcaatg

SEQ ID NO: 118652 - DNA, 1003 bp, Heterodera glycines
  Promoter: Source sequence=SeqID_3080; Location=488..1490; Strand=+; Gene=SeqID_83115
atgaagcgagttatggcagatcaaaataaaaaatacaaaaaaggcattttccagtgtaaattttgaaatagcgcgcaaaaatttacgccaaatgcgctatttggcgttatgagtaattttgtctaacactgggcttgacccatagtgccatagtgctcttttttactcaaattttttttttttgttttttattatcagaattgctttaaataatttttagcagacaacgaattctgctcataagacgagatttggcacacacagatcacttttttccacatacatttctgattttttgtggcgtaagcaatttggaggactcaatttgaattatcattgaaattcaaaggttcctcttccttgtgtgtaaagtattattttgttccctaaaaacttttttgtttgtttatgccaacttttcttcaacttcggcgtcgctcttttcccacaccaaattctgcatctttctcctcaactgttgagcaccatttaccaagcccaaattccgctcgaggaatctacggatttgcgctttatttgggcgtttggattctgtttgtcctttacctgatttgggcgttggttcgtttttatttaatttttagccggactttcttttttcaaacatatttcattttttacgcttcatccttttatgtccccgattatctgctgaaatctcttcacttaacctatcttccagcaaagtattgggcgttagctgtgccttcgtttttagtcttttccatttgtaaggatttttttctttactttttttaaaggtttcctcttttttagttgcatacattttggtgaatttctttttcaatttggtcaactttcactcactttatgaccaagaaacaacaaaatttcaattggtgaatgatttcctcgattggttcgttttcacatctttttaattttcgttattttttaattttgtcggtgttttctcttcccatttttccaaattctctttaattcatttgaaacagaaatg

SEQ ID NO: 118653 - DNA, 761 bp, Heterodera glycines
  Promoter: Source sequence=SeqID_10099; Location=1..761; Strand=+; Gene=SeqID_73179
ttaattaaggccttttagctgcttgttgtcatttatgtaaaatttcaatttattaagtgaggaggagctgcgacattttaataaataaaattttagccatataataattaaggcaactgacaaatgaggctgggattttaattataaacttttcaaaaaaattatgtgtttaaaaaaattttttttaaagattacgtgtcaaaattattattttttatgtgcgaaattggcggtaattgttgcaaagtcgggaaggatttcttttgctttgcaaattttaattttcccgacacggctgaatgtacaaaaattgctttaaaagaaattacaatatttctgcttttcttcaatgttgcaatttttcaacccccaaaagctgacgtaggcatacgaaagatatttttctttcatttttagtgtttgccaatattaaagctttaattttcttaactaataagcttttcgataattaagagagctcggctctggttcagattatgtgtccaaacaattacaatcctcagtttcttaggccataactttttttctttttggcttacattcttggtgccaatcaaagcttaaactcactagaattatgaatacagcaaagttacaaataaacacgaatttcaggctttttcgagtagctatatttacgaattatttttcgtctctttttttattaacccataatttgtcattaattgaacgcataaactaacaacagattgctagtgtatatacataaaataaatatg

SEQ ID NO: 118654 - DNA, 1003 bp, Heterodera glycines
  Promoter: Source sequence=SeqID_17638; Location=971..1973; Strand=-; Gene=SeqID_82167
taacggctaatttcctaaagcaacaaatgcacataaaatcgatggcacaaattaagcaggacattcgcattgataatttttattaaaaagaatggttcttttctgttttgtgaccccccctgaaattttcaaataaaaagtcatttctagggtaatttggggcgctgatcacgaatatgacatttatttttcataattccgaatcccgaacccgaattcgaaccaaaattcgaaattcataaattacaaggaaaacataaatcggaagcaaaataaaactaacgattggggccttcccttccatatttatgttaatttgaccacatttggcatttaatattatttttttaaaggccgaggagcgttcgccaatggccagcacgcggagaaaggagggcaagtagtggtgcgaccggagcgaagcaagcggcgcacattaggcttaggcttcagcttgcttaggcctaggcttaggcttcagcttgcttaggcctaggcttaggcttcagcttaggcttcagcttaggcttagacttcagcttaggcttcagcttaggcttaggcatagacccagtacgtattcagcgacctcgaaaacccataaaaatatgttttccttgtaatttatgaatttcaaatttatgttcgaattcgggttcgggattcggaatattgaaaaataaatgtcatattcgtgatcagcgccccaaattaccctagaaatgactttttatttgaaaatttcaggtggggtcacaaaacagaaaagtaccaaaagaattttcagttattcgtatttaacacctttactggtctacttaaaaaatatcaccatttaaaaaaatactgaaaaatatttattttttgattttcatatcctttgatagcttcaaaagatatttcgttgttttatcatgtattgtcaaaaattcattaaaaaattaagaaattcaaataattagtttcaacaattacccaaaaatttattaattgaataaagatg

SEQ ID NO: 118655 - DNA, 143 bp, Heterodera glycines
  Promoter: Source sequence=SeqID_16087; Location=2883..3025; Strand=-; Gene=SeqID_80442
aaaatgttcgaattcggtttcggaactcgccaataaaggagtcctgaatcgtactcatcgcatcaaaacacccctagaaatatgttattagatttttcaggaaactttaaaaaatttttttttagggaccaataaaagacatg

SEQ ID NO: 118656 - DNA, 1003 bp, Heterodera glycines
  Promoter: Source sequence=SeqID_7798; Location=2528..3530; Strand=-; Gene=SeqID_66003
aaaaattttctttattcgaaaaacattataaaatatttaataatcatttaagtgaccaaaattaagtttttttttgttaagttttacgtgttttgctccctaaaaatccttaataaaaaatttttaaatgccttttcatgcctttttcgggattttcgtgccttttcatgcttttttttcaattttttggtgcctataatagtgcctttttcgcgatttttggtgcctttttagtcggtctctagttatgccagaaatagtaattattttcatacaactttttcgaaggttgaccgaatttgttgtaattttgcaggctaatatagaaaaacctgggctatcgaacgatactaactaaaaaattatattgcttttattccaccgaatttggctggctctattccacatagaatgagtaaaacaatggcatctgcattatcttctaatccattcattaaataaaatattaggaattggaagaaatgcgagcgccaaaacattttcacgaactctctttcttaaaccaagttctgcagcataacaagactagactccaaccctgttactaagttcaatacacattggtttagattagagttgcacgggcccgggaattttgacaaaaaccgggaccgggacttttcgggttgaaaaccccggagaatttttgtctgggaaaaccgggaaaaaaccgggactagtcctggtcccggtcaaaaccgggacttggtactcatttgtagttttttcagtaccagtcccggtcccgtgcaactctagtctagatttaaattcttcatcttaatgtttactagttttgaatttcttccaatttgtcgggcaaaaaaaaaaaaaaagtaaaattacccattaattcggcatcagtccgaaaaatagatagttattgcctaggagaccttatccaaggatgttacaaaattatgactttttccaataacggcgattaagcaattttgaagccaatttgtaaaagtgaaaaatg

SEQ ID NO: 118657 - DNA, 881 bp, Heterodera glycines
  Promoter: Source sequence=SeqID_32071; Location=1..881; Strand=+; Gene=SeqID_62384
aaatcaaattaccgttcacgccacagaatcacaaatcattcattcatttgatttgacaaacaatttttaattaacgaaaattaatggccaaatttctttgtcaaaattggcagatgcatttcttctgactttgtgagtaaaggcaaattgccatgttagcattgcaataaaattgcatttcaagaaaacataaggacacagtcactttagcgtaaaaaatattataccatttattatcaatgagaaattccaacaaattattcaactcaaaattggcatgtgcattttctaagagaatgtaaataagcgaattgtcacactagcattaacataattcgtagaaacatcgtcgaagtgtaattagtgagtgctatagttctaattgttcactagatttttcagtgcgggaaaaattcgatttttaccatttaaaaaaaaatattttcttgaactttgtttttatattttcttaaacatttttttagcgtcaaaacataaatatgaaaatatttcatgtttcaatatatgaattttcggctttaataggagttctaatctcaaagtttcatgtaaaaaaaaagtgaaagaattttaatttttttttcaaaaatcggatccacgtttagacaccttcgtgaacgtgttagttaaatcattaaacgatggaattctatttattaatttaggatactaatcttaatgagttttttatgaaattttcacaatcgatttttcagtctgaataattcttataaaaaaaattttaatattcatgtctctttgtcgacaggtgaaaaattaaattaccgttcacgccacagaaaggaatttatattttttgaaaaaaaggtttaaaatatttacgaagtgattcagaaatg

SEQ ID NO: 118658 - DNA, 965 bp, Heterodera glycines
  misc_feature (21)..(21): n is a, c, g, or t
  Promoter: Source sequence=SeqID_12869; Location=1..965; Strand=+; Gene=SeqID_76603
tttcctgggggcagtgaacanaatctcaaatgcaatttaatttttgcaggtgaaaggtccgattgcggttggcatcagtttcacaacttatgacatggtcagtgaacggctaaagcggtggaccggccaaaagggcacacattaacagtgagaagaggagcagaagtaattcgagtccatccatttgctacattaaattataccctctcttcctcccattttcgatgttatgcgtgtcagtcaaaacaacaaaaatttgttttttgttcattcgttcatttcttctcacattcttttcgtaatttttggcattcgattttattgtatccaagtaaataattgtgtaaccaaaatgtgtcccttttggattgtgcctttaactttttcctctttcctgtcattttgtgttcagtcagcttttgttcggtgtttttcagaatcgcacaaaagcgaagcaatttagtactgtttgtactcaatgccaccagttgtgcagtcattttggtttctttttcaaggttctattttccattattctttgggtttgcacaaagccttactgtcactttttactgatttatgtaagaacttgtaattaaaataaaaaaggcgttgtgcttctgttttgttattcgattgtattttggggtttacttcaaaatatatggccttccttacaacaaattgccatcaattatttatctgctcgtcacgccatttgctcaatttcgaccaaacgaatcactcgttttgtgatttctcttgattgttatacttcagaggtttcttttgcactaatcgaaatggtacagattttgttcacaaatgttgtatttgtacacaaacagaataaaattatgttaaagttcgaagtctaaaaaaataatcgtttcaatttttgggttgtccttaaacaaaagaattttataaaaaaacacttgaagatggtctttttttaaaaaatg

SEQ ID NO: 118659 - DNA, 350 bp, Heterodera glycines
  Promoter: Source sequence=SeqID_28164; Location=1056..1405; Strand=-; Gene=SeqID_58813
tagtactatctcgtcgtttctctttttctttataatttctctcactttggcgtactatctcttcattttaatgatgtaaaaaacaacatttacttctctccatataacttgttttctatgcatacaagttgcaccaaattttgcataccgatagagaaaaaaattctgcatcggttaataggtcaagtcaatattaaaataggtcgaattagaaagtttttttgtgctaataaataaaaatatagattctttaagtattcatggcagaaagaaaattattaagtaagctaatcggcggagaatctgtaaaaaagcgctggaacaagcgagaggagcgacgaaccaaaatg

SEQ ID NO: 118660 - DNA, 108 bp, Heterodera glycines
  Promoter: Source sequence=SeqID_8569; Location=1013..1120; Strand=-; Gene=SeqID_68555
ggtgaaataatacaaaaagcctccgatacagcgaagcgaattgaattcctttaggtgaagacaatcgctaaaggaacaataaattcgcgaacgatggaaatcaaaatg

SEQ ID NO: 118661 - DNA, 493 bp, Heterodera glycines
  Promoter: Source sequence=SeqID_20790; Location=662..1154; Strand=+; Gene=SeqID_51364
aatgaacgaatggccaaagaccgtcccttaaattttgtgagttaaggtgagcgacgaagagggaacggcggacgcgggggacaattcgccgaacggagcggacgattcgctgtcgggaaaaaagaaaaaaacgcggacggttttctcgaggaaccaagtcaatttaaacaaataaaaaatcagcagcgactgattgaattgtgttgacattcgttaaggtcagtctgctggaacaaacatttggggccaacaaatatttgagcgcaaagcaaagggagcacttggccaacagcctcaaactgacggagacccaagtgaagatttggttccagaacagacggaacaaatggtgagcatatcaaatgggacggagtgccaaattcgaattcgaactctaagctacaccctcccctagcatttaaatgctaaattgaaaaaagcaatgccaaaagtaaattgctttaggaaacgtatgggccaagacgatcaaatg

SEQ ID NO: 118662 - DNA, 321 bp, Heterodera glycines
  Promoter: Source sequence=SeqID_31753; Location=1..321; Strand=+; Gene=SeqID_62060
catccaaaacattaaaaatgtaaattattttttcataatttatctaaaagcatgaaatctgagttgaattttcataaaattccttattttaaaatagccaatcacaggaaatgaacgatttgctaagttttgtcataagatttttaagaattttatttatacattaaataaatctataaaacttcgcataataattacaaaatttgtaatatttttcacgaaataattattattaaaaatccagaaaataaatcatttcaattgcagagattttgaaatattttctaaatcttttttagactgagtcattgcataaaaatg

SEQ ID NO: 118663 - DNA, 334 bp, Heterodera glycines
  Promoter: Source sequence=SeqID_17889; Location=504..837; Strand=-; Gene=SeqID_82439
ttctttgaattctaccatttttcaaaaaagaaggtgtgctctttttaatttgccaaaaattgattgaaatgcaagtgacttgggttatagaaattagttgataattatgtaattataaccggaattaacgaaggagcacaaaataataaacaaaaaggacagaaagtattcgcctaattgagcaccaatgcgaatcagtagtgatgttttgataaacacaattaggtaactttccatcgttttccattaacaaaaatattcccatttaaattgaattggaaaaaccaaaataataattatttatcctttttaaatataattaaaaaataaaatg

SEQ ID NO: 118664 - DNA, 124 bp, Heterodera glycines
  Promoter: Source sequence=SeqID_10017; Location=1..124; Strand=+; Gene=SeqID_73070
tcagatgttgacgactcttccgtgactgatgataaatcatcaaatgttgacgactcttccgtgactgatgataaatcatcaaatgttgacgattcttccgtgactgatgataaatcttcagatg

SEQ ID NO: 118665 - DNA, 715 bp, Heterodera glycines
  Promoter: Source sequence=SeqID_14036; Location=399..1113; Strand=-; Gene=SeqID_78010
tttttgttgtgtcaaaggcatcgtccgccgttcacctcctccttttatacgctttttattgcgcttggctttgtggatttaaggttttatgaatttatttttattagatgttaaatgcaaaagtatttaaattaaatcgaaggtcccaacaaagctcagaaatagtcggaattgatttttatatcacacgaaaatggcgttaaagtgtcaatctatgccaaaaagaaaagctagtctttaaaaataatttgaattttaaaaaattttgattttttgaaaaagattagctttctttcacttttattatatttttcattacaaatttccaaaaaatggccaaaaaaggacccactgattcgcatttttctcatcatgttgtgactatagaatcgattcagaccatttttggacgattttgagtttggaagctcagattaacatttatttaatttattttttaaattttattccattttagcaaatttttattgtgcattgtcaagaaatgcgcatattgggcctatgttccgacaatcttttatccgctgaatcatgcaaacgccgcagcgaatttaatttactgtttgctatggacattgggcttaatccaatttcaggcatttttaaaattaaaagattaaagcaatttattctaatttcttagcaatatgaaatgttaaaaataaatttaaaattttagctgaatttcctaatg

SEQ ID NO: 118666 - DNA, 497 bp, Heterodera glycines
  Promoter: Source sequence=SeqID_30204; Location=870..1366; Strand=+; Gene=SeqID_60639
ctagggcgcgaagcgcccgcccaagcccaataaaatttgaaaacgggcgcgaagcgcccgtctgagtccaacaaaatttgaaaaacggcgcgaagcgcccgtatggccaaaacaaatttaaaaaacgggtgcgaagagcccgtaagaatccgactacattattatgggaaaggaataaccctgtacctctatctgatccatctgaatagctacagaaggagcatttactcgacaacccttgaatattgcactttgacgcactgattgatttgatattgaaaagcaaatcatttagagaaaaactcacagaaggtaaaaattaaattgccataattaaaaaatatataattttttattgtcaaaaaggctttgataatgatgaaaatacaaaacagcgctttttggaatttgtcctgccaaattatcaggaagcggtgctgaaactgctcaattctggtgattttgctgaatttgagaatgaaattgcattgaaaatg

SEQ ID NO: 118667 - DNA, 1003 bp, Heterodera glycines
  Promoter: Source sequence=SeqID_4274; Location=391..1393; Strand=+; Gene=SeqID_53847
tttacgatttttctcccatcttctaaaagatgatcctaaatacgatgagacgtcgtgaaatgatgggaattgaaacaaaattttacacgatatgacgtcatatcggagatatgacgcgaattgaaataggccccaggccgatcagccgaattaaaatgactttgactttttcatttcgtgtaaaataaattcaactttcttcactatattaaatttactcaattcgtttgggaaaatccaatacccgaacgcggtcagccctaaaacaaaatatgatcagctgatttttgaggtgccatgaatttaggccgaaactctcgagcaaaaattgtaaggcaaagaaagtgatcgtaaaatgtctctctaattaattgaccgcatttctgaatcatcggaataattattttcccggacatcacaaaataatcagaccgatttaaaaatgcaatttttgggaaccgttgaaaaacttgggcccggccaaccctaataaaaaaatgatcagttgaatttgcagtgccatgaattcttattgattgatcttctctgaatgatcggaagaattaatttcacggacatcacaaaataatcagaccgatttaaaatggacttcttcttgcgaaaggcttagccttgcttgggttgggcttagtccaaacttaggcttaaatttcccaaaatttttgtttggtacgttttaccgtttatctggtttataaacataacatatttaatatttatttaaattacaaccaaaattccatcccaatgaatcatccatcgttttgtccgatcacttttttcagtttccaaccacagcaaattgctgattatgtaaatatgagttggcattggaatgggctttcgctgggttggttggtacatattccatccccacccttctcatttcatttttccattcattttacattttttccaaaaattttcaaaccattcaaaaactctgaacaatccaatggagtttgcccgtcgtcgtcccatg

SEQ ID NO: 118668 - DNA, 166 bp, Heterodera glycines
  Promoter: Source sequence=SeqID_10730; Location=1055..1220; Strand=+; Gene=SeqID_73976
ttgctaattgcttggctttatgcttcccttttacctctgatcagatgccaacgatcgcttgcacgcgttggaccgtacgctgaacgctctgaatgatcagctttcgtccacaattaaaggcattgatttgcgcattttggacgagcaaattgtggacccgataatg

SEQ ID NO: 118669 - DNA, 93 bp, Heterodera glycines
  Promoter: Source sequence=SeqID_11550; Location=3406..3498; Strand=+; Gene=SeqID_74986
actgaaaattggaaacgacggatttgccaaatccacaatgatcaattcactttgtgtttgacgcccgccaatcgttctgtgattagcgcaatg

SEQ ID NO: 118670 - DNA, 227 bp, Heterodera glycines
  Promoter: Source sequence=SeqID_37973; Location=1..227; Strand=+; Gene=SeqID_66934
attttttttgaatgattttatttttttaaattaattaagtttattaaaaataatttattttaaatattaaaaataataattctttcttcctaatttagcccaaaaatctattgtttgaccttttttgtgcaaaatcatttaaaaaatggagacaaattaataagttacctaaacataaaattataaatattttatgccaaaaaaagaaggaaagtgaaaaggaaatg

SEQ ID NO: 118671 - DNA, 1003 bp, Heterodera glycines
  Promoter: Source sequence=SeqID_6866; Location=1663..2665; Strand=-; Gene=SeqID_63155
aaaacaaaattggctttctagcagtactttttaatccatttgacaataaaaaaaaacaaataaaaattgactacttttaattcaactagaattagtggcaaaagcaataaccattctcttcttctgtgaagtctgtgttctgcctacgtacgtacggaagtgtgtctatttcgtagaatctttctctctctcaatgcactgcctacaccaacaaatcgtgaatgtgtgaaataaacggaattcgaatcgatcgattctaatcaatcaaataaatcgtatcaaaccgagcaaaaatagtgatatctaaagttatgaaaataatctgagcaaacgctcggctagccgaaacgttgcaaatacatgataagcttgtacaaatgggggaaggctcaaatttatatcattacaaagcttaaaattgcattaacattgggttaagcctcgaattaacggatatgttataaatgtatcggtgtcttttagatcacaaagatacgaagaaaggcgtcgattcattcaaatgggaaataaatttgtaattattgttcttagaaattaactccaaaatgctttaccttgtgtcaccattcaacaaactttcatcagcacaatcatttcatgcccagccactgacgggaaatttgtcaaataataaaccttaaataaaatggaagttaaaattaaattagagcttataaatgtgatcaaggttaaactaatactggttaaagctttactgtcgattaccgtcttcaaaaagtaataaaatcaattgtgtgtctagcatttagcgcgttaaaagccaaaattcgtatttttcatttttggcataatgcttagcattttatttaaaaaatgagaaaataaacatctgtggctgctgattacttattcccactgttttctgccccttttcactccggctttatcaatttttctatttgtcattgagaaattttgaagtttaaaagcattttgcagacattcaaaatgtcccgtgatg

SEQ ID NO: 118672 - DNA, 89 bp, Heterodera glycines
  Promoter: Source sequence=SeqID_8357; Location=1681..1769; Strand=-; Gene=SeqID_46588
tttgtcatgtattttttcaagtagttaaaatttcgctgttatatttactacattttggaatatgcattaattgatgggtattaagaatg

SEQ ID NO: 118673 - DNA, 806 bp, Heterodera glycines
  Promoter: Source sequence=SeqID_6060; Location=1..806; Strand=+; Gene= SeqID_60174
gcggctcaaatgtcggcggcgcaagtgtcggcggcgcaaatggcagcggcgcaagtgtcggcggcgcaaatggcagcggcgcaaatgtcggcggcgcaagtgtcattttggctgggcggcgcaactgtcgcggcgcaaatgtcggccaatcaacgcaaacatggaaaaattgaagttttaaaaggaattctttgagaaaatattttttgttttgcaaatctgaatattcaaaaaaaaaaacggataaactgtagtgaactccccgtgaaaaaaagggtcaaatgatataccaatcgattcgtcccgaggagcaaagaataaaccggttcaaaactcgaaaaattgagagatttcgcactctaacttttttttaaacgatcgaatccccacaaattagtaccattcgaaagctcttggcgagctaagtctaaaaatcattgtatgaagtcgaaccgcgccacctaaaaaccgacaagtataaaccggtggtttttgaaccgattcaaatcctatagtgccaattcagtaccaaaggtaatttttaattatttgaattggcggcgcagggaaactggtgcaaataggtcattttgtttattgcgctaaaaaaccgccgcacactcgactacggcggccagtaggtggggcgagactacgggctacgggagaagtccgcgcgtcgcgggtcgtagtcacgctccacccctgtttgtcctcacattttttgaaaaatttctttttcaaatttaattaagtggttcgggagttaaatatttaattcttcaatcctgattttataggaaatg

SEQ ID NO: 118674 - DNA, 360 bp, Heterodera glycines
  Promoter: Source sequence=SeqID_37149; Location=656..1015; Strand=-; Gene=SeqID_66299
gaaccggttcgtttgagggtccgcttcaatttgtcccccgatattgaggaaatttcgggcgcggaaacccaaaggccatatcctgcccgtaaaattcgttcactgcccacctttgacatttcacctattcatgttgaaaaatgcctttcctgtcccatatgcatgtgtccttttgtgagtggggagggtgccacctcactccattgtttccatatttttcatgccccatgtattgtaccatggcttaggattcagcgctcatgtcctgtttgtaaatttttattgccgtgaataaattttttgttgttctctgttaaggcgattgaggacagtttcgtcattgagcgcaccacgcaaatg

SEQ ID NO: 118675 - DNA, 300 bp, Heterodera glycines
  Promoter: Source sequence=SeqID_22144; Location=1..300; Strand=+; Gene=SeqID_52797
aaaatcctcatttcccaaaaaatcttcattgactacaaaaagccacaaaatgaggataaatcctcagatctggcaaccctgttcatagctgttctaaataaattaatttgctataggccgtaaatgtcctgcaaaattcgaaaattttggttatgattcaaaaaataaaagccaaaaaactttggattttagccttaattttttgaaatttttcgaaattctgcaatgccgggctaaaatgcgtgcattttcattcagttggccggcaaatttcttctgctacaccagccatttgtgatg

SEQ ID NO: 118676 - DNA, 65 bp, Heterodera glycines
  Promoter: Source sequence=SeqID_6711; Location=5543..5607; Strand=-; Gene=SeqID_62586
cttcgtgccatgccatttcttccgtcagttacgaaatcctttttgatgttcgtgcgacgtcaatg

SEQ ID NO: 118677 - DNA, 336 bp, Heterodera glycines
  Promoter: Source sequence=SeqID_11399; Location=3842..4177; Strand=-; Gene=SeqID_74791
gacgtccataacaaatccctttggatttattcaaggcccaaaaaccctcagaaatgctgtttttctgtcataaatcaccgatggccctccccccccccccccaccaatttaccttttttaaatttttttataccacggattggtgcaaattttcctatttattccgaatccgagttctggcataattctcgagtgtaggataattcataattgccataatttggcatttacgtgttttgaattggaggtaggggtgggctattactaaatttagccgtcgttttcaagctcaaattgctgttcactttggccaaaagtggcggcgtcgcgcggatg

SEQ ID NO: 118678 - DNA, 1003 bp, Heterodera glycines
  Promoter: Source sequence=SeqID_7296; Location=942..1944; Strand=+; Gene=SeqID_64383
taaatttttagagttatcacgaacaactacgtaacctcgataagctagcaagataagatttataaaatatacacaaatataataatatttaaattataaattaaaaaatagtaaaagtgctgaaaaatattattccgttggggacccgtctcgatattcagggatttaaagagaatataatattattttgtcatatataatttttttagttctagtttatagaaaatataaaaaacgctttggttattttttcaatttctattttatattggaagtattgaaagtgactttgaaattattaatcattttgttttctgtaggtgccaatttgaacaaactttttgtaattatacaattaccattaatgtgtctattatttaaaaaattccaaaatattcattgaatattacaatattaaaattgcttatcgaagaaaacttatcatcttattataataagtaaatcccaaacataatttttttcattaaaattgggaaaacaaaatatcgtaaataaacttattatatattttttcttttgcccattttgttttttgtttaaattatgcaaattaaaaaaattatacacgtgaaataaaaaaggaataattgataattgacacaaagcatatttcttataaataaaatttttacgtttataaaccttaataaaatgaaatattatgatattttaaattacaaattataataaatattaaaatataaaaataccaaaaaaataaatattaatttcaatgaaaaagttttaaaaattaatttaagcatttcctcagtatgttttaaacgcctttccaaaatcgagtaaattaaaaataaaattttacttggaaatataaattattaaaatttgctaaataataatccttttctcaaaataaaaaaaaacaaatatttgtttttaatgggaatattatgatttcttatttttttatcactacaaaaaaaaatagtttatagttaaaattcatatatttgtcaaaatg

SEQ ID NO: 118679 - DNA, 528 bp, Heterodera glycines
  Promoter: Source sequence=SeqID_10180; Location=1105..1632; Strand=+; Gene=SeqID_73284
tgtaagcatcaaattaaagagttaaaatatttaagtcatgccgctaactctgcaaaactttaaggatcttaattattgaaatttgtcttttaagtcttcttaagtttcttaaaaatattaatttatttgctatcgaatttattgaaaatatatatttttaaatctaatcaaaaaaatttacaatttttttcgtgaaatattcaattttttactagtcgaaaaatttttgatcataaaagcgaatttggatcttttgcttgctcctaatattcatctcaggttgaagaagtttatgaacatttagatgccaaagtgatgactataaggatgcaaattatatgcaccaaaacgtgcaaaaaagtgaaaatatgtaaaatataaaattgtcagaagtgagggcaaatttttttttaattctttaaattcgttaaatttgagcaaaaatctcgtaaatagctaaatatggtaaaaaatcatttaaaaaatgcttttactgtcctcccccaatttattaggttcatcgccatg

SEQ ID NO: 118680 - DNA, 259 bp, Heterodera glycines
  Promoter: Source sequence=SeqID_16165; Location=1256..1514; Strand=+; Gene=SeqID_80527
tttttttaagcaaattaaggattttaagactcccgcttccgtaaaaaatcccgttcaccgaaaaaagcgggagtcgggagcgggactcccgtaaacttcctccccgctcccgccgggccgtattatttaataataaaattaaatacttggcagaaagtgttcggtgagcatgaatcataagcaaaaattttttaatctgtttaattcgatgacatataattttttcataaataaatatatctttattatattacagatg

SEQ ID NO: 118681 - DNA, 55 bp, Heterodera glycines
  Promoter: Source sequence=SeqID_18337; Location=1..55; Strand=+; Gene= SeqID_82938
tttcaactcgtttttgccaattttttggccccttttatttggtggcgccaaaatg

SEQ ID NO: 118682 - DNA, 1003 bp, Heterodera glycines
  misc_feature (6)..(6): n is a, c, g, or t
  Promoter: Source sequence=SeqID_10658; Location=38..1040; Strand=+; Gene=SeqID_73900
accccncgaatttgttggtgtttgtccgcatgaatcaatctctcctctaccataagtggttaacggcgggaatgaaaaagggcatggaattgacgctgcgcgagtacgaacatagcccccctttccccccctctttcccctcttcccccccccttttccccattcccccgtccgttcctttagtctcctcatttgcacaaggtgatcggttggctgttgtttaattacccactcaattttaataccctttccctctatcaaaatatatatttatatgttttattttcacttgcttttcccccatttcagcttttttctgtgcattttattttgttccaattagctctaattatccgtcaattaagtaaaatagaaatttattggataattaagcaatttcctccaaatgtccattagtgtcaacatcaacgacccacaattcccagccgaactttatgagattttcttcgctcgaagtcccttcatcttccatcgatggcccatttggtctctgagaaacgcctctcgtgtggcaaaccaaaggcaatggcactgtccgacactttgccttcttcgctttcccagggacgacgacattttgaacatctcaatggcaattagtggcagaaccataagacgaagcgaccgccaaaggcttttcgatcgcatttcaaggtcgaaatgacaaatcactggccccaaatttgctaaagcaattatttttcgccaaccgtttggatggccagtgattacagagataatccatcggatcagttcacttcacttcatctcatttcctccctaagggatgtgcgaaattttactttctcgtaaaaaattgacttcgtgagtttcgcacatcccttcggccaaatagcgctttttgcattgtattatacaggtattaaacagaaaaaaacaacaacatttatttccgcaattttgtttcgtttcctccattttctcgccaatttccgtccgtttcgtttgttttgctcaaatg

SEQ ID NO: 118683 - DNA, 230 bp, Heterodera glycines
  Promoter: Source sequence=SeqID_6111; Location=1..230; Strand=+; Gene= SeqID_60398
taatcatctgatcaatgcccatggcactgcgccaatcctcaattgactgcacaaattcgagttcggcaagcgttgggtcggtgctgaactgaggccgacttgaacgaccaaaacctatggaaaggaaatgaaagtgattagagaacaaattgttagaaattaaaatattattgtaaatggatttctcatttcattgctatgaatgggagataatttccctgcctaaaatg

SEQ ID NO: 118684 - DNA, 727 bp, Heterodera glycines
  Promoter: Source sequence=SeqID_39978; Location=157..883; Strand=-; Gene=SeqID_68423
taattgtttgagtaccccaaacggacacttgaaaaaatcgatttttttgttttcggggcagtccccccgagccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataattgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaattttttaaaaaatttttccttatattttggttatatcgttttgcttttggtggggtgcttggaacagtggaatcatg

SEQ ID NO: 118685 - DNA, 55 bp, Heterodera glycines; identical to SEQ ID NO: 99576
  Promoter: Source sequence=SeqID_29415; Location=675..729; Strand=-; Gene=SeqID_59918

SEQ ID NO: 118686 - DNA, 356 bp, Heterodera glycines
  Promoter: Source sequence=SeqID_29446; Location=400..755; Strand=-; Gene=SeqID_59944
gaaatatgttttcatgacttttgaaaacaaaaaaaaaattctccgaaaaatgggggcaaccatctaaactattaccggggttggttaccgggaaaataattgagttgctctaagccagttttagtttaaacgatcaaaaacgcaaaacaattgaccttaatgctcctaacttttctcacccattgaaatgtttgcctcttacatacatataacttacaatttgtttttggaaattttttttattttgatcaacataacgccaaataaataaaattatttttttatttgtttatttttaattaggtacaaaattgagcgaaaccggggccagtccgggaatttccaggtttttaatg

SEQ ID NO: 118687 - DNA, 876 bp, Heterodera glycines
  Promoter: Source sequence=SeqID_6208; Location=814..1689; Strand=+; Gene=SeqID_60715
ggatttttatgtgctaaaaatcctgaaatatgtaataaaatatgtgctaaaaaatgctgaaatatgtgctaaaaatccccaaaaatgccaaaatatgtgctaaaatatgtgttaaaaattgaaaaaataagtgtgtttttgcataaaaattcccaaaaatctcattctttatcatttttagcccatacaacgcaaatcaaatacatttcgaagtgtttggggtaaaattgtctttttttgataaatcatttctataaattgaaagttccagcagagaacttcgaaatccaatgacgaattaatgaattcgagatttcattagtttctacaatcgaagaaaaaattttttaatttgaaaattatgttaataattaggaaaaaagtcgatttttagggggtgtatttttcaattttcttgtatttttattgcaatttttctcaaaaatgccaaaatatgtgcaaaatatgtgccaaactccaaaatatgtgctaacatattttatgtgacaaaacgccaaaatatgtgtttttatgtttttataagtcgctctaaatcaaaaattgttcggagataatgctatttttgggcttctctcgccataactaagccgcaaaaaaaatatgtaaaaacataaaaatccgggccctagtaatggccaaaccttttggttagaaaaaaatgtttcaaaaaaaaacgccagaaaaaaatgcgggaaaatttcccgcaccagccccggacaaacacccgggtttgggacaaacaccgggggcgacccttgttttcacacccccctcccaaaggtgtgaaaacacatgttttcacacctgggacggttgggacgctccccgtgggataactactaatgacttaaaatg

SEQ ID NO: 118688 - DNA, 90 bp, Heterodera glycines
  Promoter: Source sequence=SeqID_8134; Location=867..956; Strand=-; Gene=SeqID_67085
tttttgtctatgctttttttcaaatttaaacgccatttgaccaacagtgagctgatcgaccaatcattgctgcaaattcgactaactatg

SEQ ID NO: 118689 - DNA, 76 bp, Heterodera glycines
  Promoter: Source sequence=SeqID_12515; Location=964..1039; Strand=-; Gene=SeqID_76162
ggtgatgaaattttatgtgcgtaattaattaatttaattaataattgaatatatttttttgttttttcttcagatg

SEQ ID NO: 118690 - DNA, 200 bp, Heterodera glycines
  Promoter: Source sequence=SeqID_10096; Location=976..1175; Strand=+; Gene=SeqID_73165
aaaggaaatggggaagcactgatcagaattgtttgggctttaacctttttcgatgctccaaaagaaggtgcgaattaactgttaattaatgctaattacaacgatgattaatttccatttagacgaaaattggagttgcaaatgtcctgcaacttttcgaattgtctctcaaaagaacgatgggtcggatttgaagaatg

SEQ ID NO: 118691 - DNA, 499 bp, Heterodera glycines
  Promoter: Source sequence=SeqID_32172; Location=569..1067; Strand=-; Gene=SeqID_62499
gttaattaccttttggcactttgctcccttttcgaattaattcatcaacctggctattttctttttgtttacacggctttttctggacaaaatttcattgagtattgtttggccgtaaagatcactttcatttcttggtttggaatcggtaaaaatatcatgatgaaatgtaaaaaatgaaactttatttatacattaaatttacgtttaaggcacaataaatttaaaatttggctctatttgactacggtaaccttaatttgctttgttttcggttttgatttactcattacattataccaatttatgaatttgtatggtgatcagatgatcactggctgtgtgacagattttatcaaagttcttcctaatctattgctagttttacaaaaaattattcaaattaagggcccttctcatcaaaaaacaatatggtttagcttaacaatgatgacaattgttatttatttatttatttgttggacttgttataaaaatg

SEQ ID NO: 118692 - DNA, 126 bp, Heterodera glycines
  misc_feature (89)..(89): n is a, c, g, or t
  Promoter: Source sequence=SeqID_14754; Location=1299..1424; Strand=-; Gene=SeqID_78879
ttcattcccccgcccgaacaggtgggcacagacacgattctagtgcagaattttacttgtcactcccacgatggatcaaacccgcgctntcagctagaagaatggcgtaggcaaatcgattcaatg

SEQ ID NO: 118693 - DNA, 139 bp, Heterodera glycines
  Promoter: Source sequence=SeqID_5387; Location=3543..3681; Strand=-; Gene=SeqID_57853
ttccgctttgtcttcgtttgtcttcatttaaatttcttattaataatatttatttcggcgttagttattttcttgtttagatttattcgtttcgtttttgacctttatttccatcacaatcaactgaaaaacggcaatg

SEQ ID NO: 118694 - DNA, 151 bp, Heterodera glycines
  Promoter: Source sequence=SeqID_43986; Location=1..151; Strand=+; Gene=SeqID_71540
aatagcgtagcaatggctgagagacaggagtgagactatgtgtcatagtttatttgtaagttatttttgacgagttcaacgaacgagtcacaccactgctacccgtgcaaaaacagcgcatcaaccgtttgacactcaagactttctaatg

SEQ ID NO: 118695 - DNA, 1003 bp, Heterodera glycines
  Promoter: Source sequence=SeqID_15331; Location=298..1300; Strand=+; Gene=SeqID_79573
aacggaaattttgtgtccattttgcagaattttctaataagttcgataattgggcccattttcttaaatgtacaagctgaaatttgctcaataaatcgaaaaattctttctgaatagaaaacggaaattttgtgtccattttgcagaattttctaataagttcgataattgggcccattttcttaaatgtacaagctgaaatttgctcaataaatcgaaaaattctttctgaatagaaaacggaaattttgtgtccattttgcagaattttctaataagttcgataattgggcccattttcttaaatgtacaagctgaaatttgctcaataaatcgaaaaattctttctgaatagaaaacggaaattttgtgtccattttgcagaattttctaataagttcgataattgggcccattttcttaaatgtacaagctgaaatttgctcaataaatcgaaaaattctttctgaatagaaaacggaaattttgtgtccattttgcagaattttctaattagttcgataattgggtaaaaaagaatgaaggttaacccctttttacaaaaaaatgattattctattgttattttggataatcattagcacattacttagttaaaatttgctttatttttgttattttgaaaaagtttttcaagcctagaaaaaattttattgagaaaaaacttaaaaatttcgacttttttaaaattttcatgtgtaacttttttgttaattgtctaatctcggagcaatagcttagaaaaagcttctaaacatgttaagctttcaaatgatacaaacaatgttgggatttggttgataaagaaaaaagttatagaaagatagtgtaaaagcttgctggggccgaaccgtgggggccgaactgacgtagaccgggcactatcacttatcttttaaaatttgattatagtacgaaacgccaaattgaaacattgtacgaactgcctttgtacgaactgcccattgtacgaactgccatg

SEQ ID NO: 118696 - DNA, 418 bp, Heterodera glycines
  Promoter: Source sequence=SeqID_19207; Location=1..418; Strand=+; Gene=SeqID_47571
tgcaaaattttttaatgtatattcatgaaattttgttcaacggggtttttggggttcccgatcacactaatctgtcaaatattttgatcaattcccttttcctaacctaaatttgaacaaaaaaatcataaatcgaaaaattcaaatttcgatttttgttcgggttcgggttagggattagaaattggtcaaaataaatgtcaaattcgtgatcagcgacccttaaaaccccggagaacaaattttaacggttttttatcacaaaaaaattttgaaaatcaaaagggtccctcccccctttttgataaaaaaaaaattcaaagccgcccttctttaaagtagcgtcaattgtatcaattcatacacaatcacagaagttcaaactttattaccaaattttataacattcacgaaaatg

SEQ ID NO: 118697 - DNA, 623 bp, Heterodera glycines
  misc_feature (88)..(88): n is a, c, g, or t
  Promoter: Source sequence=SeqID_6014; Location=22..644; Strand=+; Gene=SeqID_46170
catcgtatgcttcaagttttttgtgttgaaaaacacctaaactggttatgtaagctagatttaggtacaaataagcaagccaagcctnttattttctttccaattccagctgttttgacaataaaccgttgaagaataaaatgcgcccgagacatctttgataaagtgcactgaatattgcccaaagatttgaaacgaatacaggccaacataaacttaaaagttttttttactaagtttttgggaaaatgcgggatttttaagattaatccagcgggattcgtgatgccaaaaaatttaataatgccaaaatttaattaggtataataattttttcaattcatatttccgattcccaatttttgggccgttagaattcagattgccgaaaataaattatgacgtcgtgaagagaggactctactgtctttcaaaaccattgattgtcagacaaatacccaattttttttggtactgagtgtgagaggctaaaactaaaaccgtctttagataaaatttttataatatgggatttggtggtcgaggaggtggtggatttcgtggccgtggcggtggtcgaggtcgcggaggaagagacggcgggcgaccgatgacagactatg

SEQ ID NO: 118698 - DNA, 1003 bp, Heterodera glycines
  Promoter: Source sequence=SeqID_9111; Location=1672..2674; Strand=-; Gene=SeqID_70284
caatttttttgtctaatttcagtacatttacaattttccgtcattgactaatctatttttacaaaatttctcaatagttcaaactatacggggtaatttaatctcatttcttccaaaatatgctgaaaggcgctatgttaaaagtgaccagttttgaaaattttttcaaaaggggggaacaaggggggaacccttttgttttgcaaatttttttttgtgataaaaaaccatgatgttacttggctattatagtgcattttttgttttaatggatttattttaatgaaaaatttgattggacgcataaaaatttgattggacgcataaaaattgattggacgcataaaaattgatgggacgcataaaaattgattggacgcataaaatttgattggatgcataaaaattgattggacgcataaaatttgattggacgcataaaaattgattggacgcataaaaattgattggacgcataaaaattgattggacgcataaaatttgattggatgcataaaaattgattggacgcataaaatttgattggatgcataaaaattgattggacgcataaaaattgatgggacgcataaaagtcgactctctctctcatctctctctctctgctctctctctctatctttcgctctctctctttctctctctccctctctctcccttcgctttttctctcttcgctttctctctctgctctctagcacgcgttacccaactcttaccctctcatccgcgccgacaaagaaacaaacactgcactctctcctctacccaacctttctcattagtctccaattatatttttttattttctgtttcttttcctctgtgtaaacagaacaccactttcggcgcgaattcaaaaagctaaaaaaggagcggggctattactcgcttaatatatagtaagtgattttctcaaaaattcatctctaaaatttatttatttattattttagaaatattcgaattttattactaaatg

SEQ ID NO: 118699 - DNA, 1003 bp, Heterodera glycines
  Promoter: Source sequence=SeqID_1247; Location=7969..8971; Strand=-; Gene=SeqID_70630
ggcgatttattggaaaataattttttcgtaaatttttttttgaaaaattataccaaaaagttttttgagtgtcaaacaaagcctcctttttgaaaatttggatcgtaaacaaacaaagtaaggtgtgaaaaagttttccgttggaaaaagttcgaaacacaaacttttatccgatggctttcgagatcactgattacgaaccctgacatccattttggactgttccccaatctgcaatttttgaccaatttgccgtttcctttgatgatcactcccgactcttgacccagcaaatttattatgtaatttttccccttttaatgtgtgcctttgctctctccctttgaattccccgtctgataagaattatgtcggcatcctctcttcttgtccttgcctatttaaactctgtccccattgactcttggctttttttgtcttccttttcctatccaatcctaccacttatacactttcacctttaatttcttcatacctttcccatcctacttaaataaacttcttttccatttcttggcaaacttaggagtaaacccggggattaattgggagtaaaacaaaagcctccttggccaaatctctcccaacaaattgtgcacggacagtgcagttggtgccacgacccgggactattcctcattcgcattttgccaaaccaggcaaaatcccaataggctgaacgcctaagattgtcgagtcgtagctgtgtgctcctcggcggctgtgtgccatcgaaaaaagagccaagtcgaagctgtgtgctccttggtgcggctgtgtgccctctgaaaagccgagtcgaagctgtgtgctccttggtgcggctgtgtgccctctgaaaagccgagtcgaagctgtgtgctccttggtgcggctgtgtgccctctgaaaagccgagtcgaagctgtgtgctccttggtgtggctgtgtgccgaattctctttgaccttttttttgtcaaattaatccaaaattctccatg

SEQ ID NO: 118700 - DNA, 496 bp, Heterodera glycines
  Promoter: Source sequence=SeqID_8532; Location=2852..3347; Strand=-; Gene=SeqID_68416
tcgtttttcccgatagcttttttctttgacatccaacctaacattgttggtatcatttgaaagctcttaacatatgctctattagccttaccaaaagcgaaaagattttcaagcctggaaaagaaaaaacttcaaaaatttcgacttttcgcaattttatgtataacttttttggaaattgtctaatagcgaagcaatagcttagaaaaaatttctgttaataaattgcactggaaaagattttgatgaaaatcactaaaaaattttcaagcaaatatagaaatattataccaaatatattttttgttttgttaaaaatgggtttttggccatgggttcaaatccacatgcctgcaacattttttaaaaattatttttggggtttcgagtttggatcaaagctttggaattgggcaaaatggatgccaagttcttgattagtggtcccaaaaaccctaaaaaaacatttttacaggcaagtggatctgaacccatg

SEQ ID NO: 118701 - DNA, 468 bp, Heterodera glycines
  Promoter: Source sequence=SeqID_22488; Location=398..865; Strand=+; Gene=SeqID_53158
tgtgtcgcaccaatacgattcgctgactggcccctcggggcatgtgtcgcaccaatacggttcgctgactggcccctcggggcatgtgtcgcaccaatacggttcgctgacaggccctcggggcatttgtcgcaccaaagcggtttgctgactggccctttgggcatgtgtcgcaccaaagcggttcgctgactggccctttgggcacgtgtcgcaccaaagcggtcgctgactggccctttgggcatgtgttgcaccaacttttggatctgcattcttaatgggatgtgtgagccctggctgatggatttcagcacaggatgactacactccatggcgaagaatgatgtctttgatctttatttgtgcattttggttaataaatttttaacttgtgtgcatttattggttaattacctcatatttttgccgcatttgctattccttcctgattttttgtttcagatg

SEQ ID NO: 118702 - DNA, 110 bp, Heterodera glycines; identical to SEQ ID NO: 98226
  Promoter: Source sequence=SeqID_5872; Location=644..753; Strand=-; Gene=SeqID_59507

SEQ ID NO: 118703 - DNA, 501 bp, Heterodera glycines
  Promoter: Source sequence=SeqID_3641; Location=1899..2399; Strand=+; Gene=SeqID_51232
ttcggaaggccggtgccggccttcgttgcagaccttgcacaaattctcgtgcccggtcttccaaatgctgttggcagcggcccaatcgccgttgattatgctgctgttgttgtacataaaaacgaatttacgaaggaggaagagagagtagtattaatttcgaagtaaaaatgttcaaactaaacaaattaaaaaattttaattttaaaaacaaattaaaagacaaaataaatttaaattgttgctcgtttggcattatgttattagataaattggaattaaaaatattttttattttaatttacttattaaattttgcctgcggctttgtaagccatccgcttatccccccgtatcccttttaacctaaaaccggttttttctgtagagaacatatttttctaaaattaaagcttaatttcaaatttgtatttagcagatttaaaccgtaattgcttttttattttttaaatcaaaatttaaatatacttttaagtgatg

SEQ ID NO: 118704 - DNA, 231 bp, Heterodera glycines
  Promoter: Source sequence=SeqID_11996; Location=888..1118; Strand=+; Gene=SeqID_75519
tttttgcttatgatttcatttcatgacagtagctggctggcctgctgcaaatatcgccttcttaattatacaaattgccaattttttttatatataaaattatatgcatacattttgtaaattaatttttctaaaatttctagaaaaatccaatacaaaaattagcttacctccccttccgctgtctgtccaacccctcatccgactacagtactcttttctctgtgaatg

SEQ ID NO: 118705 - DNA, 812 bp, Heterodera glycines
  Promoter: Source sequence=SeqID_4223; Location=1407..2218; Strand=+; Gene=SeqID_53666
aattttttaacttgtttcggtatcattttaatagcgattagtctgttctctctatttacaaataaaattaaattttttattattcatttataaaaagattgaaaagaaacaaaaaataattttttttttcgtttctgcaccgcgcgaattctttcttttttataattattatttaaatttaaaattaatgaattaaaaaggaatttgaataaattaaattaaattattaaaaatttttattaaaatttatttcttttgcctgccaatttaatacagatgatcaccaatctgttcgcatcaatgatgggaggagaacgagctgcgcgaaagtatggcgtgaaaaggcaaatcttgcagcgaactcggagttcattaaggtgtttaattatacaaattagaattgatccgtcgaaacttaatcactttagtcaaacatcggcgtaattttaagaacgcttttgcgtacatcacgtcattcgtactggcagacccaaaatttactgatattttttatattacaatttttggccaatatttttgcgtatataaaattagcataggagtggcattgccgggtcccattttaccatttttttgataattaacccctaaatggcaaatggtcatttttaataacaaaaaacaacgactacaaatttctgattctcccttcagatttttttttattcggtcaacaaaaaaagactgaatatttttaattttttttgacgcattttttgcttagaagaccccaattggtcagtgttcgttcccgtggctctgtcttccatcaacaaaagcgtcgtgacatg

SEQ ID NO: 118706 - DNA, 135 bp, Heterodera glycines
  Promoter: Source sequence=SeqID_8039; Location=2190..2324; Strand=-; Gene=SeqID_66785
tctaaaggtgagagataagcttttggaataggcaatatgccatttttaccacaataatctgagttttattggaaatagccaatcgtaaacaatcaaaaatttccgaattttcagctttgtaggattttaaggatg

SEQ ID NO: 118707 - DNA, 863 bp, Heterodera glycines
  Promoter: Source sequence=SeqID_2150; Location=1..863; Strand=+; Gene= SeqID_78094
tattaaattgtattataatatttgcgcactggcagtcttttgaaacgcgccgataggcagtttttagaaacgcgcaaccccattttggcagtttttagaaacgcgcaaccccattttggcagtttttagaaacgcgcaaccccattttggcagtttttagaaacgcgccgattggcagtttttagaaacgcgcaaccccattttggcagtttttaagaaatgcgcaaccccattttggcagttttaagaaacgcgccgattggcagttttaagaaacgcgcaaccccattttggcagttttaagaaacgcgcaaccccattttggcagtttttaagaaatgcgcaaccccattttggcagttttaagaaacgcgccgattggcagttttaagaaacgcgcaaccccattttggcagttttaagaaacgcgcaaccctattttggcagttttaagaaacgcgccgattggcagtttttagaaacgcgcaaccccattttggcagtttttaagaaatgcgcaaccccattttggcagttttaagaaacgcgccgattggcagttttaagaaacgcgcaaccccattttggcagttttaagaaacgcgcaaccccattttggcagttttaagaaacgcgcaaccccattttggcagttttaagaaacgcacaaccccattttggcagttttaagaaacgcgcaaccccattttggcagttttaagaaacgcgcaaccccattttggcagttttaagaaacgcgcaaccccattttggcagttttaagaaacgcgcaaccccattttggcagttttaagaaacgcgtcagcactcttatatttactattttgaagaagaagcaaatg

SEQ ID NO: 118708 - DNA, 54 bp, Heterodera glycines
  misc_feature (50)..(50): n is a, c, g, or t
  Promoter: Source sequence=SeqID_19834; Location=1974..2027; Strand=+; Gene=SeqID_84583
ggtttgaaatttcaaaaagatgaattaatttaaaatttaaaatttttaanaatg

SEQ ID NO: 118709 - DNA, 789 bp, Heterodera glycines
  Promoter: Source sequence=SeqID_20498; Location=1..789; Strand=+; Gene=SeqID_51037
ctctagagtcactccataatgttttatcatcaaaagttcaaaaaaaaatttttttttttctaaaaagctcttattgaaaagaaaactggtcaaaatgctattttgagtttctcatgcgataaatattcgcaaaaaacatactgaaaagaatattaaacccggtcctgtttattattatttttaaaagaaattttcatattttattttgggactcaaaatttaccccatttttcgtatgttctttgtgaagcagttctttatttttatttaaatttacttcctccaacactcaaattgggaaaaagataggtccttttatgttcaagtgataaaatgaaaaatgaagatgaaaaattccgacttgtaacaccgtaaacccaaaaaaaaaaataaggggaacataaatattccgcggtggttccaaagtgatgcctttgaaaaaaaataaataaaatatccgtaaaaaaattctaatcaatttttcttacaaaatgtattaaaattaaaaaaaaattccggcggcgcctatcggcaccacttttctttttgaaattttcctcaaaaatagcaaaaattagtcctattttttggcgaaaggcggctacaaatttctttttttttttttgctcaccgctgctcaaatttttaaattaaattttggcccaaacagcaaaaaaaagcttttcggttgcaaattcaaattgttctcgctttgttttttaaaaaatttcaaaagacaccacatcggaacgagcgcctacaattcccataaaaattgcgttaaaaatg

SEQ ID NO: 118710 - DNA, 626 bp, Heterodera glycines
  Promoter: Source sequence=SeqID_11155; Location=437..1062; Strand=+; Gene=SeqID_74506
tgtagaagattgagcacagaataacagcagaacacatcaaatagatggcttaatacaaataatgatcagtagagcctggatttatggatttttttgcataaattattcgaccaaatatcaaataaaagtatttttagccttggtttgatgcttcgatgcttttattttttccacattcatatttttgtacaaaaatatttccattttttatccataatccggcactttcacaaataaacctctaacaaaaatttaaaaaaaattcaaaaattaccaagacttttttcatgttcaaaattcctattcaatataaattttatttaaaaattattttaattaatgagaaaaaaaatattttctcagactacaatatgcgatattagggttgcaaccccgacgtcggggttggaagcgtcggggttcggggttgccaaatcgttcggggtcggggtttttcaaaaaactggattttcggtcaatagcacctattttggcctttttccagaaatttcatagcaaaaatgcaataaaaacgaaaaatgcaccccaagaatcgatctaaaaaatttcaaaaaatatacccctaaaaattgaccaaaatttcagaaaatattcccctaagaatg

SEQ ID NO: 118711 - DNA, 59 bp, Heterodera glycines
  Promoter: Source sequence=SeqID_23566; Location=1917..1975; Strand=-; Gene=SeqID_54255
attaaaaaaaattgcttaaaatttaataaaaattcttcagagttgttaatctgctgatg

SEQ ID NO: 118712 - DNA, 112 bp, Heterodera glycines
  Promoter: Source sequence=SeqID_5099; Location=6994..7105; Strand=-; Gene=SeqID_56900
ttatttcgaaatgaattttcactcaaaattcccccctcctctaattgctcgcctcgtgcttcttcgcaatggcatcatgctaatgatgcgcagtttgtacggttttaaaatg

SEQ ID NO: 118713 - DNA, 1003 bp, Heterodera glycines
  Promoter: Source sequence=SeqID_27613; Location=116..1118; Strand=+; Gene=SeqID_58294
ttctatttaatctattattattaataaattttaattgtatcttgcataacattaagtcaaaaatgaattgaagttgcttgctacacatataaaaaaccaaccaatgttttattatatacagtttttagttgcttagatattaaattcaatcttctaaagcgttgatttacattcattttttaactctaatcacattctatgtacttaaaattaatctaagtccatttataaaataatttaaaaggaaaagattaacgaaaagtgtttaatttacagataaataaaaattattaaaaaaaagaaaaaatattcccaatttgattatctataaatttgctcaaagaaataagtataaaattgggaaaatgtctccaaagtcaacataaaatttaatttcttattgacgaaaattgtgattatgaaatttcacaatatttaaaaaaataagaaatttaaactatttcgctcaaaatataatcttattcgctcaaaaaaaaagaatatctatttatttttataataattgatcgatataaaataatttactaaatataatttaatccatatacaattttatatgtgttgttacttttttaaatattggcacagcaatttttggtataaaacaaaattagttaatttattctaaaaataataattataactgattgatgattactgatggaaacattgtgttggactttttgacctttattttattttttgtatttgtttggcattatgtttaattatttgtgaccgtttttttcccaccttttcaatgattcgaatttaattgtattagttttatgttttgtcttctccaaaaaaaattgtttgtgtttcttttatttaatttggaataaataaactctctgaaaagccttgacaccttccttgaatcccaaccaaaagtagaagaaaaatctcatttttatgttcttctcgcaaagtaaaagcctattttttcacgattttttttatcttttaggcgtgataaatg

SEQ ID NO: 118714 - DNA, 611 bp, Heterodera glycines
  Promoter: Source sequence=SeqID_28898; Location=524..1134; Strand=-; Gene=SeqID_59466
ttttgaatttaaaggaacaaagcaagtttatgtgcggataataattaaataattcagcacttaatgaattgaaaagcaaatatttattaatgaaagtcaaaatattatcttatcaaataaaactgcataatgaactcaataaaatatatttatttcagttatttaaatgtttataaattttcaatacattaaaaagcaataaatataaatatatttctttctttttaaaacaaagccaaattgcattcaaattattttaaaaaatttcccccggcggcgtctagcggcatcgcgcaaaaaaacgcacattttttccaaaaaaattgtataaatttttaatttataccttggaatttttaaaactttaaacaaattgtttattgagttaattcaaaaaatcaaataaattcgaattcaccgctttgtttattaaaatatatttttttattcaattaacaatagtttaaagcataaaaaatttaaataatttttaattaaattaaatatgagaaatccgaaattaagaaatacatataaatcattcaaataacaagaaaaaatattgaatataaaattcttttatatgataattgaaatttcttcaaaaaatg

SEQ ID NO: 118715 - DNA, 1003 bp, Heterodera glycines
  Promoter: Source sequence=SeqID_3999; Location=1211..2213; Strand=+; Gene=SeqID_52757
gataatcattcgggatgaatttgtggtaatactggggtttgttccccccccccctttttggcaaaaatttaaaattttaaaaagtcaggtaaagcatgttttctggggttttcggggccgctgatcacgaattcggtatccatttcgcccaattccgaaccccgaactcaaattcgaacaaaaagtcgaaatttatttttcatcaaaattcaatttattgcaccaaatctattcaaatgcacgaaatcaacaacggaaagaatagattttacaattactcacgaggatagatttcaattctgagtgtaagacccagtcgcggggtctataaaattctgtgaatgattcacagtaaaatgttgataaccctggggcagcattgagatggaattgtagccccgcccaatgaatgaccatttcgtgcatttgaatagatttggtgcaataaattgaattttgatgaaaaataaattttcgactttttgttcgaatttgagttcggggttcggaattgggcgaaatggatgccggattcgtgatcagagaccccggaaaccccagaaaaaatgttttacgtgacttttaaaaatttgaaatttttgccaaaaaaggggggggaacaaaccccagtattaccaaaaatagtaaaattttaaaaagcattttttctggggtagaaaaatacgctgatcacgaatctgaactcagattttgaaaaatcattgattttgtctatggctttttatcaggtacttgattttttccaaaaaatttaagaaaattaattagcgtaaaaaactcataccagatgttgtagagcttaaaaagagctttcgaatgagctattgaatctttacagatgttaagtatttaaatcccaacttatgattaattaactaaaaataagtcttataggtaagttcgaaaatttctttatcggtacgctctcgactagtgattaacattttacggctatcttagcttcctaattgtttatgaaatg

SEQ ID NO: 118716 - DNA, 1003 bp, Heterodera glycines
  Promoter: Source sequence=SeqID_40842; Location=251..1253; Strand=-; Gene=SeqID_69089
tcggggcagtccccccgaaccgatgcgcccagatttatggggagaccgaattcttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagcctgtactttaattctgcgttggatttttgctccccataattgtttgagtaccccaaacggacacttgaaaaaatcgatttttttgttttcggggcagtccccccgaaccgatgcgcccagatttatggggagaccgaatccttccggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaattcttcgggaatagcttccctatagtctgtactttaattctgcgttggatttttgctccccataattgtttgagtaccccaaacggacacttgaaaaaatcgatttttttgttttcggggcagtccccccgaaccgatgcgcccagatttatggggagaccgaatccttcgggaatagcttccctatagcctgtactttaattctgcgttggatttttgctccccataaatgtttgagtaccccaaacggacacttgaaaaaatcgatttttttgtttcataaatatttttttcagaaagtgctctaaagcgcaccaaattttatttacaacttaattttagcactctgatgctttagtatcaaaaaggaagatggagaaaaaaatttttaaaaaaattttccttatattttggttatatcgttttgcttttggtggggtgcttggaacagtggaatcatg

SEQ ID NO: 118717 - DNA, 563 bp, Heterodera glycines
  Promoter: Source sequence=SeqID_19649; Location=1396..1958; Strand=-; Gene=SeqID_84384
attttaaacattttcatattattgtttttttattgatattttatatattttatgaagatttctttgcttgaagcacttttataataaatttaatatcattatatagttaaaattaaattttcgactagttggcgaaattagttggcgaaacgtcagattttggctgagttggcgaaacgtcatgttggcgagatgtcagttggcgagatgtaaacttggtgagatgtcagttggcaaaatgtctgattttggctgagttggcgaaatgaatgtttttggctgagttggcgaaatgtcagttggcgaaatgtcatgtagcccaccaaattagctacaagatgaaaaggtcccatgtctctacgatttctccccattgagaaaagagaggtcaaaaatcaagtatcccgaaataattttgttggcgcgctgtcaaaatcccgctgcgtcgaaatcgcgccaaagccaaaatgagtcgaaatcccgccaaataaaaattagcgaaaaagtcttaaaattacattcctaaggcttcaaaatatgaaattcattaattgggaataatg

SEQ ID NO: 118718 - DNA, 149 bp, Heterodera glycines
  Promoter: Source sequence=SeqID_2628; Location=647..795; Strand=+; Gene=SeqID_80790
ggtaatatattcaaaaatacaattaatttcccatttaaaataaataacaataattttaaattcattttattgctaattttaattttattcaaacataaaaatgattatttgttaatgatagttaatatgattcatttgttagggtgatg

SEQ ID NO: 118719 - DNA, 1003 bp, Heterodera glycines
  Promoter: Source sequence=SeqID_10096; Location=2771..3773; Strand=+; Gene=SeqID_73166
tgtgaagagctttcgaatgatatcaaaaattgttggattcggtcaacaatttaaaaagttacgctgctcaaaacttggctgggacggagttggcccgttccgccccaatcttgggtgtcaagccccccccccgcccccttattttttttttgtatgccctgcgtttccggtaagtccctatcctaattttcaaaaaaaattaacattttccattaaatcactagggatgctaatcttatgtaacaaaatttgcgaattatgtaaataaaatatgtataaaaaatgctaaaatatgtatgaaatatgtacaaaaacccccaaatatgtactaaaatatgtaaataaaatttttttaatggttattttttggaaaaaaattcttcgtaaaaagtgaaataggcacaaaatgccataaaaatgaccaaaataggcttagaatcacatttgaacattttacagattaatttttgatatatcattttttgaaaaaaatcgatttttttggatacattttcaaaaaaaaattttaaattttttacaaaaaatttctataaattctcaaaaatcctcaaaatatgtaaaaaaatgaaaaatatgtacgaaaaattgcgaaatatgtacgaaaaagtccaaaatatgtataaaaatatgtacatatgtaatatgtagaaaaatccgaaaatatgtaaataaaagtcccaacttttgttcgcaaacacaaaaaagaaagtgattttcctactaattaggttatggagaatctaggaaaaaatatgtatttacataaaattagcatccctataaatcaccaattatgataataaaatttattaaatgcattcccactgactcagcaccatccatcccatttttctccactcggttttagaattggcggaatcactttattaaccaaaaataaaataaaagtgaacaaaataaaacgaaaaagcattctttttaaatatttgtattttcaaaaacttcaaaaacttccaaaatg

SEQ ID NO: 118720 - DNA, 224 bp, Heterodera glycines
  Promoter: Source sequence=SeqID_2354; Location=4560..4783; Strand=+; Gene=SeqID_79288
ttgtcaaccaaatctaattttcttgatatcattcgaaagcccttcacatgctctattagcctgcaaaatttcgaaaaatttcgttaaggttcaaaaaagttatggccaaaaaagctgaaaaacccggtttctgatgtacttttggtcataagtttgttgaaaattaacgaaattttttgaaattttgtaggctaatagaggatacttagggctattgaatgatg

SEQ ID NO: 118721 - DNA, 211 bp, Heterodera glycines
  Promoter: Source sequence=SeqID_36426; Location=314..524; Strand=-; Gene=SeqID_65731
tttatgaaaatttaaggtttataaattaacgtacttactgaattagtacccccccccccctcttttagaaccccctttcgaggggggttgaaaatagaaccccgggagtaataattcagtaaatacggcatttagatatcttttttaataatttttgaatcaatttttgaaaatatttgatcacaataggacagacaaacagtaattaatg

SEQ ID NO: 118722 - DNA, 93 bp, Heterodera glycines
  Promoter: Source sequence=SeqID_952; Location=298..390; Strand=+; Gene=SeqID_64824
tacctagaaaataagtatttcgaaaatcgataaattctaagatcgtaattaaaaataaatgatttttagaatcgagaaacaagaaacaaaatg

SEQ ID NO: 118723 - DNA, 400 bp, Heterodera glycines
  Promoter: Source sequence=SeqID_29041; Location=1..400; Strand=+; Gene=SeqID_59608
actttttgtttatatttaattagttttttcattttttaggtgtatatttaataattaataaaaaaattagccaaataattgcattaattaattaatttttttggtgttaaaatttagacgacattaaaggcacatgagcgagtgcatgacataacgcaggtattttaaacttaattttatattttaatttaagcgtattatttatttttccgtaaatttaggcgtaatttaaatttatttattttttttgtaaatttaagccctatttatgcaataaatgcggcgaatcatttcattacatgtgcgagcttgaataccatgcaaaaacccatctgcgtaagcaattttaatatttttaaataatatttaataaaaatttagaacaaaaaggctacaaatg

SEQ ID NO: 118724 - DNA, 260 bp, Heterodera glycines
  Promoter: Source sequence=SeqID_33454; Location=439..698; Strand=-; Gene=SeqID_63518
ttttgaattaattctaaaaaaaggctgcaatgatttttacttttatttaattgttaaaaatgaatattccgctgattctgtgcctttttatcgataattttaaaaaatagacgcaaaatgatgacctaaaagtgtgttaaattggcaaaaatttgaatttattcccatatttattctctcttttatttgcctccagacaaaaattgattaattagggcaaaagatggatggataatctttggttaactcaattaaaaatg

SEQ ID NO: 118725 - DNA, 783 bp, Heterodera glycines
  Promoter: Source sequence=SeqID_621; Location=10828..11610; Strand=+; Gene=SeqID_57660
agaaggaaacccctggctggggggaacttctgtcatggacagaaattttgttgaatccatatataatcttgatcgtataaatttcgcttttccttaaaagatttggattgggaattttgccctagtcggacttttttaaaatatggggatcatcttcccacctaatccctgcgtttttcccatttttaaatatcttcgtggtcagtacgtagcgtaagccggtccttggtcatcaacaatttgccgaacgcccaactcaacggcccgcccatggatcagcttgtccgacggatggccgtataaaagaaagacgaaggaatgatgctcaccttcttccactacccttttccaaagtccaatttcttcccccaaaatttgcttttgctatccaattttcaaagatcgtattcaagtgatcatttttcatttcacatttcattttcttggtgtgtaataaaggttttgcgttgtaaaaccttgcgttcaaaagcaattgtgtgccatcccggccactcgaactccctgacattctcagggacggtcttaagccaatccggcaaattataataaaataaataaaaccaaaacaaaaactttttccaatcacttcattttcacataaaacattcatttcctaaaacgaatcaaaagttttggattcagccgcctcggttgacgtctgttctttaaaccgggtcagacgaagtcgaaacaaccgcagtcagcggccacaatgagcaggcgctggccattgacaagcaaaaagcggagcaactcaaaatg

SEQ ID NO: 118726 - DNA, 862 bp, Heterodera glycines
  Promoter: Source sequence=SeqID_8056; Location=717..1578; Strand=+; Gene=SeqID_66844
ttagcgctgagaatttgattatttttcttaaaaaatgacaaaaaaataacatttaattaaactaatatttctttttaaaataattatattttagttaaatgccttatttcatttaaatttaattatcaataaattaatttatctacactaattatttttgcataaaatcgtctgaactttttaagttaatttttgtaaaattctgttcctgtttcctttttgtagcaatttcctgtttaaaaaaaaataatttttataaaaagagtaattaaatctccgcatttttcacattttttgcacttttgcgtaattaacggaagcaaaaaatatttgtaaattttaccgtatccttccgtctccgcttccggcatttgcttaattaggcaattaattattcatgttatacccattttttgtgtcaatgaagcgaaccccatttaaacgaagaaaaatatttacaatgttcacaatacaatcagttttaaggttcataaatgaataacaaattgttaaactttttgaataatctttttacagtttttggaaattaattaatttttgaaaataataaagaaatattttaaatatttaatagaataaataatttttaaacattaaattaaatcagctcttttattaatttacgatgaaaattttggtgatagatttcaatttaataaaaaaaataaccaatgcctaaaatacgggtccctaatggattacaacataaataaattaccattaattaaaaggaattttctattaaataaattttgattatttcatttgacctttacaagtggaaataaatattatcaaatttattttttataacaattttttagaaaaaaataaataaatg

SEQ ID NO: 118727 - DNA, 292 bp, Heterodera glycines
  Promoter: Source sequence=SeqID_173; Location=665..956; Strand=+; Gene=SeqID_76277
ttgctgttgttgtcgctgttgtcgggctggctttgtgggtgcttgatgtgtgatcgttgagagcgttgcttgaagtgttgctgctgctgagtgaggagaatgtgcaaaatccacctccttatatacaaaattcgggtgcaaaaattcatgcagcaaaaaaagtgtataaaaggcgacggttttcttcacttttcaccagtgccagccagccttcaactcaacgcaacatcaacaccagtgcgcgccaagctcgtctacacatttcgtcgcgacaactcatcacttcatcatg

SEQ ID NO: 118728 - DNA, 106 bp, Heterodera glycines
  Promoter: Source sequence=SeqID_20498; Location=1777..1882; Strand=-; Gene=SeqID_51038
aaaaagattggcatttacacccaaggaagagatgtccaatggcgtctcgcaatgcacggctattgggcactgatcagttttcacaaaattggcattgtgtcaaatg

SEQ ID NO: 118729 - DNA, 76 bp, Heterodera glycines
  Promoter: Source sequence=SeqID_30585; Location=1..76; Strand=+; Gene= SeqID_60992
agcaatcaacaaagaacaaagaggacaaagagctggaacgacatgcgcatacggcagaaaaaagacaatcgacatg

SEQ ID NO: 118730 - DNA, 1003 bp, Heterodera glycines
  Promoter: Source sequence=SeqID_22961; Location=33..1035; Strand=+; Gene=SeqID_53659
attatttatcaagaaaaaaaatgaattttgcgttcaattcataaaagtatattctctgaatctccctttataaaagtttggggtgcggccgcatatagtaattcaatttaaaaattttcttgaaatttgttatgaaaatttcgtaaattgaagaaaacaaagcctttatagttttttcactccgtctcccctcccttcaaagtttttatcggttctcaaaatggtaaattactcaatttttaggtcgggttttcatcattttttaatatttttatttgaaattttcaggtttattaaaaaattttatttattttttttttgcatttaccagtagaagaacgcgccgacgagaagaaaagcagcgattggtcagcaaatcgcagtacaaaaggacagcaggtaaacgccgtgctcaattgttcggggggggggggggaaattaatttaagaatatttattccatttaagaaaattttgacagttccgtttttgtcaagttcttgtctcattgtcagtggttatgaacggaaaatattttggaggagattcggctcctttccacgccaacttttaattttttttaagaaaaataattctatttcattaaaaaataaataaattttgaaagatgctttacagaaccctcccaatccctcttctaaaaattgaactttttacacccaatttccgaccgaggaacacgtgggtgttttgattaaattaaatattgattgcttggttgtcaattaataatggttctaattctttattttatattttcacaaattaaacaaacaaaattacgcgcgcacccaaaaaaataatttagtatagaaatgtgtccagcagaatgtcacgaccagaaggcatgctgataaccagaaaaaactcggaggtgaaatcaagaaactcctttttttgctcttacaattaggcgccaaattattttttttaattttagtttttcaaaaaaattctggaacggacttttgtccgtgccatg

SEQ ID NO: 118731 - DNA, 754 bp, Heterodera glycines
  Promoter: Source sequence=SeqID_3599; Location=5144..5897; Strand=-; Gene=SeqID_51040
gcacataaaattcactattttccaatatcttttctctgcataaatcacactttttcttcctcaattgtccaacactgatgaggcgacaaattggtcaaaaattgacgaggaaggtgagaattttgagaaaatattcggatttttaatgggagggttagtaaatttttttcgtactgggaatgacaatttaattattttaaaacgatgacttttcgcgtttattttgtgtttaaatttcatattcgttttgaggttttttgttcgttgggagttgcttttggatattctccgtttttgttttttctccgtgttttaaaaataaattgttcttcaaatcgccttaatttgttctgatcaacaaagtgtttgtcatcagacgactttttgactacgaggtgcggccaatttgtaaggcaacaattctcttcgtcttctctccgcttctcttcaactccgttaaatcttgactaagcattcaatcttgtccccgtaattgtgtttctgagttttaattacctgaccaccccatttccttccccaaccgtccaaaatacagtcagtcctaccccatttcctatttccgcaatcccggagaggtaagacttggcgctcctgggttacgacgtaaacccatccttttggacagcgtttttaaggcgctgacgcggacaaaagcatttgactgggtgttaattttggaaagtcttgactcaaatttttcaggtttttgttccattttgcagtaaaatgaatg

SEQ ID NO: 118732 - DNA, 64 bp, Heterodera glycines
  Promoter: Source sequence=SeqID_23566; Location=487..550; Strand=+; Gene=SeqID_54256
ggcaaggacaaaaaattggcatttttcaaaaattttcaaaattttgttaggcctcgtttcaatg

SEQ ID NO: 118733 - DNA, 629 bp, Heterodera glycines
  Promoter: Source sequence=SeqID_3250; Location=803..1431; Strand=-; Gene=SeqID_83909
tttttaatctaatgctttattaaaatgataaatcgacaataggaagggcatatttatatgagccgagctcgtaacaaatacaaaatggggaaggaaaagtgatgaaattgagtgaaatttaacacttaaataaacccatcttggcctgatgagccgcgcactgccacccatgaagcacaagacgacagggcacctaaacaactctgggaattagacaagtcaaaaaagcattacctcaagatctaaaaaacaaattaacaaaattgctgccaggataaacggtactctgtaggtcgagctaccgccctggttaacagcaaaattggaaatggaaaatttttattaagaatataattaagggcaaggaacaaatgaaaaattctctgtacagtctcgcttttaaagttgctgtctccgcccattaatcgataacttttcggcgaatcaatgcgcatttccctctgggaaatgccacatggtaacagatgtttgcaaacaatcgataattttcaaagccaattcaaattttcactgattcccgagggaacggtatcgccttctggtatcatgcatcctaaagccaacctatgcatgcatttattcattcatttctttttttcactacaatg

SEQ ID NO: 118734 - DNA, 168 bp, Heterodera glycines
  Promoter: Source sequence=SeqID_13509; Location=1..168; Strand=+; Gene=SeqID_77404
ccccccccccccccccattatttttttgcttcaaatttttcatgaaattttgaatttttccaccccctacctatccctccatttttttttttgcagttcaatttccacaaaaagtgctggggccaagtgccgacgttgtgcgaaccggagcggatcaccagcgaaatg

SEQ ID NO: 118735 - DNA, 875 bp, Heterodera glycines
  Promoter: Source sequence=SeqID_5846; Location=1642..2516; Strand=-; Gene=SeqID_46138
cattattttaattaaaattttaattttaaagaatattccaacttttttctttcatgttaagcatcctaaaaacccaaaacttaatcaattggtcattttttttacaaattctgttaacaaatcgcattaaaaattacaaaatttttcccggcggcgcctatcggcaccgccggccctccttgttccccaaaagtcttgagaaaaacgtgccgcgaaaaaagcggtgttgaaagcaaaaaaggtcattgatttacattaatttacatggccggagacccttcgcaaaattagaaaattggctgctgaccccttgttttgcaataatctgaattttgaggtctatatctgaattttagtgttctatgtcctgaatttgaaaaaaaaaacttggtcaacctgaatatacatatacttctgaacaattctaatgctaaaaaacaggtactcgcgcgaaaactgaataaaaattttgtatttggaaaattttgtccaaaaatttttacgttggaaaattaccggtttttaccggtaccggtaccggtaccggtggaaaaagttggtaccggtaccggtaccggtttttgcagtaccggtcagtaccggtaccggtttttttgcaattaccgattaccgagcaactctactcaaaacttgattaatttttgcctttatagtttttaaatttacaaattttggcgttatttattttaattacgaaattatattaatgaaaaatttagttaagccacaaccacagctcttgcctttaacataaaagcttcactaacacattattttatttatctttggttaatttcttgtcaatcaatcattaaaatttctatttttagactgattttttgaaaaaaaaaatg

SEQ ID NO: 118736 - DNA, 399 bp, Heterodera glycines
  Promoter: Source sequence=SeqID_30763; Location=795..1193; Strand=+; Gene=SeqID_61160
gtgcaagcaacacagtacggcatctaacgaacgtaaatacattcgaatttaaatcatttcaataaaaaatttaataaaaaaaatttcattttttcaaatttatttttattattatatttaggaccctcttaacaatttgtcgctagcggcagccgacctgccgcaggaagtaaaaataattaaattataaatcaaaaacaataaaaaaaatttttacagtatcaatataactttatgttttttgactaatttgtaaggtcctttaaatctttattaattaaaaaaaaagaaaattcggtaagtgaaaacgaagcgaaaatgtaatttgaaatatgatgccaaaaaatcaaatcatttttatgtttagcattgaaatttcaggaaaagcttgtccaaatg

SEQ ID NO: 118737 - DNA, 238 bp, Heterodera glycines
  misc_feature (82)..(82): n is a, c, g, or t
  Promoter: Source sequence=SeqID_17499; Location=2575..2812; Strand=-; Gene=SeqID_47450
actgtccctctctctgcctctgcgctgtttctccctgtttcatatctctaggctccgccatatttacgtggtactaacaganaatcactcgccaatttgtcagtagctgtttatattgttcgtttatcacttacgattaataaattactgtatttctggcgtttgtaaacaataaatacctaacaaacaagtctttgtgttcagcttgttactgaagtataatccaacattggaaatg

SEQ ID NO: 118738 - DNA, 643 bp, Heterodera glycines
  Promoter: Source sequence=SeqID_16207; Location=1..643; Strand=+; Gene=SeqID_80574
tcatcattttttcacttttcgcgcaacgacctagcaccacagagagccaagggcaaatttttggactcatttttggcataaatttctaattttttagataaaatatacaaaaaaattgcaaaatatgaaaagtgagggaagcaaacaaaaataataataatactaataataataatcatttgaacgctacctaacatcatgtaaatattagcgtcaacatttaaattttcccttttttatgaattactgaattaattgctttagtaaagtttataatttttagactaatatcaataaacatattttttaataattttcatcatttcctttcatttaactcattttagcaaaattttcaacaaaaaacaaacaaataataagcatatacatttacgtgtaaatattaacaaatcgattagctaagctagagaattgctttttaacattcaatgttcattttataataaaatattacatttatttttatacaatattataataatttaaaaaaagtaaatttgaaacatattaaatttgtgggataatttcttttttttgatgattattaatttcccatcaattgatctacctattcctaatagtttaatgattattaaaaatattttttcattagtctcagatg

SEQ ID NO: 118739 - DNA, 176 bp, Heterodera glycines
  Promoter: Source sequence=SeqID_21691; Location=1399..1574; Strand=-; Gene=SeqID_52303
agcttggaatctagagcccgatcactgattacagaatgggttccccagaccaagcaaagacaggtcaaaaccgcccgaggttgatgaaagtaattttcgggtgctccaaacatcagaaacaaaccttggcacagtggaacaaagtgcgcgcgcaaatcagtcaaaaattggggatg

SEQ ID NO: 118740 - DNA, 875 bp, Heterodera glycines
  misc_feature (30)..(31): n is a, c, g, or t
  Promoter: Source sequence=SeqID_4102; Location=5174..6048; Strand=-; Gene=SeqID_53194
tttatggcatgagacatttaaagaaagggnncgattttggaaaaatgcaaactttgtttttgtgtggatgaacaactcttattttgtgatcctaacaaataagctattaagaggtctaattttgatctattctaaattcgatactgaccattttcaagatgcaaccgaattcacgattcttacatacctatttaaatttgtaaagaaatgtaaaaaaatgtcccattaaagataaatttaaattaatattaatagaaaatttttacgccaaattaagcacaaaaataagcaccaaactagcgcaggagcgctcgattcgctcgcgccctcgcgctagataaatcaaaaaatttcttacgtttctttctcttcctctccaatatactctatttcttcttctctctagcactctctctatttcccccgctttctctctcccttttctttcaaactctctctcattctccctctctttgtctgtatctctttctctctctctgttactccctctctctttgtctcactttctttctctctctttcactttctctctctctccctttctttctctttctctctctccctttctttctctttctctctctctctttctcctctttctctctttctctttctctctcactcctcttgctctctctctctttctctctctctctctctctctcttctctacactctctcctttccctccccctctatgtattgtcattttttttttgaattttccccttttcaaagttctcccagtctttccaatccgagtgatcgacaaagcatcgactccgccctctccgttttctcattcgcaaattccgctgcttcgatcgaccgaacgcgcgcactttcattccatg

SEQ ID NO: 118741 - DNA, 473 bp, Heterodera glycines
  Promoter: Source sequence=SeqID_24001; Location=649..1121; Strand=-; Gene=SeqID_54705
cctggaatgttcaatgatttataacttttttatacttaagataaaaattttgtaatattatattctaaagaatacacccatagctattaaaagataccatgaaatattaatttggctcaacttgggccaagttatgaatttttatttgttacatattttttgtttagaacccattggcggatttacgaaacacgctggcggttttacgaaacgcgctggcggatttacgaaacgcgcatgggtggcggtttttaggaaatgcaccagcaccgtatttttcatgtgaaaatccggatttccaatgataaattacaattgtctaatactagagttgagcgggaccgggaccggggcgggaaatcccgggtttttcaggtcccggtcccgatcccggtttttggaaaaacagaaatcccggtcccggttttgccagtcccggtcccggcgggactaaataagcactggtaagaatg

SEQ ID NO: 118742 - DNA, 76 bp, Heterodera glycines
  Promoter: Source sequence=SeqID_7425; Location=1121..1196; Strand=-; Gene=SeqID_64778
tgcgcctgcctatgagacgggttcgctgcgacggttcgccgacggacggacggacaccgtccgactgccaaccatg

SEQ ID NO: 118743 - DNA, 319 bp, Heterodera glycines
  Promoter: Source sequence=SeqID_4767; Location=1037..1355; Strand=+; Gene=SeqID_55646
aatatttcttcgttttttatgccattttaaaattttcaatttttatgccataattaacggtgccatccctccatttactttttgacaattagccaatctattaatttattcttcgcccatcagttacaagctgtacactttgcatcgcaccgttggcaattgggtggaggccgggctgacgctgaaacggcacgccgatttgttgcgctggagcacttcacatcggcccgagtcgttcctttgcgggacggcacggaaaagcggtgggaccgagtttggcacggagttggagttgaaggagtacatttacaaggagatg

SEQ ID NO: 118744 - DNA, 310 bp, Heterodera glycines
  Promoter: Source sequence=SeqID_12701; Location=1312..1621; Strand=-; Gene=SeqID_76382
ttccgaccggcggcacaggtcaaacagactgggagagaaagcaacgattttacggtcaaaaatgaatattacaaggaaaaaacatttaaaaatgaaattaaactgtcttcgagacagaggatggaagcacagccaggggaaaatggccggacaccgaaggtttctcgaacaaacaattttcctccattaagcatacacttttccaccataattaagtgaaaagtggcaagaatagggagggaaaagaaaatggaggaataaaccagcaaataatttaaataaatcttcgttattaaacgtgccaaaaatg

SEQ ID NO: 118745 - DNA, 703 bp, Heterodera glycines
  Promoter: Source sequence=SeqID_1204; Location=1535..2237; Strand=+; Gene=SeqID_69862
atgcggtcgaggaattctctgttagggacttggatattcaaagtcgaggaataaattgaagtttcattgtagaaaaacgaagaattaagtgaaatgttactttccattcgctaaaaaaaattatgagaaaaatagtcagtaaatttttcttcggtttgcgctagttaaagcgtgacttcttcccattagtctgattcttttaagaaagtcggcaaattaactgaagaaaatgttgtcacgccaaccacctcaataaacgcaaaataattaggtatgtaagaataataaaataataatgtactgtggtgagaaattattacattattaaattattctcataaaaataattaacgttgtgcttccacaattcagttgaacaaacgaatgaaaagaatgggaataataggaattagaagagagaattggtggaacagaagcagaacccctgaggggtttgaattgaaaagggaaaagaatgaaagagaaaagaaatgcgaaaggaatgaaagggaaggaagagagcccattactgacacttccattccactttaaacatttgcttaattctttcacccgtcaaaactaacaaatcaaacaaaaagcattaaaattaaaacacaacacaaattcatattaaattaacctagtaactacctaaataaatcttgtgtttatcaaacaaaattgtatttcttacagaatg

SEQ ID NO: 118746 - DNA, 323 bp, Heterodera glycines
  Promoter: Source sequence=SeqID_11078; Location=1..323; Strand=+; Gene=SeqID_74411
attggccaacttggcgagactcgcaacaacgacttgaacatttctggcgacgatggcaccgggaatacctcatgaccttgcgagagagggccggctggcatcatcctcaacgacgagtgaatgcacccggggcaccggaagtcggggacgtcgtgcttgtggaagacaaattccaccctcgcaacttatgggccatggggcgaatcgaggagctcagaggttcagacggtcacacccgcagcgtgctgatcagaatggcaaatggaaggatttgggggagacccgtaagcaaaatttgccccctggagagaagtccagaaatg

SEQ ID NO: 118747 - DNA, 75 bp, Heterodera glycines
  misc_feature (43)..(43): n is a, c, g, or t
  misc_feature (70)..(70): n is a, c, g, or t
  Promoter: Source sequence=SeqID_8897; Location=1..75; Strand=+; Gene =SeqID_69566
attttggtttgtatcgatgtgcttagtagaaagatttttacgncagagtctgagtcgaagaaaagcgacnacatg

SEQ ID NO: 118748 - DNA, 109 bp, Heterodera glycines
  Promoter: Source sequence=SeqID_27208; Location=1..109; Strand=+; Gene=SeqID_57895
ttttacagctccaaccgatgtgttatcaaaggacgaagttaacgccatttatcagttccattcccttccaaattgtcgtgagatttacaatgacggacttttcccaatg

SEQ ID NO: 118749 - DNA, 159 bp, Heterodera glycines
  misc_feature (53)..(53): n is a, c, g, or t
  misc_feature (63)..(63): n is a, c, g, or t
  misc_feature (98)..(98): n is a, c, g, or t
  Promoter: Source sequence=SeqID_5315; Location=3633..3791; Strand=-; Gene=SeqID_57650
ttccaaaagtgtttggtttgttttgaatggcataaatatggtacaaaaagccnaaggcattgnatttgaatcataaaatgccattggctaaataacantgaaatggaataaagtgcaataaaaacatgaatgaatcatcatttttcagtctttttgatg

SEQ ID NO: 118750 - DNA, 107 bp, Heterodera glycines
  Promoter: Source sequence=SeqID_13023; Location=1947..2053; Strand=-; Gene=SeqID_76800
ccttaaacatttaaaattttttttttaatttttcaaatttttttttaccacaatcaccgccttggtaatttcatcattctcctctaggccccacagttcggtgaatg

SEQ ID NO: 118751 - DNA, 406 bp, Heterodera glycines
  Promoter: Source sequence=SeqID_38532; Location=599..1004; Strand=-; Gene=SeqID_67317
ttcagaaaaaatgccttgtggtgaaaacaatatttcacatttcactccataactttgtgagttcggcacggatcgagaccgggataagaccattggaaagagcagctcgagctctacaagaaggtatggaaagaaaaaatagttatttctgggactttttcagaaatcagaattaattctccaatgtggcccaaattttaggcccccagccacagccctttgcttctcccagttttaagtcttggatttgtcaaataaattcaagacttcaaattaataatcaaaaattctcttaaaatttttttgaacccaattcaaaaaaggaaaaaaatttgcagtcaaaaaattattcgaatttctccaattttgtttccataatttccgaaagttattcggtatcataatg

SEQ ID NO: 118752 - DNA, 175 bp, Heterodera glycines
  Promoter: Source sequence=SeqID_13820; Location=1..175; Strand=+; Gene=SeqID_77755
catccttttgttgtgcaccttaaattatgcagcaattttcggccttattttatggcgtcatcaaacaaacaaaggatcaactcagactcaacaatcaggccgcaaaatgtcctaattattcatttaaaattcaaattttaatttccacattttagcggcttctgatcgttcaatg

SEQ ID NO: 118753 - DNA, 290 bp, Heterodera glycines
  Promoter: Source sequence=SeqID_21887; Location=825..1114; Strand=-; Gene=SeqID_52527
ggtaattatataatacacaattaaattcaattaaaaattatttcatttaaacagaaaaattaaattaattcaataatatttagaatttcattttggcaatcaggatggcgcattaatttcagacaaaattcgtaggcgtagtgaccccgagagaggaatgttcgtttttaaacaaatttggcactcaaaattttttttgtttaattagaaaattaattgaaattgggactaccaagaaaagcatatgggaagttcaaaaaatttttgatcaattgagtgatttttacatg

SEQ ID NO: 118754 - DNA, 1003 bp, Heterodera glycines
  misc_feature (795)..(795): n is a, c, g, or t
  misc_feature (848)..(848): n is a, c, g, or t
  Promoter: Source sequence=SeqID_10121; Location=2022..3024; Strand=-; Gene=SeqID_73212
ccgtcgtccatttggtctaatccgtttcttttttcttcatttgggatcattgccttctttaattatgccatttttcccctcaggcgaaacgtttttacgcgtgggacgaaatgtcggcgaaacgttcgctgatccctccggagccaaacagtgcgacgaagaaattggagcaaatggaaacggagcaaagcgcggcggaggaaatgggcgaaatgccgaagttggaaacattttccgtttatatttgttaatttctgtttcctcttcatgggtggaagcgttctctgcagcagcgtcccttccctttggcacggctttttccgcgccgtcttcaagccaattgaacggattaatagtcaaatgaataaaaaaagaaaatgatgaaaacggcaaatgtaacccaaaaaggcacaaatgtttccaatttacttttattttttaatcccccattatctctttcatcgtaaaagaatttaagcttttcatcaaagtttgaaaagaattggtggacagagaaagatgaaaagcatttggcactgagaaattgagaagatatccggcacatttggggaaagaccatttcatttggcaatcacttaatgagaagaaaggggctaaatgaatgatgggaaagggggagaagagcattctgagaggggagaagaagagaaaagaagagggatcggatgaacggacagagggaaaagggaaagggaaataaggagggatacgatagtgccaagggggggagcaaagggaaggcaaacacggcaacgatgccaaggagtgccaagnggcagaggggaggggcggggggagcagaagtggcgggggtcattcactcccanattgagcaacgaatctttcccccccccccggcctatcgcacacaaaaattcccaacgtttgcgacgaaatgaatttcaatggcacaatttcgcatactttttcgctagaacttctctttaaaatgtgccaatgcgcaacgaaagcaaaagaaatg

SEQ ID NO: 118755 - DNA, 518 bp, Heterodera glycines
  Promoter: Source sequence=SeqID_17651; Location=1..518; Strand=+; Gene=SeqID_82179
cagatagattttgcactaaaaatcgtcttttaaaatgaacacaaacaatgtggccgtcgcggtttgtgctcttttttgtgccgttgttaaaggcggtgtcatgcggtcggaaacagcaccactgctaattgccgagggtagaaaaaagcaaatttaatttaatttaatttctgccaaaaacaaccggttttccgaatatctaattaaattaaagttgatggtaatggaaaacgaatttagaaaccaaaaatgttgccatggtggaggcggtgttgccgaaacatcgcgaaacggtaatgaggattcaaatgggcggttaaatgggaggtaaaaaattaaaaatttcataaatggtctgagaatgtgacagcaaaacagcattcaatcgacaccaccggcccaaaattaccttaagattttcaaaatatgacctaaaaatggcaattttcggtgaaaatttgttataaatggtcaaaaattccaataaaatttattttttttagagtgtgcgtaatatg

SEQ ID NO: 118756 - DNA, 505 bp, Heterodera glycines
  Promoter: Source sequence=SeqID_6737; Location=3291..3795; Strand=-; Gene=SeqID_62694
aaaagtattctattttaaataaaaagcttattagtcattttgtagaacgttactttacctcaaaaacggcagaaaattcgtttcgtccgttatttgcacagttgcgacaaatttcagaaaaggttttttttcaaaaattaatgggtaatgatcgaaaaaagttcaggatacattaaaccaactcgccagtaatatcggaggtaaaaataaacaaagcgaaaaatgcaaagcactcctcccccattattatagtttttctttttttgtgaaaatctgttaacaaagcacacccaaaactccaaaattttccccggcggcgcataacggcaccgccggaccccctgttcccgaaaagttttttggaaaaagcgcgccgaaaaaaacggtttttgaaaagcaaaaaaaaaagaggtcatcggcggccgaccccccttcgcaaaaatttttaccgacccacccccctttttaatgtatggttttgtttattgtaaatattttagaaatg

SEQ ID NO: 118757 - DNA, 65 bp, Heterodera glycines
  Promoter: Source sequence=SeqID_443; Location=1..65; Strand=+; Gene =SeqID_52871
cgaaaagaacaaagaacaaaaatggaaaaaacaatgcgaaaaaagaggacggcgaaaaggaaatg

SEQ ID NO: 118758 - DNA, 340 bp, Heterodera glycines
  misc_feature (51)..(51): n is a, c, g, or t
  misc_feature (57)..(57): n is a, c, g, or t
  misc_feature (64)..(64): n is a, c, g, or t
  Promoter: Source sequence=SeqID_4239; Location=1..340; Strand=+; Gene= SeqID_53724
tccttattattgttgttaaatgttgatattatatcctctcagatagagagnaatatngatatgnaccagggatggctcttaatttcgcttatttccgaaaaaagtttaggcctcggaattccaaaaaaaaactggagcctcgaaatgccgccatctctgataggtgccttgcccttttgtgtttttttctgagaagctttattcctcaatttcatttacgtttccaaataaaatggttgttatattcatcgaatttttttcaaattgttcgtctacaattgaatttttatgaaaaatttgtccatttttaatttgttagagcaaaaaatcggcgaaaatg

SEQ ID NO: 118759 - DNA, 388 bp, Heterodera glycines
  Promoter: Source sequence=SeqID_10517; Location=2611..2998; Strand=-; Gene=SeqID_73744
agttatatatatatggtcaaattattgttaaaattgatgatcacggatcaaatgttacgctctgctctctctttttacgtgtataaactaaatgctcaaaaatgctgaaagtttaatccttagacggtttgtccattttattagaatttgagaaattattaaattaagcattttgattttccaaggagctgaaaaaaatcaaacattcgtagtcctagtgaatttttttgcattcttttcctattggaaatggtattcaaatatttgttattttcttcatacagaaaaattttcaaatctttccattttttgtaattaattttttatgacttaataactccgtgtttgttgttgttgtataaattaattagagcacttatgcagaatg

SEQ ID NO: 118760 - DNA, 1003 bp, Heterodera glycines
  Promoter: Source sequence=SeqID_14396; Location=155..1157; Strand=+; Gene=SeqID_78431
agcaatctgactccacttttctccatattattcgacccttttaaaaatcacccatttaagttaaggggaaccgaaattttttcaaattttttattttaaaatttatttattttttaatagcttttaataattttgaatttttcattcatgttgggttaacataaaaaaacgcagcacgcgcacatcaatcactaaactgctgcctcaacatggcacatctcaattattcgtggatatacaccaccaacccacgcccatggcactgctttatttcatccactactaagctataacccattcattctttcatgcaatttttgcatagattttcagtgatttaattagattttgttttataaaaaaaaattttttaaatattaataaaaattattgtacaatttttgtttgaaacttgagcaaattagacacgattgaattaaaaagacaaatgacatcaaaaaaactttctgctgatcactagggattaaaagaatgggtgcaacccaaaacgtcgccggaagactttttggaccataactttgtttattgtcaatcgcattaagcattcttggtgttgtccgaaagctcccatgtgtttatttttatttgcaaaatttcaaaaattttcgttaaatttcaaaaaagttatggccagaaggaactcaaaaacctattttttcgaacttttttttttttgctctgaatttttgtacatgaaaaattatttttgaaattttgcatgttgatagagtttttcaaatgctttcgaacaataccccgaatatttcatttgttaaatttttctcaaaatttcttcaaaaatccattttaaatgaatgggttgttctaatagaggttttttttttgaaaaaataaataaaattaaaaataaaatatgcattaaaaatatatagaaatatgaaataaatcaaccaatgcaaaatttttaattgtttttacaattttaataaattttataaattattactttagatttgatatg

SEQ ID NO: 118761 - DNA, 1003 bp, Heterodera glycines
  Promoter: Source sequence=SeqID_17294; Location=788..1790; Strand=-; Gene=SeqID_81770
ttctttctactaatagcacttgataagaagcgagaaaatacaaattgaattaattaattatttcctgtttgttgaaattgaattgaattaatcagtaatgatcagttggcaagtttaaatattcatttcttatctactctaattgcgtaacaaacaattaggttttgattgtgtattccaaacagtcgatcaaaatcaaaagaatgaaaatgtgatcaaacaaaaaaaaaattgctcctggcccttatcagcgagtgacgttacgccaaaaaaacgaaaattttgttttttcttgagttggtttggtttggttgaattgtatttgttcgtcaataaaacgtcaacgaaaaaacaaagcctcaaagaatgacaccgttgtgagaaatttcatgtgacgttgaaatttgaaacttcaatcaacttcttattttaaattaaaaaaaataaatcctctttcatttagggaattttttgtgtgtaaataaacactaattacctaattaatattttattaattaataatgcaacaattttcaatttgatcatcgactggctgtacatatatccttctatgtcagatcatccacgtgaagagaaacgaatttttgagaaaatgtgagataaatttgtataaaattctaattttaatgccataattcgttaaacaaaattcagttttatctgcaatgacattttgttggattcattgcccttttgtgggcacgcaaaaatcggtttggaatttgcggttgtctcctatagatttgatgtagtggtggacactcatcttaaacgaagaaaatggaagcttggaagtttgagaattgaacgttccagcacgaatgacggagcggaaattgtcaaatgtaacagtgacaagacagttaaacggttgccaattccattaaagccgcttcctcccaatttgatcggtttcaagcggattgccgtttagtgagttttctgatcagccaaatattgattgattccgatcattccaatg

SEQ ID NO: 118762 - DNA, 191 bp, Heterodera glycines
  Promoter: Source sequence=SeqID_12458; Location=1191..1381; Strand=+; Gene=SeqID_76090
aaaataatatatatgaataaattaattaagggctttttcgggccagtttgcaatataggtgtctgtgtggggatgaaaaattaaaaatgcacctggaaaaaggtacagggaaaaaaacgtaattaattttttaaaaactccaaggacaccaaaatgctctgtatatttcgtcaaaagtgcaaaatcaaatg

SEQ ID NO: 118763 - DNA, 124 bp, Heterodera glycines
  Promoter: Source sequence=SeqID_7689; Location=1358..1481; Strand=+; Gene=SeqID_65632
acggcgttataaccgccggccaatgctttccattttttccaaatatggtccattagtaattttgcgaaatgcttattagcaaaacatggattcacctatttttgattttcttctttcagatatg

SEQ ID NO: 118764 - DNA, 208 bp, Heterodera glycines
  Promoter: Source sequence=SeqID_2507; Location=1..208; Strand=+; Gene= SeqID_80123
tcagccatttcttttttttgctaccgggtcaaaaattctctcattgccagacggcacaacgtcatcccctgattttaagatttagctcatcaaggttttttaatgataaaaatttgtctgggttcgatctttaaaaaaaagttgtaaataccaaatttgctcaactttagggtttcaggttcctttttggcatttccagaaccggatg

SEQ ID NO: 118765 - DNA, 1003 bp, Heterodera glycines
  Promoter: Source sequence=SeqID_7058; Location=1186..2188; Strand=+; Gene=SeqID_63698
atataagaaagtataaaggaaaatatttttagaaaaaaatggtgatcattgaaattgtttttaaattaatttcacttataaaattaactcagggatgcgatctgtcctgatttgtaagatttgtcctgatttggagggtccaaatctgataaatcagggatgcgaaatgtcctgatttatcagatttgtcctgatttggaggtagcgatcaaattttgtcctgatttcttaaataaactcacatttttgaaattttatggcataatgtcactattttattaagaaaataaaagatttgtggcaaaatttggttattttttgacaaaaatctgttaacaaatcgcattaaaatcgcaaaaatttttccccgcggcgcctatcggcaccgccggaccctccgtccatcctccaaaattttttgaaaaacgcgccgcaaaaaaagtgttttaaagcaaaaaagtcgtcgcttgacttaatttaattgaaaaaattggccttttttggtgaaagtctattaacaaatcagaacgaaattacaaaaaaattttccggcggtgcctaatagcaccgcctgaccctctcccctcgcccattcctcagaagttttttggaaaaattacgccgctaaaaaattgcattaaaatttataatttcctccccaaaattgttacaatcgttaatgggaggtgaaaaaatataatatttaatacatttttgattgaataaattgtaaaaataactgttttgaagcaatgaagcaaaatgccctgattttcgaccccaaaatctgattttttgggctcgatgttctgattttgaaaaattttcgatcgcatccctggtataaatacaattgattttttcaattttcgcacatttttgacattttttttttgtttttagcacatatatgtatttcagcattttttaacacatatttcatgatttttagcactaaaaatccgagtttaagtgataatagacccgaaaatttatttaaatg

SEQ ID NO: 118766 - DNA, 315 bp, Heterodera glycines
  Promoter: Source sequence=SeqID_11352; Location=1..315; Strand=+; Gene=SeqID_74737
tgaatctcggaatgctcagggggaagttcaggtgggtctgatcccgacagaagcgagaagggcaaaactcttctgatcagtgatcaatcagaaagaaaggggagggcgagaaaatggcagggaaaaaagcacagttaggggagagggaacggaaaggacaaatctcacaaatcactaaccaaaatgagtggggggggggagggattgtcaaattgtggcacattccattcgacattttccgagcagtctaaagggaaagtcccgcgtttattgaccagtggggacatccatggataaacattttcgctcagaatg

SEQ ID NO: 118767 - DNA, 343 bp, Heterodera glycines
  Promoter: Source sequence=SeqID_9229; Location=1..343; Strand=+; Gene= SeqID_70688
agagggagagagagagcgagagagagcgagagagagagaaagagagagagagagcgagagagagagagagaaagaaggaaagagagagaattaaagataatcatgggaagagaaatgagactgggaaggagaataaaaggagaggcctaaggtattcatggagttttgggataaaatttgttgggcaaaaatggttcacataacaaaccggggtcaagctaagaataagcacccagaaagggtataaatagaacccgaagatgaaaattttcaaaagcagaattttagaatcaaaagcctcattaaaagattttattccaattacaaaaaatcaaaaacaatg

SEQ ID NO: 118768 - DNA, 895 bp, Heterodera glycines
  Promoter: Source sequence=SeqID_14690; Location=1123..2017; Strand=-; Gene=SeqID_78802
ttggctgtatattttgttccaattgacttggcaaatttgccgaatgggtaaaatagaacaaaaaattttgcatgaaatgtaatggacaaagcataaaaagggacaaagcattcattttgtttgtcagcggacaaatggccgaaagaattgcggcgagtgaatgtccatttttcgtaatatttctcattttgtgatactcaaaaaatcacatttttcctcttcctttaccaacatcattttttcatgtttgaatagctttttatattttattttacattcactaatcattggccaaattgcaagaaaaatgctcagactctttttcacatttggaaaaataattcaatttaattccttttacaaattattttaaacattttaatataaattatttatttccattttttttattgttaaagtcttcgcaaaagatgattcaacaatctcgcttttcacaataaaatgttaaaagtcaggcaatgatatttctgttgctttttggctgattttgtgagtttgccaagcaataaaattgggtcgttctatcccaaaaagagttaaagcaatggaaatattccatggttccatttctaaacttttccttaaattctttctttttaaaaatgctttccgctgctttttttatgcctttgtttttcattgccattggccaattcctccaaatttctgatgccattgactgtttttcttgcgcatcgccggcacttcacaaccaatgggaggtccaaaaaataaattcaattaattaaattaattaattcccgctaaggcaactggacttcccgaaattccgccgcccgaccgtttcgcgttccacgcgtgcgatgggacgggcactgactataaaccgtgtgccgatgtttgcatggaaatg

SEQ ID NO: 118769 - DNA, 685 bp, Heterodera glycines
  Promoter: Source sequence=SeqID_27351; Location=1..685; Strand=+; Gene=SeqID_58044
gtgcatatttgagcattttttccacaaacctctattaaaacggccgcctctattaaagcgccctttcggtttctaatgaccgaaaaattttcaaaaatattttttgagtattttctaataaaaaatttaaaaatttctgccaaaaataagtcagaaaatagaaaattctccctttttacccaattttcttcaaataaattaattttacttttattttgtatttttggttttaaaatgattattcatacgatatttagctatttcagagatttttatgcttaaatttaacaaatttgaagagatttgtaaaattttgccctcaatttggaaaaatttatctacatatttttcactttttatgtgtatattttgccatttttggtgcatatttcatgcgcatattttaagattttatatgcatataattcccaaccctagttattgatttcgaaaatggttcatgtgcaaaaattataatttaagtaaataataatttaaaaaattatatgataattttgtcaaaagatttatcactttcactttttcaatacaagacgtcccctgctagactgtgttcaaaaaatacaaaaaatttcatagaaaagattctcgaatcgcgtgggaaaatcctgctggagacttggggggattaatagagagattgggcgataattagagaaaaatg

SEQ ID NO: 118770 - DNA, 524 bp, Heterodera glycines
  Promoter: Source sequence=SeqID_17903; Location=1065..1588; Strand=-; Gene=SeqID_82452
ttttatataaaaaattaaattttttgtttaagctcatttatcattggcaataccagctaataactgtataaacaagacatgataaatggctttataaccagtaagtggaaagaatgaatggatggaataacccagcctcatccaagacaatagctattctcatcgattttactattaatgatggtcattcctagagctcgacattttgaaaaaagcctggacctggacctggattggttattctgaagtttgagttctgctcctgcgtaagcatttttttcgacgaaaattgcaaatgtttcattaaaaataattccctcatctttttcattccctcatctttttcattccctcatctttttcattccctcatctttttcattccctcatctttttcattccctcatctttttcattccctcatctttttcattccctcatctttttcatcattccctcatctttttcatcaaattgaccaatcgataaacccttttctctcctccaaaaaatcccaaaaaatg

SEQ ID NO: 118771 - DNA, 104 bp, Heterodera glycines
  Promoter: Source sequence=SeqID_9030; Location=4480..4583; Strand=-; Gene=SeqID_70050
aaaaatgcaaatttctccaaaaagaattgcttttcctcggtcacatcatttccgcagaaggaattcgccctgacccaaaacgatcagaggctatttgcaaaatg

SEQ ID NO: 118772 - DNA, 622 bp, Heterodera glycines
  Promoter: Source sequence=SeqID_10040; Location=1..622; Strand=+; Gene=SeqID_73099
ctacctcaaaattagaatatttctgataaatcagaacaattgaagccatgtaataaaatgaaaatttgtattaataatgcgcaaataccagggatacggtgcattcactaaatagacatcaattgtgcctccaaatgtccattttcgcgttttgaagtgcgtgtcgacaagcccatcaaattggagcgaaaggagtgccaaagtgaggccgacttcggcagggcaaagccacgggaaaatgtgcagccaaatgtcgtggcaaatattgctaaaaaagcagaactaaatttttcagttgaacattgatgccgttggcgcaaacatttttatttgtcatcaaaattaaataaatttggtaagaatgtaaagcgctaacttgactattgcctgcgaaatttacagtagttttaaattctttttattatataattgactgtacatatgaattttttatatttaatataatttgcataaataaaacttatagtttaagtaataatgaattaaattgtaatttttgtcaagagatatatcgctttcactttttctatacaaatatttattgtgcactcaaaaacactaacaaaggaaggtcctagggtgtccgtggaatttccgaatg

SEQ ID NO: 118773 - DNA, 72 bp, Heterodera glycines
  Promoter: Source sequence=SeqID_33049; Location=856..927; Strand=-; Gene=SeqID_63233
aatttcattttatgtttcagcgtgaattggttccgcaagatttgctaatttgccctcgccggtcccacaatg

SEQ ID NO: 118774 - DNA, 610 bp, Heterodera glycines
  Promoter: Source sequence=SeqID_16260; Location=2732..3341; Strand=-; Gene=SeqID_80644
aaatattaaaaagggattaaaattagggcttccatttttaggaaaatgcctaaaattctgcgcacttttgatacgcatagataagcacgaaaaacgcgttttcgcttggtttgggtgtctacgatgacttttataatgcctaactttgcctattttggaatttttatgcttaatgcctatttgcctatttttatgactatttcgccacttttggcgcctttttcagaattttcggaaaagtcaatgaaaaatacacccttaagaattgaaaaaagttttcacaaaaactgattcccaaaaattaattatattttcttggcaaacattttggtttaaaattgtctttatttgaaaaaacgttaaaataattgaaatataagcaaaattaagttttttgattaatttttatatgttttgctacctaaaaaaaatgttatttgcctttttttgtgcctaattaatgtaatgcctattttgcggttttttctgccttttaggtgcctatttcgcgattttttttgactaaaaatggaaaccctaattataatatttaaattcaccaaaatctccggaaacaaaaaacaccgaataattatttcgtggtaaaatg

SEQ ID NO: 118775 - DNA, 352 bp, Heterodera glycines
  Promoter: Source sequence=SeqID_37017; Location=617..968; Strand=+; Gene=SeqID_66199
ttgactcgaatattgtacaaaaaagagataaaataatttttttttttgtatatatgtgttaaacattaaaaaacaatttttacagcttatattaaattgaaacatcaatttaaatttttgggagattggattttttacaaaaccgcccgccgttagtgttagagaaagccggtagggccaggatttctgagcatatgcttgaatatttgtaagcattttaattttattaaatttggcatttaattattttgctttttgaattttttttttcaaaattaaagaatgtcaattaacgttgtttgtcggtttccgtttcttcgactgtgtttaggtatttcggtctgcagaaatg

SEQ ID NO: 118776 - DNA, 237 bp, Heterodera glycines
  misc_feature (32)..(32): n is a, c, g, or t
  misc_feature (67)..(67): n is a, c, g, or t
  Promoter: Source sequence=SeqID_43578; Location=1186..1422; Strand=-; Gene=SeqID_71219
attttatgaaattacagtatcaaatactatgntagatgatggttttcatgtctaccgtagccaaatntaaattaggttgattcccattgaatttaacaataatttggctgttcgatcattatttgactcatttataatcaaatactttatacagcaattgcaattggtcttttggatgccatccgtcggcgtgagaatggcgaattgccgtgcccggtgaagaagcatcgacagatg

SEQ ID NO: 118777 - DNA, 169 bp, Heterodera glycines
  Promoter: Source sequence=SeqID_21310; Location=1807..1975; Strand=-; Gene=SeqID_51910
tttttttttttttttttttttttttttgttgggggggaaaaaaaaaaaaaaaaattatgtttgttgggaagggagggaaggggggtggctgttggaaagtttacataatcagttttatttattaaaaggaagggaatgaaagtcaaaatcaattattcccaagaaaatg

SEQ ID NO: 118778 - DNA, 795 bp, Heterodera glycines
  Promoter: Source sequence=SeqID_584; Location=6140..6934; Strand=-; Gene=SeqID_56856
agtaactaacacaaattgcgctttcgcttagcccattgtctccaccaaaggcggggcaaatgaacgcaaaaggtcctctgctgaaaatgaatgccgggcccagcggacagcggaagaaaaagtgaaagaattattaggaaatgagaaattttaatcgattattatgaatggaaaatgatctgtcaattgctcctcacatgtatttgttgcttcgttcataaaagtcccaacttttgtttgcaaacacaaaaaagaaagtgattttcctactacatatttgtcgtaattaataatgacctcattttatttttgattttatgatatttttggcattttttttaatgtttgtgatttcgtttttgttttcatttttgtcctcagactttaatttggaattgcctgacataaaataataaggctttattttgtgtgcttcaattgtgtgtaagtgctgaactgttcgacgtgctgctgagtaaaattaaattatttgtacgtggcgctcctgcaaaaaggtgtggtcgacgcgggttttatacggggaattgtagaagtaggaaattctacaaagtcttcaactactgcggcgacaaaaaagtaaaaagtgaaaagaaattcaccaacgatttgtcagctcggtaaagtaattccgtctacaaagctgattcgacaaaaagggtaaagtaattcccatcgacatttcatcttctacagaacggaaattttgtgaaattcatcagttttcttctcaccgaattcgacaagtgaaattttgtggaaaagggcgaagtaatg

SEQ ID NO: 118779 - DNA, 137 bp, Heterodera glycines
  Promoter: Source sequence=SeqID_24327; Location=1..137; Strand=+; Gene=SeqID_55051
ttatcgaaattttaagagatttttaattgaatttttttctttgcgagactttacatttaaaatttgtaaatgtactaccctcgcagcagcattgttaattttctgtttcccattttaaggaatttgccgacattatg

SEQ ID NO: 118780 - DNA, 621 bp, Heterodera glycines
  Promoter: Source sequence=SeqID_5415; Location=4546..5166; Strand=-; Gene=SeqID_57949
gcttattataaaattaaaagcatttgcataaattttttaaaataataacaaaaatttgctccttaaataatcaagtataattttattaaaatagtaaattgatttgctttttaattggttgattaatcatattcaaatataattagttaaaagattaaattaaaaaccaatataaaatatttagtttgcttaataaaatttattttgctttgcttgattgctgtggctttgtgtgtatacggtttagggccgaaacacaaataataattaatttaaataaattaacccaaagagacaccgtactgatgaggcccggtctctttcggttaaatttgcacgtttcgcgaagtgcccatttttgcactgtcgcgaaacgccccatttttacaccatttttgcactgtcgcgaagtgcccaatttttgcatttttcgcgaagtgcccaatttttgcactgtcgcgaagtgccctttttgcacttgtcgcgaaatgacgtagcaccctttcgactgcctaagcttcagacagccaatgttcgaaaaaatcaaataaattaatttaatttgaaaaaaatgcattttataataattgttttaatccaaagggccgtgtgcaagagatg

SEQ ID NO: 118781 - DNA, 414 bp, Heterodera glycines
  Promoter: Source sequence=SeqID_2481; Location=9567..9980; Strand=-; Gene=SeqID_79954
ttatttagtaatcagaacgccaaaactttgcaaaacttaaaattttttaggggattttcccttgtaaaaatagaagagccgatctcgagttaaaaactagacagctaaaacatgaactgtttttacgacacttaaacttgaaaaaaaatttcattatgaaaaattgtaacactccaccttttattcgaattcggaacccggattaaatagttgatccgtagcgattcgatggtcccaaaaactccaagaaacatgttttaacgactattttttccaaaaatgagggggaactatcaacagtagtacagggaaaattttaattctttatttttgtttaaaatttttgttaaaaagatttcattttttatggccaaagctgagaatcgaaagctcaaaaatggcattgaaaaaatg

SEQ ID NO: 118782 - DNA, 179 bp, Heterodera glycines
  Promoter: Source sequence=SeqID_21019; Location=1642..1820; Strand=-; Gene=SeqID_51598
tttttgttttgttccgcagtacggacaaagcacaactcaacgattttgtttcaacagcgacactctcaggaaggggttgcaacaaaacagcatcaaaagcgacactctcagaaaggggttgcgccacacagattgtggttatttgagatcaattgacaaaagggaaactgctgaaaatg

SEQ ID NO: 118783 - DNA, 112 bp, Heterodera glycines
  Promoter: Source sequence=SeqID_9609; Location=1..112; Strand=+; Gene= SeqID_72073
ctcgtccatctcatcaaagcagaatcaggatttagttactcaatttctgcacctcaatgaggaagcacgcaactttttggagctggataggctgaaaaagtccgaaaaaatg

SEQ ID NO: 118784 - DNA, 1003 bp, Heterodera glycines
  Promoter: Source sequence=SeqID_2088; Location=1461..2463; Strand=+; Gene=SeqID_77777
ttggtccttcctccaatgtcagtttttctcgagttcgttcattgaccaattcacatggcacaatttgcggattccgagcagggagcagcaggacaaaacgtcgccgggacatatcaaatttctttattacctagcctggtttggaaaaaattctagaaaaattcgaaaaaaagttattaagaaaattcaaggaagtacgttttccgttattttgaaaatcagcagatttagttttttattaacacttaggctttcaaaaaagttaagttttaaattttcttaaatttaagttgttttttcaaacgcaaattggtgccagttttgtcccaaatttgctgattggcacggagaaaagcgaggacggaatcgtcgtacctgaaaagggaatacatttgtcgtcaacaaaatgtttgaatttcaattaccaaatctgaaggtccttaaagcgaattttgtcgggcagcggaaaatcaattgaattggcatggtcaataaacacagacagttttggcatttccgcgtcagtgtcttttcgaattttgattggtctccaaattaccaatttgcttttgccatcgaaatgtttgtccactaaaacatcaaaacgtggcgaaagcaatgccaatttgaggccgagttcggcatggtcaaaaaagggaacatatccatccaaacacccgtaaaatccaactgaaatgcggggaaaataactagggcaccgatttatagtgaaaaaactctggcccacaaaaaaggaatttaccagtgtaaattttaaattagtgcgcaaaaaattacgtcagttatgctatttggcgaaatgataattttgtctaacactgcactggacttgacccatagtgaaaacggaaataatgtatataaaaggagcgcatttgcagtgttccatcacataattcattgcccacatattattgttattatatattgctcatcgtctgcaactttaatcccacgaagcgacgtgcccggcgcaacaatg

SEQ ID NO: 118785 - DNA, 682 bp, Heterodera glycines
  Promoter: Source sequence=SeqID_4142; Location=1..682; Strand=+; Gene= SeqID_53349
tataaataagacacgaaaaatcatgaaattagagacgtccattaaattccgggcctgactattggttgctctgcactaactaattagggtaatgatttctgaccaacccaatttgttaaatatttgaatacataaaacaattaatttttctctcattatttcaatactaattttggtggttagcactggtttgacatctcatattccgaacggaggatcattgcaaaggtctcctctctctaattttttattttttgtatctacgtaaataataaataatttatgattttcttaaatttttatttttgtatctaaatagtgaataatttttaaatacttatgcgcaatgtaatgagtttccttcacatgccccttgcctttttccgcctgcttccgccattttttttataaaattaaaaatgccaacaaaatttccatgattaaaaaaacgatgccaaatcaaaatgtgcgtccaacagtgccatcaattttggcgcgtggtggggggggggggggcgggaagcactacaaaacacataaataggagtgcatttcttatcgaaatataaatcagtaatatccataaattttgggtaaacatttatttacgggaattaatagtaaattaataattttaaaatttaaacaatttttaatcatttagcttctaaaaaataaaatg

SEQ ID NO: 118786 - DNA, 440 bp, Heterodera glycines
  misc_feature (13)..(13): n is a, c, g, or t
  Promoter: Source sequence=SeqID_5134; Location=1..440; Strand=+; Gene= SeqID_45988
tgcaggtcacaanaagagaaaaaaagttcaatttcaaatgaaaagggatcaataaaatttctctttgctttgctcgccctcccctcgcccattattttcctttgccttttcctttggtctgtctgtctcttcgtttgtctgttttctcccttttcccaccctttcctttcgtcgtcgcccttaacagctcacttctatagcacttctgcggttcatacacattcatattcatcatttcttgttgttcatttttattttccttttccattttaaatggtcatttgattaattccaacatttaattaacgtgggatgaaaattgaatagtaaaattgtccattaatgaattatattaaatgcctattttaattcgttaaacattttagtacgattattatcttgcacgaatccaattgtttcctatcttagacacttaaatg

SEQ ID NO: 118787 - DNA, 78 bp, Heterodera glycines
  Promoter: Source sequence=SeqID_31044; Location=1058..1135; Strand=-; Gene=SeqID_61415
ataaatttgtttggcattccgttgtccctgaccaatctgtgcctggtggcacgcacatcaatcatccacccgaacatg

SEQ ID NO: 118788 - DNA, 328 bp, Heterodera glycines
  Promoter: Source sequence=SeqID_1337; Location=4132..4459; Strand=-; Gene=SeqID_72851
attttctattattttctgccgaccaatgtttcttttcggcatattctttttcattcattcacttttattttatacaatacatacgcatatttcaatacatattctatgcatattccatataaatgtcagtgccttcttaacatatttactcttgtttacatatattcattcgcctgttctctattgtcgttgtttttgtttaaaaaattacttataaaatgttttttggcttatttgaatttaaattgtcgaaaattcgttaaaatgggaaaacatttaacgattcattagggataatcaccattcacagtttcagctgctgcttatg

SEQ ID NO: 118789 - DNA, 642 bp, Heterodera glycines
  Promoter: Source sequence=SeqID_13436; Location=1927..2568; Strand=-; Gene=SeqID_77326
acattgactcaaggaacgtggagccagcgcgtcattcataaaaaagtcattttcagttacatattctggagttaactcaaatcaaacccccgcccccgcccccgcgggggcggaattatcgtgcccccgtccccgcccccgcgactctgacccccgccatcccccgcccccgtgaaaagccacccccgcccacggggtccgaaccctagtcttgaccgtggacatttttgattatgccggtcttgaccgtggacatttttgattatgcggtctcggtcgtggcattttttggttgtacggtcttagtcgtggcattaaatgccacggcgacgactcgtatcgtgctatggatgagttgggtttacccccccccctaaaaagagatgtttcgcctttttttctctgcactctctatttattggtacacatctcgttttttgggatggtgtgaccatttaaatatcggtcattccatatggccgtttccatattcgttgatcagcgatcccgaaaactccttggaacaagttttatgacttggcaaatatcatagaaaaaattttttgctatcaaaaggggcgcccctacaaagtgtccaagcctcgaaatgtccaagccacgaaatgtccaagccacgaaatg

SEQ ID NO: 118790 - DNA, 428 bp, Heterodera glycines
  Promoter: Source sequence=SeqID_28490; Location=442..869; Strand=-; Gene=SeqID_59100
aggcaactctgctccctttcttaatatccgattttttccggagtttaattatttccgcacactgcccatatccgaaagatactctaaaaaaggattttctataataagcctatttaatgttacaattttttctgtgccttcttacccgggatactgtacaaagaacaaatggtggttacagtagtgatacggtaaccaaaaacaaaatggaataaaaaaattacataggcccaatttggcggtgttctgctcggcactttcacttccggcgccctttcggatgcgtttgggcgtcgtcccattgcaatttgtgcccttacttttggcatttcgtctgtccttgcctcaggtaatttgatttataaaaaattgcggacttttggcgcattatttaatttaattaattaattagttttcgccacaacatg

SEQ ID NO: 118791 - DNA, 264 bp, Heterodera glycines
  Promoter: Source sequence=SeqID_11426; Location=1355..1618; Strand=+; Gene=SeqID_74819
cctgaattttatttaatttatgaatatttatttgatttggataattaaatgggttatgatttgttctgggctcataaacagcacatctttcagccaattcatctgctttttttgtctctattctgatgggagtgtcctttcccttgggtctttgaccttttccaccatttcgttaaattcaattttcaaatttcccgctaattgttcgtcgtcaaatcaaattcattttggcgaatcaccgaaaaatgatcaaatgtcaaaatg

SEQ ID NO: 118792 - DNA, 765 bp, Heterodera glycines
  Promoter: Source sequence=SeqID_19715; Location=795..1559; Strand=-; Gene=SeqID_47604
tcttctctagttcatttgtaacacacgcacaacaaaagtcaaagtgaaaaaatatatatgtaattattttattatgtctcaacatttttcatctgaattatttatggcaataaaaatgtttgtttttttgtctgattttttcgttgaaaataggtaattcttttttttattgccattcattgttcaccaaaagctgtattttcttataaatgttcgtttgaaattttttttattgactaaagaacaaatatacattttttcattaatcgattagtgaatttgttaaatggtcatagaaaactttttatttgttacatagttagcggacagtgccgtttctgcgccaagaattctttttgctagaccatcaaattttcataaatctgtatcattcgaacgagaggttgattgttcggtaatagttcagtttgtcccctccccctttttcgaaaagcgcttgatgccgaaacgattccgacccatttttgttaggttttcgtgtggcaaaattagccaaaaaaaaatttttccacatttggcgttgcgcttttgcctctgtttaggtgtcattcaaaaacatttaattgcattttttatttgattaaaacaaaacttttttatgtatgtataaacttgaacaattgctaaaacttaatcattcactgtaaattaattaattatccaatttgttaaattgtttatctgtgtaaattcttttacaaatttgatttaaaatttagcattttccattaaaaaaataaaatg

SEQ ID NO: 118793 - DNA, 685 bp, Heterodera glycines
  Promoter: Source sequence=SeqID_12889; Location=1907..2591; Strand=-; Gene=SeqID_76624
tctttctatagtgaaattaattttgtctatagtcaaactcaaaagttattaaataataataaaaaagtatttattttcctctccttttggcgtactattttcatgtctctaacacattaaaaatcatgaaattcgcaaattctaataattttggttataagggtacaaaatcactttgaacatttagaatcaatagaaaaaagaataaattagcattttggttagaaagagctgcctaggacttgagttataacgtaataaaaatttggaattcccacaacttttttctgagatgtcaaattgcttagcattcacttagaaaaagattctccttttcaaaatctttttttagataccaaatttgttcatttttgttgggaatgaagcgtgttatggctgatcaaaataaaaaatacaaaaaaggcatttaccagtgtaagtgcatatactttgtttttgcgtgtgttggcgttttgttttacgccaattattttttggcaatttttttcgttttttaccgtccatgctccattttgaattctttctcgtcattcattcctcatttgactttatgctttggcagagatgccatttttctttttttatggattgtttttccacttacctatccttttgtacatttaagttgtatctgccatttgtgtacacgcatctaacgattatg

SEQ ID NO: 118794 - DNA, 406 bp, Heterodera glycines
  Promoter: Source sequence=SeqID_1049; Location=1..406; Strand=+; Gene= SeqID_66890
aagagtaaaattaaaataattgttaacctgtgccatcccccccaccgaaacgaacctaaacaaaattaaataaatatgaatattaaacagtagctatagttaagaaagcataaattaaattgataagcaattagcaccatcgctgccttttttgcatttgtttttgacttggatttcatttatttttttaaacatcatgccaaaaatggcggaaaattttaattaaaatttatttattttcaaaaccataatttaaagagaacaagagaactcttattttcttcctcttcttctccctaatgattcaggaaaaattacttagaaaggaattctaaaatttaagcccttacaaaaattgcgaataaaattctgcatcgacgcatcactcactgtttgtcaaaacatg

SEQ ID NO: 118795 - DNA, 357 bp, Heterodera glycines
  Promoter: Source sequence=SeqID_31216; Location=1045..1401; Strand=-; Gene=SeqID_61583
tctaaaaaataaaaatatattttcatctttcatttgatttctttggttaggactaaacaaaaaaataaggacatttaatgtttgcgatcatatgccaattcaggacaactctgaaaaaacaggacctttctgccccataaaattgcattatctgatatcaaaaaaatctctcaaaattactttttggacaaatctgtaaaaatttcataaaattccaacattttccctgtttttcttgctcggaattttattaagtgtttgtttctgacaaacaaaaggctgagaaattgaacataggcaatgaaaaaaaaaaatttttttttattggtttttatatctgggataaagtttcagatg

SEQ ID NO: 118796 - DNA, 1003 bp, Heterodera glycines
  Promoter: Source sequence=SeqID_1763; Location=3867..4869; Strand=-; Gene=SeqID_75784
caataaaataacactacaaacatcatttaatttttgttattttgtggcatctttcttactaaagttaaacatattaaacataaaagctgatcggctataatataaatgaaatggtaattaaatgacaaaagaaaattacattttttcaaattttatattaacaaaacaaaacattaaaatatttttgcctaaaatcattaaaattccaaaattcttcggcaaaatgttattttatgcttttttcccgcattgaattaattttgtttatttcatagctttcatctaattttatagttaagcattttttgatattcgtctttgaataatttattaaaaggaaaaaatacatgttttctgagcatttaatttgtgcgccttttatatatattttttaaatttataaatgcgttaaccataatttaatataatataaattattttttcctgtattaaaatgaatttttccatttctttgttattcgtcggagtcatttttcttttgaatttcgtcgataaagtaattaatccgaatttaaatgtgaattaactctgaatttgcacagacttttccatgccgcgcaatggtttatccgaacggatgctgcagttactccgccttttttggctttttagagtaacatttttaatttgataaaatacttaaccaatactgcttataattgtatgtgtataatgttggtaaaaatttgagtggaatcgggaatttagacaaaaaccgggatcgggacttttcgggttgaaaaaccgggactttttagctgggaaaaccgggacttggtactcatttgtacctttttttaagtaccagtcccggtcccgtgcaaaaatattcaaagcaattagtgccatcatgcaacaaatttctgagcttgtttttttacgaaaattccaaaatttttaatctgggaaagatagcgccctaatatttaaaaatctaatatccctaataattagtcaaaatataataatggatagatagatg

SEQ ID NO: 118797 - DNA, 145 bp, Heterodera glycines
  Promoter: Source sequence=SeqID_15083; Location=327..471; Strand=+; Gene=SeqID_79256
tttatttgatttattttaccatattcacaatttgatcaaaatataggtggtcaaaagtgttgtcccatttcatttttaaaatattgcttctctggatcagcattaaaaaaatctaaaaaaattcaggtaagcataactttggatg

SEQ ID NO: 118798 - DNA, 56 bp, Heterodera glycines
  Promoter: Source sequence=SeqID_13341; Location=1122..1177; Strand=-; Gene=SeqID_77210
aggaaaaggaaaagggaaatgaaattgaaattgaaaggaaaaggaaaaagaaaatg

SEQ ID NO: 118799 - DNA, 352 bp, Heterodera glycines
  Promoter: Source sequence=SeqID_37017; Location=615..966; Strand=-; Gene=SeqID_66200
tttctgcagaccgaaatacctaaacacagtcgaagaaacggaaaccgacaaacaacgttaattgacattctttaattttgaaaaaaaaaattcaaaaagcaaaataattaaatgccaaatttaataaaattaaaatgcttacaaatattcaagcatatgctcagaaatcctggccctaccggctttctctaacactaacggcgggcggttttgtaaaaaatccaatctcccaaaaatttaaattgatgtttcaatttaatataagctgtaaaaattgttttttaatgtttaacacatatatacaaaaaaaaaaattattttatctcttttttgtacaatattcgagtcaatg

SEQ ID NO: 118800 - DNA, 468 bp, Heterodera glycines
  Promoter: Source sequence=SeqID_288; Location=3552..4019; Strand=-; Gene=SeqID_81479
ggtgagtgaccaggctgattgattttggcagcggcttcacgtgtgacgtcattgctgaactgcatcaataattcacacaattttctatatttgaataaatatgttgtttgtgtgcatttattggttaaatttcctcgatacttttgtcacacttgaattttcacgctgactttgtttttgtagatgccatcaaagcgagaaaaggagaagaagagaaagagagaagagatgagagagagagaagagcacctgcggtggacggagcaatctgtcagcccagggagcttgcctatcccaaattgcccttctgagggcaacccactgaattcagtagataggaatcgggcggattcgctccgggtctttaataccccgaacataagtgctttgcaattaagcacaccggcttcttccattggaagtaaaaaaaggggcagaccctcaaaagccagagcggagtcagttatg

SEQ ID NO: 118801 - DNA, 197 bp, Heterodera glycines
  Promoter: Source sequence=SeqID_14772; Location=1..197; Strand=+; Gene=SeqID_78907
tggtcatcagatttgaattttaattttataatacaaatttcctagggtccagattttcttttaatgttttatgaaacaaaaatatgtcgataaaattttatgaaaaatgatcaatcaaatattttaagaaacaaaaatggtcgctcagcttttaatttaaatttataaaaattttgttgaaaaaattcagttccatg

SEQ ID NO: 118802 - DNA, 1003 bp, Heterodera glycines
  Promoter: Source sequence=SeqID_7669; Location=717..1719; Strand=+; Gene=SeqID_65576
aaattccggcggtgccgataggcgccgccgtgggaaaattttaagaatttttaatgaattttgttaaaaaatggccaactgatttttcataaaagtcggttgattgtttcggtttttcataaaagtcggtcgattgtttcggttttttgattatttcggtcaaacggtttcggttaaaaaccgaaaaaaaccgaaaaactcaaaaatttctcggtcggtttttttcggtcaaaaaccgaaaatcgaaaaataccgaaaaaaccgaaaaaaaaccgaccggtccgatctctactataaattctcaaaaatcctcaaaatatgcaaaaaaaaaaatgaaaatatttacgaaaaagtccaaaatatgcataaaaatatgtacatatcagggatgggccaaattgaaaataaaaagcgaaatgcgaaaagcgaaatttgcgaaactgaaaaatgcgaaatgaaaaaaaagcgaaatgcgaaaagctaaaatatgcgaaagcgaaattttttctacaactttttaatagttaaaatcataaagcaaaaatcatttttaaaaattttattccaaatttaaaaatcaataaaacgcttttttgaggcgcgctttttccaaaaaaactttcgggaaaatttttcaaaatttgattaaaatttgttgacagattttcactaaaaaatgatcaaattttgtgatttttatcattttctaatgagaaataagagttttggggcgccgctgagaatagtttttcatcaaattaccaaattttgcgattttgagccattttctaagaaaaaataggagttttggggcgcggcggtgccgataggcgccgccggggaaaaaattggaaattttgatcatttataaacaggttttcactgaaaattagccaatttatatgtaaaattttgaaaaattttatgggaatttaatccaattcttaggggtgtaaaagtcgcgtttcgcgccaaaaagcgaaatgcgaaacgccaaaaaatg

SEQ ID NO: 118803 - DNA, 80 bp, Heterodera glycines
  Promoter: Source sequence=SeqID_4968; Location=3650..3729; Strand=+; Gene=SeqID_56394
tcttcaaaaaattaccatgaaagggcaatagacaaagctgcgaattgtgagccaaaagtaagaaatgcgaaactaaaatg

SEQ ID NO: 118804 - DNA, 428 bp, Heterodera glycines
  Promoter: Source sequence=SeqID_13648; Location=580..1007; Strand=-; Gene=SeqID_77548
aaatatgcacaaaaatctcgaaatatgcaaataaaagtcccgacttttatacgcagacacaaaaaagaaagtgtttttctcaaatttcggcttcaaattaaaattacttattgttcgaattagtgttcagcgataccaatacgccgaaacgggtaccaaaatcgtgatcaatgatcctgaaaaccccagaaaaagtgttggcaataaaagaatgtccgaataaatggagattaaaaaatgcatgtgaaaacctcgaattgtttctcaaaagaacggtgttgaggattttaaagaatgcgatgaaacagatgtttttaacaatgatacactgtctttgggttttgaaaatttcatttcttttgcggtgagtggcaatataattaaaataatgtgactttatttttaaatggcagattaaggaattgatg

SEQ ID NO: 118805 - DNA, 239 bp, Heterodera glycines
  Promoter: Source sequence=SeqID_20308; Location=2000..2238; Strand=-; Gene=SeqID_50816
ggtggcttttttaaattaattccttacataaaaagggatttttgaataattttttatgagagagaaaactaaaaaaagtaaaaatttgaacagatattttttaatggaataaaaaaaatttctattaaaactctcactctcataaaaacatataattgataattaatttgattaggaaggaatttactgtcgcttaattgtcggtttgcctttttaggttttccctcattaaccaaatg

SEQ ID NO: 118806 - DNA, 108 bp, Heterodera glycines
  Promoter: Source sequence=SeqID_31359; Location=1..108; Strand=+; Gene=SeqID_61725
attcttgagtaatttttaaattttttttaaagtcagactataaagcacaattaatacaaaattaagcatttgttgtttttattagttgctcttcatgggatgaaaatg

SEQ ID NO: 118807 - DNA, 1003 bp, Heterodera glycines
  misc_feature (378)..(379): n is a, c, g, or t
  misc_feature (416)..(416): n is a, c, g, or t
  misc_feature (450)..(450): n is a, c, g, or t
  misc_feature (463)..(463): n is a, c, g, or t
  Promoter: Source sequence=SeqID_2825; Location=1300..2302; Strand=-; Gene=SeqID_81808
actttttagcaactattttcgcttataaaaatttttaacaactatttggcttgtgaaatttaaaaaaaaactattttttcaactatttctgcttttcaacaaaaaaaaattattataaaaacgtaaaaaaataaaataaaaatgcatctctaagaatcgacgttagtttttttttaaaaaacacccttttttcaaaaaatgcacccctaagaatcgaccaaaaaattttttcaaaaaatacacaccctagaatcgacataaaaaatttcaaaaatcactcctaagaaatcaaaaaaattttatcaaaaattccttttcttggcaagaatttctaatttaaaaaattatttttttaggtaattattttggttttttgannttaaaaaggggagtggtatttatttgtaattggaatnagtgaataaaaaatatttttgtttaatttttggntgaaaattatgtnattatttgtagagaccggcgcaggacaggatcctgcgcaggattttgcaggatcccagtccgcaatcctgcatattttggaaaatacaggatttacaggattaatcctgccggatcctgtcctgtaaaaaattttgaattccaatcctgcaacaggacccgcaaatttgatttttatgcaggattcagcaggatcctgcattgattttttgaaaatttttaaaaatagaatgccaaatattcagaaactttcttttttcaaaaatttttttcttaataaaaatttttcgtttaaaaacttatccttattcgaaaaaagtttatacaattgaattttttatgtgttttgctacctaaaaagcgttaataaaatttttttttactattttcgtgcctattttaggatttttctgcctttttaagtgcctatttcgcgattttttgtgcctaaaaatcccatccctatacataatggattatggcttttttgcaaagaaatttaaataaaaattattttactttaatttaagctattattatg

SEQ ID NO: 118808 - DNA, 142 bp, Heterodera glycines
  Promoter: Source sequence=SeqID_36122; Location=480..621; Strand=-; Gene=SeqID_65529
agataataaggtttatcataaaatttcatttaaaaatataccctcaattattggtatgaacgatactttataaggtttatcatacaatttcatttaaaaataagccctcaattattggtgtgaacgatactttccagacatg

SEQ ID NO: 118809 - DNA, 308 bp, Heterodera glycines
  misc_feature (75)..(75): n is a, c, g, or t
  misc_feature (77)..(77): n is a, c, g, or t
  misc_feature (85)..(85): n is a, c, g, or t
  Promoter: Source sequence=SeqID_4259; Location=3228..3535; Strand=-; Gene=SeqID_53791
ccaaatcatcatttcaacttaaccaccccccgtcagttctttaccttcaaaaaaattatccccccaaaaaaaatnanctatctanatttcttaatatggacatcaaatctgtggtcggttcttgctgggaaaggaggggggcttgaatttattagattctatgaaataataacgattattgcatctttttagtcttattttgaactgtaataatgaaaaaataaaaaattttgaaaaattgttcaaattcacatggttctgaatctcaatgcattttatggaaataaaaattaccaagtttcagaatg

SEQ ID NO: 118810 - DNA, 341 bp, Heterodera glycines
  misc_feature (130)..(130): n is a, c, g, or t
  Promoter: Source sequence=SeqID_22156; Location=1..341; Strand=+; Gene=SeqID_52814
aaatttgtgacagaattttcactaaaaaatgatcaaattttgtgatttttatcatttttctaatgagaaataagagttttggcgcgccgctgagaacagtttttcatcaaattaccaaattttgcgattntgggccattttctaagaaaaaataggagttttgggggcgcggcggtgccgataggcgccgccggggggaaaaaatggaaattttgatcatttataaacagtttttcactgaaaattagccaatttataggtaaaattttgaaaaattttatgggaatttaatccaattcttaggggtgtaaaagtcgcatttcgcgccaaaaagcgaaatg

SEQ ID NO: 118811 - DNA, 218 bp, Heterodera glycines
  Promoter: Source sequence=SeqID_44964; Location=1..218; Strand=+; Gene=SeqID_72366
attcccaaaagcttcattcagtcggcattcgtcccccacataaagcatttggctgctcctccatttggtgcaaaacggaacggtactgaaacgcacaacaaagggcttattgttgaatttgctgccgaaaaagggccagcaaaacctttttccaaaatcccaaatcgaactgttcgggcagtcttcgcactgtacacagccctttctccttcaaaatg

SEQ ID NO: 118812 - DNA, 268 bp, Heterodera glycines
  Promoter: Source sequence=SeqID_2182; Location=1..268; Strand=+; Gene= SeqID_78320
cttcggtcacaatttcaaatacgatctgtctaaggaattttaagactttggaaatgtttgtttatacaaaccaactgaaatgttttttttctgattatcactgaatatttgagattgaattttctaagtgatcagtcagaagctccccaaattttaaaattttccgttatctttttcatttagtaaaaactagagaccggcgcgggacgggatcccgcgcgggattttgcgggatcccagtccgcaatcccgcattttttggaaaatg

SEQ ID NO: 118813 - DNA, 88 bp, Heterodera glycines; identical to SEQ ID NO: 101305
  Promoter: Source sequence=SeqID_32326; Location=328..415; Strand=-; Gene=SeqID_62638

SEQ ID NO: 118814 - DNA, 110 bp, Heterodera glycines
  Promoter: Source sequence=SeqID_20682; Location=841..950; Strand=+; Gene=SeqID_51242
tgtaagtaaaattaaaatttttttaattttaaataatttgttgtttcttttttgtttagtttatcgcaatttttggaatttattgcagagaaaaatataaaaagcaaatg

SEQ ID NO: 118815 - DNA, 1003 bp, Heterodera glycines
  Promoter: Source sequence=SeqID_7324; Location=3798..4800; Strand=-; Gene=SeqID_64476
aattgcgttggaaactttatttttatggtactaccgtagagttgagcggaccgggaatgttgggcaaaaccgggaccgggacctgagaagccgggacgggaccttggttttccgggaatttttaaattcaaaaaaaattcaaattttaatttatttcaagtgaaaataacacaaaattaatttttattttgctatttattttataaaatctaaaagttaaagctaaattaaattaatgaaatttttaaacgaatttacttcagttatttcaaacaattaatcattttggactaaatgatcgaataatcttagaaatccagaattgcttttcacataatttttcggcgcgttttttccaaaaaactttttgggaagaaaggggtccggcggtgcagttaggcgccgccggggaaaaattttgaaaatttgagtgagatttgtttacgaatttcaacaaaaaggctggttttttggactactgggctcaatttgtatggattttctttaaaaaaattataaaatatgcgcaattaaaaaaaagtatgaggaagcatagcttgtcgatatgtaggaacccatgaacaaaaagaaaatcaaaatatttgaatttctgcagagtgattgaaccaagggaaagaagtagaaaatcaagaggattccatattcgtgatcattgatcagcgacctcggaaacccccggcggatacttgttttctgaactttttaaaccaaaaaaagaatttgaaaaaatgttgaccaaaaatgtggatacaaactcctgtagtaccatttttataattagagaacaaagcggaaaacaatgaaaacaaaatttgagaagctcgaaaaacacagaaaaagggaacgcaacagaagaggagaggaggaccaacaaagagaatattttgcaaaatgatgaccatttgccgggcgttttaccttatccccccacccacaaatcaatcaatcaaataatcaattggacggatagaggaaaaggatg

SEQ ID NO: 118816 - DNA, 612 bp, Heterodera glycines
  Promoter: Source sequence=SeqID_23577; Location=440..1051; Strand=+; Gene=SeqID_54267
tttctattcgcgctctgttcagtaatttgactgacagaagagcagcaaattccaattaattatgtttaaaaattgacaaattttgtcatgagagcgcgcatttttttattttctcgttgaaatggcagcaaaactgcgcctgctcactttattgggtgtgtgcctgctgtggggagcaccgatcgcaaaaaaaaaaaagtcacgagaatcgagagcgaagatttcgagagacaaacggaggaggaggaggaggagggggtggagggaacggaagggggaaaaggtggggtttaaaaccgtccgaaagtcgctccaaaaatgaaacgtccgttcggcgcctccaccgaatttgataaatgagcagcattttttgtgacatcatcacatgaaattgagcaaaattttagtataaaagtggggagggacagcacaatcggagacatcattttgtaaatgtaaagtcatttcagtttcacttttgttcaaaaaatagaactcatttggaaacgataaaaatattttcccattatttcggaagacggtcaatcatttaaaaatatttcaagtttttactttcttaaattttcgtcaattttaagaagtttaaaaatg

SEQ ID NO: 118817 - DNA, 169 bp, Heterodera glycines
  Promoter: Source sequence=SeqID_24899; Location=967..1135; Strand=+; Gene=SeqID_55642
ttcccttccttgcctatttatttattttccaatccgccacaactcgagctttttccggcaatgcccccactccaacccctctcctgggggatttccaccaccaacaacccacccaatccactcaatatattttcctcatccgtcagcgcaaaacaatgccacaagaatg

SEQ ID NO: 118818 - DNA, 523 bp, Heterodera glycines
  Promoter: Source sequence=SeqID_41168; Location=1..523; Strand=+; Gene=SeqID_69356
attcaaggtccatttaatttagaaacttaggcaaatacctttttttatacaggcttattaaatcaaatttcaaaaaaaaaccggtccaggcctaggctctagacccacgttgctggatagacggctgtaatcaagaaaattcaaaatgatgtttttttttctcagaacgttttgccaacaaaaacaaaaattggcacatacaaaaataacataaaaaataatgataaaaaagttaaagttaaaaaaaattaacaacaatttttacttgttttatttatttttgtttaatctttatgtttttgaaattttattttccacttaaaagaaaaaaatcaaaatttttttttaccttttcaacttttttaaagaataaaaaaatacatctgccttttttatatagctttgccctgtaattctcttcttactctcaagtgttgtgtccattttatcaccatattttgaaattccaaaaattgttgctctgttgatttttaattgccaaaaatttggcttcattagtatg

SEQ ID NO: 118819 - DNA, 470 bp, Heterodera glycines
  Promoter: Source sequence=SeqID_10246; Location=1540..2009; Strand=-; Gene=SeqID_73398
tgtaaattcaggaaaaaatcactttatttaatttagccgtattcatcaattttttaaccaaatttaattaggtgttgtgcttcaccaatgctgcgtgactcacgcacgatgcgtgagtttgtcaattagttaatgacacaattattgtttattataataatatgtaattgattcggactcgctcagttcggcccccacggttcggccccagcagggaaccgcctactttggcgcggccattttggcacacgttataaattggcttttttggcgccaatgtttaaatatctcaaaaaatttttaatttgccttttattgtgcataactatgatgccatttctttcatagtagcatgctaatgcagtggtgagcaattatatagaatatgatccctatttaacttttatattttgattcaaaaatactatccaatgcgttttcgagggtgctgatcagtgatcacgaatatg

SEQ ID NO: 118820 - DNA, 73 bp, Heterodera glycines
  Promoter: Source sequence=SeqID_5593; Location=911..983; Strand=-; Gene=SeqID_58586
ggtgagaaagtgggagaactgctgaagacaaatgagtgcaatgattggaaatttaatgattggctaattaatg

SEQ ID NO: 118821 - DNA, 359 bp, Heterodera glycines
  Promoter: Source sequence=SeqID_1992; Location=1..359; Strand=+; Gene= SeqID_77227
aagtcacgactttttgaaaaaactcctgaaaaattaggcgaaagttaaaaaatcacatttttaataatttatagaataacattttgatcgtatttttaggcacttaattttataaatagtatctaaaataggcataaaaaagagattcttccacaattaagaaaaaattcatccacattgcctttttatcgatcgaaattttatttcggaattttcttgtatttttcggcattttcttctctaaaattcaaattttgcctaaaaaagtcaaaaaaaaaatcatgaaaaaagtcgcaaaacgtcaaaaaaagccataaaaatccaaaaagtgtaaaaaaatcaaaaaagtcacaaaaatg

SEQ ID NO: 118822 - DNA, 51 bp, Heterodera glycines
  Promoter: Source sequence=SeqID_2667; Location=1..51; Strand=+; Gene =SeqID_80971
ctctttttggcctcctccgttttggccgtgcttataattggcattaaaatg

SEQ ID NO: 118823 - DNA, 231 bp, Heterodera glycines
  Promoter: Source sequence=SeqID_36437; Location=1..231; Strand=+; Gene=SeqID_65747
taaaaataaacatcagattcgtgatcagcacttaaaattagcctagaaaaaaattattaaaaaatatttcaggggggtggcaaaacccataagtacctcaacaaccccgtttttctagttcctaaatttttatgctgttgtgaaaagaatttgaaaattttgttgacgtaaaaatggggtgaacctcgtccagcatttgcttcaactccgattgggtgggcgcttcaaatg

SEQ ID NO: 118824 - DNA, 123 bp, Heterodera glycines
  Promoter: Source sequence=SeqID_17973; Location=1216..1338; Strand=-; Gene=SeqID_82540
ttcgtcacttttttttgctgaggcgtggctatcctctacacttcggcgtttgctctctccgcttttctgtttctgtattgcctttttctgaaattctttcagaatttgacccgattaaagatg

SEQ ID NO: 118825 - DNA, 193 bp, Heterodera glycines
  Promoter: Source sequence=SeqID_1282; Location=6638..6830; Strand=-; Gene=SeqID_71483
tgataccagtttgataaaaatgttaccatttaaaaataaccagataccctgttcggtggccttataaaagagagaacccgaatttaccaacaaattttgggttatgccatgggaagactaagaaatgttgttaaacaactaattaaaaaccaagcaattggaaaattatgacagaatattgcaagaacaaatg

SEQ ID NO: 118826 - DNA, 1003 bp, Heterodera glycines
  Promoter: Source sequence=SeqID_4453; Location=174..1176; Strand=+; Gene=SeqID_54504
ttttttacaattttggtaagtcattcgcctgtcatgtgagtaggggggggggggggggtggaatggagcagaaggaatccagggatagaaaaagaaaagcatggtggattatgaaaatgtttaatctctttttttatgatttttgcgagagcggaatgcaacttgggggtcggcaccagggccgttgcggtgccaaaatttgttaaaagttttcgccgaaaaaatctgcaaattttgcgcataattttcttataaaaaagtgatattatgccataaaatttcaaaattgtctgcatcgaaatccccgaaacgacatggccccgaaacttgatgagattttcgtttaagaccagctgtccgcatgaaactgcatgttatcgccttgaaagtgatgtttcatggatgtgctgcacgcaaaatttcagacggaaatgtgtcaaagatttttccgaggtaataaccaaaatgttgagaagaaataatgtttaaattgaaatgtaaattttaaatcaaaattatttctacaacaaatatattttttttaaatttcatgaaaaatgaagtaattaaagttttcatcgaaacaatgaatagaaaaatctaaaagccataaaaaaaattttttgttaagctcaaattaaaatattaatttaaaaaatattattttgaattaaaagaatatttttattgttaaaaatcttttttccaaaattttatcatacatataattttgaaaaatttccaagtttttttgtgggataaattatgaatatatggctcaaaattatatggagtaaaaatgtcaaatatggacataaaacatggactgaataaaaagttcaataattgccaaataaaaattgcaaaaatataagtctaaaccctcaaaaattaaaaaaacgcgtttatctcaaatattgattggatttatatttatggtatataagcaaatgtttatacctaatcaaaaaataataaataaaaatttaagattgaggcgatg

SEQ ID NO: 118827 - DNA, 517 bp, Heterodera glycines
  Promoter: Source sequence=SeqID_19890; Location=2420..2936; Strand=-; Gene=SeqID_84648
atatagaaaagcaatcaatggaaattcagtttaattgctttattattataataatattattggcattattgactttacaaaattatatattttaaaaaacttaaataattttaaaaaatttgtcgtgttttttgtataaatattattaaacaagcacatgacatcactcgataaagaaaaatagaaaaatgtttaaaaaataatttgtcttcaaattaaaatataatttatatattaattttgaatatacaaaatagcaattatgcccaattaattaattaataataatcatttagatttcaaaaattacacctctttatttgtatccatagaaagaatattataagtacattgaaatgcattataacaaattattaatcgttctggtaaaaatattttccgatttttttcttctaatttaatgaaaaaaaatatttttcattttttctttccacagtaacagcctcccatgccggacatgcaaccgtaacatccgccactgctgtaaccgcccatg

SEQ ID NO: 118828 - DNA, 135 bp, Heterodera glycines
  Promoter: Source sequence=SeqID_10534; Location=1..135; Strand=+; Gene=SeqID_73766
acatccaccgcaactcccccgtcacaaaatatcactttgccggacattcactcattttcaaccgaaaatgccgaagaatttgaggagtgggtggagcgcttccaatttgcgttggattgcgcggcggcaaatatg

SEQ ID NO: 118829 - DNA, 181 bp, Heterodera glycines
  Promoter: Source sequence=SeqID_17309; Location=1..181; Strand=+; Gene=SeqID_81785
agagttggtcagtaatttatatctttagccaaatttgaatccataattttttgaatttgttttcttttcagtttctctcacaaaagtgaagaagaagagtcgcgagggcaaagaaaacattttgaaagaggcggaaaaatttttttttaattttaaacaaaaaatttcaggtcagagaatg

SEQ ID NO: 118830 - DNA, 275 bp, Heterodera glycines
  Promoter: Source sequence=SeqID_26067; Location=1166..1440; Strand=-; Gene=SeqID_56812
gggggaggggtccgggagagggggaggggtccggagagggggaggggtccgatcatcgccgccgccctgggggaggatcgggaggaaaattatcggcacatatccaacatttgctcccatcatttcaaccgcctccgtggccgagtggttagagctcccgtttccaagggttcgagtcccccaccccgcggcgaatttaatttttattaaaattctcccgaatttaaataatttaaaaaactaaaaaaaactgcgcgagattcctgaggaggatg

SEQ ID NO: 118831 - DNA, 1003 bp, Heterodera glycines
  Promoter: Source sequence=SeqID_15628; Location=1230..2232; Strand=+; Gene=SeqID_79920
tcttcactcatgcttcgccccctcccctccccttttcctttctctctctctcccacttttccttgggatcgccaactgtcccaaacagttgggtcgtccgtccgtccgcaaagcgttgtgtagcaagaaacgcacgaatcgcttccctccttttattatgggtggaagaaacaattgagcaaaaagagaaacttttccaggcgtttagtcaaggaaaaagcaaaacgaaaagggcaaatcttaaagttttttatgcacaccgcttgcccccctccccccgaaatttttatttttaccgacgactctcaagggtttctcttatccactctctgaatctgatttacaataaaaacgatacttgaaggagaaataattataaaaaattttttaaattttcggatggctggctcaaaggcacgaaaaaatcgattgagtgagaatgggtgagaaagttaaagagtggacaagagaaggtgagagggtttagacagaagcactcgttgtgtgccctccccccccccccccccccctccctgattgaggttcgctgatcaatccctctcccccctccctccctcaccagccggtcttgagtaaaattgggagagagtggcttaacgggcggagttactttgcggcccattctaatgggcggagattgaacaattgttgcctcgggcagaaagctgaacgtaatcgatttgtgaggttcctctccgtgcgagtgattgggatgataagagaacgatgagaatgaatgaatgcatcggaaatggggggggggggagcggatgtcaaaatgagcggtgagatgctgtttcggtgctttgtcttaagttttaaggaaggctaaagcgaatgaatgcgaagtttgctgccttccgttcattgtcatattttcgttaattatttcggctttgggcgcttttcaaaaaaacggaatcttttcttttattattattattattggctctttttgatatgtcgatgcaatttaaagatg

SEQ ID NO: 118832 - DNA, 248 bp, Heterodera glycines
  Promoter: Source sequence=SeqID_5320; Location=3526..3773; Strand=-; Gene=SeqID_57667
ttcattcgattgttgtcaaatggaatggaatggcactctcagaaagaggcgcgtcaattgcactttgctcggcatggtcgtcgcgttcgtcggctgcaacggccctctgacggccgtaaatttggccaaagacttcggttttgcatttggcctttgttcgcttcgcattcgcccccttaggcatggaaccgcacttcttgttcagtcagccctatttgtgtccgctggtcgcccatttggtggcgatg

SEQ ID NO: 118833 - DNA, 308 bp, Heterodera glycines
  Promoter: Source sequence=SeqID_9889; Location=685..992; Strand=-; Gene=SeqID_72916
agaccaaaaatgagaaattctaaaatttgaattttcgattttttgctcgattccgggatcgacctaggtcgaaattactgtcagattcggattctccgacccttaaaactcctaatataatcttttctcgaaaaaattcaaaaattttgtttttcgaaaaaggggggctaccatcggtactattaccaaaatatattttttagttaaataaaagtaattttcttttttataagaatttaaacaatagttttttttaatttaaaataataatttgtttatataagaacacataaatccccgtttcgatg

SEQ ID NO: 118834 - DNA, 175 bp, Heterodera glycines
  Promoter: Source sequence=SeqID_9534; Location=2073..2247; Strand=-; Gene=SeqID_71772
atcattgaaagagacagcgcgaagtgatagacaattgctgagcagtgccggagccaattgacgcaaatgccgaaaagcgatggtgttcaaaattatggcacgaattgagtcgcggagcattggccaaatgttcaacaaaacaaactccgaaatgcgaacattttcagtgataatg

SEQ ID NO: 118835 - DNA, 856 bp, Heterodera glycines
  Promoter: Source sequence=SeqID_16759; Location=528..1383; Strand=+; Gene=SeqID_81171
tcgagttttggcaggtcgttttattgctttagcaaatagcccatgatttagggatgtttgttttttagggttggactatctcaactctaaattgtttgttcacacaaacatttgtgcctcaagtgtcttcgtggatgaccgttgttctatcaaaattggcgcctttctccacgcacgacgcattcattcaacgcaatgccatataaatattcaccgtagcttttgattttcaggaaatgggaattcactggcgaccccagccgactccccccggaggctttccgcgtcggaagttcctcccaaaacattgtcagaccgaatttcgacacttgggccattgggctttttgtgttggaaatgatcaccagaaagcaattgcaatacacgcgggagcaaatgcgacaagttgccgaacaatttgtacgcttttttaaatttttcgtttgcaatttgaccattcggtcgccttaagagcgacgggtcggagggaccaccgacgctggcggagacggaaccaagcacaattggggcaaacggacagcaggtggtgattggtatttgatggacatcggtaatgattgtcgatttggttgtttttttgcagctgtttgacccgcacatcgattcttttttggcgttgtgtttcactgccgatccctcaaaacggcctaaaccgacagagttgctgaaccattcgttcatgcgaaacaaatgcaacgaaacgaaagcgagaataaacattggaggcgaataattggggacgacacaacttgaagaaggctccccccttttagttgagccaaaaggcgaagtccaatggaattccaaacggagaagcctccgacttgacatgatg

SEQ ID NO: 118836 - DNA, 173 bp, Heterodera glycines
  Promoter: Source sequence=SeqID_25736; Location=1395..1567; Strand=-; Gene=SeqID_56480
catcattatttaaatatcgtaaaaaaacaaattaattaaataggcaaaacaattgatttttgttttttggtaaataattaaaataaaatcagcaaaaacaattagatttttttgtttatcttaaaataaacattaactatatgttcagattaatttttattggaaataaaatg

SEQ ID NO: 118837 - DNA, 171 bp, Heterodera glycines
  Promoter: Source sequence=SeqID_4779; Location=2715..2885; Strand=-; Gene=SeqID_55685
gaaattttcaattttctggcattttccactttcagcctgctgactggatgactgactgaccagcagggtggacatgccgccatggatgaccggcacgaacatgtgctgcaagcattggaccatccgctcctcccgggtgcccaacgaggtgagaaatgcgagcgcaacatg

SEQ ID NO: 118838 - DNA, 271 bp, Heterodera glycines
  Promoter: Source sequence=SeqID_2780; Location=329..599; Strand=+; Gene=SeqID_81547
acaaaagaatcggcaaaaaagaatggagagaaaaaatggataattattttcacattaaaaaaaaattaaaaataaataaaaattgaaaaaaaataaaatttttggtcaaagaaattttagaggttattttggatgaaaatctttaagtagtcactacaatgtacgattttctgttttatttttcgaaaaaaccattatcattattaagtccgtttcagggcgaaaaattttaacaaatttatgcattttaaaaacaacaaaattcaaaatg

SEQ ID NO: 118839 - DNA, 1003 bp, Heterodera glycines
  Promoter: Source sequence=SeqID_5880; Location=2253..3255; Strand=-; Gene=SeqID_59533
aaaaaaatgtccattttccaaaaattaaacaaattaaaataaatttcgttagccttggtcttgtgtatattttgcaagttttcttttgaagccaaggaattaataaattattttaattaaatataaaaataaatatatttaatttaatcaataaatgtaaagaaaatagaatttccaattgagtagaaaaaacactaaattaagagaaattataatgaaaaaatattgaggcacaatgacttaaataaaaaccaacagtagggaaatatattgtaaatttttttttttttgctaaatttagcttgtgaatatataattttgattgtcatcgtgaatcaatatttaactaatcaatattcaactaatcaatattcaactaatcaatattcaactacttataaaaaaggtatagaaaaataaaaattgagaaatattgtaggcaaggaagagaaaaagagtattctaataggtaatattcatatgtatgcatatattcctgcaggaacatatttataggctttagaatattttttcagaaacaagcaaataaaatatttttgatgttctttgtacagaatcgacatgaagcattttctgatagcctataaatttcagaatttaaatttttttctaattaaaaattatgaaaaaaaacttttataattattgaattttttcactcaaattcctaaagaagactaaaaatttcattgccatgtaaaattctatgctccaaaaaattttaaaagtcattcttttaccagggctcagaaattttgatttttgcgggttctaattcattcgccttaaatattcattcgccttaaatattcattcgccttaaatattcattcgccttaaatattcattcgccttaaatattcattcgccttaaatattcattcgccttaaatattcaatgacaaaaagaccctgccccgaaaccgaatattctccaatttcccaaaaaaatggtatccaccagttaattgactctcaaatg

SEQ ID NO: 118840 - DNA, 1003 bp, Heterodera glycines
  Promoter: Source sequence=SeqID_19537; Location=374..1376; Strand=+; Gene=SeqID_84268
taaaaaatgtccttggatgccaaggacgtccttgaaaatgaacatttagaaaagttttaaaaaaatcaaagaaatttgagaaatctttgtaattttcaacaatattttgattaaattatggcattatgtcatttaaaaatgtaatttttgagaatttttgaaattttatggcattaagtcactagtcactatttttcttaaaaaattagccaaaaatcgcaagttttggtcatttttggacaaaaatctgtaaataactcgcattaaaaattacaaatttttccggacccccctatcctcaaaaaattttttaaaaagcacgccgtaaaaaacccattttataaacaaaaaaagtcgttgcatggcttaaaatcgcaaaaattaggcagtttttggtgaaaatctgttaacaaattgcattcaaattttcaaaatttttccccggcggcgcctgtcggcaccgccagaccccccccccccccttttcccggaaatttttggaaaaagcgcgccgcaaaaaagcgtttttaaagcagaaaaaagtcgtcgtaaatgaagaaaatgataagtgaaaacaaaaaaatgttggaaaaaatccattccggtgaaaaatacaagccatttgaataaatattaaccattttgcattgcatataataaaaattttaaatgtccttggatttcatgaattttccccactatgtccttgcaaatcggcatacccgtccttggaaacggagcatggacgatggcaaccctgaataaaaactaaacatacaaccctaagaatcgtaacatatgtaagtgatttcatcagtgataattagggctgtcaaaaatatgtacaaaaaatgttaaaattttggtatctcctttttgaaaaaaacccgatttttaggggtacatacatattcaaaaaattttatttttttcacaagaatttttataaattttcaaaatttctcaaaaaaattagaaaaaatgataaaaagtccaaaatatg

SEQ ID NO: 118841 - DNA, 1003 bp, Heterodera glycines
  Promoter: Source sequence=SeqID_14162; Location=2146..3148; Strand=-; Gene=SeqID_78167
ttggccaaggcgtacttattaaggggagccgcagcattagcaaagagaacacttttattattggccggaaatttttcaaaatttgcacagaataagttcatattttattggtcgaaaaatttttgaggtaatattttcaggagggtaaaaattttcaaaaatctacccattttttatgttttcgttccttgatccgttgactaataaatttgttttttcaaatccctttttatatgtgcttcaggtactgccccatctggtccgacatcgcaagtcccatttccacaatttgccatgcggggcctccgtcattcttggccgaaatgggtcggtccgatttgctgtttttgtattgattttccatttaattgggacttccggtccatgggatttttggtgaaaaaatttgggccaaaacttgggcgggacctaaacaaagccgaaaattctaacccccacccacctctttttaagtaagatgtgcgaggcaattaatatgtgtaattaggcctcgctgaaacttttgttgggttttttcaatgataataagtttttgttcagctacatttgggtgtcacgccatctgagcgacgacgaggcgagcaccggcggttacttggcggacacgcaattggtgccccgggagacgcgggaggccatcgcacggacggcgtgttgtatcaaattgtagaggacaagtttatttaatatttttaacgattttagattattagccggaaaaaggcctaactaaaattgggggtttcacaaaaaatgggaaaaaccgataaataattaaaattatacaatctttaatgcctttaccttttaactcaatttttcagggttttttaaattttgaaaaaatcaaatttgaaaaacgaaccaataaattataatacaaaaatacacgaaaaattttgtttttttgtcctatttcgtaacactcacaaaatttggtctgacagttggggttgttttgcaaattaaagtattctccatg

SEQ ID NO: 118842 - DNA, 177 bp, Heterodera glycines
  Promoter: Source sequence=SeqID_16224; Location=472..648; Strand=-; Gene=SeqID_80599
acctcctttgttttgtgcttattctttgatttgaaaataaaaatgcaaaaattgaataattttttgaattacatatcatttttttgaagcgaatatttgaattaattcgtttttgtaaaaaattacattttaatttattttcgtgagtgtaattcgtaaatgttaaatgccaaaatg

SEQ ID NO: 118843 - DNA, 171 bp, Heterodera glycines
  Promoter: Source sequence=SeqID_34604; Location=101..271; Strand=+; Gene=SeqID_46397
ggtggaaaagtgggagcaaaaagataaatagaaattgccaagtgttaggcctcggcgggtgggaattgaaccaacgcctaaaccattccctcgtgaacatttttaccactgggctatttttgggggtttctacgggttttggctgcccattcttttgttcctctcaaaatg

SEQ ID NO: 118844 - DNA, 143 bp, Heterodera glycines
  Promoter: Source sequence=SeqID_25669; Location=225..367; Strand=+; Gene=SeqID_56421
ggtatgtgcaaaagccgtggccaattattcgccaattccccccccccccctcccccccccctctctctccaatcgaattgtaagacttggagtttcgagaagttcggaaaactaaaaatggaaggagtacgagcgaatgaatg

SEQ ID NO: 118845 - DNA, 451 bp, Heterodera glycines
  Promoter: Source sequence=SeqID_7449; Location=1..451; Strand=+; Gene= SeqID_64854
aaattatcactctggggattttttagatcgcttaacatctgcttaatgatagtttctaaacacttagtgcttccgaataacataaattttataaaaatttgtagaaaaagaaaaaagttatgaacaaaagattagttttctagaaaattttttccagatgaatttttctcgaaatttttattattttttccattttcaaaatgattgatcagataaacgcatgcactgattttgcagagagcaaaatgcttgggcaaaaaattttttccaacccaaatatttcctatccatttcaatttgtcgtgacggaaatgcacatgaataaaaaaacgaataaaaaaaacgttgtcagacggatgcaaacaacattaataactaaaaaattataacagcaaatcaaaacagttttattcgaaatatatttctgataatttttagattcgaaaaaatg

SEQ ID NO: 118846 - DNA, 155 bp, Heterodera glycines
  Promoter: Source sequence=SeqID_42450; Location=1100..1254; Strand=-; Gene=SeqID_70340
agaattaccaaaagaggcaaatgtgtattcacatatttctttttgggcaatgattatccttttcggattgtccgtgatccgtctaattatctaccaatttcgctcaattctttggttaaaattcactttgacggaacggtacagtaagaccaatg

SEQ ID NO: 118847 - DNA, 128 bp, Heterodera glycines
  misc_feature (26)..(26): n is a, c, g, or t
  Promoter: Source sequence=SeqID_35889; Location=1..128; Strand=+; Gene=SeqID_65343
tgaatttagaaaatattatcatgccncggtggtacagttactgcttgaaaacggcgcagacccaaacttaccgggtgaaaaataattttggttgagattttctgtaattaatttgtcagatttcaatg

SEQ ID NO: 118848 - DNA, 856 bp, Heterodera glycines
  Promoter: Source sequence=SeqID_12721; Location=851..1706; Strand=+; Gene=SeqID_76415
atttcgacagtaaagcttattttttaaaaacttgctcataatggtatgagtctagttaaattttgaaaagtaaaatgataagcacaggttcacacattgcagagtggtttgcaattttcgaattcttctacaagagcctgcagatttgcatcttggcactcaaacccggcattagttagcagatgttcgcacacgatttcgagaatcttatatataagaaatttttttgtcttttggactatagtcagcacgagatgtttgtacagaaaaagtgaagcgataaatcttttgacaaaaataatcatacaagtcctaatttattttgcttcaattataaattttgtatatgcaattgtatgttataatattaattcataggttcaataaattatgtaaaaagtaattaaaaagtactgtcgaaaccaatcactgtcgaaaacacctggtacgattttttcaacattttgactcattttagcctgggcgacatttcgacgcagcgacattttgacgggcagcggcaccgcccgaccccccccccccccctccccccactcaccggccttgtatatgtgcagtcatttcaaaaataaacccttcaaaatggaaaactgggcatccttttgttgcaaattaataggcccgaccatttttttcaaaatttatataaaagacaaagaaaattaacaatgactaccattcacgacgatattaaaatgtgttttcttgtgaatgttctacaacttaatgtcgtcccctctttttttttaaattcttcatgttttttgaagaaaaataagccaattcaactggaaagtgccaaaaactatcgttaataatttgccacaaaaaaatg

SEQ ID NO: 118849 - DNA, 218 bp, Heterodera glycines
  Promoter: Source sequence=SeqID_20637; Location=1..218; Strand=+; Gene=SeqID_51189
gcttttaaaaaaatattttggcttgtattttttaatttgttgatgtgtgcttctttagttttgtgtgtctgcggtagggccgaaacgcactttttttcttattttttgttttcttttggaagagcaccgcactgacgaggcccactcttccattagaaatttttataacaaaaaaaatttttttcatttaattttttctcaggaattgtccgcaaatg

SEQ ID NO: 118850 - DNA, 510 bp, Heterodera glycines
  Promoter: Source sequence=SeqID_16833; Location=1595..2104; Strand=-; Gene=SeqID_81254
tgctaatgatgccttttgccgtaggtcaacattaataaaaattctttgaaataatgcctttttaccacttcaaattaatgaaaagcattggaattgcaccttttattggtcatatgttttgcttctgattacaagacgatttgtaatgtgtccagcggtgtataaattacaaaaaatgttttgagaaggtttttctgattgatcatgttcatctttcgtcgccaatcacattgaaaatccgttgccgcggcctccaaatcttcgccattttcccgttggtttatcggcgtccccatccccaacctttgaaaaaagaaattattcaaatgctaatttgttgttttatatctgcccaattaacaatataaattggcttaatcacttacaattaattttccaggcatttacgccccgccccttttgcctaattagatctcattttccggaccccttttagtctttttaattgcctgttgatgagtggcaattaataaaagcggataaaaaatg

SEQ ID NO: 118851 - DNA, 405 bp, Heterodera glycines
  Promoter: Source sequence=SeqID_23131; Location=816..1220; Strand=-; Gene=SeqID_53837
tccttttttcattttccgttttcccctttagctcttccctctcccctccattttccatgtgttcttctccccttctcttctcttccttcttcctcttcctccctctcacttccgcgttttattttggtgagtcatcctttcctttcccatttcattccctcccttccccccttcttttgccttcagttttgactcgttattcgcccctccaatcagctttttctctcggtagcggtgatcgctttcttccgtcaatttcgcccaaagaagtgaatccctcggacagagaatggaccgtcggaatgagcactttgggggaggaggggccaattggaggggccgaaaattgggcgaaaaaaaggggcggcggaaaaggggcgacggggaaacgaaccgcgggaaatg

SEQ ID NO: 118852 - DNA, 277 bp, Heterodera glycines
  Promoter: Source sequence=SeqID_27219; Location=594..870; Strand=+; Gene=SeqID_57904
ggtaaatttggtggtactttacttaattataatttatttaattattaattattgaaaataatatttacttgttttattgcctcaatttttaatttaaaattattatggaaggcactcgaccggtcctaatttgtcttctggtttttaacagattgccaaaataaagcagctaattttctcatagatgtttaaaattgtctttaattaatttttttttgcattttccgtaaaatttctcctttcactatttattcaaaatttattaatttttaggatg

SEQ ID NO: 118853 - DNA, 291 bp, Heterodera glycines
  Promoter: Source sequence=SeqID_32917; Location=867..1157; Strand=-; Gene=SeqID_63142
tcccccccgtttcccttcatccttttcatcgtctttgctcccttcaatccctttatttcccgtcgttccctttgcttccctttccctttcaatcatttaccttattgctttggccacttcgttcgttcgttcccttttattttttcttttctttcttttttttttgttattttaattcctcttaccaggacgtttctattaaagttttgtttatagaattttgggactgtgctgttattctcatttcccctatgattgcctctgaaaacaatcacttagaagcccaaaatg

SEQ ID NO: 118854 - DNA, 528 bp, Heterodera glycines
  Promoter: Source sequence=SeqID_1938; Location=1..528; Strand=+; Gene= SeqID_76912
caagccaaatggtagacaaaatgactcgaaacgccaaaatagggtagtgatttcggcatataaaagcacgcgacattaacattttccgccatttcatcgcgtcttcgtcttccattttcactattatcgccatcgcacattcgtcgtctccgttcaaccgcgctgattcgcacgggcaatatttttcacgtaaatccttttaacatctttgttttatttgtgattgcaacgccatgcttttaagttcaattccccccccccccccccctcccattttagagtttttttaagaagtccatcattccaccgggttttcaaagtcactttttactatttttcaggaagcacaccccctgaaaaatattttgcacaaattctgcatcagatttttccttttttcaaaaactgattttttccccacaattaaggcagatgctgaacctcccgctgctgctgatgctccggctgatgctgttgtggacaactttgagacgcgcactctccgcttcttcgacctgatcaacgatg

SEQ ID NO: 118855 - DNA, 60 bp, Heterodera glycines
  Promoter: Source sequence=SeqID_5448; Location=4444..4503; Strand=+; Gene=SeqID_58086
ttcgccgatggcacatcgacggaacgcttttcggcaacggaaagcgacggaagggcaatg

SEQ ID NO: 118856 - DNA, 179 bp, Heterodera glycines
  Promoter: Source sequence=SeqID_3154; Location=1..179; Strand=+; Gene= SeqID_83450
aatccgtgaagaaatttctgtttggcaagcagtcctttctttttaattaaaaaaagttacaatttatttttaaaataatttcctatttaattgtaatttatttttcggcactccgctgggccgacgaaaagtgccgtgaaaatggcattgaatgttcagcagagaatcgccgtcaaatg

SEQ ID NO: 118857 - DNA, 56 bp, Heterodera glycines
  Promoter: Source sequence=SeqID_25002; Location=1..56; Strand=+; Gene= SeqID_55739
tggagctgtacctgaaggcctacgagcggaagaaaccaagcctggcccaggaaatg

SEQ ID NO: 118858 - DNA, 207 bp, Heterodera glycines
  Promoter: Source sequence=SeqID_6762; Location=4163..4369; Strand=+; Gene=SeqID_62796
agaacagagattagagagtgccaattattgtgatataaatgctgtaaatatgtgataatcaactattatttatatactgttttttgtatacacataatattgattgtactctatcatatgaataagtatgtagttcgaattctctacttttttaccaataatttttctattttaaacatctttttgttgttgttgttgcagaaaatg

SEQ ID NO: 118859 - DNA, 1003 bp, Heterodera glycines
  misc_feature (1)..(1): n is a, c, g, or t
  misc_feature (5)..(5): n is a, c, g, or t
  misc_feature (7)..(8): n is a, c, g, or t
  misc_feature (18)..(18): n is a, c, g, or t
  misc_feature (28)..(30): n is a, c, g, or t
  misc_feature (35)..(38): n is a, c, g, or t
  misc_feature (42)..(42): n is a, c, g, or t
  misc_feature (46)..(47): n is a, c, g, or t
  misc_feature (54)..(54): n is a, c, g, or t
  misc_feature (62)..(64): n is a, c, g, or t
  misc_feature (68)..(68): n is a, c, g, or t
  misc_feature (75)..(76): n is a, c, g, or t
  misc_feature (81)..(81): n is a, c, g, or t
  misc_feature (90)..(90): n is a, c, g, or t
  misc_feature (101)..(101): n is a, c, g, or t
  Promoter: Source sequence=SeqID_14414; Location=2478..3480; Strand=-; Gene=SeqID_78452
ngaangnntaaatttaanattttttgannnagaannnnattnttannagtgtanttttggannnggtngggtaannggaanccggccaancctaattttgntaacaatggagcacaatcatttataaatttattccacaacattatgacaaaattaaatattaatcaaaattattaaaccatttattcgaaaaaacttttaatgttttacacaatgtctattgcattttcctaatacataacaaaactgtgacttccttccgttttccagtccaaattaactgcatagacataaacaaacgctgtggtattagtgactctttgaccctttatttgattgtttgaatttgtttggcataatgtttattggaattcgaaccaaatattttggttttcttcaagggtgggtggatttttggttatcgtcggtggtattttagccgttttgttggtcgtcgatttatttgtgtttttattaatttgttgttgattgaattttatttattttggattgtcttttaattatttgttgcataaatttattttgtttggtattggatttttaaagcaggttttggccaattcatagactatttgtgcaaaatttagaagcgtggcaaagaaacccccgacaaattgattcttcttttccaacatggcgctcctggtaacaaaggttagctaggtggcggacggcttggtttttcttcagtgatatttcttatatttttttttaaagcaactaatttggaaaaacactcgtgttgggttcatcgactgcttgtcaaatttttaataccctcgtgttgggtttatcgactgttcttcaaatttttaataccctcgtgttgggtttgtttttcttcatccgccttatttggtccacttttacaacttatcgtcgaaagcactcgtgttgtgctacaccaattaaattttgtaaaagctcgtgttgctttaaattggatttttgttttatctcgtgttgataaaacaaaattatg

SEQ ID NO: 118860 - DNA, 55 bp, Heterodera glycines
  Promoter: Source sequence=SeqID_12905; Location=1..55; Strand=+; Gene= SeqID_76646
agcagttgctgtgttgaggaatcaactgaatactgcagttgagcagcagccaatg

SEQ ID NO: 118861 - DNA, 65 bp, Heterodera glycines
  Promoter: Source sequence=SeqID_38715; Location=393..457; Strand=+; Gene=SeqID_67445
ggtaattaatgagagttgccccttaaaaatcgctaattaaatttatctaaaaattcagtgacatg

SEQ ID NO: 118862 - DNA, 382 bp, Heterodera glycines
  Promoter: Source sequence=SeqID_44413; Location=352..733; Strand=+; Gene=SeqID_71898
ttggccattatttaatggcttgaggtgacgtgcgcttaatgttatttgcaattattacgaaattggcagcctcatttatgattcggtcgagtttttgtgaagtcaaaattttttgtcactttaatactcccaactccgggttttcgattttgggcatttatttattagtgattttaaacaattaaaatttgccaaacaaagggcacacgatttctgctttgctatgtcacgaatagacgcaaatatttaaaaattttcttttctgtaatagatttttcaatttcaccgtaaattccttaaaaaatcgttttttccatattaaatgatcaaaaagatttattttattcaacaaacttataaaagcatttaataaattacaatg

SEQ ID NO: 118863 - DNA, 774 bp, Heterodera glycines
  Promoter: Source sequence=SeqID_20818; Location=1..774; Strand=+; Gene=SeqID_51399
cggggtggcggaatgggtgggaggacggggaaattgggagggagagagacagagaagaaaaaaagaaatagaggaacagtgagagagagagatagaaaggagaaagagagactgattgtgagacagacaaaagaataactggtcgagagcataacgccaaaatgaggggggaaggggatgatttatttttgtgatggcagaagcattgcggagtttcaagcctcggttggggagattttttgacctccaaaatttggggagagctcaatgagactggtaactatttcataaatcctggatatcagaattttagctaataaaaagcttttatcaatatataaatatatttaattgaaaagtattacgtaacagtcaaacaatttaattgatttttaatcataaaaaaatttacactcttattaacgcgcatttaaaaaaaaaattctgttagtaataaatttggcctttttattttaaataaaaatgaaagaaatgaaaatcgaattttaaaatttttattttattctctaatgaattaaaagaattttatggcaaatttacggaaaaaaagaataataattttgataggaattttaacagcaaaggttttcacaaacagtgaattaatggaggaggcggaggagaaaacggacaatttgaacaaaaaaggcaataaattcgccctggggggaaatccacggaaaagcgccgaaacgcaaaatcaattgaaccaacggacggacgaccaaagaaagaaaggaccaccggcggatg

SEQ ID NO: 118864 - DNA, 1003 bp, Heterodera glycines
  Promoter: Source sequence=SeqID_2985; Location=995..1997; Strand=+; Gene=SeqID_82641
ggttcaactttttttaattgcttcaaatttttgaattgtttttcttttctgttgatcatttggttctccatttgtgtttgattacttttgatattattctgatcattttgcatttgagcaattgattcgataccattttcttacttggcatattgtcccattttttgccgaatatttcatcaaaatttggttggattttgccggattccatcttattaattaagaaaaataaaaaaatattaaaagccacaaattcatgtatagtattcagaatactaatagaatgaatttatttattggctttttaatattaatattcattttattatttattttatctttaataaatctttttccaacattaaaatgtcacgtaattctgagcaatgcaatcaatttttcactcagatcttaacaaatttttttttttttttttgcaaacaaagttaatatgacaaatatttatatttttgaataaaagatttttactaaaatatttttttctgaattttttaaaagtaattggatcgcatttgttttttaacaaaattcttttggaatttcagaaaattttcaaaaatttcttatggcggcagctttggcaccctgccggaacactaatttattttgatattaatattgaattaaaaatccataaaattgctaatttttagtcgaatttctttttttaattaattttaaacttttcggaattgcccatttttatataaacctattaataaattatacaagattttgaataaaaaattaaaatattttaattttaatgctttttgatgcttggcatttttttaaatatatcatttcttctatttagtgatgtcattttgaaaaatttttccgtgcgatctccgggtgaaaaatgcgttaaattttttacattttggtgggaaaacaacagcaaaatgaagcagaaataacgacggacggacattcttttgacaaaataaaatgaaaatggtaatgataattaaaatgaatg

SEQ ID NO: 118865 - DNA, 1003 bp, Heterodera glycines
  Promoter: Source sequence=SeqID_22973; Location=287..1289; Strand=-; Gene=SeqID_53672
gagagaaatgattagagaaacaggaaaaaagagagagaaagtatgggagtgaatgagacagagacaaataagagagagagagataaaaataagagaagcgagagagaggggggagagagatagaaaagaggagagagagagagagatagaacagaggagagagaaagaaaaaaggagagagagaaaagaggagggagagaagaggagagagagagagaaagaaaaaaggagagagatagaaagaggagagagagagagaagaggagagaaaggaagagagaaaaagagaagagggagaaagaaagagaggagagaatggagagagagagagagagaagaggagggagagaagaggagagagagaaagaaaaaaggagagacaagaggagagagatagaaaagaggagagagagagagaaaagaggagggagagaagaggagagagagagagagaaagaaaaaaggagagagagagaaaaaaggagggagagaagaggagagagatagaaaagaggaggaagagagagagagagaaaaagaggagagggagaaagaaagagaggtgagagagagagagaagataataaattttttcaaagctcggctagcgcgaggtgcgcgagcgaagcgagcgcgcctgcgctagttcttaattaattcctctgccctttttttcagttcgccaaaaattatttaaaaaaagaattctttcagatgtaagttcaaatttgcggatcccgctgcgggattgtaactcaaaacttagaacgttttgtttttcgaccccttattctaaaagagggtactttcctgtttaggcacaccccattttttaaaacattttttaaaattggggtgtgccttcaaaacaggaaagtacctaaaagagtgcaaaaaaacacttaaaatttatccgttgatagccgaatgtttgacattataagtgattgtttttacagaagtttctgtttttctcaattttcttatacttatgcagagaatg

SEQ ID NO: 118866 - DNA, 369 bp, Heterodera glycines
  Promoter: Source sequence=SeqID_31775; Location=848..1216; Strand=-; Gene=SeqID_62075
ttgtttgttttttttacctatttaggttctcattttccgtttttttataccaaagaatgacctcagttataatcattaaattaatcactattttagcatttctaatgctgatttaacacaccaaacataaattatctaaattagcatcacaaaaaatgggaaaaatatcagagaattattgacaaatcaaaaatggagtcccattttatcgttatgattcattgtccgaattgaatttgtccgtctcatcccagcagcacatttttgcttccattggacagtgtgtgcacagaatttaattgagtcgccgattaagccaaattcattttaatattcattttttaaataatataaaattggagaaaaatg

SEQ ID NO: 118867 - DNA, 124 bp, Heterodera glycines
  Promoter: Source sequence=SeqID_25176; Location=796..919; Strand=-; Gene=SeqID_55906
ttttcgtaccgccgttttcgtacgagtgagtatggaaaaaattgcattcaaataattttgttaatctttaagtaaaattatttttaatgttttgacaatttaagcttttattaactacaaaatg

SEQ ID NO: 118868 - DNA, 74 bp, Heterodera glycines
  misc_feature (64)..(64): n is a, c, g, or t
  Promoter: Source sequence=SeqID_14293; Location=2632..2705; Strand=-; Gene=SeqID_78316
ctgaagaagatcgctttcacaaaaatggcaaaatgatcacaagaaggggcacaattttgcactnccaaacaatg

SEQ ID NO: 118869 - DNA, 104 bp, Heterodera glycines
  Promoter: Source sequence=SeqID_9055; Location=1019..1122; Strand=+; Gene=SeqID_70121
tggccgagaggagagtgttggccttggggaaacccgaaaaataaatgcgaccattggcacgatggaggaaacgagaacggcatttacggacaaaatgccaaatg

SEQ ID NO: 118870 - DNA, 677 bp, Heterodera glycines
  Promoter: Source sequence=SeqID_4942; Location=916..1592; Strand=-; Gene=SeqID_56302
tttgatttgtagctaaacagacattttaaagttatgtttatgtatatgattgacaaacaaaagaaatttataaaaagtaattaatttgtgggtgaaaacagctaaccagactaaaacgaccccctgactaaaacggccagactaaaccgaccctctgactaaaacggccagactaaaacggccagactaaaccggccagactaaaccgacccctcccgatttattttttatttaaacataatgccaaattaaaattttaaaaaaaggaaaaaataccaccgctgccgagtaacgaggaaacggctaacaccctgctggagccaaaaagacggcggcattaattggacggaaatcgaggggaccgcttttttgttaggattactgactaccaaattaaataaacccaaagaagaataaaagcataaatggttctttaagaaatcttcaacaattattttaaattttggtttttacctccatgttctaattttgtaattttttgttatttctacaaaagtataatttgtttgacacatacaccttctgttttttacaggccttattttcacttctctgttaaatttctattgaaatggataatgaaaacttttcttcctcaaactccaaacagcaaagcagaaacggtggtggacgcgtcggttcacccttcagaaatg

SEQ ID NO: 118871 - DNA, 641 bp, Heterodera glycines
  Promoter: Source sequence=SeqID_10063; Location=1..641; Strand=+; Gene=SeqID_73130
aaactagtcacgttctggtacaaaacagctacaaattcttacttttccgccccggcgctgaaaatgtataaaataacactggagaacaaaattttgacccgaagagcaaaaaaaaaaagtgtttggattcctccctccgattttttttctgactaccggcctgggttgacccccacctccccttttttcatgtatgataattttccaaaaatgcaattttgagtagcgctacgaaaattgtgttctttcacatataaagatttgtgagaacttaaatctttaaatttaattttttattttaatttagaatttttgatttctatataaataaatctttatttaaaagattgaagaaatcgttcaatgaattggaccgagaatcgctggccaagaatcttgcatttacagcaggtagcaaaacatactaacgaataatcaaatctattaccgattgatccttttctttcatagtccgtctcgacagtgatggtgttgacaaaatacagaactcatttttgcgttatttggtccaaatggaattggccaaaaaggagcgagaaacgaaaatgtgtgattcctttttttaatattttgattgaccaagctaaactatttccatttccaggcgtggaattccgatg

SEQ ID NO: 118872 - DNA, 831 bp, Heterodera glycines
  misc_feature (62)..(62): n is a, c, g, or t
  misc_feature (65)..(65): n is a, c, g, or t
  misc_feature (69)..(70): n is a, c, g, or t
  misc_feature (72)..(72): n is a, c, g, or t
  misc_feature (79)..(79): n is a, c, g, or t
  Promoter: Source sequence=SeqID_30912; Location=1..831; Strand=+; Gene=SeqID_61284
cccgttcccgattcgtacaattgagtatcgtataatttccttcgaggtcaatcaagacttanaanaagnncnaaaaaanactttaatagtttctactaattttttcacgtttctttgaaatttttcccatatttttatgaaaaaatctgtcttaaatgagaatttaaaaaaaattttgaaatcaagtcattctacgaatttccatttgctctcgaggtgtcggagctcaaccctgaaccaaacaaataagtagaaatgataattatatatagaatggctaaaaaggatcaaaattaaaaccattagtaatacgtacaaaaaattttgctttctaccaacttctgaccctagcagatggtggccagctgcaagccgtggtgtggggatgtgccgaaagtgacaatgccaacatttgcaccgaatttgaacagcaattaaatgctaagcggatcaaacatgtgtcctgtgaatgcctttttggcgcccggggtgtcgatttttcaaatcaaaagatgatggtcgaccatttgtttctgccaccgtcatcatcattgaccacacttctataaatgccggttaatatatggacaagctggggaagcctttgagggaaaaactattggactggtcgaatttgacgtggcatctcgggcttcaggaccaatgttatttcatcagaacaactgacccggccctcaattatataagaccaattatctccttaattgaccttaattggtccattaatttaccgcacgggggaatcttcttcttaacttttgttataactattgttattacacagcaactcgtactaccgctaccacaatg

SEQ ID NO: 118873 - DNA, 183 bp, Heterodera glycines
  Promoter: Source sequence=SeqID_43589; Location=1..183; Strand=+; Gene=SeqID_71224
cctttgggaaagtatataaaagcaatttatcctcaatgagtagaatgaggtagtaaatataattattcacgattgtaatcaattttcgcagttctcattcatcttgatattttcattagatccgactaaatagcttatgagataatttgggttatcataaaatttcaaatataattagaaatg

SEQ ID NO: 118874 - DNA, 219 bp, Heterodera glycines
  Promoter: Source sequence=SeqID_8182; Location=1097..1315; Strand=-; Gene=SeqID_67226
ttttgcatccttcttaacattgtaataaacaaaacaaatattaatttcaataataatgaataaaatgataaattgatacaaaattctactataattatttttaaatttatttttcatttatttccaataattttttatgttattttacaaactcttagatttttattgttttttttttttgcatttatatttaattgtttattttttcagaatatcatg

SEQ ID NO: 118875 - DNA, 744 bp, Heterodera glycines
  misc_feature (54)..(54): n is a, c, g, or t
  Promoter: Source sequence=SeqID_37576; Location=1..744; Strand=+; Gene=SeqID_46522
tctcttatttgaatgaaatttaattcctttttttttggtcaaaaccgacaaggnttgtttcacgacccttccaaaatctcagaaaaaacgccacgaatcgcggtccgctccacccctgctgatgtcaaattaatgtttaccccccactaaaaaccttacatacgagaaattcaaataatcaagtgaaaaaaaaagactcactactctcatccgcgatgtccttcattccctgtgtttgtatactattttccatgctttactttgttaacaaaatattccgagagtgaataaagtagcaaaaaagtggcttttacatacgtgacaatataacgtaatgaaaagggcatttgttttcacagagaagtaaaacttctttattaagagatcataatgggacaatagatttcgccaaacaacaatataagaaggaatgaaatatatattgaaaatttaaataacgctaaaaaaaattttatgaaacgaattttattttaatttgtattgaaaaaaaagaatttttcgtggttttttctttagtaagtttctgacagtgacagttatgttttggttttttagttttcaaacaaattcttttcacttgcatttacggttttttgaccattgaatccttttttcacgatgttttattttattttgataatcggtcttttacattttttcattccttttcaagaacttaatttgaggattacattggaaataaattaattagacttcaaaatg

SEQ ID NO: 118876 - DNA, 507 bp, Heterodera glycines
  Promoter: Source sequence=SeqID_16934; Location=2073..2579; Strand=-; Gene=SeqID_81365
aaaagggggggcaaccagccatcggcaattttccttcggaaaaaatatgtttttttgtgttttacaaaattttaaatttggggttttttttttttttttttatagctcggcgccaaaacgtcggcgccaaaacgtcggcgccaaaacgaccctggcgccaaaacgatgcggacccctattttagttaactatttcggggattttttttcactaaaattcacgccctactcattatacacagcgtccggaaaatgagctcctgtaccaaaaactaaaattcgggtggggatcgttttagtctggcaagctgtttttattccacataggtagattgtattggttatttggcattttccgcccctcttttatactcaatttttttcaattccttccagcagaatcggatgtgtataaaaggagccgtctttccctccgctgcacatttctacttcttctgtcaccacactccaaccaccgaaccgcttcagtgcccaacgcaacgcaatg

SEQ ID NO: 118877 - DNA, 1003 bp, Heterodera glycines
  Promoter: Source sequence=SeqID_5444; Location=2743..3745; Strand=-; Gene=SeqID_58065
ggtgattaaaatttgctgaaaaatgcagcaaaaaccaattaaaattcgtgtggtttgtttcgaaaattgtttttgtcaatttttctatagtcttcataacccgtataattgagatgataattaattaattaatagttaatatagtagtgaataaattaatttctaaaactaaatatatttatgattttttatgtgatcagtagaattataatttgaattatgaaaaaaaaaattattttataattattttacttattgacaatattttggtaggctttagactctaaaaaacccataaaaaaggcaaatggaaaataggctctaaaaaggctcattagggatataaaatgacaaatttttattcacaaagcaataaaattaagccaaatcagtatctcgtcaataaaataaataaataagcttttgagacgaatttttgggaaagttttttttcatttcttaggggtgcatttttgaaaatttagggtcaattcttaggggggtgtctttttctgaaatttttggggtagattcttaggggtgtacttttcttttttattgttttttaagaaattctccaaaaaatgtcaaaataatgaaaaaaaaagtcagaaaacgcaaaagtgaattttcattatgagaaaaaaaggagcacagttagttcaagttctttaattttctattaattaaaaaaattacaattactaaagaatatctgttttttcataaaaaaaactcaaaagcctcaaacttcgcccgaggctttgatccaatttttattgtttttttgtgaatagacaaaaatgcactcttatgcttccaaagtttgtaattttttgaaaaaatttcacagttacaaacaaattgattttttgtgagatttcttgtactaattcaaagcaagcccccgcccccgcgaaaagccacccccgcgcacggagctcgaaccctacttcgccccatcggctaacaaaaaagcatattttgccaattttaaaaaatg

SEQ ID NO: 118878 - DNA, 1003 bp, Heterodera glycines
  Promoter: Source sequence=SeqID_10750; Location=2586..3588; Strand=+; Gene=SeqID_74000
ctcctccctccagactcctcataaatttaggttgtctttacattaatttacaatatttgcgagcgtattccagttcttaaaacaaaaacggggtggaaggagaacaagaggtagtgtgagaagtaaaagatggcccagaatatgcaaatacgaagaagcaaaataaaggttattgacaaatgaaaaattattaattaaataaaaaacatcaaagagaaaacataaaatataaataaaaataaaaattagcatacatttgatttaacaaatcggaaaattctaattttcaccgatctaacaaaaaaaaattccgctgttaaatgagattaaaagaattaaatgtagaaaaaaataatataaaaaataaataaacaatataacttttttcaaatgtaagctaaaatagaacattatataatactcgaaaatttacaaaaataaaaaagcctgaatcgaaaaatatgtaaaaatattaaatgaatcaaagtttaatttctacgatttaatgtttcgaagaaaactgattataaaaacaatagctaaattaagaagatgttgataaaaacaatgagtctctctgcaaaaatgcgggtaagctcgtcaagaattatttcatcggaaagcaaaaatcttaactatataatttaatgggttactattaaaataaaaaataagtagataactaactatattatatgatatatgaacaaatatagataaaaattaattaatgaagaaaaattatggcttagaaagaatgagagaataattctaaacgcatttttaatgtattatagatatttatatataaaactcgaagaattattaaaaaaaatcaatattaatgtaaatttttaacgaaggtgtataaacccaaccttatcaaaaattataaaaaatttatcattattttgaaaattcttcaagcatatttgaaaattacgtaaattttttaaattttcaaagtagaaaatgttggttccaggttcgaaccctcagcatg

SEQ ID NO: 118879 - DNA, 102 bp, Heterodera glycines
  misc_feature (94)..(94): n is a, c, g, or t
  Promoter: Source sequence=SeqID_21033; Location=1..102; Strand=+; Gene=SeqID_51616
agttgaagtgtgatgagagatttctattttccgctgtgctggaggtgcgcgtcgatgtttagaaggagactacaagatgtggccacaaatgccnccatgatg

SEQ ID NO: 118880 - DNA, 381 bp, Heterodera glycines
  Promoter: Source sequence=SeqID_19236; Location=1494..1874; Strand=-; Gene=SeqID_83980
gggtactgagtattgagacagtgcccgtgtgttatatttgcatttatgtataatatgtaggtattttttgtaataatttccttattttgcatatttggtacttatgtgtttaaagtttcattctttctagcaatttttgaatttttgcatgattccttgtatgtggttctataatattttattatgttctctagaattatttactgcacataaataagttatgctggcatggagcggactcgtacctgcacttactacccaatttatgtgggtgttttattaattgcttttaatgaaagcacttaattcttaagtagcctttcatttaatttctaactaataataataataaaaaatcatatcaattttattataataatg

SEQ ID NO: 118881 - DNA, 53 bp, Heterodera glycines
  Promoter: Source sequence=SeqID_28329; Location=1..53; Strand=+; Gene= SeqID_58958
ctttgcctgtacacctacaaggtgaacatatttgttattttgatgagaatatg

SEQ ID NO: 118882 - DNA, 333 bp, Heterodera glycines
  Promoter: Source sequence=SeqID_11112; Location=1761..2093; Strand=-; Gene=SeqID_74453
ttttaggatgcttatatttaaaattaaatttcaagttaattacctttttttaattgatccttttttggttagtatttttaattttggaatattaattgacaaaaagattttttaattaaatttattaaataaaatattaaaaataataaaaaataaataaattcctcacaaagctcagggtttcctgcattttctaatatttttataactcaccacataagaatggtatttcaattttataatttaagtcctctttcatgttcaaaaaaaaatttctcggctttatccaatgcttctgagcaaattcatttaacacattgatcagccacaatg

SEQ ID NO: 118883 - DNA, 1003 bp, Heterodera glycines
  Promoter: Source sequence=SeqID_18897; Location=919..1921; Strand=+; Gene=SeqID_83606
gaatttttccagcattgatttcggccgcaggccattttctggcaatcatgtcttttactggtcccgaaaaaattgttttttaaacttttctgaaaattctaataacacatttcttggggggtattttgaggtgctgagtacgaatccggcctactttttggcgaattccgaaccctgaacccgagttcgaacattttcgaaaaaattttttgtgtgctaattgacttcatttcaattttaaattattaatttctgtggcgtttcgtatatttttaagagactcaatatattttgtgatgtttttggttgttgttttatgatttaattttggagagaaattgtgctggattattttattttgtttgtcgtcgctattttattttgtttggtataaatttatttgtgttttgttttgttttgtaaagacagatcgcagagaactgttgacaatcaccgttttgacatttgaattgggaaaagtggacgcaaacaagcttttgttttcaacttttgttttgaaagccatgaaaacacatttccaagggttttcggggtaactgttcacgaatccggcatccatttcgaacaattcacgaaccccggacctaaatttgaataaaaagtcgaaaatttaaatactccgaattttaaaaatggttaaaatatgtaaataattaatgtcatccatcaatgcttcaataaaaaaatcatttaaaccacttttaaatttttaaaattaattccaaaaaattttttcgaaaaatgttcgaattcgggttcggggttcggaattcaccaaaaaggaggccggattcgtactcagcgcgtcaaaacacccctagaaacatattattaaatttttcttgaaaactaaaaaattttgttcgggaccagtaaaagacatgattgcccattttctttagtaatcttttttaaatttttcaggccaataaatactaatagcctcttgaataatatcatgaatattttattttgagggatg

SEQ ID NO: 118884 - DNA, 127 bp, Heterodera glycines
  Promoter: Source sequence=SeqID_37995; Location=119..245; Strand=+; Gene=SeqID_46543
ggtagagcattttggaaaaataacaatagataattgattatttcctttaagtaaaaattggttagacattggtattcctgccgagcgtatcctcccatttggaatgaaagacaatttttgggaaatg

SEQ ID NO: 118885 - DNA, 1003 bp, Heterodera glycines
  Promoter: Source sequence=SeqID_4178; Location=403..1405; Strand=-; Gene=SeqID_53481
aaattaacaaaagggcatttcaaaaattttaactttgaattcgaaaatactaatatgctaataaataaattactgcatttttataaaaaaaccattttaacaaaaaattctaatttgtttataaaattgttactgaattcttagacttatgagggagggccttttcgcagaattgttttcgctagagaatgaatgaattggtcatccgccgttgttgatctcctttttctttgagacgttaataactcacataatcaatcgcagcgccggcggctatgttttttgcatagacatgaccaaataaatagtgggaagcgaccacataactgcaaagatcaaggggaactttggtgttgatcagcaaagtaaataattgagcagagatcactcattccttcacagtgactgaacccaatctgcgatacacccccaaaaatatggatcaattattcgatagtaattacctactactgtaggttggacctttcataagaattactgtgtcttttgggagctgtcatctcgtatgtgtttctaggaattgacacttttgaaagtcattacagcagaatttgcactaaaaacgatgaccatatttataaaattggtactcattttttgcacgttttttgccattatcgtgccttttggtttaattaaaatacttaaaattcagtttcttcaaaatgagaacattttaaataccattaaatcttcgccactgtttaacaaataatttttcaagtacaaataaataaatcggaaaaagggatatgtcatttaattaagtgtgtatttgaagttcggtccaaaattggcctccacttcgtctccggggttgttcaaggaaattgccggatataaatcgtcggcgtcttttgatgcgaagaagaaattggtatctgattgtgagaagggatgaggggggggataattagtattttatttttcgatttttaattaatttatttattttcccaccaaacaattcgctgccgtaatg

SEQ ID NO: 118886 - DNA, 992 bp, Heterodera glycines
  Promoter: Source sequence=SeqID_14477; Location=1000..1991; Strand=+; Gene=SeqID_47206
ttgcgaaaacggcgagcgaattgatgtgaagaacggaagaacgaacgaacgatgagaaacggcgatgaggtcgcttttgaagtgttgttgttattgcacaatgaagggatgatgatgataaacgcaaatagttctgttctaaaaaaggaaaaaacataaaaacaatacataatgaaatgaattataaatttaaaaatagggaaattgcagtttttgtaaaaaaaatttgataaatttaggttcaaatttggtagtataggccagggaaactctgataaactttcaggtcgatgtcgataatttttggaattcgggtttggtatttactatgtctttttgaaacagtgaagtttatgaaattcacaaactgaaaattgacgaggaatcagaaaaacagagtaatcatccataaaagaaaaatgagtgaatgaaaagggaggaaaagggggcacaatatttatagtacgacgcaacaagggagggcaaaagttaggtaggtacgtaggtaggtaccattgcccaaattccaaggttttctctctatataaggaggtgttttctcattggactgacattttttgcattacgcctatatgcttttcttacttgttccctcctctattcagtccttaatgttctgatttaattttttgtgttacagagtacgcaaaatataattaacccgaatgtttccaattgttttttcaatcaaaattgactgtttctcacagaattttcctgctggacaatctaaacttggaatttaatcaaaaaaacacaaaaaattgcttttccctatttttaaaatttataattcatttcattatttatgtttttatgctttttcattttttagaacacaactatttgcgtttatcatcatcatcccttcattgtgcaacaacaacaacacttcaaaagcgacctcatcgccgtttctcatcgttcgttcgtccgtccttcacatcaattcgctcgccgttttcgcaatg

SEQ ID NO: 118887 - DNA, 413 bp, Heterodera glycines
  Promoter: Source sequence=SeqID_8062; Location=1..413; Strand=+; Gene= SeqID_66853
gatttaggttttttttcgccaaaggtcgaaacaattgccaccattagtgagccattatttattactagaggtaatcttctttacagacgaattatcgaaacactgagcactaattcataaaaaggaaaaaaatttgttccataaaaatatacaaaagggaaaacaattttaaaaggaccaacggatattgaaaaaattcgggaagaatttgagcagaaaatgtataaaaatacgaagcaaaatgccaaaatgaatcaatgaaaaattttacactttttatttcgtcaacatttcataaaaatccttttcacaaaatgattgaaactcttctgattttttagaatttttatgaaaaattgaaaaaatttcaaaaaattttccatttttttcagaaaaatactgaaaaaggcatg

SEQ ID NO: 118888 - DNA, 396 bp, Heterodera glycines
  Promoter: Source sequence=SeqID_38962; Location=654..1049; Strand=-; Gene=SeqID_67641
agtagtgatgctcgagagtctcggtctcgactcgagaaaagtctcgggtttttttggtctcggtttcgagtctcggtctcgggttttcaagtctcggtctcgattttcgagactcgagaccgagacttttttacacccctaatgattgttggcctttggtaaacttctatttttataaatttaggttcttttttgttcaaatttgttaatatatgcgtggtcagcgggttgtgttcttggttttgttacttatttttgcgttggatcagttcccctccaagtattattttttcttctcatttttcaaaattaatgtttttttcgatgggagttcaaacacaattttaacaattaaaatcgtaaaaatgtaatttttggactaaatctattaacatg

SEQ ID NO: 118889 - DNA, 578 bp, Heterodera glycines
  Promoter: Source sequence=SeqID_21220; Location=1597..2174; Strand=-; Gene=SeqID_51808
ttgccttggtgatgcttttttgaatgaaatgcttttattttaaagaattatgttaagaaattggtggaaaaaaatgagcaggaaaaaatgtcagcaccgcttagaataattggcttttcaataagaaaatgaagaaatattcagttaatcaattaaataaaaaaataaaaattgcttctttattgattcacttgaaataaatccacgttaatattattatgtttgcttgcatatctttaattattaatgcttgctccatgttaaaagccatatagcgagtagttatatattcttaggaatgtgttgttggtgtcctctatctgcatactaaaattcaagaagttttattcagttacaaaaaagttatggccataaatgttttccaagttggtttttattgcggcgacaaaacggaagaataattaattagttttaattaaaaattaaattgaaatttgccatatttttataaattgttttaattaccaaaatttacatttgaattcaatgaaaatttagaaaagaaattgttcaacgaaagtgctggtcactttaattcacaagtgatcctcaccatg

SEQ ID NO: 118890 - DNA, 223 bp, Heterodera glycines
  Promoter: Source sequence=SeqID_19439; Location=453..675; Strand=+; Gene=SeqID_84162
ttatttgcgaatataaaaaactaaatttaaaaaaattaacgaaaagaagtaataaagtgagtaaagcagtgaaaaatatgagcgaatattaagctatttataagaattttttgttgtatttctaggttaaacaaacaataaactgtataaaaacggaaatcgtgatcattttattcatcctttattcaaaatacattgaaattaaacaactaaattaataatg

SEQ ID NO: 118891 - DNA, 169 bp, Heterodera glycines
  Promoter: Source sequence=SeqID_1093; Location=528..696; Strand=-; Gene=SeqID_67693
ctaacatttagcctttcctgatcgtttattgttgttgataaatctttcgatttggttttgtttttctccattatttgcttcattttcaatcacttccgttccgttacttaaccactcacttgctgagaaagtcattcaaagaaaatatttttttgtgacgcgaaacatg

SEQ ID NO: 118892 - DNA, 206 bp, Heterodera glycines
  misc_feature (17)..(17): n is a, c, g, or t
  Promoter: Source sequence=SeqID_10703; Location=1789..1994; Strand=-; Gene=SeqID_73956
aaaatgtcatgcaatancagtgtgtccaatggccccatctttaaacgatagaaaattttgctcctaatggatttttgattaataaaattcagtcgtccgattggttggtgtttttaggacaaaaaattgaaaggaaaaaatacaacaaaaaaaagagaaataacgggaaattacagttggatgacattaaacaaaatgacgatatg

SEQ ID NO: 118893 - DNA, 121 bp, Heterodera glycines
  Promoter: Source sequence=SeqID_44909; Location=1546..1666; Strand=-; Gene=SeqID_72312
agaagaggtgcaacttgattaagaaaggtaaaacagtgattagaagagatacaacagtgattagaagaggtacaacagtgatagaagaggtataactgtgattagaagaggtacaataatg

SEQ ID NO: 118894 - DNA, 627 bp, Heterodera glycines
  Promoter: Source sequence=SeqID_23480; Location=1..627; Strand=+; Gene=SeqID_54178
ttgtatgattttatgattatttaactcttaaagtaaaatttctcatttttttattttaaaattactaactaactaataatgcatttttaggagcttaggttttttgtgaaaaaatttatttgatctgtcaaatgataaatgcatcgagtgattcattcctttacaccgctttattttgtcatcgcttcactattattttcaaaaaaattatgcaataataattcactaaaaataataataatattttttaaattttacatattattaaacaaaaatataaaatcccaatgaaaatagtcaaaaaattattcgaaataaatttggaaaacgtacctttcaatgaatttaatgaattaaacctgatcatccttttaatcgcttttaattaattttttaattactttttattgtgtacgccacgcattaaattaaatttggtctttcagctataaaatttccccaatgccaagcatcatcattacggccacttttgtagcggtggtacttttcacttgcgcttttttggacctttgccatggtaaaaaaacattttcaatctcaatatatttaattgcttttttaataaagcattgacttgcaaaagccgttcgataatggagaaaaatg

SEQ ID NO: 118895 - DNA, 599 bp, Heterodera glycines
  Promoter: Source sequence=SeqID_7192; Location=3409..4007; Strand=+; Gene=SeqID_64102
attcctatttttatattgtttggcattttctttttgaccaaaattgaagttgcatggaacttggaattttaggcaaaaaccgtgacagtgaattgacgggaccaaaaaattagaaccgggactatgttttaaaccggaaaccggatccaacttgtgaattgcaagaaaaaatcaaaagttttatttcttgcgtaaatttattcagctcactcatcctgttgtttatgacatgaaaataaatagaatttgtctcccttctatttatactgcaagaaatgggcatttggcgtattttttggggtatggactgaccaaaggcggtatgtcatttaaatatttatttggaaaaattttcgagcaaatataatcatttttaatttcgccgttaattataaacgggaattcaaatatgtgcttattcgacatataattttttgttcttaagctctcgagcttgctgggacaaaccgaacaaagtcaaccaaattacgcgaagactttgtacaattgagggttggcccgccatgcccagttaactttttatgtaccaattcccaaacacacccaacacgtcacacgacacccgtattatcttaatg

SEQ ID NO: 118896 - DNA, 923 bp, Heterodera glycines
  Promoter: Source sequence=SeqID_8262; Location=324..1246; Strand=+; Gene=SeqID_67485
tttgaaaaaaaaaaatttgttgaaattaattggattttatctgaaatatttttaaattaatttgacttatttattttcatttttatttggactaataaattgtaaaatgaatgcttttcacatttttgttcgttttccatttggcttttttaatgaatcattcactttccatcccacaaatattctttctgcagccactgttctgatgactaattgaaaatgatcaaaaaaaaaaattttatgataattattcactgggaaaatggacaaataaaaatgatttatgttaattaaatgtgcaaattattttttaattaaataaataaaaaagcaataaaaatgatttggtgccatattaattaattaaaaataattcggtgtcatattaattaatacaatacataataatttagagtgtcatattatttaattaattatcaattgagtgccattaatttcggcttcggtatttttggcacaaatgtatgaatcttaaataattttaattttaagatgttttttgtaaatttaaattttgttattttttgcttttctatccatcttttcgctgtttccaatgccaataacacaatgtaatcaaaaaaaaaattatcaaatattcaaatgatcatttactaatctgaagcaattaagcaaagtgccgttggaatttagaccattttgcacattaaaagtgaaatatgaaattcatggaaattgtgaaaggtaattaattgaaactaattaaaggcatttcaattaattaatttgctttaattaattaacccaattaagtttttcgttgtgttacaaaagtgaattattattcggcaacaaaaattattcatggaaattggcgaaaagatttaaatttgacaaaacattcactgaaaaggcaaatgaagaacaatgtggagaaaatg

SEQ ID NO: 118897 - DNA, 812 bp, Heterodera glycines
  Promoter: Source sequence=SeqID_18990; Location=2094..2905; Strand=-; Gene=SeqID_47556
ttctttttcttcaatattcattctctctttctctttgtcgctcttctgctaatctttctccaggtatttttcattgcgaagaatcgaagaaagataatcaaagggttggaaacgaacaggcaacaaaagggacagaagaaagagaggggaagtgagaagggaaagaatgagaaaagcaatggaaagagagagagagtaagagaaatgaaagagtgcgaaagagcgatggaaaaggaaataagagaagaaagaaaagaaagggagaacgggaagagagaaagtaaaattcaatgaaaagaacttaaaaaaggaattttttgcctataagaaataggtgagtgaaaaagatgtccttttttcactctttcctcttccgtctgcattttctatgctctcttcgttcgtttgactctctcttttatattactctacttttcgctctttatcagttatttttgtcagtcttatgacttgctgtctttctcgtctcgtcttccattacagttgtctttcttgctaaatgcataatgaactctggccaactgtgtatgaatggcctgaagggggaggtgaagaaacctaatacatgattaattgctatatttttaattatttatcacttacttttactcattgtttagctatttttgtggaagaaaatgttgaaggcaaaaaaaggaagttgtcacgggaatggcaaacattgaaagtcgaaaaaaggggttgaagaaccttcaaagacatggagacggtgctcaagtatgttccattggtattaacaaaaaactcgaactttttcctgtccaagcatg

SEQ ID NO: 118898 - DNA, 175 bp, Heterodera glycines
  Promoter: Source sequence=SeqID_23242; Location=1..175; Strand=+; Gene=SeqID_53958
cccaatgtggcggaatttaagaaacgacccagcacgattacgaggtctcaaaaatagcgatagacttggcctgagagaaatcacttataaattgccttaaattttagttttgattgccttctacagaagcttttatcatgtgattgggaccaatgaggccatctcacaaatcatg

SEQ ID NO: 118899 - DNA, 198 bp, Heterodera glycines
  Promoter: Source sequence=SeqID_17568; Location=3059..3256; Strand=-; Gene=SeqID_47457
tcgctcagggccgtgatttaagggatgccgtcagggaacactcaagacaggggctgactaaccttaccgataagttacaacaatgtgggaaaggaaaaagggacctgatcactaataagaatcgaaaacgggtatatgatcagttaagtttcatctaaaggtataaatagaataaataatacaaagaattaaaaaatg

SEQ ID NO: 118900 - DNA, 89 bp, Heterodera glycines
  Promoter: Source sequence=SeqID_340; Location=968..1056; Strand=-; Gene=SeqID_83233
tattacatataattattaattataaataaagaataaatagataaatattttaaaaaataaataaagaatatatttattatgtgtgtatg

SEQ ID NO: 118901 - DNA, 118 bp, Heterodera glycines
  Promoter: Source sequence=SeqID_9597; Location=1..118; Strand=+; Gene= SeqID_72023
atatgttgaaggggatcctcgaatcccgttatttctggttggcatcaaaaattgggcaaaaaccagaaacattttgaatggttccggttatttaaacacattcggttggtctctcatg

SEQ ID NO: 118902 - DNA, 135 bp, Heterodera glycines
  Promoter: Source sequence=SeqID_19680; Location=1367..1501; Strand=-; Gene=SeqID_84414
ggatgagtacctgaagatcgtcaacgatcgtggattgggaaaaagagccatccaggaggaacaactcgcagcacaattaaccgcaggacaactcgccacaagccgatcaatcgcgcagcttttttccaaggaatg

SEQ ID NO: 118903 - DNA, 339 bp, Heterodera glycines
  Promoter: Source sequence=SeqID_29153; Location=570..908; Strand=-; Gene=SeqID_46148
ttcttgtcttttttggctgattttccgtttgattttaaaggcatctttcttctttgtcctgctccctattggcattcgctgaaggaatgtgccatcgaaattccgtagtgcagaattcaagaatttggtatttatttaattctgctatttatcaataggcaaaataatcaggtcacagaattggtgaatgccttgcggaactgcgcttcggagttgctgcctttgcctgatgaagcacagaaactaacgctgaagaatattggtgggtggattctatggtttgatgcaaaaaccaacatttccaatttgtgttaagaacatgataaattccgcatgatg

SEQ ID NO: 118904 - DNA, 181 bp, Heterodera glycines
  Promoter: Source sequence=SeqID_21044; Location=582..762; Strand=+; Gene=SeqID_51632
ttttgtagttaataaaagcttaactgtcaaaacattaaaagtaattttaaaaaattagcaaattatttgaatgcaattttttcgatactcactcgtacgaaaacggccgtacgaaaacgtctccggtacgaaaacggcggtacgaaaacgtctcaggtacgaaaacggcggtacgaaaatg

SEQ ID NO: 118905 - DNA, 678 bp, Heterodera glycines
  Promoter: Source sequence=SeqID_96; Location=2348..3025; Strand=+; Gene=SeqID_66805
ttgcggcgcgcactttgcttgagaagacgcattcgctaagtggacggatcacttcagttaacagccctcgttccgtgcaaaagccaaattatttcccatttaacacacaaaaacatttcaattctttgtgacgtaaatatttttctcgctctccaagatttacttatttttctgtttttcatcgataaaattcaaattttgccttaaaaatgaaaaaaagtcattaaaaaaatatcaaaaattgcaaaaagaaaaaaaagaaaaaaaaggaaaatttttgagcatttttggatatcttgccaagaatttgagtgcaaaaaagctactttcgtaaaaaataaaaataaaatttccaaaaaatccccaaaatatgtgctaaaaaaattagtgaattaatgacatcagatgagaacgaaaatgtgatatttgtgatagttaccttaaaaatctccataattatagttatctcatattaattactacccaattcgctgataaaaggaaaatttaataattgaattattataaaaatgttgtatcaaattaatgaaataatgattaaatgtggttaatattgattgaagaaaaattaagccatgctataaaattaataattacaaaattcattgcgaaaaatatttttataaaaataattcattatatttttacaaaaaaatg

SEQ ID NO: 118906 - DNA, 286 bp, Heterodera glycines
  misc_feature (125)..(125): n is a, c, g, or t
  Promoter: Source sequence=SeqID_44008; Location=853..1138; Strand=-; Gene=SeqID_71563
cctttggacgatgccaatttcgcgaccagtcatcactttgttcgtttcggctccgcactcattcaataatttgtaagttcacaaatggtaagcttcaccacttttttggccagcttggcctttanctcggccaatcccagcgttattcactctttgcatgcgatgaatattaattggatttttgacaatttgccgtataaaagggagggcaaacgaaggcaaaagcacacgccgtccacaccattcaatcaaaaccaaccaaatccccactcattagctcattatg

SEQ ID NO: 118907 - DNA, 198 bp, Heterodera glycines
  Promoter: Source sequence=SeqID_5082; Location=4212..4409; Strand=-; Gene=SeqID_56825
ttacctccggcggaccgctcaagcatcgtaagaataccttcgagtgttaaggacagtccttcgaaaacggaaaagggcaaaccgcccgaaaaataacccaatcccaaactccgatcatttccctccggcggactcgactgatcaggcgtggtcagatcaatttcgggaaggaattttgaaaaaaaaaaatcaggaatg

SEQ ID NO: 118908 - DNA, 1003 bp, Heterodera glycines
  Promoter: Source sequence=SeqID_20320; Location=1148..2150; Strand=+; Gene=SeqID_50826
ttttgcattcttctggccatgttgaatttggttgacaaagaaaaaaagttatagtccaaaaaccacgctgaggccgggcccaactgaactaaaccgttttatggcttgttcaaataataataatggacctttttttaagaatattattttgaataatttgatcaatttccgctaaaatcatttttgttttatttcgtagtgaccgtttggggctgtgccgtgccgtcttgtccgagaggcgtgtactcaaagccgaatggcctggaatgccacagcacttcgtgttgcgagggcaactattgcaatggcgcggctgggccgtacaattttggcatttttgccacggtttttatcaccaccatgacaagtggtatacaaatagtatatagtatagaataggcccggaaatttcaaattagcgtatctcgctgcggaatttgaattcaaaatcctttgcgggatgggattctgcggttaatcccgcaaaatcacgatttctaaaaaaatggcgggattggtgggctgggatttcgcaaaatcccgcgcgagatctccgtccctgtatagattattaatgattgtaaaatctaagaatactgtagtacaaaagttaaactttttaagaatttcgttataaaaattctatgaaaggcgaaaatttgaaaaattaccaaaatctataaaaaaaacaaataaaaatatactgtaattggattattgtaaatttgtttccaacattcaattcatgtttaaattttaaatcaccaatttgttaccgtattttcttgttttcagacaattctgattcacttacactttccattggtcaaaaggggaggttttctctgtaaaaatctcgccaaaaattccataattttttttggcatcgccttgacatttttccacacaaatttacgattaaaaattcttgaaaatcggggaattttcgggtaaaatctttgttaataatttttgattttagtgattttcattcgtcacaatg

SEQ ID NO: 118909 - DNA, 492 bp, Heterodera glycines
  Promoter: Source sequence=SeqID_4855; Location=1246..1737; Strand=+; Gene=SeqID_55971
tttaaattctaaaaaactatttaccttacttagttaagttattaatttttgtcagatccattttcactcatttctctatcaactttactccaactgcattggtattttaatgtaattgaaatttaaaaagattttattcgaaattaatggccaaaatttgtaatctctaacattaaaataagcaatttaaatttcttcatgaactgctcgcttcagctgatgcgccccgttctactccccattttcagtacacatcggcagtctgaaaaattgaattttatccacataactattttatttttatttcatttttgtcacttaattatgtcatttaagaaatttttatttttgcagtgccattaattgggactttataacaaacattccaagcaacaaaagcaaagggcgttatttttattcaataattaatttcgtttttgaaaaaaaaatgtttgtctaactttttatttatgtattttctctttcagcatg

SEQ ID NO: 118910 - DNA, 529 bp, Heterodera glycines
  Promoter: Source sequence=SeqID_6072; Location=1423..1951; Strand=-; Gene=SeqID_60216
tgaattatttaatgaaataattatattaaaatgtttattttaataaaaattaattaaagtttgtatttatcgcttagatttatttatttatttttgaattataattttcaagctttttagctttttaattttcttcaacttttcactttattaattcactttttcaggtttttttaaattttctataattatttattccaataataactaaataaaaataaaataactttattttttgataaattttattcttttacattatttaattattatgcataaaacagcactttcacaatgaatcatcaaatcatcagaatcggttcggtcgtccgtcgctcgacaaccaattcattcactttcattctcctcttattttcattgatcatcatcaaaaagcattcgatgttaagctaattctggtcggaattcatttattattattattgctttattaaaaaataaagttaataataataataataattttctacagataatttaaatttaaaaacaaaaccccctcaaaatg

SEQ ID NO: 118911 - DNA, 1003 bp, Heterodera glycines
  Promoter: Source sequence=SeqID_9163; Location=229..1231; Strand=+; Gene=SeqID_70454
aacttaattaacatacttgttagtctgtccacgacaattttgtctgttggcggcacatctttttcacatatttggcacaacgggcttttgaaatctctggagctcagacaaaaactcattttttttctaaatataatttcttaaaatggctcatggacaaaatggtcagcctatactactgatacagtatatttttttgtcgtaatatacatatcgtatctttgacgcattttttcggacaaacgtaattaaaaaataaaaattccgttaaagcaaatttgtattcaatttgactgaacaattcaatgtgctttctctcaatttgttttaagccacaatttgtttttgagtcagtgaacagctgtttgagtaagtaaaatgaacacattgcttttgaaagaaaaatttttttttattttttatatttattttgcctaatcaataaggaaaagcattgatagttgaaaatatttgaaaagttgaaaaaatgaatgaaaaaaaattagtttaaataaattaattaatttgatggattaaatatagtgagtgagtagattcaaacatatatatatatatatatgtattagaggtatttatatatttttttaattaaaatttaggaaattattttcaaaaatcttctcgtccaaaacaacaaaaataatttctgcctttttggaagagcaattaaaaattaattttgtgtccttcatcatggacttcttgtccataataagcatactttttgtcttagaatgaatgtgtcgataaaataaattggcacccacattttttttttgttcttggcaatttattttgacgagaaatttttatgtttccctggagattggaagggcaaggcgaattttaggagtaaaaattaaaaacaaaaattattgccaaaaaatttttttttggcaatatcttcaatgagcttaaaagcagtcatttttgaacattacttctaaaaaacaaaaaaaaaatttcagctctctccaagatg

SEQ ID NO: 118912 - DNA, 742 bp, Heterodera glycines
  Promoter: Source sequence=SeqID_44556; Location=365..1106; Strand=-; Gene=SeqID_72039
gttccacacttttatgatgccccactcccttaggaggttgactacgtggtgcaaaagtgtgtccgggacgcgctccgtctgcgcgaaatgtcgccgctgtgggaaatggtgcaggagggcgtcgacctgaagaccatcaaatggacgcagcactgaataagctgcccattctcctctctctctctattcattttttgttgtcgccatcatttttaatggcccaaaaatatttgttttgtttttgtcgccccgtgtgattatttagactaaacaatcactcacaatatgatgctcctctctctctctctcctctctgtacaagggcatagcaatgttaaaaaaaatccaaaatgcatactcgaaagaaaacaaatttttgaaaactaaaaattttcgagaaattttcatatttcggctaaaatcctcccctcctcattttcataaaataaataatttgaacataaaaaaggcatcccctcgggggtttttggggctcctatcggaagtaaaaaattggcctatggctatgtcctttattctcctcaataatatgcattctctcttctctcgtccgctgaatttattttttatttgctcatatttatttttgagtcatttaaaaatgttttaaaaaggcatgctaattactttaatattaccgtttttctcaattacgctatttttcttccttttttttttgttcctaatttacatttttatttgccaaaaagcaatcactatg

SEQ ID NO: 118913 - DNA, 1003 bp, Heterodera glycines
  Promoter: Source sequence=SeqID_15276; Location=2615..3617; Strand=-; Gene=SeqID_79493
atatgaatttttgataaaattttccatttctcaggggtgtatttttcgtttttattgcatttttgttaataatttttttcaaaatagcagaaaatattttacaaaaaattcttcaaaatgaaaaagagcacaaaaaagcaataaatttattattattaacaggttatatcgctccaatttgattcggttttttttcggtttttgaaaaaagtcggtcggttttttcggttttttgattatttcggtcggtcggtttcggtataaaaaccgaaaccgaaaaaaaccgaaaaactcaaaaaattttcggtcggtcggtttcggttaaaaaaccgaaaccgaaaaccgaaaaataccgaaaaataccgaaaaaaaaccgaccggtccgatctctactttaaaccctcaaaaactccaaaaaatgtgtatttattcaatttttggttaaacaaagttaaaaaatacactaaaaagcttaaattaaaaaaacaaataaaatatttattttatattagtctaaatttttggcttttcaactccaaaagttgctaaaacacctcctaaaatttgggacgtttaagacaaagaaagaagaccagctcattgaatattacaattcttctcttcattggattcatcattaattttccgtcatcattatcatttctaaaatttcttgctttctttatccccactgtttctcctctaattgtccctctcattttccccttctcccaaaggggggccaaccatcgaaaattggagttggcattggcattgctcattcggtgggcgtgggggacacttggtaccctctgctgtccgcttctcctcctcctcctttaggcccttcccttccccccccccccggccaatgccaatttccctcttctcgactcctccgccgaaatgagcctgatttgattaccatccgtccttcctgtggccatggcgtggcccacttatattttgacaagggctatagcacactttttagtccaccatg

SEQ ID NO: 118914 - DNA, 67 bp, Heterodera glycines
  Promoter: Source sequence=SeqID_22513; Location=1..67; Strand=+; Gene= SeqID_53179
aatgccatcaaagtttactgctggaacaaatttgcaagaacaccaacaaatatcgtatccacaaatg

SEQ ID NO: 118915 - DNA, 731 bp, Heterodera glycines
  Promoter: Source sequence=SeqID_25321; Location=78..808; Strand=+; Gene=SeqID_45922
ttttttattagaatctgaaatttctttgtttagaagaaaatttgaaatgacataaaaatgaaatgaatgatttatttgatgcaaaaacattatagatattgtatattctctctttttattttctctttgacattatgtatttccaataggcgaaatgaatgtttctggcttagtaggcgaaatgaatgtttttggtttggtaggcgaaatgaatatttttggtttggtaggcgaaataaatagtaggcgaaatgtcagtaggcgaaatgaatagtaggcgaaatgacagtaggcgaaatgttcggttttgggttagtaagcgaaatgaatgtttttggcttagtaggcgaaatgtcatcgtgccagcagaatcactgccttagcattttccctcattttcgtttgtgccagtgtttatttgttagttcggcttttccattataacttttttatttgtcacccaaatgcaacaatcttggtatcattcggaagctcatatgtttcgtgcgtttcataccatagggataaaaacctaaaatataagccctaactatgaacttttgaatgtttcctaatttgtccgggttttaccgtttgaaaaagttaagagtgcatccatttagtccattatgtatttcgatttaaaaacttcataaatcgtcttttttcgttatcatagcgattcacactccgtattcaatcgatatacctttcaatttatctttactatg

SEQ ID NO: 118916 - DNA, 185 bp, Heterodera glycines
  Promoter: Source sequence=SeqID_27463; Location=1..185; Strand=+; Gene=SeqID_58157
tgagttggacgtgagtaggggtgtaaatgtcaggtcaaaaaatcggaaaaaagggggcggtcgaaacgtcgcggaaaattttgacgaaaattaatatctgacaattgtttaacttaggaaagctcttaccaattcttaaaatatcgaatgttttaaagacacaatttcaggacgcgaccgaaatg

SEQ ID NO: 118917 - DNA, 212 bp, Heterodera glycines
  Promoter: Source sequence=SeqID_2674; Location=2584..2795; Strand=+; Gene=SeqID_81014
tttttcaaaaaattagttttaatgaatgattaaagtgtatacttaagcatacaatctgcacttaaataggctgctatgtacgattttttgaagcgaattttttagcgcaaaatttgaatacaaattttgagggtgtgtagtgagtgattcgaccattcattctttcaaaaagcacgcattcacttttcgtgtaactaactcctgctcagatg

SEQ ID NO: 118918 - DNA, 76 bp, Heterodera glycines
  Promoter: Source sequence=SeqID_21270; Location=3331..3406; Strand=-; Gene=SeqID_51864
aaaagcattcaataaaataatataaatctttttttgaatttaaccatttaaaaaaaatatcaaactcgacaaaatg

SEQ ID NO: 118919 - DNA, 171 bp, Heterodera glycines
  Promoter: Source sequence=SeqID_3547; Location=1360..1530; Strand=-; Gene=SeqID_50820
tcctcgccccgccgaatctccccaaggacatcgacttggggattttcaaaaagccgattgccttatgtttgtagtcagtaattaaacaacattttcttaaattattctcaaatttagggtcgagattggagcgaggactgtgccacttgtgcggcattcatgggcgccatg

SEQ ID NO: 118920 - DNA, 680 bp, Heterodera glycines
  Promoter: Source sequence=SeqID_39277; Location=176..855; Strand=+; Gene=SeqID_67884
attttaaaggaaattcagtcacttagttttggtaactccctccctcccacttgggcaaaaatgtttgataatttataaataaagaaaactcatttatgaaatatctttttttgaaaggttattcggcaatttgccagtcgaccagttgccaccaccaagcaatttaattggttttaaagagatttacatcaggtagataaatacttttattttgtatataaaaaattcttatcccccatgctgcccctataaaaaatgtaagaaaaattaaaaacaaaataccttattatgtatatagcacatgtttcggaacctaaatgaattcgactcaatccaattttaaatttcaacaataatttttgctagattttttaaaaaggaggacacgtagagctctagctgcctgcttcttacaataccaagattgattatttgattaaatttagctaaattatgatttattattttgcaaacaaataatataataattaaatttaaaatattactatcattgatacttttgtaacttcttctctccacggacaccacaccggtggtccgggggtttggagatttagtaaataaataaactaaattaataacatttaaccggcacgttcagttactttgacaactctgtgctctcattgctccattgcttaacgccgcttttcaaaatg

SEQ ID NO: 118921 - DNA, 67 bp, Heterodera glycines
  Promoter: Source sequence=SeqID_25505; Location=761..827; Strand=+; Gene=SeqID_56250
gaagatttttgtaatttattttattttttagatttttgtaatttggttttattttttctagtcaatg

SEQ ID NO: 118922 - DNA, 552 bp, Heterodera glycines
  Promoter: Source sequence=SeqID_45523; Location=110..661; Strand=-; Gene=SeqID_72805
tgattccactcgttccaagcaccccaccaaaagcaaaacgatataaccaaaatataagtaaaaattttttctccatcttcctttttgatactaaagcatcagagtgctaaaattaagttgtaaataaaattttggtgcactttagagcactttctgaaaaaaatatttatcgaaacaaaaaaatcgattttttcaagtgtccgtttggggtactcaaacatttatggggagcaaaaatccaacgcagaattaaagtacaggctatagggaagctattcccgagggattcggtctccccataaatctgggcgcatcggttcggggggactgaccgaaaacaaaaaaatcgattttttcaagtgtccgtttggggtactcaaacaattatggggagcaaaaatccaaagcagaattaaagtacaggctatagggaagctattcccgagggattcggtctccccataaatctgggcgcatcggttcggtgggactgaccgaaaacaaaaaaatcgattttttcaagtgtccgtttggggtactcaaacaattatg

SEQ ID NO: 118923 - DNA, 110 bp, Heterodera glycines; identical to SEQ ID NO: 98226
  Promoter: Source sequence=SeqID_30516; Location=1017..1126; Strand=+; Gene=SeqID_60928

SEQ ID NO: 118924 - DNA, 461 bp, Heterodera glycines
  Promoter: Source sequence=SeqID_15589; Location=2092..2552; Strand=-; Gene=SeqID_79879
tagaatcttccaaattaaacattcttggaatcatcaatagccctaagagtcctcaattagtttgtaaaattaaaaaaatagttgtttgtttcaaaaaatttacggtcaaaaatgtccgggaaacgagttttttgaagtttacaagccttaacttttttgatagactaaaagaggactcttacagctatcgaatgacaccaagaatgtttaatttaggtgattctataaatgatcccttaaattctgggctttgttcctgttttggctctatggttcctttagttagtttagaaaaatgcatagctaccgacaggcgcccacataatttcatgttgcaatggcttttccttttagactttcttcatccatcaaatggaattttttatcattgtgcatgcgttgagcatccaatttcgttggacgaagcgctgcggcgcggtttcatcaaattgccgagcatg

SEQ ID NO: 118925 - DNA, 254 bp, Heterodera glycines
  Promoter: Source sequence=SeqID_28920; Location=575..828; Strand=-; Gene=SeqID_59487
tccgccaacggcggttccgcgcttcggccgcgtgcttttcttacggatgcgcaagtgaaaattctggcggaacaattccgccgcaattccttgccgagcaaataccaactgtcggaaatggcggaacagatcggagtgaacaaaagagtggtgcaggtgggcgcgggaagaagaaaggcatgggcggataatgagtgcttaattaatccattggaatcgctttttcgacttcacaggtttggttccaaaatatg

SEQ ID NO: 118926 - DNA, 233 bp, Heterodera glycines
  Promoter: Source sequence=SeqID_4060; Location=1..233; Strand=+; Gene= SeqID_53022
aaaaataattgccataattgtgagaaagaagtgtttgttcatttgaaatatttgaatcactgtcgataatgagaccaaacatttaatttatacactttttacatgtgacttttatgtacaataaacaaatgaaaatggatattttactaaattgttttttgaatcgttttgccttttcacttcatattttctcattgtgctctttccacgttcgttaattctgtttctcgatg

SEQ ID NO: 118927 - DNA, 1003 bp, Heterodera glycines
  Promoter: Source sequence=SeqID_13779; Location=1166..2168; Strand=+; Gene=SeqID_77703
tttttcgtcatcttgagggtgtccttacaaattagtatctttgcccctctacccccccccacatttataaattttgtacgattggcaaatgatttgtcgcttttgctcatttgcctcggttccattatgcccaaaaggcatatttttagttcaccaatttcatcgcaaaattctgaacaattatgctttttcgcactttcgttttccacttaatgtaatgtcgatttgcttgtcataattagtctagtttaattaaaattagaaattttatttgttaaaaaagttaataattcatatttgtcttttaattaaaatgtttttgtatttaaaaaatttttataataaaagcataaaagccattaattatttaaatattaatttatataaatttcttaattaatctaactttttcaaatattgacaagataaaatttagtacaccaatgacgatttttggtcatttgagatcatcaacagattccgcaaatccttgaccgcgattttttacggaagataaaataatgggtcaaagcgtccgaccgtcgtaagctatttttgaacggtgaatgaacgaaattttggtaattaattaattgatgcgattacacacatttgttccaatttttgcaaataaatacgcactgaaaaccgatgagattattcagtgtcatttcattcagttaattaattttcttttaattaatttaaaattttttttttcgaaaatttttcgagttaatttattttgaagataaaataaaataaaagaaattgaatttgtttttgtttttttaagaattatttaacataatgaattcaatttcagcaacataaactgcatttaataacacatttaaaaatatttaattttgccaaaaccgttatccgaaatttcgataaaaattatctttttcctaataagattctctttaaatacaaaactaattattcaccaataattaatatttcttagaaaacattttccagaccaaaaaaaagcatg

SEQ ID NO: 118928 - DNA, 95 bp, Heterodera glycines
  misc_feature (12)..(12): n is a, c, g, or t
  Promoter: Source sequence=SeqID_3319; Location=1632..1726; Strand=-; Gene=SeqID_84192
atatttttaaanttgaagcaaaaattggggacaaacacgttcccccgagcttcttctcgcaaaataaggacgacattaatatggtcacaaaaatg

SEQ ID NO: 118929 - DNA, 163 bp, Heterodera glycines
  Promoter: Source sequence=SeqID_10275; Location=2045..2207; Strand=-; Gene=SeqID_73435
tgatcgcggatcgggcgattctgtccgagcaggagcccattgagcgggcatgacgtgccagcgaagccgaggcggaagcgcaacgcgcaaaactatcccagctgagggtttgtggggttgtgccatttcaggcgcaattcgcttgccaatgttgaaaaatatg

SEQ ID NO: 118930 - DNA, 637 bp, Heterodera glycines
  Promoter: Source sequence=SeqID_7774; Location=737..1373; Strand=+; Gene=SeqID_65908
attgcttttatgatgtttattgtttagcatctgctaaatgaatgttatcataaaatgagcaacatttggtggatcttgtttgtggattatgcagatttctcgcctaatgtgggggttggcttgtcatcccacggggtgggtcgcctgcaggaggaacttgctccggcccaccccacggggtggggcgcccagcgaccaacccctctgtccttggggctagaccacgcccacttggctgggcgacccctataaaagggcagccattttgtctcagtgatcattctcaacaattcatttttgttgtcatgtgggggttatgtgggggttggcttgtcatcccacggggtgggtcgcctgcaggaggaacttgctccggcccaccccacggggtgggtcgcctttcaagtgctccagtttctttaaattttttagattattaggtgatatgcgtatgcttaaagctattttaacagccaatataccaaattaattattgactttattcatctgtcttcattacaactgggttttcattgtagagaatttaccatccgaaggattttcctccgactgtatcatttccatccgacggacagacaactggtacaactattccatccgagggcagacaaacatg

SEQ ID NO: 118931 - DNA, 172 bp, Heterodera glycines
  misc_feature (12)..(12): n is a, c, g, or t
  misc_feature (32)..(32): n is a, c, g, or t
  misc_feature (52)..(52): n is a, c, g, or t
  misc_feature (78)..(78): n is a, c, g, or t
  Promoter: Source sequence=SeqID_32509; Location=1176..1347; Strand=-; Gene=SeqID_62812
aaagtatcattncatttaattattcttttacntatataaggggtacaaatanttatgggattaattgagaaatatacnacatttgaagaaatataattaaattaaatattaaattttctttgtataacttaattttataattattcttttaaaaaaatttcagatatcaatg

SEQ ID NO: 118932 - DNA, 105 bp, Heterodera glycines
  Promoter: Source sequence=SeqID_43802; Location=898..1002; Strand=-; Gene=SeqID_71389
ttttctatgcaacaaacgctctcgaacatgaaacgaagtgcggggcgccgtggccattttatttttcaaataatttttaaatttaatacatattccagaaaaatg

SEQ ID NO: 118933 - DNA, 1003 bp, Heterodera glycines
  Promoter: Source sequence=SeqID_18598; Location=1347..2349; Strand=+; Gene=SeqID_83232
gttggattggacaacagtaccgactaatattaaaccggcaatgcaaaaaaggctggaggagaacagcggagaattttggtaattaatcagtagagaccggatttttcaccatcaaaaaatgataattaagcacataattcagcataaaaaaatactaaaataagcacaaaatcagcatgaaaatggtaaaattattttaaatgtatttttcaagaaaaaaaaattttggggattaattttcgagaaaattttccatttttaggagtgtattttttgaaattttgaagtccattataggggtgtatttttcgtttttattgttgggagacagtgttttagtcaaaattttataataccaatcaagcaaaaaataagcacgaaaatgctaaattcagcacaaaaattacatgcgcaacattaagcatgaaaatactatttaagcaaaaaccagcatgaaaaagttggaccaagaagcttcaaaccaagttttaaatacttttttcatacttattagcacgccccgggttagcaaaaaatttcagaaaatgctgcaaaatccgggttctagtaatctgtttcacattttaaacttaaattattaaatgctatcattttaccatatttatatgcatttaacaatgttttttaagtcgctagggtttttgggaaaatttgggtttacatttttgtcagtttaataattttttaaatgattttaaaagatcataactttgaaaaagtggtcaggtttaaatttttggaccatatttaaaagagattaggtttatttttttgcaaatgccataaatgtggtaaaatagcaggttacattaaatgtcatcttttgccaattggattttattaaaaaattaaatggaacaatttgctagggtttcattggacgacttgatccgatggtttgcaagaattcatatttgctttttggagccttcggcaatttgggaagtgaataagatgttaccgaacagtaacattcaaaatg

SEQ ID NO: 118934 - DNA, 311 bp, Heterodera glycines
  Promoter: Source sequence=SeqID_20362; Location=1273..1583; Strand=+; Gene=SeqID_50882
attcttttacattaatttaaaagtagtgacaaatttgtagtgacctttatttctacttaaacaatttatcactttttaaaaaattttatatttcctacaaacctagatcagccctattatggcacctttaaccaattaataaaagcatttacaggtataaagctttcagatttttgaaattactatttttaaattctaaagaaaaaattaattgcttcttggtatcggagaatgccggattaatagggcttaaaaataaatgcatataaaaacctctaaaaattattttaggaaaaactttgtaaaacatg

SEQ ID NO: 118935 - DNA, 1003 bp, Heterodera glycines
  Promoter: Source sequence=SeqID_5037; Location=515..1517; Strand=-; Gene=SeqID_56671
gtcgctcatcaaacttcgatcaatttgtcgtcctccgttcgaattgagctttttcattcgatcgctttgcaatttattcgcttttccttttgtccaaacccatcgaccaacagaagttgccttattaaattaatgggtgccaaaaataacggcgacagcaatttgaaacggcgcactcggctgatcatcgacttggcctaccgatcggcgcttcttttattgctggccaatcagcggcacttggcacgaacaacattcagtaaaattcagtaaaaatatgtcagaaacatttaaaatcgaaatttgtttcctttttttacttcgatgcttttcattccgtcaattgcttttgcttctttttccgtccgtttcccttttcatttttcgatgctttcgcactttctcaggttggcccagggcgcgcattccctttgaggacgacccgcggctgctggtcgacccggaccaagcggttgcactgaacaacgcccgcatggacctgcaggtacgcacctgcgtccgcttagtgccgcgtcgtgccgaggcggattatgtgttcttcagcgacctcggcccgcacattgagtgagctttaggcattttaaatttgaaatcattaattggtcttgatcaactcattattatttatcgtttcgatttattataaaagccaatttgtgctgcttcagatgctggaatatgttcgaaccgttcccgccgaaagggcgaattctggtcaatgccggtacttcctgccttgagccgatgcgccgtccccaccggccacggcgcgtattcagcgattgtgagttgatttttaatatgtttgaatgtcactgtttctacacaatgccaacacattggttcaggtgacattgagtacattaaccatttgtacaattgcccacggcggagaaagtcttcgcccatttgcccagcggggcgactaattatggcaaaaccgatggaactgcgccagctgcagcaccacacaacgccaatg

SEQ ID NO: 118936 - DNA, 357 bp, Heterodera glycines
  Promoter: Source sequence=SeqID_3105; Location=2640..2996; Strand=+; Gene=SeqID_83205
tttttttcgtccatattataatccatattttggctttttttgtcaatggtccctactaattaggtatgtatctaattaaaagttggttctcggtgacggtgatttagtcgtcagtgaatgatctcgtaatttaaatttttctgttcccatgtctgcctttttgaaatgcagagacgcatattttgagtgtctctctccattctctccaatacaaacaatggaacagagaaaacaaattgtgaaaatagtgtgtggaaagacaatttctgccgttcaaaataatttcgccaaaagtgggacaccaaacttaacaaaaaaaactacttgaaaaataatttataaagccaatcgctaatg

SEQ ID NO: 118937 - DNA, 293 bp, Heterodera glycines
  Promoter: Source sequence=SeqID_22320; Location=2189..2481; Strand=-; Gene=SeqID_52999
gatttccttttttctaatctctttaaattcaagatcttctaagatatattttattcatctaaaaaaatgtgcttttcttgtctgagttattctgtttgtggttgaatttttaaaatgagtcggcccattaataattaattaggctagacaaacccattcaaaacggcaattattgttattattattatttgttccctttaaattttccccaaaatcttggccatttttctttttgccaatggaatttaaaattttgtccatttgaagagttaaacaaaaaattggaataaatg

SEQ ID NO: 118938 - DNA, 74 bp, Heterodera glycines
  Promoter: Source sequence=SeqID_24587; Location=1..74; Strand=+; Gene= SeqID_55323
ataatttgggtttggctaatgagtatattggtaaactgagtcgagacaatgcaatccgtaaggaagcggaaatg

SEQ ID NO: 118939 - DNA, 878 bp, Heterodera glycines
  Promoter: Source sequence=SeqID_15505; Location=747..1624; Strand=-; Gene=SeqID_79784
attattatttattaataagtgtgaaaaatattatattttaacaaaatcgatatagttattactttttctttttcctataaatttaacttaaaatacatatttatcctaattattgaaaaatagtagaatttaaactaatccaattaaaactcagggagattctggttcggctcttgttgtggacatttcttctcgttcttacgcagttggacttttttcaatgcttaccactaactcgtccttccgcaacgttcaggcaggcatgtttttcaaggcttttcaaataaattttgagcgcatttttatgtatttctatattttcacaaccttcggataattgacatgcaaattattagttttagtttgtttttatttcttcatttaaaatcttttgagcccgggaatcggcactttggcactgatcaaaaaaataggccaaatttctacccgctcttacaatttaacttgaagaaaaaaaaagcgagcgggcaaaacagcattcaaaaaaatccggttttgccaattgagcgccagcagaggttttaaaaacttgaattttcataaaataatcggattttgttcatatttggcaagttcaatgataataaaaagacatttttgttttcttatttataattattgagttaaaacgaaaatcgtgagttagtgccgaaatcccagttccgcgggcttcaatattttacttccttcaattaacttattttccatgaaactttttcatgcttttaattaaatttgtttaagcatttataaaattggatatggttttttgtgaaatacaaccttaatatgcaccttacatatttatcagattttgcatcccaatctcagatgtgtttattcgtagctcagagatg

SEQ ID NO: 118940 - DNA, 333 bp, Heterodera glycines
  misc_feature (17)..(17): n is a, c, g, or t
  Promoter: Source sequence=SeqID_40416; Location=571..903; Strand=-; Gene=SeqID_68754
aattccggcactcttcnagcctgaaaaagggcaagcgcgccctaattctatttttcctacacatttctgacctatttacatcgattctgaccctttttgagcaattttgagtttgggacctaaaagcatattttcctaaattttgttaaaaaaggcttttgaacctttttttttattaaaaaagctttttacaaaataaaaaatgatctataagattgataatgttgccaaatttcataaccccatttttatctgtgcttatttggaaccctgactcgaggaaaaacagatacaggatgtgatttgaattttcgaaaaacttaaacttagatg

SEQ ID NO: 118941 - DNA, 1003 bp, Heterodera glycines
  Promoter: Source sequence=SeqID_228; Location=4447..5449; Strand=+; Gene=SeqID_78608
ggttaggttaaacaaatattaggagctataaaatcaaaaaaattcgtgatattattgtccattcattcattcattcattcattattaacatatcccaccagcccattcattatctcaatgctccaaaacgaagattcctgcatgaatgagccaaaacaagaagtcaacatttcatcaccaaaagttcaatcctggaaactttttcgtccaaaatacatgttgacttaccgcttgtgcgactgtaagtttatcaaattagcaaaaatatttgactttgtggtttaagtatgtctttcggctctttggtccaacaaaaacaaattcacgactaacgaagaacgatcagtgatcagttttgaactctgtgagaagtgcaccattgacaattgccgagcgactgatgttttggccccgtacagaccaaagaaataactcttcataagaatgcaatagttagggacaaatcaatatttttcattcagtacatcattaaatttgttatttaatttctcaaataaaatgtcaatattcggaattccctctcaattattttccccgattaatcggcacctttcagtcttccattgctctcgagttccttaatgtttgcacaaatattgccgagaaaattttcctctccgcgattagcaattgccctttcccgtcatttgaattacgcttgcccttccgcgcagagagtgtttatattagttgagcattaggagctaatcggcggtagctaaaaaaggattttcgctcggcagttcaagcactcttcggcaaaaaacgacgatgagcagagaagaaatctgagatgtcagaatggcttccaatattaggtcgactgtatggggcgggaccaacaaaaatggtaaaccgagaggaacgacaattttagtcatttttgttagatttttgcgaaccaaaattgtttgttttatcgtttcgcccattctatttaattgaataataaattttaattttcagatagcaagcaaaaatg

SEQ ID NO: 118942 - DNA, 1003 bp, Heterodera glycines
  Promoter: Source sequence=SeqID_21358; Location=678..1680; Strand=+; Gene=SeqID_51961
aaaaggaaaaacataggaaaagtgacgacaaaaatttaaatgttttaactatgtctagtgtagaacataaaaggtaactcgcccggtgggactcgaacccacgaccccagcaatccgtgccgtgctctaaccaactgagctacgggcgcctcttttagaggttcttcaggtcctttatcccactttctcccacactccgttccttctggcatcacactaggccaaaatttcattttgaaaaaatttaaaaatttaacgaaaatgaaatgaataaaatttttgttgaaaattttggcagaggagagatgttttttagttttatattttaatggacattttgtcatttgatgaacaatttattttaattgctttttttggatatttgattctaaaaaaaacaaaattttatttttaaatacaactaaatgatattcattttaccaaaattccgaattaaccaattcaaaactttaacaaaatttttgtcatgactaaaactatttttttgcgtattttaagattttgttgatcgacaaaaagcggcttttgcgccatcggtgccgataggcgccgccgagggaaaaattgagaattttgaccatatttttagcagattttcattaaaaaattcttaatttttggtttttttttgggaaaaaattgattctattttcgttttgatgctctattaaaaacccaaattattaaataattgtcaaacattatgccaatttatcaaaatttaaaaagattctgaggattttccccaaaagcctcaaaaatcctcaaaattctcaaaaaattcacaaaaatcctcaaatcctcattttccaaaaaaaaatcctcattgacctatcaaaaagccacaaaatgaggataaatcctcagatctgggagccctggatatcatagtgcttcaaatatgtttcacattgcaaaactttatcttctcaatattttactcagatccccattcttacaggtgcatatttttttgcctatg

SEQ ID NO: 118943 - DNA, 217 bp, Heterodera glycines
  Promoter: Source sequence=SeqID_27778; Location=583..799; Strand=-; Gene=SeqID_58442
ttttctaagaaaaaataggagttttgggggcgcggcggtgccgataggcgccgccggggaaaaaattggaaattttgatcatttataaacaggttttcactgaaaattagccaatttataggtaaaattttgaaaaattttatggcaatttaatccaattcttaggggtgtaaaagtcgcgtttcgcgccaaaaagcgaaatgcgaaaagcgaaatg

SEQ ID NO: 118944 - DNA, 627 bp, Heterodera glycines
  Promoter: Source sequence=SeqID_836; Location=1..627; Strand=+; Gene =SeqID_62543
aaaattttaaaatttgtttcaaattttatgaattgagggggaggaaaaaacaacaattaccccagacaaaatgcacaaccaaatcattttcttaaaaagggcttggaaaactggattttttattattgtataataaaaacaacacactttaaaaatgatgtgctctcaacaaataaaaaagtccaaaaaattaaaaaataaataattaaaggataaaaaaaatgcaaagtttttgtgacaatgaatgatccaaaattattaattgaccatcattgttaattggataatgaaaatttcgcacataactttcaggattaaaagtacaagtttttgactgaacggttttccggaattttttaactgtattttataggaaattttttatgatttatggaaaaaaaaatttggatagccgtggattactaaggctttaaggaattaatgaattaattaattttttagctcatcgacaaccattcgagcagctcatcccaacggcggttgtgcccaccaattctcagcgaagtgccatcaccgctcggcaatactgtagcgcaacagtcgctcggcacaactactgtatcgagggattcctaccgtatccaaataaacactttccaatcaatg

SEQ ID NO: 118945 - DNA, 128 bp, Heterodera glycines
  Promoter: Source sequence=SeqID_45290; Location=727..854; Strand=-; Gene=SeqID_72615
taatcactaacctaacatcagttttggtcaattgcgaacctcggacccgaatttaaacaaaagtcgaaaattaatttttcaccaaatttcttgaactctgcttatacatatctgttttagcgtttatg

SEQ ID NO: 118946 - DNA, 63 bp, Heterodera glycines
  Promoter: Source sequence=SeqID_13896; Location=144..206; Strand=+; Gene=SeqID_77845
ttgatcaactcgtcctgcgaaaatgccgatctgtcgctgagcaaagaggagctcaaatgcatg

SEQ ID NO: 118947 - DNA, 1003 bp, Heterodera glycines
  Promoter: Source sequence=SeqID_565; Location=1361..2363; Strand=-; Gene=SeqID_45944
agacattaaaatggaaaaattttctttgaaaataacggaatcggaaagattgttgcaatttattcaacgggaaagggacttcaaaaaagataatgagctcgtcttagaggaccaaagcacactttgtaaggcagcaaaaacaaaaagggcgataaaaaaacgcataattggtaataaaaagtaattacttaattaggtagatagatatgtacctaagtacatcgattaatgcactaaccaaccattaaatcacaatgcaacgatcaaatcaacaaacttatgaatgatcaaacatcaagcatttcactagagccctggagattgaagctaaactacatataatgctcgagatcgggcttattgttgttagacaattaagccgctcgataaaattccatcgaaaatgaaaagtgtttttctctgcagtctctctatttattggttcattttttgttttttgactcggtgtgaaaaacagtcgggggttttctttgtctataaaaatggggatgttcaatgtttctttacatttctaacgttcataattttttttttataattttcatttcttttcgtttggatgagtgtgtagtgagtgagtgccctttcctttttggggtttttgttgaataggcagtcccctccccccttttttgaatataaaatttgcattgattgtatgtacctcgtcagttacatgtactttttagaaaaacaccaaatcttttaagccttttaaagaattgaattgctcatttctttccgaataccaaaatatttaaattcatggtttccttagttttttcaatttgtttttcttttggatgggcgtgtcgtgcccttcttccctgtttgctttttgttgagtaggcggatcccctcatttttgaatataaaatttgcacagtttctctctctctctctcatcttcattttgcttttagaaaatcaatcatttgcttctctcaacaaatcttctctcttctttcattcaaataaaatg

SEQ ID NO: 118948 - DNA, 381 bp, Heterodera glycines
  Promoter: Source sequence=SeqID_30607; Location=1..381; Strand=+; Gene=SeqID_61006
aagaaaatcatcgccttcaaaaaggtgaggaggcgttaaaaaaataaataatcagaaatcgtatataaatgtcaatcaaataaccatataatctaaataataaaagaagaattatcgagtttcttaagctttcgtatatttaaaaatgaaaaaattatttattaaatttacacgaaattattgtttttgatttattttttatcccaaaaaaaacgaataaccacaaaaagtgccaaaattaaatgtcatcttaataaaaacaataacaaattacattataattttactttaataataatatttattcgtataaattttcttgtaaagttatgatttgaataaataaattaactaattagtccataattatgtcgcggaatg

SEQ ID NO: 118949 - DNA, 1003 bp, Heterodera glycines
  misc_feature (217)..(217): n is a, c, g, or t
  Promoter: Source sequence=SeqID_27882; Location=103..1105; Strand=+; Gene=SeqID_58551
gtgatcagcgacccaattttccccggcggcgcctatcggcatgtgggagccctgttaatgtatgacataattgcaaaaaaatttgagattttaatatcacagtacgaattggctttttaccattcatttcattgccattgttcgtcccaaaatcgattaatcgtttaaccgttggccatcccttccattcattgcctattttttcttcagaatttgnacatcttcgcccccccccacccctccccctttttctctaattgttttgtcattttgattttcccctttctcttttccatcaaatgcaaattcgtcctccccttcgctccaaattttgacatttgccaacaaataaaaatcataccaatcaattgtaatgcttttgttactttcaatttttacaatccactgacaaatgaagcacatatgtataaaaattttctgtctcccgtttcaatgctgcaacttagtgcgaaagctctaaattttcatgctaaacctccttgagccatttaaaattaagaataattttttgtagcctttagccagaatttagttaaacaaaaactcggctctgttctagtttacgcgtccattgagtaaccaccaccaccctcatttttttagatcataacttttttcttacttagtcaatccaaacattcttggtatcattcgaatgcgtagagtttagttatgacctaagtaacgtagagtggtcattgatgggacgcctaaattgtgatagagccatatcgtcaacctttttgttaagagcatcaaattaggcctaaaaatttttgtgaaaaatcaattactgaaatggccgccaaacccctctcttctgtggatcgcatgaaattgttgctgagttcgggggatggggcggacgttcactttttggtgggccaaagggacccaaaagaggcgagtgccgtggaaattcaaagcattacaaaattgttttggcttttagcttttgtcggctcacaaactcattctgatg

SEQ ID NO: 118950 - DNA, 494 bp, Heterodera glycines
  Promoter: Source sequence=SeqID_4976; Location=1..494; Strand=+; Gene= SeqID_56423
taattgtccactatatgctgcaaagagtgtgacgtcaccaccgcgaggggtacggtagtccggtgaaaattcgcaataaattctgccgcaggcaagcggattcgaacttttgctctgccaccaaaaccaacacacaaccactctgccacgcgaccagttgccagaaaaaggataattgtccactatatgctgcaaagatgatgacgtcaccactgcgaggggtaccgtagtccagggaaaaaactttgaaaatacgcaaaacaagacaaaacgccacaatatatacataacgccataatttattgagacgaaaacctttcgcattagattcaaattcaaaatttggcgggaaaagtggcttggcgtcgttttttttgtttctatccttaatcctacccttttttcaaaatcattcttatcttctttcattatttattaacatgaatattttctgtttctgtcttttacaatgctgtttagccaaaccaactatg

SEQ ID NO: 118951 - DNA, 95 bp, Heterodera glycines
  Promoter: Source sequence=SeqID_30030; Location=832..926; Strand=+; Gene=SeqID_60480
agtttgcaaattcgtattccattttagaaaaataaacaaaaaataaaattcggagaaataaatttattttcagagaataattttggagaattatg

SEQ ID NO: 118952 - DNA, 197 bp, Heterodera glycines
  Promoter: Source sequence=SeqID_41762; Location=653..849; Strand=+; Gene=SeqID_69821
taaatggagtgagttatccttccgtagcgatttgctcactttgctatttggcggcccatcgccctcggcattgtccccctcccaagaaatggggaacattcctaaattcaagccgaaaaatgggtttctccaatacggtttcgtccattaaattaaaaaatccctccgctgaatagggtcgtctcaatcaaatgatg

SEQ ID NO: 118953 - DNA, 863 bp, Heterodera glycines
  Promoter: Source sequence=SeqID_20437; Location=1222..2084; Strand=-; Gene=SeqID_50974
tccccccagtttgtccccctccttttccgacaaactttctggtgccacgacccgggaacacaaacccttcaccattcaattcactttcgaccatccatcactcttctctctgccgccagccgaccctttaggctcccggcaactcaacccttcgccgtccgccgaccatcttaggcctccggcactcaactcaagtcgccagccgccccctcttaggctcccgacaaaccctcaccgagtcgtcagccgcccctttcaggctttcgaccattcatcactcctctctgccgccagccgaccctttaggctcccggcaactcaacccttcgctgtccgccgaccatcttaggcctccggcactcatcactcaactcaagtcgccagccgcccttttaggctcccgacaaccgacaaaccctcaccgagtcgtcagccgcccatttcaggctttcgaccattcatcactcttctccaagccgccagccgccctttcaggctcccggctttcatcactcaactctttgtcgccagcccccctttaggcttccgacaagccctcaattgagtcgtcagccgtcctcttaagccgaccctttaggctcccggctttcaccactcaactcttatcgtcagccgtccctctcgggctctcggctaatctccactcaacccaccaaccgacagccgccttctctaggctctcgaccaaccaagcccgactcttgcgtccagccgccaatcctagactttcgtaaatgtcggaactcattcgtcaacgtctcaccgccgaagtccgaaccctttcggacctcgtcaagcgcctccgacaaagggtcgggaggctcactgaattcaccaggatg

SEQ ID NO: 118954 - DNA, 178 bp, Heterodera glycines
  Promoter: Source sequence=SeqID_5906; Location=143..320; Strand=+; Gene=SeqID_59633
atggtgccctttttttgctcaaccaattaatcaagtcgaaaatttcctgcgctatttttcaaactttaaatagagataaatcgatgatccgactgtggttttctcaaagattaacttgttaagctaaatgacaaaaattaaaaataaacaaaccgtttttaggtgtatctctgcgatg

SEQ ID NO: 118955 - DNA, 696 bp, Heterodera glycines
  Promoter: Source sequence=SeqID_14181; Location=1..696; Strand=+; Gene=SeqID_78194
atgggccaaattgaaaaataaaaagcgaactgcgaaaattgcgaaactgaaaaatgcgaaatgaaaaaaaagcgaaatgcgaaaagccaaaatatgcgaaaagcgaaacgcgaaatttttttcaaaaattttaccaatagtaaaatcatagattttgtggttgtgatgcaaaaaaaaaaacaaaaatctctgcattttccggttcaatctttttctcacatcacaaaaaatgacaaattctacccattttgtggttaaaatttcaaaaatcatggtaaaatgagggtccggcggtgccgtcaggcgcccccggaaaatttttttttggaaattgtaataaaatatgatatgtaggaaaagttgcaaaaatttcaaaaaatttactatttatttcaaaaaaatactgaaaaaggcatgaaaaaggcacaaaggtcaaaaaaggcaccaaaatcgcaaaaaggcaaaaaaatgcacctaaaagttcaaactagaagcttaaaaccaagttaaaaacgcgtttttcgtgcgtattagaccataacaagttagcaaaaaaggtaattattaatcctctgcagcccaaaataataataaactgaagcattcgttttaaaaattaaattttcaaatatattcattcttaggagtggaaatttcgcatttcgcgccaaagagcgaaatgtaaaaagcgaaatg

SEQ ID NO: 118956 - DNA, 82 bp, Heterodera glycines
  Promoter: Source sequence=SeqID_2644; Location=228..309; Strand=-; Gene=SeqID_80875
tgtgggtatttaacatacaaatttaattggtaattaaatatgattcctaaatgaatattttaggttactctatcaaacaatg

SEQ ID NO: 118957 - DNA, 772 bp, Heterodera glycines
  Promoter: Source sequence=SeqID_6737; Location=1180..1951; Strand=+; Gene=SeqID_62695
tgggacaggctgaaatatgttgaaagtatttatgaagaaaattgtgtgagtccaactcaaaacaaattcggaaattaggtaccaataaaggagcgcaccttcggtatgccgttgaaattcggaggagaagtcacgaaatgaagtgaacaaaagtgcggaggagaaagaaacggaaggaagagaaggatgaggagagattgaacgagataacagcgaaacgatcggtcgatacaatgacataaatgaaatgttaagtgaatgacgagggggggggggggggaaggacggacgatggggcgactgaaaagagcagggaaaagagggaggaaagagagaaagacccaaattggatgatcggattggagaggaaaattggaagggagttgctgattagaaggtaaactcagaaaaaagggaggacaaaatcggaagagttggagggagcgacaaattaagacacgaacaaatacaaaacataaaagtgttcgggttggggtgtttgcgttcagcaacttttgcattgagcggtggagagatgttgtttcagtacaaagaatgggccgatatatttaaagtacatgaaacatatacatacaacagaaactaatgaaagacacaaaatgttccgattttttaatttaaaatattttaaaatggcaattttttgtctatgcgtcgtatttttctcagagatggcaaatttgaaatttgtaattcaatagttttgtttttaatgcttttcagctctttcttttggccgtcctttcaaatg

SEQ ID NO: 118958 - DNA, 74 bp, Heterodera glycines
  Promoter: Source sequence=SeqID_1287; Location=1..74; Strand=+; Gene =SeqID_71577
cgctgtccaaagaacaactcatcttctaatacgaagcgcgtctccgaaaacgcctacaaaacccagctccgatg

SEQ ID NO: 118959 - DNA, 602 bp, Heterodera glycines
  Promoter: Source sequence=SeqID_10812; Location=1..602; Strand=+; Gene=SeqID_74076
aatggttggaacgatttctgtctcccggataatgctaacttaaaagagaagcaaatcccaatccatacacctggaatatgccagcctttagatgtttttttccggtagttttgttgccaaaaataaaataaaaaatagttttagaatttggaagcaatttacgagaaaaatatcggaatttgtaatgatttatgatgtgaaaataaatttgcacgacagggataacattgttaaattacaatcgttaatccataatcaggttcaagcagaacgttttcatggatggattaattttgcctggagaaaatcgggttattacggggacgagcctctgccaaatttttgccatcccgttaaatactgctttgaagtgccaaaaaatgacatgtgtcagaaattaaattgtgaatgttttattttattacggtgtgcttattgtgaattatatttatgctttaaccatttttttaatgattaccatttgtgtgaagatgaataaaattgaatgaaaaaggagaatttttgacccgatggaattgatttcaatggccattaatttgcataaaatcaaaaataaaacggggaaaataaattaacatatg

SEQ ID NO: 118960 - DNA, 1003 bp, Heterodera glycines
  Promoter: Source sequence=SeqID_1977; Location=1043..2045; Strand=+; Gene=SeqID_77140
tgatcgttttatgtccaaaataagcaaaaaagctaaattttgcttttcaggttgatttttctaaattttaagctgtattgggtttttttcttctaaaatgatttttagtaccatattttatccatttttgtaagtcttactttgcgtttagcgaataaagaaattttgagaaattacaacatcaatttggaaaattttatgtgcatattttcactttttatgtgcatattttgccattttcggtgcatattttgcgattttatatgcatataattctatgcctgccctaatcatcattaatcaaagatgtctgtctctctcttctctctcttgattggaaacggcaacactaaaatgccttcctactcctttttttcatattgattcgaatggcacttttggttcttattttttcaccttctcttcttccccttcttcatcattcttttctgggtcagccaaagctccattaattaatttgtaaaatgcattcgatgtgattttcgttttctattcataaatttctaatgtttttattacttatttctctgaaaaatgcttttttaaaacataaaacccgggtaattcaaattaaaattcaacataattccgtttcaaattaatcggccccaatttgtttaattggttttcgttttggccattcattcttttacatacagtagtagtatcttttctcactctctctctctgtcactccatttttatttttaattttttaaatttaaataaatattagcggtcattgtgcctcacgacattcaaatcgttcaaaatgttcacaattgtacaacgtcacagcaagtatattttttgcagtttcaagaccgataataaaattaattttaaaaattggtcggtgtcacttagagagacaaagaaaaaatatttttttggatatttttgtgtttatttcttcttcttaatcaaaaaagagcatgctctcgactagaatcgggtgttgatctaatatattcacaggatg

SEQ ID NO: 118961 - DNA, 228 bp, Heterodera glycines
  Promoter: Source sequence=SeqID_32687; Location=430..657; Strand=+; Gene=SeqID_62964
aggctattagcaaaataataaaaataataagccgactaataaatataatgttgatatttcttaataaaaattaaaaaaagtttctgatttttaacaaaaaaaaaagctccaaagaagcttaaattaagagttttattttttgtttgaggctatttttattttcttcaatttgtaagaaattatttttaattttattttccgtttttagaaaatttaagtgtcaaaatg

SEQ ID NO: 118962 - DNA, 939 bp, Heterodera glycines
  misc_feature (825)..(825): n is a, c, g, or t
  misc_feature (837)..(837): n is a, c, g, or t
  Promoter: Source sequence=SeqID_3197; Location=1..939; Strand=+; Gene= SeqID_83639
ataaatttcttagattttatttaaaatgccaaaaaaatttggctttgattcatggataattaacctgacgagtcctgtctcgattatttttctgatttttttaataaattaaaataaaatggtgcaaagttttcatttataataaattctttcaaatttgattttctttaaaatttaattaatttaaaaagtttaaatttaattaagaatcgattgattgaatccatgcgaatcttcagcaccatttgcaactcgcgttggttcatcaagacttgcttcatcttattcctcaacaagcgtgatttgtttgagcaaaaaattcgacagggccaatcgatcagtgtgtgcttcaaaaattattttggtacagcttgtttggtttaacagatcctagtaggatttctttaaaaattttaatcagacagaggcattatgccattaccgaaccaaaattccggatttttaataatatttatagggataagatttttaggcacgaaaacgcaaaaaaattattattttcattaaaatttttaggtagcaaaaaaaagctaaattatgctatttcaatagtaaatgaataaattcaataataaaaatttttatgaaaatttttggcgtcaagaaaaaataaaataaatttttgtggtaaggaatttttcggaaatgggtataaaaaaaatgagaaaatttgcactaaaataagatgactaaggcattaatttgtaagcagaaaaaggccaaaataggcaaaaattggcattataaaaatcagccgaaaagtttttaaccaagattaaaactagtttttcttgcttatctcanagtattaagtgngcaataattttagacattttcctaaaaatttgatccctaattattaattatgaaaaataaataaaaattgaaaataattatagagagaaaaaaccctaaatg

SEQ ID NO: 118963 - DNA, 146 bp, Heterodera glycines
  Promoter: Source sequence=SeqID_6786; Location=1128..1273; Strand=-; Gene=SeqID_62904
gctgtggggggattggaattgttttaatttttgatgggggaagttttgggatgaaaaggaacaatcaaaagagtaccgaaacattttttgttgcccgggtgagtaataccaaaattgtaagcgtattaaattttcaggtcccgatg

SEQ ID NO: 118964 - DNA, 141 bp, Heterodera glycines
  Promoter: Source sequence=SeqID_9707; Location=273..413; Strand=-; Gene=SeqID_72434
tatcggagcagccaaaattgcagcacgggaatcggacaatacgacggtgtgcagcgacggttcgccacaaatccggcgggagtgatcggcagcgaggccaatttccgacgcagcaaagagataaaacatccgaagccaatg

SEQ ID NO: 118965 - DNA, 352 bp, Heterodera glycines
  Promoter: Source sequence=SeqID_16725; Location=1776..2127; Strand=-; Gene=SeqID_81127
tttccctgtattaaaccgattttgaagaaaaacactaattcggaaattctcgacttcttgttcgaattcgggttcgaggttcgaaattatgaacgctattcttatagaattatacttctatattacaataccaatactacagaacttaatattaaaatatttacatcactgacgcattttctactgacgcattttccggtcacgtcccgtccctaatgatgataattagttaattggttaagatttgcatttgagtcgcaaatgttcggcaacccttcgaattgtatcgcaaaagagcggagtgtgtgatttcaagaagaaattcggtggcaaaatttttaacaataaaatg

SEQ ID NO: 118966 - DNA, 96 bp, Heterodera glycines
  misc_feature (7)..(7): n is a, c, g, or t
  Promoter: Source sequence=SeqID_27959; Location=980..1075; Strand=-; Gene=SeqID_58617
tcccgtngggagtccaaaatcaaacagatcgaatccccttcggctcggtcgtctcttcctacttcattttcctccgttgggtgttgggaatgaatg

SEQ ID NO: 118967 - DNA, 75 bp, Heterodera glycines
  Promoter: Source sequence=SeqID_43428; Location=1..75; Strand=+; Gene= SeqID_71099
gaagaggaggggaaaggtgaaaaaattaatttaaaaacatttaaaaaaataaatattttaggcgccagtgaaatg

SEQ ID NO: 118968 - DNA, 174 bp, Heterodera glycines
  Promoter: Source sequence=SeqID_3862; Location=2835..3008; Strand=+; Gene=SeqID_52194
gtgccgttagcaagggcaactacagccaccaacaatcggtctacgagcgaccaatcggtctacgagcgaccaacgagcacgaattcgagaagctaacggcaaactggtgccgttagcagggggctccagcgaaacatttcggtcgacgaacagaacaggcggaaacgaaaaatg

SEQ ID NO: 118969 - DNA, 294 bp, Heterodera glycines
  misc_feature (51)..(51): n is a, c, g, or t
  misc_feature (53)..(54): n is a, c, g, or t
  misc_feature (58)..(58): n is a, c, g, or t
  misc_feature (61)..(63): n is a, c, g, or t
  misc_feature (66)..(66): n is a, c, g, or t
  misc_feature (69)..(70): n is a, c, g, or t
  misc_feature (96)..(96): n is a, c, g, or t
  misc_feature (106)..(106): n is a, c, g, or t
  misc_feature (113)..(114): n is a, c, g, or t
  misc_feature (126)..(126): n is a, c, g, or t
  misc_feature (130)..(130): n is a, c, g, or t
  misc_feature (138)..(138): n is a, c, g, or t
  misc_feature (152)..(152): n is a, c, g, or t
  misc_feature (236)..(236): n is a, c, g, or t
  misc_feature (269)..(269): n is a, c, g, or t
  misc_feature (280)..(280): n is a, c, g, or t
  misc_feature (287)..(287): n is a, c, g, or t
  Promoter: Source sequence=SeqID_14433; Location=1..294; Strand=+; Gene=SeqID_78473
attatttcgttttaaataaaaaagtgtaaaaataaaatcttacttggaggngnngggnttnnnatnggnngggaaagccctttcggaagttatttngagaaaattngggaaannggatttgtattngaanaaaaagtnaaaattgttgtaangtgtgttgaattatgtaaaaatggttaaaaagaatgataattaattatttttatttttgtagattaaataattaatagggttgnaagaattaaatgaaattttaaaaattgaatttngattgttgttngaatttnggatatg

SEQ ID NO: 118970 - DNA, 283 bp, Heterodera glycines
  Promoter: Source sequence=SeqID_12493; Location=339..621; Strand=+; Gene=SeqID_76130
aaattttataaatttttcttaatttaacgcatttttattatgaatttgtaatttatatatttatttgcatacgagaagttatgtttttttattcaaaaaaaaaaaaattaaaacaaaattgaaaaattgaaaaaacaaaaggttgtcaaaatttaatatttttaaatacaaagcttttattttattaaaaaaggcataaaaattaattttcaaaaaataaaataaatttcttcaatttcacagggaatcagctgttttgttggaaatttattatgaacaaatg

SEQ ID NO: 118971 - DNA, 385 bp, Heterodera glycines
  Promoter: Source sequence=SeqID_34758; Location=633..1017; Strand=-; Gene=SeqID_46404
aaaaaagcaaaaaaaaaaaaaatgttgtttatccccggagaaaaacattttttgctatgcctaaaattttcccgaattgtaggaaaaatgccaaaacggggtaatttttttttaaattagtcataaaaatttactggcataaagttggcactatgttttacttattgttagatagggcacttgcgaaatagaatattgctattataaaacttgaacattagcaaaaaaaaaaaaaaaatttttttttgttcaattttcaggcaaaaaaattgttgaatattttttaggaaaaaaaattcgaggttttatttgtaaaatttaaaaaaatgtgtccaaattgccattgattgaccgttttttccaggcccctgaagtgattcgcatg

SEQ ID NO: 118972 - DNA, 117 bp, Heterodera glycines
  Promoter: Source sequence=SeqID_28197; Location=1379..1495; Strand=-; Gene=SeqID_58841
taccgggaataatagtaattgcaatatattgctaattatttattaatttatcttttgctgaacaattgtcccttcaatcggaattgaccactgcaattagtgaagaaagcggaaatg

SEQ ID NO: 118973 - DNA, 1003 bp, Heterodera glycines
  Promoter: Source sequence=SeqID_8656; Location=1185..2187; Strand=+; Gene=SeqID_68787
gaattgaaatgtattgctcacccattgcattttttgtcatataagcattagggctgcttattttatgtaaatacatatttttttcctggtttctccatgctctaaatagtaggaaaaacactttattttttgtgtttgcgaacaaaagttgggacttttatttacatattttgggatttttctacatattaaatatgtacatatttttatacatattttggactttttcgtacatattttgcaatttttcgtacatatttttcatttttttacatattttgaggatttaggatttttgagaatttatagaaattttttgtaaaaaatttaaaatttttttttgaaaatgtatcactaaaaatcgatttttttcaaaaaatgatatatcaaaaattaatttgtaaaatattcaaatgtgattctaagcctattttgtatacatattttatttacataattcgcaaattttcttacataaaattagcagccctataaataaataaatgttcccaatttccaatttcaaaattcatttgtctttttggcaaagtgtttgtcccccttttcatttgcataatctcctctaattttggttattcaacagatgtcggcaaacattgctaagaaataagccccggttaagcagctaatagtaagaagcattgaatcctttctgctgtttgttaagccattgagagttcatttgcattttttcttctaaaattttctaattaatgccaataattttaatcatttccaaaaagtgaaataatttcaaataaatatttccgcaatatatttttaatttaccctattatttcctcaaagtattaatttgccattgtaaacatatgtgcacatataataaaataaatatcattggagaccatttatttcttttttatgattctaattttaaaatattttgaaagataaataccgtaaacagtgactaattactgtaattatggccgccacaattgcgtcccatgcgccccaaatg

SEQ ID NO: 118974 - DNA, 535 bp, Heterodera glycines
  Promoter: Source sequence=SeqID_6197; Location=1..535; Strand=+; Gene= SeqID_60675
tagggttgagcggtaccggtaccggtaccggtactggccggtaattaccggtttttttggtacctgtaccggtaccggtaccggtaccggtaccggttttttcaaaaatgaaattaccgttaccggtttgtctagtaccggtaccgccggtaaaaatttgcactggtaagaatgggggtctggtcgagaaaagagtaggaaattggtgaagaaggagaaatttttgagaaaaaattaaattttatttcatttagtcatggaattacacacatgcacatgtggtgtagtggttaaactttctacctttcataatttttcgcctgggttcaattccccacttggatagaataatttacatggccggagaccccttcgcaaaattggaaaattggctgctgaccccttgttttgcaataatctgaattttgaggtctatatctgaattttagtgttctatgtcctgaatttgaaaaaaaaacttggtcaacctgaatatacatatacttctgaatagagaccggaattctcaaaaatg

SEQ ID NO: 118975 - DNA, 229 bp, Heterodera glycines
  Promoter: Source sequence=SeqID_28745; Location=1258..1486; Strand=-; Gene=SeqID_59323
ataaaagttccattagccttgattttcctggattttaagattagggatgatgaaaaaatattttattgagaaccgttttaccgcaattgcatttccattctttcacaaaatgcgaaataattttaatttaatgaaattaaaaacttacaattttttagctatgaaaaaaatttcttctggcattcaatcgtgtttatattggtttaatattaatctgtccgagtaaatg

SEQ ID NO: 118976 - DNA, 261 bp, Heterodera glycines
  Promoter: Source sequence=SeqID_3021; Location=1265..1525; Strand=+; Gene=SeqID_82811
agtgcgtcaccgttgacgccttcgggaaggtcgtccgtaagcagagcaacctcatctgatagggacgaagaaacgaaaggcggcagaagacgaacaaaaaagcggtgagttttgacagggccaattatttttttcgatgataaactttcaaccccttttttaaactctagggaatatatttctggttccgtcgacaatggcaccgcggatgctgctgctgttcagcatcggtttagtgatggcatttccgtctcgtcaatg

SEQ ID NO: 118977 - DNA, 1003 bp, Heterodera glycines
  Promoter: Source sequence=SeqID_3796; Location=703..1705; Strand=+; Gene=SeqID_51906
cccgatcagatttgattgatcaaagaactcgaaaggtattgaaaagtaaataattaagggtttctgattctgaaaatgccattcctactaattaccaaaaaaaaacacaagaaaaatttgtaaaaaattcaatttttttaaattaagttttaggaaaaaacttttaaaaaaatgaaagttttaaaaacatttttaaatagaaattttttttatgaaaatgttttattttttcttgaaatttttgcttgaaaaatattaaaaacaatcaaaggtcttgttttaaatttaaattttttcactaatttataaagtagttagaacaagttttcctatggcgaagtgttcggtgcaaacggttatttcaaattgtaattaaaaaacgatgcaattaaattacttaaaattaaattatttcaatttttctttaaaacaaattcactttattatacaacatggcacttgtgaagttgtattaaaatatttgtgatattaaaaatgaaaatttattatattttattgccactaattatttgtatcaaatatttggattaaaaatgaattattatattttattggcactttgtagtttgtataaaatattaaaaataattatttttttttattgtatattattgaatatgtataataaattttttattttaaacaaatatttgatacaaactacaaaatgcagataaattataataaattttcatttttaatatccaaatatttgatactatacaaattatatattttaatgcgaactatattattagcgccaataaaacaccaaaaattgtcggatatattattattctctcataaattttttaatatttatgaaaaataagagaatgttcaacccagtttctgctatattctttataattattttcctccatttttcattttcaatttcaaatgaaaatccatcggtgaattttgacttttttttaaataattttttttaatccattttaattaggctgatgacaaaatg

SEQ ID NO: 118978 - DNA, 334 bp, Heterodera glycines
  Promoter: Source sequence=SeqID_31786; Location=1015..1348; Strand=-; Gene=SeqID_62080
aaattttcccggcggcgcctatcggcaccgccggacccccaatttactttagttttttggaattttagccacaaaattgccaaaatttgacagtttttgacgcaaaaacggctacaagtccctattttttttgctctcgggtgctgaatttttaatggaaaaattttttttgcccgaagagcaaaaaaggtcttcaggttccccccccccccaaaatttttctggctacgggcttgataacaattttaaagactgactttggcacccaaattgaatcgaataaaattttaaacaaatttttaatctaatttaaaacatttccttctcagacatg

SEQ ID NO: 118979 - DNA, 960 bp, Heterodera glycines
  Promoter: Source sequence=SeqID_4235; Location=3066..4025; Strand=+; Gene=SeqID_53708
tgaaaagaaagaggtcaagtggaaaaagagggaggaggaggagagaggaatggaagtgaagagcaaatgaggaaggaagaggggacaagctttgctagtgaaccattttctgtttgtttgtttgttttgtttaatcttaagtttaaacgaattgaacttttctttgcatcattgcttctccctttgcattatttgcataatggtggctcattccttccgtcgttggcaattgtcgaacttcattctctccccatttgtcccttttcccacccccccccccatccgtccgtcctccgccctttgtgccatccatcgcttcgtcctccggcagcccttttctttcaattggccaagcctatctatcgacatctcacgtatattgtcccgaacgagaatgaatgaggggacacaatttctctgaatgccttcccccgaggggattcctctgctttctcttcgtgctctgtcccactcagccctttccctccgtttttccgccttttggttttggaagaaaaataccccttgaatttttcataggaaaaacgaaggcaaaaaatgccatcagtcaatgagagagaaaaggccgtaaggaaacggaagagaaaatggggcggagaaaaaagaaaagttaaaaaacaactaaatttttatgacaaaatttatgaatttattattgccagtttctaaatgaagaagtctttcccccttaattttatcatttttttgttcatttcgcctgcgtttagtccaaattgccctttccttccctcgtcattttcatctttcaattcgtcaaacaatggccattccggcatcttttcccgaacacagtgccttttccaataagcccaaatcgacggaatgcctttgcggtgaaatggaaaagggccaaaatgcccccgggggaagaaagacaaaagtttattttgcggtacgaacaaattgtgcgaggccatg

SEQ ID NO: 118980 - DNA, 396 bp, Heterodera glycines
  Promoter: Source sequence=SeqID_6447; Location=2045..2440; Strand=+; Gene=SeqID_61605
atttaaaaaaaccaaacttttatatgggaataaaagcacatgactgccagagatatgatgatttatcatcatcattagggcttccaaaaatatggatataaaatggcgaaatatggccataaaacatggaccaaaaatatggacataaccgcgaaatatggatatagagagtagaaacccaccctagaagcttaaaaccaagctaaaaacatgtttttcatacgtttcaggccacccacagtccaggaaaaaatatggattggatttccatataattggaagagctaatcatcatttttgctaattccaaggtgtcgatgaatgattttttctgtttaaaataatgatttccaaagcacaaaattgcaaattttcagtgaaaatctgtttaaaatg

SEQ ID NO: 118981 - DNA, 340 bp, Heterodera glycines
  Promoter: Source sequence=SeqID_18680; Location=361..700; Strand=-; Gene=SeqID_83344
aaaataataagaaaataatattttcaaaaatacaccaccataaaatgcgagtcttctcaaaaaaagaatatttcattgacgaataccgaaatttagctctttttaattgcagttaaatccgatccccattaataactctgtgaaaaaatattttaattgacaaagaaaattggattaaataatacaaagaaagaaaaattggattaaataaattcgaaaattggattaaatcatacaaagaaaacaataggattaaataaattcgatctcaaaaatttttggttttttttttctcattttcctccaatttgtccatatttttcattgttccactgaaatg

SEQ ID NO: 118982 - DNA, 662 bp, Heterodera glycines
  Promoter: Source sequence=SeqID_682; Location=1420..2081; Strand=-; Gene=SeqID_58944
tcatgtgaagaaggtagattaaaaataaatttgagcaacttcccaagtagtaaattaatcattgagttttgtctttttgtcctagctcagatttggcaatcactaaggctgtgaatttaagtccgcaaaatttaaaaaattcaacgaaatccccaaaatcacgaaaaaattcaaaaaggcacaaaaatgcaaaaaacctaaaaatttaggtaaatgttaaaaaattctaatttttaacaatttatagaatagcattttataaatagagactggattttgaggcaaatttaatgcataatataaaattttcgcgcaatgattccataaattttcagaatttgatgaactcctaatactctgtgaccagcgagcagctgtctcttgggccaatttggagcaatcaacaaggtaattgttgtgaaaatatgtacaaaaaatgacaaaatcaaatttatggagaaatttcgaaaaattaacaaacgaccaaaaaaatgatcgcgtaaaaaaattgttcatcgcattttagttctttcgacaattggtcaaaaattggcgagggggcatttggagaagtctttaaaattgattccatcgcagtgaaggttttactcataatttttgcattatttcaaatattttatcaaatatttttcaaggtcatg

SEQ ID NO: 118983 - DNA, 520 bp, Heterodera glycines
  Promoter: Source sequence=SeqID_14610; Location=304..823; Strand=-; Gene=SeqID_78693
agagataaataaatatttgtttgttctctcaaaagggtcaacagaatccggcacaatttgacaatccatcgacgaagaagacaaaaagttatgccgaagtcgtgcgagtcaaattggctgacggaggaaacagtgacgagccaatgatggagtgggaagggcaacagaatcagtgggaggactcaacgcatggcgacggcactctatcggacaatggtaagaaaaaaaagggattccgtatttgctctttttatcatcccggggggattatttttcgacagatttatttgtcaaatatttttgaaaatttgtaaaaatttcgccaaaaaatgtcatcgcgtcaaaaataaatcattttttatttcatttttgttaaagaattccaaaattttacatgaaaattctaaaaatgcttataatatttaaaaaatattgaaaaacacaaacatatttttccgacccctaattcgccaaaaatttaataataatcaaataaaataaaatatgtttttacagaatg

SEQ ID NO: 118984 - DNA, 165 bp, Heterodera glycines
  Promoter: Source sequence=SeqID_10879; Location=314..478; Strand=+; Gene=SeqID_74161
atgaatgtgccaaactcttccaacacttcaccaggatttttcgagaacttggcccagtcgttacttgacctcaaaattcaggacaatcgcaattacaaaaatgaggaaccaagatctggggcaatgaatacgctcacacacatcaaacccaaaacaacagcaatg

SEQ ID NO: 118985 - DNA, 1003 bp, Heterodera glycines
  Promoter: Source sequence=SeqID_2399; Location=2211..3213; Strand=-; Gene=SeqID_79529
tttttgtttgctttgttattttttatccatcgatgaattaattttgcaaaaattaaacttcagctatttttttgatattaatttgatgacttttaaagttgcgcagaaaggtagtgcaattaaaagtgtaattaatggtgagaaattgtcattgcgcagcagcgaccgaccgacccaaaaggggcggcgatccaaccgaagatcagtcaattaagaaatcaaatgataatgactttgttcggtctgatcactgaaagttaactgtaaaaagtgatgaacaaataaatgttcaattggctgctgcaaattttaatgacccattaattggaaagcaaattaattaacaaccgcaaaccaaaccaagttcaataaccaaaaatagaaccaaattcgactcattatcaggtgtcacacaaaaaaaaatcctcaaaattgttagatttagcaaaatctatacagagaaaattaatcaagcattttcagatgaagccacaggttcattacccctaaaaaccacccattaaattcaattggcaattatttcttttttttccaaaggcaattaaattttaaaaattgtcaaatttcctttcccttaaaatttactttttttttttgctatttgaataattttccttttcatgtctaatccagctgattttttctgttttttaggtggcacttttcgaattgctggcctaaaatgccatcttgccatttttgaatcaatacattagcgtttacttccttaaaataatgaaaataataagcacgataatgcaatatatatatatatatatattttggtaacaaattttattatttttatgcattaaaacagaattaagtatattcaaaaatcagtgtaaacccaaatgaataattaaattgtttcttttcatatttgtagtgacttttctcatgtcacataacattaaaatattaatttgtaaatatatccaattttaatcacttaattaactaatacatattcagagtaatg

SEQ ID NO: 118986 - DNA, 76 bp, Heterodera glycines
  Promoter: Source sequence=SeqID_10770; Location=1..76; Strand=+; Gene= SeqID_74026
aaaatcccctttttatctttttcaataattttctctttttttaattttagcaactccaacaggacgaccaaagatg

SEQ ID NO: 118987 - DNA, 1003 bp, Heterodera glycines
  Promoter: Source sequence=SeqID_5469; Location=2134..3136; Strand=-; Gene=SeqID_58170
tttctttccaaatgaattcactgtccaaatgtccggatacgcattctcgacccaattcggcgaatttccaatgtattctgttgcaatcgaaatcggatgagagtgtgtttaaatgaatttcaaagacttttttttattaaaaaaatattttatctttttttacgagtgagttttaatgaaaattttctccacgacaatttttaaattactccaagccatcccagacaaatttcagtttttcacgaaagaaacgtgtccactaattaactcatcggcatttcaaagcgcaattgaacaccaaaaatgcgggttgatccagctatttctcgctaatggtcagctcgacgtgaatggcacatggacattgattccacaacattataatgtgcggccaattagaatttgcaatattttctcaccattacagaacccaactatgcatatacagtaatcaataggtcgtgacgggacttcagttttctaaaaaagcccttttctgttaataatacttacttctttgactgtgaacgaaaaaatttggcatataagaatttaattcgggcttttagctcccaatttttcatttaatctgcaaatttctaatgcagcacataaaattagccgtagacgaccaaaaaaaggacattagagattaaatggaaaattaatgtgaattttttattgatttttctactaatttggcattttttttatagcaaatttggggcaatctgttcaacaagcttaacgtgcttaaacttcaatcggacggtgaagagtacaaatattttatcgccttctcatcgaaaaaagtagagagacactgcacattaatcacccttgttaagtttaattgggcacaaaatgccacaaaattctttattaaatttcaaagaaaatcaatttaattaattttttgtactaattacatgagtaatttttgtacaaattaccattatgtgttggacatgcggtaaacgcggaacgcaatttgacccaaatg

SEQ ID NO: 118988 - DNA, 294 bp, Heterodera glycines
  Promoter: Source sequence=SeqID_15880; Location=803..1096; Strand=+; Gene=SeqID_80213
aataataattttttttattaattttattaattaattaaggttccaaaaaacgcgtaatttgccaatttcaatggacaaaataatggacataaaaaagaaaacgccatattttctcatcgaatttggccaaaacgagcaaaaaagtgcaatccgagaaaagggcgacggagaaaattttggcggcaaatggaacaatgaggcaaaaaatgcattaatttgaatcaattttaattgcattgattaatttagaatgatggcatcggctccattctcaaagacattgcgccacaaatg

SEQ ID NO: 118989 - DNA, 624 bp, Heterodera glycines
  Promoter: Source sequence=SeqID_11135; Location=2294..2917; Strand=-; Gene=SeqID_74477
agatacgtcacgtacatacaaacagcagtattcccagactgtaatatttaaaattggttacggtagtgatgatactatatttttcgaaatcggactttgcctagaatttagttggttctctttcatttatgaatatactttggctattgtaatttgatgataaattaaatccgagtttttataattaataaaacaatgcaaaattttaattttcattaaagaaagaacaaatttcctatttttcaaaattgagttggcattttgagattccaaatatttttcaatttttagattttttaaaaagttgacatttgcgattcaatgttttaaatttgtcattttgcggttcaaaatatcaaaatttacttccattatttttaaaaatctttttcaaaataatttttattattttttttttgcttgcagcagcaggtgtcacccattacacataatccatcgcatgtgtgcttttctcggcaaagaagtttcgggaaaacaaatgttttctcttcaataaattttaccacattcatcagaagcatgaaagcaaatcatttagttaaattaaataattattttgtttaaatatattttattaaattagaccaaaaactttttaaaatg

SEQ ID NO: 118990 - DNA, 97 bp, Heterodera glycines
  Promoter: Source sequence=SeqID_18912; Location=1181..1277; Strand=+; Gene=SeqID_83628
aactttgttcttctcacttagtttttactctgccaaacaattgttgcaaagtgaggaggacatacggcgtgaagagcaggcccattttttggcaatg

SEQ ID NO: 118991 - DNA, 222 bp, Heterodera glycines
  Promoter: Source sequence=SeqID_7476; Location=273..494; Strand=+; Gene=SeqID_64937
aaacggttgcttttgctcattatgctggacggttcgactcacatttcgtccttcgtgtgctgacagaaagggggcttaacaccgaactgatgatggccaaagaccttagggctgagcatcccggcaaagttgtactttcctcataagtacaataaaaatgagaattttgggaagagattgtcacacctgccgccttttgatgattacaatccaaatgctatg

SEQ ID NO: 118992 - DNA, 136 bp, Heterodera glycines
  Promoter: Source sequence=SeqID_35900; Location=1..136; Strand=+; Gene=SeqID_65350
ttgaatatttttttccgcgcatctttcgatttggcattgtattataaatcgaattcattcgaaaaatatttggaattttcattaattcataattaaatttgttcaaatgaattctttctgatgtgtttaaacaatg

SEQ ID NO: 118993 - DNA, 124 bp, Heterodera glycines
  Promoter: Source sequence=SeqID_6948; Location=1..124; Strand=+; Gene= SeqID_63378
catgccgtacacactacaattaaaatcctaatttcattttttcatagcgctcttttaatagtaatggccgagaatatttaaatgttaatttgagttctagtcaacattaaactttttagaaatg

SEQ ID NO: 118994 - DNA, 134 bp, Heterodera glycines
  Promoter: Source sequence=SeqID_25333; Location=287..420; Strand=+; Gene=SeqID_56082
agtgagaaaaagggagagaggggaaatatggccaatacgggggacacttacccaaactaaattttccaatttttagacccgccaaatcagccgttggtgtggccgcttcaagtgacaaacaattcggtgcaatg

SEQ ID NO: 118995 - DNA, 725 bp, Heterodera glycines
  Promoter: Source sequence=SeqID_466; Location=305..1029; Strand=+; Gene=SeqID_53454
ggtaaggaaagaattcgaaaaatgtgccaatttacccattcaaaaggtgctattggcatggatgcccaagctgcttccctgacgatgcggcaattgtgggcggtggtgagacagcaggagccctccgggcccgggacgcaaaacggactcgtgacattgcgcgggagttcgaggtggaaatcatctgggagtgccacttgaacgcaatgctggaggacaacccggctatgaaagcgtacttcgacaactgccctgattcaggcccaattgacttccacgacgccttctttggcggtaccttttccatttaatttttaactaattttccggcacaggtcgaactgggcccgaatacttgggcgcttcggtgatcaaccctgagacgggcgactggaaaagccgcacaatcaaagtgaaggactttaacagtctttatccgtcgcggtaagaaatgtcggaaaaaaatgaatagttgaaaaatcttttgcactttaaggaatatgttcaccaattatccggttggccacccgaccgtggtgcagtttgacaaggacgtggaatggaggcgtccagaggacgttgttggcgacgacggcatccgccttgagggcatcatcaagtgcttcgtagtgccgccccgccactgccactacgatatcccggtccttccgtaccggctcaacaaccgcacgctgtttcccctctgccggacgtgttccgaaatg

SEQ ID NO: 118996 - DNA, 196 bp, Heterodera glycines
  Promoter: Source sequence=SeqID_31066; Location=1..196; Strand=+; Gene=SeqID_61440
gagtttatagagcatcgctagaaatatctcctagtttcttttgtccacaaaaaaggtccagagatctctagcgacttacaaataaaatcccaaatcagcttttgatcccggcaggatcggtgttttacgaaatccctcccgccgtcaaaccccaattaaaccattttccctctgttaggtctgtggcgctttcatg

SEQ ID NO: 118997 - DNA, 215 bp, Heterodera glycines
  Promoter: Source sequence=SeqID_18339; Location=1277..1491; Strand=-; Gene=SeqID_82945
gttccaattatgggagcccctggtaaagagtagatcgaggaaagtattctgcatattaagcattaaatcgtcaagtatcagtaaaaggggtttttcctgttctttaatcttattcatgtccggaatcccgttaaaagtctcaacgccctccccgattaatcctaaaatactatcattcatctcaccataacaataaagaattttttcaggcgatg

SEQ ID NO: 118998 - DNA, 467 bp, Heterodera glycines
  Promoter: Source sequence=SeqID_6333; Location=1..467; Strand=+; Gene= SeqID_61177
tgagctctcaagaaaaagtgggcgaatggaagagaatgggagaggaaggaaagagcttttaaagcaaaaatgcgtcaataaacgaccgtttaataaaatcgtgtaaaaatggcaaaaaaattagtataaaagtggttgctcttcctccgccacgtttcattattttccattcgccatttcgtcgactttttctcgctgacaatgccttcaaaaatgaatttgtacgtttttcacatttttttcacaattttacgcctttccttcacattttttagtctgttgggtgtgttgttttaacacacaaagacaaaaattattccataaaattgaccatttcaatggcttttttcctcttcaattttttataatgaaattctgagcagatttaaataattttaatcttttttgctaagctaaattaaatcagtcgaagaaaattgtcttaataatttcccctcaaaaaaatg

SEQ ID NO: 118999 - DNA, 476 bp, Heterodera glycines
  Promoter: Source sequence=SeqID_39839; Location=1..476; Strand=+; Gene=SeqID_68321
aaattatgtcattatggacttttcgccactatctttgccactattttggcatttgtagtacttttactgtcgattttgtttgtttttttgaaaaaaattgacggcatataattttctgaaaattctatttatccccctgggggatcattggagattgggggattaatggagattgggggataattagagcaaatacggtatacggtggcatctgaaaatgtatgttaaaagtatcatgtaaaggaaacaagggcaatctttcggaattgtggtcccgaaaattttttaatttgtatggcactttttctaggcttaaaaatatgctaatcacgaatatgaactcggatttgcccaattccgaaccccggacccgaattctaataaaaacttgaatttttttttttcaaaaatatacgttaaaatcgatcaaattttggcgtaaaccgcggatttttatccaattaacaatttgaatg

SEQ ID NO: 119000 - DNA, 381 bp, Heterodera glycines
  Promoter: Source sequence=SeqID_22179; Location=1759..2139; Strand=-; Gene=SeqID_52840
tattattggttacggtattcctctaccgctttaccactttttcatagttataccgttaaattttcaacccaatccgatgggactgatgagttcggttccgttgggatctttcttgcccccccccctccgcccccaccagaaaaattttttaaaattattttcaaatttggaattcagtcgttgatggcacgcccggatggcaggtcaaagagcaatttgcaaattttaaattaaaatttttgatttttgtttctcgcttgattagcttctatttgcatccctccgacctgtccgacgccttcgcaatggccgtcgcattggccgacacgcagacgggcgaacccattgaccagacactgcaggcgttcatcttcagagatg

SEQ ID NO: 119001 - DNA, 171 bp, Heterodera glycines
  Promoter: Source sequence=SeqID_1237; Location=246..416; Strand=+; Gene=SeqID_70469
tgtaagttttgaaatggattttttatatccattaacacaaaacggagtcgggaggggtggggcagtgaaatttcgagggaggaacgagtgaaattatgaaaaaaatttttttttaaatttcctcatttgttagtaaatcaaaaaaaaggtgcatttttttagttgcaaatg

SEQ ID NO: 119002 - DNA, 470 bp, Heterodera glycines
  Promoter: Source sequence=SeqID_901; Location=12325..12794; Strand=+; Gene=SeqID_63560
atgagccacagcacacaaaattgttttttgtaagcaacaaacaaaaaacttggtttaacttcaatttctattcattttcaggtgctgtatttgcaacaaaattgttgatgagacaaaaattgttttttgtaagcaaatcactttttttggttcattaattcttatttttattttaaagtgttttggtttttggtcccggattgaactggagcgaaaaaactccaaaaaaactttttatttaaattctttaatacttgtgtttaaataattgtcacaagttttattgaatttgaataaatttgtttaaatatttcaacatttgtctctactaattaaaatgttattgcgtcacaatattatctgcttgcaattcattccgtcttttcttcattccttgcttccttttttcccttccttccttcctcccttcctttcttccttccttaattattcaatttttagataaaatg

SEQ ID NO: 119003 - DNA, 461 bp, Heterodera glycines
  Promoter: Source sequence=SeqID_38973; Location=1..461; Strand=+; Gene=SeqID_67653
tgtatacgtcagctgctgaataggggttagagattgcacaaagatgcaaaacatttaaattttttaaaaattccatttggcataatgttttaaattcttagcacttttttaaataataaaactgcaaaaaataatcgtagtaatttacgcgctgcgaccaaaaatgcccaatcccgcttttatcctctcaaaaaagtccggtatccataagaatgaacgagaaaaaaaatttccctaaagcaaaggacgagaaatacaaaaataaaccgtaattcatagattaaaaagaaattctccccaaatttacttgttttcaaacgcttaattcagaaaaagaattgttttgcggttaatttctgttgaccccattcccggcttttgctcaacaacagatggtggatttgtacgagttcaaccggcagcgaccgttgagcagcaacagcaaaagtcggccccaaatg

SEQ ID NO: 119004 - DNA, 261 bp, Heterodera glycines
  Promoter: Source sequence=SeqID_19454; Location=2235..2495; Strand=-; Gene=SeqID_84174
cgccgccgcgtagcaaatgccgtcgtctttacgacattgttttgtgctggtggcaatgcgactcatcctcaaaaagcatgcccttttcggcaccaaaaaaatcccactcttcgaatactgtgggcccgaaccggacggtgagcaaatggaaagagtgagggacacaatttggcactaattaaaagaaaagacaaatgaactaattaaatattggacaattttaaaacagctgatcccgccgcgggacaccttcgaatgatg

SEQ ID NO: 119005 - DNA, 186 bp, Heterodera glycines
  misc_feature (17)..(17): n is a, c, g, or t
  misc_feature (41)..(41): n is a, c, g, or t
  Promoter: Source sequence=SeqID_12258; Location=1..186; Strand=+; Gene=SeqID_75846
ctaaaaatcaaaattantttgttgccaactaaattcgcttncacttgggagagtacaattaacaaccaaacaataaaaaattatattgttgctaatgcgatacaaaactcagcaaaaaaaaaaaaaaaaaaactgcacttttcccccattttgtagcccattgttttggcaaagtcacaaaaaatg

SEQ ID NO: 119006 - DNA, 952 bp, Heterodera glycines
  Promoter: Source sequence=SeqID_30303; Location=311..1262; Strand=-; Gene=SeqID_60717
tttgagggtttgacaaattttttgatcaaaatttcataaaattcctaatagcaaatcgagctgaaaatttggggtcctgctgccagttcgtacaatgggcggtttgtacaacggagttagtacacaatagacagtttttacaaaagctttgaataaacataagctttcaaactaagcttgagcctaggcttaagcctaagcataaacttgcttgggcttaggtataagcttaggcttaggcattgttttgtaaaaatctctattgtataaactgctattgacccaaaaatttagcaaaagactcactgatttaattccatttaaaatgattttgaacggaacggtccgttctgctgaaggtgaataataaaacacggaaactttaataaagatgtttattaacattttcaaaacatttaatattaaatattttattttgttttttcatttcaaaaaagaaaaattaaagaaaaataataaagaaaaaaaatttaaaaaagcataaatggaaaatatgggaaatgaccaatgcgaattccattccattcaagtaaattcaaaccatagccccagtaccaaatccataatgttaattacaattaatagattgttttaatgtacgtgaaaaaagaaatccaaaaaaatttgaaatcggcaatttgcccttagggaatggagtgagtgatctttcgcccttacacaaatttcctttaatctctttcaaattgcttttttgatttatttattcttcttagagaattcaaactaattcaacgttattcatttacaaacattcaccacaaataagtttgaacattgattaatgagacaataatatttgtgaataatacaattaattacaatagtattgtaattagcgtattaattgcttttttcaaaaaaaaaataatattttattataaaataaaaataatttaatctagtgcaaatg

SEQ ID NO: 119007 - DNA, 647 bp, Heterodera glycines
  Promoter: Source sequence=SeqID_1386; Location=4322..4968; Strand=+; Gene=SeqID_73205
aattcgatttcctttactcatattgtagttacagtaccaatcagtgtatcagcaacatttgcaaaaaaaaatgaaaatttgaatttttcaaaatgttcgagttcgggtcaggggttcgaaattggtcgaaatgcatgtcatattcgtgctcagcgcatcaaataacccttaaaaatgtgttttttggatttttattcctttttttttgtgggaccaatgatctgcacaattgccaaatggcacttgtcagtgtaattttgaattagcgcgcaaaaaattacgccaattagctctttgacgttatgagaaaattttgtctaacactgggcttaacccataatgctcaaatggcatctgatcaacttctttcatcccgagatagatttttctcattcagagttttagattcataaataatatatttgtcctggtccatccacaaaaaaataaccacaacatgaggctaaatcttaacatttgggtacactgataattttattgatgaattaatttccatctatttttcatgtcgattaaggcatattttggttaatgtacctatttatgtcgaacctctactgactccccattttcgcgcatctccaaaaataaaatttgaaaaatacgcctccaaaagacgacagatg

SEQ ID NO: 119008 - DNA, 1003 bp, Heterodera glycines
  Promoter: Source sequence=SeqID_20830; Location=191..1193; Strand=+; Gene=SeqID_51416
caccgccgaccccaaccattgcaatttcaaataattgtgtaatttttgcttttgccaaaggccacatattagtgtcttcactcattcattcggccattttcatttaatttttgtcagtcccaactgacagctgctggcgaattgggcatgccaaatgcattggcttcgaattcccccccccccccccgggggatggccaatgtaaagacggcgttgtccattccctcccctcactttagcagtgtttcattgtgagtttatcattcccttttaagcccttcagaaaagggtcactctcccgcagaattcgtcattctcattcatttattattcgtaaaatcccatcaaaaccatcaatatttctaaggttaattaaacacaccgtccgaaaaaacgagatgtgtaccaataaatagagagtgccacagaaaaacattatctttttttctctaattttttgtctccttttggcgtactatctaatatttttattattaggaaaaacaacatttacttcgctatgtttagcttcttttctatatgttagatccacaggaaattttgcatatcgttagagaaaaaaattctgcatcgattaatgctgaatttatttttgttaatgctctatttcaaaagttataagaaaaacaaaattttaaagcctcatagcttttctctggtacaccaaatcgcttagcatttgcttagaaaaagcttctcattatcaagagctttcgaaagataccaagattatccaatttggttggcaaaaaccttcaaaaataattcccaaatatcgtgattttttaatattttggacaaaaataaatgaaaatattcatgttgcacaacggactcgaaccaccaccctttgtccctttactatcttacaaaaaccactgagccacacatgcaaatcttttctggcacaggagctcatttcccggacgctgtgtttaataaaccctccaaattaatgaaaatcaactatcaaattgagatg

SEQ ID NO: 119009 - DNA, 144 bp, Heterodera glycines
  Promoter: Source sequence=SeqID_29479; Location=1..144; Strand=+; Gene=SeqID_59973
acatacgatgtcctgtaagagccgttgtcaccaatgtgaaaaagttactaatttaatccaacaaattaatttgatatttcctacagttggaccgcaatatccttgcataagagtgcaaggtgtctgtctacactgtcaacaatg

SEQ ID NO: 119010 - DNA, 431 bp, Heterodera glycines
  misc_feature (67)..(67): n is a, c, g, or t
  Promoter: Source sequence=SeqID_41738; Location=927..1357; Strand=-; Gene=SeqID_69805
ggtgacggtgtgccttacagcccgcgacacgggacaaaaactcaacccatacgtgctggtcacaganaagcgatcgatgccgcagattgtcaccaaatttgctagaaattggtgataaatttcgctggctcgatatggatgaacgatgacacaacggaggactacctgcacaaaatcatcggggcaaagctgttcgttggcgaacgcctcttggtttgggtgcgtttggcagccacaagagcgagagaactacgaaggtggtgaagggattgggagtgaaaacggtttttgtccctggtggctgcaccaaattcattcaggtaactaaatcatccttcacaacgaaattcatttttcttccctaggctcccgatgtctcgtggaataagccgttcaaggagcgaattcggcacttctacagcatttggatg

SEQ ID NO: 119011 - DNA, 55 bp, Heterodera glycines; identical to SEQ ID NO: 116214
  Promoter: Source sequence=SeqID_129; Location=8427..8481; Strand=+; Gene=SeqID_46876

SEQ ID NO: 119012 - DNA, 689 bp, Heterodera glycines
  Promoter: Source sequence=SeqID_2106; Location=1567..2255; Strand=+; Gene=SeqID_77881
tgctgttcggcttgtgctaaaaaaatgccaaacaaatttttgtaaccaaaaaatgccaaacaaatttttgtaaccaaaaaatgccaaacaaatttttgtaaccaaaaaatgccaaacaaattttgtaaccaaaaaatgccaaacaaattttgttttatctttttttgtttgactttttggatcagaaagtgtcaacatttattttattgatataaaaaatatatatacaattaaaataaatgggatcagtttgttatcccccaccaacctgaatttttttaatctcgaagttagaaaatttttcaaaaaaaaaaacataggtaaaatttttataagaaaatttttgaaaaatctagtgatttttcaaaatttaatgtttttcaaaaaattttcccaaaaatgcttaaatttttcataattttttttccttctaattttcttataaaaaatttatttgttgaaaattttttaatattttacgggtggtgggaggacttagtgcacccaaaataataaatggactaaaattattataaaatatattttaaaatgtgaatgaaattcattatttaaaattattaatttatacccgtccccgcacaaaaatgtgacacttcttctgcagtttcatcccaccataatttgcaccattgtcattttcatcagcaaaaggtgcttcaaaggcaatg

SEQ ID NO: 119013 - DNA, 1003 bp, Heterodera glycines
  Promoter: Source sequence=SeqID_16617; Location=2477..3479; Strand=-; Gene=SeqID_81030
aaatttatttatatttttaaagagccgaaaatttttaagctaatgaaaattaaaaaaaacccacaaaataaaatttaaaaaattggaaaacgaaaaaatatctattgtagaagcttccctttttgacaacataagcaaaaaacataaaacttcatccaaacacttaattttagttatatttcaattgttttaaagttttttcgaataaggaaaatttttaaacccaaaaaattttatcaaaaaaaaaaaaattaaattaggggtcaatttttgtgaacatttttttcaattcttaggggtgtatttttgaaattttttcggacatttcttaggggtgtatttttcgtttttattgcattttggttaaggatttattcgaaaatcctgaaaataggtggcaaattggcgtaattggcacaaaaataggcatttaggcattaaacacaaaaagttcaaaataggcaaatgcctaaaaaacgaagccctaacaattataacctcaaagaatttaaattgaacaaaaagtatttaatgaaaagccgagtggaaaataaaaaagatttcataaaaattaaattcgtaaaaaatccaaaatataaaaaaaattatataatatttccttataaataaaaacaattaaaattattaaactgactatgtgattaaaaattgcgttttttgttaaaaaatatgtctaatggcttcattttaagcaagggaaccatcctaaaaatacgttaaaaaaataatagtaaaaacaacaacttataattaaacttctcataattaaattgttatttttacgaacagtataatgaatgaaatgtaaataaaaacaaaaataaaccaggaaaaagaataaaatgaattgaatttatacatttatatttaggtttattttatcggatttaaaagaaataaataaaaacatttataaacgttgaaatcattccttgtatatgaaatattccgtcatttgttataataacattccagaaatatg

SEQ ID NO: 119014 - DNA, 88 bp, Heterodera glycines
  Promoter: Source sequence=SeqID_26180; Location=1..88; Strand=+; Gene= SeqID_56928
ataaaatgacaaaaagagagtatttcacttgccaaacattctagagttgttagatctgatgggggcaaagaaattttacacgtgcatg

SEQ ID NO: 119015 - DNA, 381 bp, Heterodera glycines
  Promoter: Source sequence=SeqID_4886; Location=4780..5160; Strand=-; Gene=SeqID_56088
ttttccggtctttcttttttggcgtcaaaacggaccctaattttcaaaaacatcggaagcgctcttcaaaataagctgatgtgctggcaaaacctttaaaaaacgtggataattaatgaaattgcaattgaaaaataaaattaaatttttatttttaattaaactcgcctctttttttgagttttttttttcaaaaaattagcaatttttgtacaatttatgttaataaattgcatagaaattttcaatttttttccgacggcacctatcggcaccgccggactcaaaaaaacttaattttcttgagaatttttaatttctgtttttaatttctgtttgtattttctattactggaagttgaaagaagaacatggaaaatg

SEQ ID NO: 119016 - DNA, 1003 bp, Heterodera glycines
  Promoter: Source sequence=SeqID_1352; Location=6298..7300; Strand=+; Gene=SeqID_72984
attttaaggaaaaaattgatttttaaaaaatttttactttgaattacctatttttcaagtgaaaatattttaaattgtttaaaaatttctttatgtaaattagagttgagcgagaccgggactggtactgaaaaaacgggtacaactgagtacccagtcccggttttgacaaattttgaccggtaccgggaaattcccgggtttttcccggttttcacaaccaaaaattccggtcctggtttttgtcaaaattcccggtcccgctcagctctaatttaaatgattgagtatttttaaatttaatggactaaaaatttccaggtccaggcaaaactggaaaaacctggatttcctggacattagaatttttatttcaaatgaccgatgttttttcaaaaaaatgtttaaatagatttaaaaacagattattagtgtaattagtagaggccgagatttccaaaagtgccggaccggaccggtctgatattttcagaagcaaccggtttccgggcccggcctctcaaaaccggtgaaaaaagacacgaccataaaatatttttgaaactttaatacactataactttttagagaaccatccaaattaagcattattggtattatttgatagccctaagtgtcctctatcaaaaactttggttgtgtttcaaaaaagttgtggcttgtaaatttcaaaaattgatttggtaaacctcttgaccacaacttctttgaaactcatgaaatttttttaaatatacagaaaaatagaggacactttaggcttcaaatggtaccaagaatgtttaatttggttgcttcaagaaaaaattatgatgcactaaacttgcaaaaaaatttttatggtcgtgtgaaataaaaaattcaacagaaaagttcaaaaaaattgataacattatgccaaaggaatattttccaaaggaaaatgaacaaaaatcaagaattttaggctttgtcataaaccggtaaaaaccggtccaaaatg

SEQ ID NO: 119017 - DNA, 605 bp, Heterodera glycines
  Promoter: Source sequence=SeqID_40112; Location=1..605; Strand=+; Gene=SeqID_46616
tattaaaaccgcagaaaaaataagtaaaaaccgaatcctcaccctacccattaatacgcaaaaactatacatactaaacatgccttaattgtcaatttcaatttttttgtttaataatttttcttggcagattttgattcattagatttgatggcaggcgtatctttgtgtgctagtctcttctccctctttcttgttgcccccccccccccccccccgctctctctctctctctgccctctgttctctctcctttctttgccttgtctctttctctctccctctccttcgccgtttctctttcgtcacactttcgtcagcactgtccatttcaaccaatgggcgtgtaacatgttgggtttttgtggattcgttttcattcatcagatagatgaagcgcgctctcaccattcgcttctttgaaaagagatcgttgagcttcgcaatacttaagtggcaaagcaaacagtcgaagtctattacaacactttttaatttgttatttttacattgacactcacaatcaatcagacatttcttcattttcgtttaagcatgaataacattaaaaatactaaattttatttcattttagaaagactatg

SEQ ID NO: 119018 - DNA, 166 bp, Heterodera glycines
  Promoter: Source sequence=SeqID_15294; Location=3230..3395; Strand=+; Gene=SeqID_79520
agtcatcgacataaacggaaagaaagtgaagtgctatggaattgtttctctgccaattgagcgcgggcctttaaacacgaaaattcgtgtattcgtcgcagagtcatcttttgggtacgatttgattttcggcacgaatgccttgaatcaattgggcttaaaaatg

SEQ ID NO: 119019 - DNA, 130 bp, Heterodera glycines
  Promoter: Source sequence=SeqID_22526; Location=1..130; Strand=+; Gene=SeqID_53192
tttttgaatttataaaaacgagtttttgatatcacttttttaaatttttagaggtacattttcaaaaaaattaaatttttcacaaaaattttttaatttagggagaaatgctaaaaaaatccaaaatatg

SEQ ID NO: 119020 - DNA, 1003 bp, Heterodera glycines
  Promoter: Source sequence=SeqID_149; Location=55..1057; Strand=+; Gene=SeqID_75163
taagcggataaagggataaccactagaccacacatcttcccaaaaatatgctttatatgccaaaatatatgtgttattttaaatgaaaacctacaattatatcttatatatgacaaaccctagagaatactataaaaaaatgcaaaatatgaaaatatggtaatttctgtataaggatcgaacacaatgtaaaaataaggaaagtctaaaagaatagccactaggctatttgcacaattgtcaacattacttttgaagaatttattaatatatttttaaaattttttccttttaactccaattttctttactaatttttcactcagacccccattcttaccagtgtttgtttttcccgtttgccctaccgggaccgggacctgagcttttcaaaatcgggaccggtaccgggacctcggatgaccgggaattcccggcccggtcccgcttcactctagtattgcgctaaaaaaccgccgcacactcgactacggctacgggctatggaagaagtccgcgcgtgatccgcagtcaaccgctgtggcgctcgtcagactttttcctccgccctccgtctcgccccactacttgctccgtcttcgcatgctcccttttatttcttttggtactgaattgtccattttcactgggacttagttgccccagtgcctggatggcatcggttcgaatttataccttgttttttagatttagctgatcaagagctttcgtatgatatcaaatttgtctgaatttgaccattttaagggtcagtggcccccccttttcactcaatttttcgagttttaaaccggttcaacaaccgattttttggcatttccgcaactggagacgtattttttcgtgcagagctcgtcgagacaaatcgattggtatatcatttttgccgttttttacggtggtttactattgtacacccttattttgctatctgtgtgacattattcctaataaggcaaattgtgctaattgccacaaaatg

SEQ ID NO: 119021 - DNA, 137 bp, Heterodera glycines
  Promoter: Source sequence=SeqID_14269; Location=920..1056; Strand=+; Gene=SeqID_78287
cgtcagcaaccgaaggttggccggaaagtcgccgcatttcagcgttggaaagcaaaataagtggaaaagcagaacgtgcctttggcgccgccatgaagcataggccgaacaaattcaacgaaatttgtcgcagaatg

SEQ ID NO: 119022 - DNA, 570 bp, Heterodera glycines
  Promoter: Source sequence=SeqID_33172; Location=353..922; Strand=-; Gene=SeqID_63318
aataagcatatctcacatggaattttttaatgggttcactcactggtggactgttatgtttttgcaaaaaattgttgcctttatttagattttaaaattaaatttccattttttttttgctccatttactgtactttttttgaaaatttttaagaaaactccccagtcctttgatcttatgtaagaagtaaataaaaaattgtttgttacacattcattgtttgtttacatattattgcttattagtttcaaaataagagaaaagaaatgcaaattgagtgtatattttaagaatgttctctttgtatttatttatcaattatattaataataaataaattataaaattaaattttaattactttttgtacaattcaataccattatgttcattatccacagcttgttattggcattaagtttccattcttaaaaattggttttcttagattttagatttgcattttattttgcctctttttgttgtataaaaaaaaatcggttttttataattatatttgttattcctttataaaatttagatttaatcaaatccaaattttcactatg

SEQ ID NO: 119023 - DNA, 511 bp, Heterodera glycines
  Promoter: Source sequence=SeqID_3585; Location=2369..2879; Strand=-; Gene=SeqID_50971
ttgggtagtgcctgtcctcccctccccccgaaaagcgttcaacaatgcacggcacataaggaaagtgcagctttatgcggtggcgggcgtaaaaatgagcagccacattgatgttgaacgggttgcgcaagtggccataagcgggaagaaatgctgcgccccgtgccgaaatcccagcaatgaagaatgttttggtgagcccgttacggtcgttgtaggtggtgcgcactttgcgcccaattaggtgtttcagcacgagtgcgcggtcctcggggtggttgagccggtctcgcaacaatttgacagggcaatcgagcagctgagcgcaaaatacgcttacgagaaccattgcaggagaaaatgaaagtcagatgtgcatggatttcacttttatatccggaaaagtggtgccacgcccacaccaaatttttttaccctgacacgcccactcccaaccaaaatatttcacccggtcaaaactcaaaatcattctaccaatttttccaaaatg

SEQ ID NO: 119024 - DNA, 1003 bp, Heterodera glycines
  Promoter: Source sequence=SeqID_9936; Location=1885..2887; Strand=+; Gene=SeqID_72971
cggtccgagccgactttgccttacgcaaattttcagttaaattctgttcaaattcatgcgaattgtgtgtgtttttctgcaaagacttcttccattgttccaccttctcatttgttcattcgacagatgcattcgaattgcaattttgtgggttaataagttacattaatccaaaattgatcatttttagctcgactcatttgcccttttcattgctcaccatcggaccaatccctccctccgtctttacacggctccaatttcgacattttttgatttggttttctgttggagtgaaggcaccctttttgaacgggaaacggacaagcaaattgaagaaatcagaagtaagtttagtcattttcagtctcagcgactctaaaatcataattttccgggtgagtcgcaatttgcaatattccaaaatttcagagcggaatttttaactttttatattaaacactattgttatttactttcaattccctttcagcttttcctccttcctttgcttccaatgctcaaaaacccttccttttttgccctccaaaaagacgtctttgcgcttctcttccttctcggcctccgtctttgcttgaactgatgtttttacaagaatccacctctgctgaagagaaaatgaaaattttaaggaaaggagaagggcgttttggaggaaataattgcggaagagaacggtgctttatccgtagttttaatataacagaaataagggttcatgattaatttcagtccattttcccgtttctcaacaacgtttttacccatgggcgatttgccagtgccaatgcttccaaattatctgaaacgaatgcggcgacgaaaatgcaaaagtggcggaagtgaaatgccttcaaactctgaaattgctacagaccatttttttgacccaacatctgcttcattgaggcgatttaattaaaaaaccaaaaaatatataaagttttttttataatttagtgatgtgtcttctttatcaatg

SEQ ID NO: 119025 - DNA, 184 bp, Heterodera glycines
  Promoter: Source sequence=SeqID_38184; Location=900..1083; Strand=+; Gene=SeqID_67079
ctcacaaactgaaccgaaggatggtggaactgcctgaacgatgcacgttgagaaatcggatcatctgatttttttgtatgtaaatcccatttcacttgatgaactccctcaaactgttgtcatttcaattggttaatctcattttataaatggtttatttttctagataaaattagaaaaaatg

SEQ ID NO: 119026 - DNA, 223 bp, Heterodera glycines
  misc_feature (18)..(19): n is a, c, g, or t
  misc_feature (70)..(71): n is a, c, g, or t
  Promoter: Source sequence=SeqID_24454; Location=1..223; Strand=+; Gene=SeqID_55188
catgaagaaatgcgcaanngatggaaaatttgggcagaaaagatgcttctcgcctacaggacaccccgannattcggcactcaacggactttcgcccgatcaattgttcttcggtcgaaggcttcgaactcagctgtctctcgtccatccgaaggaagaacaagccgaagtcatcgacccagccaaaatccgcaaatcacaagctgattatgcgcgaaaaatg

SEQ ID NO: 119027 - DNA, 569 bp, Heterodera glycines
  Promoter: Source sequence=SeqID_26648; Location=984..1552; Strand=-; Gene=SeqID_57400
ttttatagaaataaatttattatgatttaatttcttctaattataaaaaacggtacaaatatgtcaaaagttccctgacattcttttcatggtcgagacacgctttttttattttcagctttctaaaatttattttttaaattattatgagtttttgagtccttcattatttatttaaacattaacatatatattatatttaaaatgaatacaaaaaataatttgaattatttaatttctgaaagtcgcttatttttaaattaattttattcgagcagcagccgggctggtagggcagtagcagctcatgcgcagatgcatcagtgcggcgttggtgaggcggggggcgtgaaggcgcgggagggatgcaggctagaggcggggaacggggaggcagaggatagaattttacgaagggcgctttgcgccacccccacccccgccctcctcccgtgtgtaccagaattatcaaaaacattctgacgtttaccagaattttcagaacaattcagatgtttaccagaatttacagaaccattctgacgtttaccagaattttcagaacaatg

SEQ ID NO: 119028 - DNA, 238 bp, Heterodera glycines
  Promoter: Source sequence=SeqID_32348; Location=544..781; Strand=-; Gene=SeqID_62664
ttgttgctgctgatcctttctttagcttcaaaccttagttcaccagcaaatccatgctgtccaatgttttgttattttattttgctaacctttcccccccccctttttaacaaaaaataccacaactttttgtttaaatatttggtcttttttaaatatttcgttttcataatttcagtttatttccaattcgttggaagagcttcgaaatgagaatttgacgcttaaacaaaaaatg

SEQ ID NO: 119029 - DNA, 113 bp, Heterodera glycines
  Promoter: Source sequence=SeqID_36316; Location=1..113; Strand=+; Gene=SeqID_65661
aaaaatgttaattattagctcacttttcaagtttcaaaatcctcgacccatccgccggcgccgttgcgtccgccaatggcatttccgtccggcacccgccctttgcctggatg

SEQ ID NO: 119030 - DNA, 137 bp, Heterodera glycines
  Promoter: Source sequence=SeqID_23599; Location=1054..1190; Strand=-; Gene=SeqID_54290
attgggaagccaaagatttgttaaataaggtcggattattggcaaaacgaaagggaaagggcatttacgattttgaggaaacggttaaatatttgagccaacaatattcagcctatcttggcattgtgtatttgatg

SEQ ID NO: 119031 - DNA, 1003 bp, Heterodera glycines
  Promoter: Source sequence=SeqID_1141; Location=1710..2712; Strand=-; Gene=SeqID_68545
aagactcttgaacatctcgaggtatagaggggaaagtttttatgtgccttcaggcgctggtttatttattttcccaattcggattggaaaattttttcttttgtttgaagtcataatgaaattaaaaaaaaaacaaaaaatgtgctaaaaataaataataaattaaataaacattacaacgtattcaaatcatttcggtctccgagttttataatttactgttacaatgacttttaattataatttttgtcctttttcagaaaattgctgattccaagtacaatcttggaaataaatcaaatttgaaaatttctaagcattagggcctatttcaaaaagtgctaggtcgatccaaaaaaaactcagtgattgatcggtgtcaatgaatttaagtatacgattataatttaattataaattaaaaaaggaataatataaaaatttgccattttaataaatttattattttaatgattctgaaaaaatattaataagtccaacctaattaagattttgcttgtccaagaataacctcgaagtaaataaattattcatttttttaaattttaaaattaaaaaatcttcaataattgatgaatataataattatatgaatttagagaatcgaataattaaatttaattattttatcgatcactgagttttttgttcgactcagcacggttcaaagtacgtaaatggcatccaaatacatatgtcaacactgtcgaaaattcaaataacagtgccaatgaacaaatttaagggacaaaaaatgcccccgtcccaaaaattggcatttcgccttttcattttacaaatttttcggcgactttttgtcatccaaaattagagaagcgcttcaattcattagtatgaaatattgtcatacgctgcaaaaacagcaaataaacgaagcttttggcgacaattcatcaacacggcacggcactcggagatattggaaaggataaacggcaatgtttaaaacagcaaatagatg

SEQ ID NO: 119032 - DNA, 310 bp, Heterodera glycines
  Promoter: Source sequence=SeqID_4089; Location=2196..2505; Strand=-; Gene=SeqID_53141
ggtgcattttcgaatcaattaattaatatttaattaaatcgattatttttgttcattagttttatatttgttgccaggttttttgaaatttagtcacgatttgtcaatgaatatgtttggccaaaaatgggatgtaaaattctgaaagtttttgttgcatttgtgtcatactgtgtcgacaaaacgcgaggaaaattttgataaattttcattttttaatcacaaaaaagcgataatttgcaaaaaagcctaaaaataaatattatttttagacaaatactctccgaccctaacttccaaaaaaaaaatg

SEQ ID NO: 119033 - DNA, 258 bp, Heterodera glycines
  Promoter: Source sequence=SeqID_3361; Location=1..258; Strand=+; Gene= SeqID_84372
aggtttccaacattttattataaggtatgtgaaggcctctttacgttatatttttgcaataagctgtcatagattattaatcaattaatgataccaagttcataacgatgggctgactcaaatgaatttttcactgaagaatttgaattcgatcagacggactttgaatgtgcaatgggccggagaaaatttaaaaggcaaacaaaagagcaagagatatatggtttgttactcacagaacacctatttttaattatg

SEQ ID NO: 119034 - DNA, 73 bp, Heterodera glycines
  Promoter: Source sequence=SeqID_41190; Location=1400..1472; Strand=-; Gene=SeqID_69373
cgctagacattcgctctttccggaatcagctttatctggcattttctactttgaagttttggtcaaatctatg

SEQ ID NO: 119035 - DNA, 67 bp, Heterodera glycines
  Promoter: Source sequence=SeqID_18290; Location=182..248; Strand=-; Gene=SeqID_82879
tttcccaattaaaatataattataatttttgaattaaaaggaaatacaatttgttccactcaaaatg

SEQ ID NO: 119036 - DNA, 291 bp, Heterodera glycines
  Promoter: Source sequence=SeqID_32520; Location=1..291; Strand=+; Gene=SeqID_62823
ttttcaaataatttttaaatttaatagatatccagaaaaatggctatctattttttgagaaattttctatgcaacaaacgctctcgaacatgaaacgaagtgcggtgcgccgtggccattttatttttcaaataatttttaatttaatagatattccagaaaaatggctatctattttttgagaaattttctatgcaacaaacgctctcgaacatgaaacgaagtgcggtgcgccgtggccattttatttttcaaataatttttatatttaatagatattccagaaaaatg

SEQ ID NO: 119037 - DNA, 1003 bp, Heterodera glycines
  Promoter: Source sequence=SeqID_13016; Location=818..1820; Strand=-; Gene=SeqID_76791
atgagaatgtcaatagtccgaattattaataaggaattataataatgggaggatttgattgctggactgtttgaatttgtgtttggaatgtggtgggaatgccccatttacacaacacacacacacattaatcgatgaacgacgaagacaatggtgttgtaaagttgttgaggaatggacgaacaaaaataaggagagagggaaatttaattaatcggaggaaaatgccgaaagccatcgaaaggagggcaaagaaagaataaattgaaaatgtcatttcggctcagtcggttcacaggaagtggtaaaactccgaaaatgatcctttcttattctaatgttacataccaaatgaatttttcgaaaaattttccattgtgtgagaatctggccaaatgcctttctcgctgtggcagtggctgctgataagccccactcatccgaccgctatgtattcatttcctccctccctcttttcgtcccattcattcgcgaccggcagaagttccatcgagccataaattttctcgaatgactaacacacaatggaggggggggggggggtcataatggctggtggtgacgacgatgggcagaagaatatataatgaatgtgtaaataaacaactgacggtacacagacggacaacaaaatcggaaaacggggcctcattcacacagaagcggagaaagtgtcgaaaattagtgattggatggaattaattcaaattaactatgtaaaatcccgaaaaatctgatttaccaatctttataccagggatggcattctgaggcccaaaaattttcggaaatcgaaaccaaaaaatatcggaattccgtgccatcctagttctataccctaattatattgttgcctaatttttagcgccaggaatgtccgttaaaaaattgtaataattccacgaacgctattctaaatttacattattttgtttaattgagcaaagcactcaaattcaataaacaattgcagactaaaatg

SEQ ID NO: 119038 - DNA, 329 bp, Heterodera glycines
  Promoter: Source sequence=SeqID_19122; Location=1..329; Strand=+; Gene=SeqID_83866
tgatttttggaaatcgttgtgtcggcccatttcactctcctcgctgtcaatttgtcattctgtaatttagagttctttttcaaaacaatgctttacaagcgaacatttagcccaaatgaagacataaaaaaacattcagaagggtttagagccaagtaggaaaagttttgggcatctctttcgaaattcaggcattaaatcattaaaattcggcatcccgaccctcaaaaaattatgaggaaactgaatcatcattccagaaatttgcgcgtacatatgaaaattaatatcaattatcatcattattttagcttttattattcatgatg

SEQ ID NO: 119039 - DNA, 82 bp, Heterodera glycines
  Promoter: Source sequence=SeqID_39; Location=14676..14757; Strand=+; Gene=SeqID_54452
acaagtggaaatagggattaaacaagcaacaaaaattagattgcttgtcaattttaatgttgacacatttggcaacgcaatg

SEQ ID NO: 119040 - DNA, 756 bp, Heterodera glycines
  Promoter: Source sequence=SeqID_9622; Location=1..756; Strand=+; Gene= SeqID_72112
ggggtgctgttagttttcgacagtggtgatctcgacagtgttggtttcgacagtgattgatttcgacagtaaagcttgtttttaaaaaaacaattaaaaattactgtcgaaaacacctggtacggttcttagattacaaaaatttaaaaaataaaattagtcttttcgttttgataatttcgtttcccttttccttttcttattatttttctccaagtatttctgcaaatgttttttttaacttttttcttttccattccagttttaatttgaacaattaaaaatgcaattgaaaagaataatagacacaatttcattattgacaaatattcataaaaattaaatgtgtttttcgtgaattttttggcgaatttttaaaaaagaataaaaattttacgtggtgttccgaactaggcttttgaagggaaaggctgtatattcagtcccaaaattattataataaattctttaattgttttaatttacttttccttataattataaattttaatatttaccaaaaacaattattcgcagagattggacataatctgttaaatagccataacaaaattttttttacatctataaaaaatatatttgttagaaaaatatccaaaagtgttttttgaaaattgttggaagtttagatatttggatttttaagtacccaataaaaattcttgagaaaattctacttctcgagcctcggggatgagtctctgtttaaaaaaaacattttattttttggaaatg

SEQ ID NO: 119041 - DNA, 228 bp, Heterodera glycines
  Promoter: Source sequence=SeqID_17101; Location=1806..2033; Strand=-; Gene=SeqID_81533
tgccattaatttgattgctaactgagtttgttgtatgatattgttgtaagtttcctgatttggatgttgctgatgatgctgagcgcctgcttcttgatctgggagccaagcatttaaggatactgaactatccgatgtggcttgaacatttgtgttcttcctggttgcatcatttccggttaagctctagtcaacggaactgaactgagctcgcggaaccttgtaatg

SEQ ID NO: 119042 - DNA, 1003 bp, Heterodera glycines
  Promoter: Source sequence=SeqID_15388; Location=1125..2127; Strand=+; Gene=SeqID_79651
ttgtctgtcacttgttgtattaaattttggtctaaaatcgaatagtttttgaaacaaaaaataaattaaataaaaataggagtgattgaggaattcctagagttttaggatcacagagtgattatattaattgaaaattaattaacggagaggagcatcttacaggagaagcagatccatttttctcatttttcaaatactaattttagtggaatgtactcaaaattctgtccagaaaagtttgtacgttaatcctttaaaatagccatcagaaatttaattttacagtttgtctctaatcccaatcaactctaaaaatcgaaaaaatttcaattttataatgactgtcatgttcagaaaatagtttttattttattttttctattgccccattgaatagagtgtttggtggtgtgtttacaatttaatgcctattagctcattatcataatcatcatcatcatcattagcagcaccatcagcagtttgcctgctgctgttcagtggtcacagaagtgggtaaattttttcactgctctgctgcttattcatcattatttttaaattttcgatcggacggaccgttgtgaaaagagaaaaaaatgaataaattaccattttttacattagccatccattaataaaattagaaaaaaataaaaaaaaatgaaaattaatttgtaataaacaaaaattcttaaaaatattaagaaataggtgaatgaaattttttttttaataaattgatgcattgaacggtttaaattggcatcagagaatcggtttttcgatattctgtaaaaaaattttgagaaaatctggatttgtataaaatgtatttatgaaaatttggtcgtattctttcgtatggctatattttgataagcctttattagcatacgctaatttactaaactactcgagatttatttggtgaaattattaaattatttattataatataaattaaaggtaaaattaaatttacaattttttagccatg

SEQ ID NO: 119043 - DNA, 341 bp, Heterodera glycines
  Promoter: Source sequence=SeqID_36459; Location=1..341; Strand=+; Gene=SeqID_65763
tttttcatttatttccccgccacttccgacaaacaatgagtaataatacaacaagcattgaaaggaatggaaagaagagctgctgagaaattacaattattcgcctttattaaatgccaaaggatgatatgaaaagggcaacgtttttatttatcaataaaaatggcatttcaattattttttaagggattattaaatcaattattttgcaatttttttaaaattaaattaaaaaaggctttgaataaatcaacttcagctgtcttaataaacattttgctgacagcagcagatccgtcctctgctgcacactgattttcttcttcttaggctagcaaatg

SEQ ID NO: 119044 - DNA, 161 bp, Heterodera glycines
  Promoter: Source sequence=SeqID_16097; Location=592..752; Strand=+; Gene=SeqID_80451
agaaaactttgcctaatttcgaaaatgattttcagatgaattttcacttttttaccatcactcggacactcggcgcaaaaatgctgctcccctaaataattgtaaaataaattagaatttgtttgttggacgaattcacttgtgaaacggccgtacaaatg

SEQ ID NO: 119045 - DNA, 314 bp, Heterodera glycines
  Promoter: Source sequence=SeqID_29898; Location=1..314; Strand=+; Gene=SeqID_60358
ctctataagtctacaaaatttaaaaaaatttcgttaagtttcaaaaaaattatggctagaggaactcaaaaaaccttggttttcgagcattttttgagcatctttggccctaactcttttgaaacttaatgaaattttttgaaattttgtagactaatagagaacacttaggactatcgaataatatcaagaattaaaaattttgttacttttcagctaagttataaataatttttcatcaaatcataatgatggttttttaaataaaacatagcaccttctaatataatttctctaatttagattgcgaaatg

SEQ ID NO: 119046 - DNA, 115 bp, Heterodera glycines
  Promoter: Source sequence=SeqID_6725; Location=336..450; Strand=+; Gene=SeqID_62646
ggttggcacatattccgaattttgatttaccgaaccaaataaaaattgctacaattttagaagccattggagtggccgatgttctctcaccagtggaccatatgcaatttgtatg

SEQ ID NO: 119047 - DNA, 388 bp, Heterodera glycines
  Promoter: Source sequence=SeqID_11438; Location=2983..3370; Strand=+; Gene=SeqID_74832
ttttgtcgtcgaaatgtggagaggcgaaggttttgttgaagagagctggtgaatcgattcgtttgctttctaatgaaagtggggaatggggcacagtgagcccttttatgtcgctaaagtggagggaacgcccatcccattgacagacaatgcaaatccccggtgggagcagagaaaaatggacgagagagagtgtgtgagagagaaagtaagacggcgtcactttttgaaatggatttttttcaacacgaaaggagtctccgcgtgcctgcacattttagccgccattttttcttagcataaatagcgcccacggtcattctattcctcacttttcttcttttgctcatttgaatttgctcatccatccaactaccaagcaaaaatg

SEQ ID NO: 119048 - DNA, 80 bp, Heterodera glycines
  Promoter: Source sequence=SeqID_9486; Location=913..992; Strand=+; Gene=SeqID_71599
ttgtaagcaaaaataattaaaagaatggcacacttttagtccattgtcagcaattactgttaatttatcgtcaggtcatg

SEQ ID NO: 119049 - DNA, 88 bp, Heterodera glycines
  Promoter: Source sequence=SeqID_21371; Location=335..422; Strand=+; Gene=SeqID_51977
ggtaatttttcacaagcttttccaaaaaaaattattcctttaatttgaaggggaacaaattgttgcggcgggcggtggccaatcaatg

SEQ ID NO: 119050 - DNA, 830 bp, Heterodera glycines
  Promoter: Source sequence=SeqID_27789; Location=1..830; Strand=+; Gene=SeqID_58453
attaattcaaggcaaattttttttattaaataatttttctttattttgatgttttttaaaagattcatattaaacaaaacaattattaactttattattattttttcaattgtgaccaaataattaattaggtctgaaagtttcttaaaattcataaatgaaacttttgaaaaaaattttgctttatatcatttttggtggaggcttttactcgaactttagatttttttgtaatggatttaaaaaggtcttaatatttttttgaggaattttggctgaaaatttttcaggttattctggccctataaccaaaagaattggattgaaaatgcctaaaaataaaggatcctcagaagcaaaaataaaatcattttaatttatttgataattggtctaaattaaataaatattgaaaaatgccgaatattgagttcacacccgccaaaaatcagaaatttgatcaaaatcgctaaaaatttttaaaggaaccttcggaacccagcacctcccgaattctaagaaattttttttgttttatatcggtattttttgcagaaacatttaaattttttggtcgccgttactaaattttggttgaaaatggcacaagttttctaaataaacctcagatcaaacatcaaccggaattttattaaaatatttgaattttcaatgaaaaaatttagtaacaatgataaactcacaattagcgcaggtagtgcttcttgagaatgtcgacgattacgcaggcgaacattgtgaggccctcgggaaattgcaaagcgactgaaaatctttgaatttttgatttcatttcagtaaaagaaatg

SEQ ID NO: 119051 - DNA, 892 bp, Heterodera glycines
  Promoter: Source sequence=SeqID_1352; Location=825..1716; Strand=+; Gene=SeqID_72985
tttttatgggacaaagatttttggactctcttttcaaattatcatattcggaggatttaaatgaattttcaaataatctgattgaaatggcactaattttgagtcaatttcagatgttcgtcagaggtttcttcaaaagggcgggcgtttggcgctttgccgaaaaatggcaccgtttcggctgtttgatggtcagcgctgaaaaaagaaacaaaaaattgcgaagcaaatgtttaagttttcttctgcctcgaagttttcacattggcgaaagttcggtggtgcttttgttgcggctttgaagggcaaaggtgattagtaagcaataaatcaatattaacatactatatgttacagtatttcattgcttcccttccctttaattgtctaagtcgcctttttctcgcttgtctttctctcccccttctttctcatgctctctcctctttcctccctcactctctcctctttctctctctctttctctttatttatctcgttttctcttcctttttattttctttctttccctcttaaatatgttaacatatgtagaaccacaccgtactttgcacccattcactttttaaaaggctcatttgtttgtctatccatccgcagtgcacgcattcgtcacaaactacgtgttgttttcctccgtctcttccccctccgctttgggtgcattcacccctctccttccccccttccccatttggtctctctcacattcattacttttgtttatttgtttacttctcctaacaaataagtgcattggtcccccctttacccgctcatcattctctcgatcattcatttcccacaaatcttttaattccttaaatagttcaactaaaaaaattaactaaaattaacttaattaatgatg

SEQ ID NO: 119052 - DNA, 1003 bp, Heterodera glycines
  Promoter: Source sequence=SeqID_12071; Location=2281..3283; Strand=+; Gene=SeqID_75619
aaattaatgtaaaatatttctgcttttggatgaaatttatatttttgatcgtcctaattaattatatcggatcataaaagaaaaagctgcaaaaacctcttttaagaaaatatttggtaaaaatggaatattttttaaatttttatttgaagacaccaaaatgaatatcaaaatatgcctattattcatttataactgtctgagctgcagtatgcacaaattaacaaaaatttaaatttaaaaattcgagcctttaggcaattgaaaaaaataggtgacagattttttcagctatttaacatattgcctttttgcattaaagatcatcattttacagttattaaattaattttttttattctatttaaattatccataatgaaaatgcttttttctttaaaaaataaaaataaatttttcctttttattcttttatgagaaaatttaatcttattagtaaaagaataacatttaaagattttaaaatgaaacgagaaaaacccgaaaaggcattaaattttatggcttaatcgaactttttaaacttcattacatttttgtattgccataaaaatatgacacatttaattccttaatttaaagattctttattattcagttaaattttaaaaattttaagtttaaaaaaagtttgggacaaaaatattgagtctcgaatttcgaactttttagttatattttttgcaaatttttgttagaatcaattaaaaacatttcatatttttcaatatgtcctgatttttcacgtttttttcctgtgtatgaattctatatgcattttttgttgtaaattaatgtaaaatgattctcttttggatgaaaatcattgataattgtactgatttttttcatttgtacttttataatcaatccaaacaaataaattctcattttcttcatttattaaaaaatagcaaaaaatttcataatttccgttatcaaattgtaataataaacaaaaatttattgccaattgaaaatg

SEQ ID NO: 119053 - DNA, 827 bp, Heterodera glycines
  Promoter: Source sequence=SeqID_13309; Location=702..1528; Strand=-; Gene=SeqID_77157
ttctggtagagccctgaaaaagcgccattatgggcgtttcgtaaagtgccaattgcacagattttcgagaaaaacttgtcataaccgggatgggattcatagttttgtttttatttttgcaccaaaaaacctaaaaaaaaattaaaaaacttttttcaactatttaggcattttgccaaagattattaacaaaaatgcaataaaacgaaaaaaaaccccaagaaacgacccaaaaaaatttcagaaaaatataccccctgagaaatgaaaaattttttaaaaattaatttccaaaatttatttattattttctgacaagaatttttaatttaaaaattatctcaatactgattggcttaatttgttacttttttggataattttacgattttacacccctaatttgagtttttcgcaactattttcccatttttagctcctatttttaattatttttttttagaacctaaaaattaactatttggcagtttttaaattactccctactaaaaacttttcttaaaacagaagaaaattaatttttgagcatttttggtcacaacttcatgaaaataaaaaattttttaaaattttccacgctaacaacagctaccatatgctatcaaaaaaaatgaaattactgtaatggtgagttttctctaaaaatcgataaaattggcacttttacgaaacgctcattttgtgcaactttttatgaaacgacctagcaaaaaagagctaaagcattgatacttgactttttgggtctcgaatttcgtgaaattttttgccttagaaatccaaaaatgaatacaatttcagaaatg

SEQ ID NO: 119054 - DNA, 438 bp, Heterodera glycines
  Promoter: Source sequence=SeqID_24775; Location=1..438; Strand=+; Gene=SeqID_55506
gcaaaatgagtcattatatgcaaattataccatacccagaagtaaacttcaaaaaatttaaactttcgactatgttagaactttggtccggggttcggaattggtccaaatggatatcttattcgtgtgatcagcgaccttgaaaaactcaggaaagacttttatttagataaaaaaaaaattatttttaagtaaaaaaatttaaaaaattgtttgaatccgggttcggggttcgaaacaaagtcaaaaaagatcaaattcgtgctcagcgcatcaaataacccctaaaatatgttttttttttggatttttattctttttttttgtgggaccaataatcttcacaattgccaacttccttgcctttttaaggtgtgcaatttgttgcaaaaaaacggagcagcagcgacggatcaatttaaaggacaaacaaaaatg

SEQ ID NO: 119055 - DNA, 58 bp, Heterodera glycines
  Promoter: Source sequence=SeqID_18475; Location=666..723; Strand=-; Gene=SeqID_83085
ttataataaatacatcattcattcaaatttggcactccgctctctgatatgacaaatg

SEQ ID NO: 119056 - DNA, 76 bp, Heterodera glycines
  Promoter: Source sequence=SeqID_44197; Location=492..567; Strand=-; Gene=SeqID_71720
cctaaatcaaatcatattgtcggacactttcaaatgtcgccgataatttgagagggcagtaaaaagccaaaaaatg

SEQ ID NO: 119057 - DNA, 477 bp, Heterodera glycines
  Promoter: Source sequence=SeqID_20548; Location=501..977; Strand=+; Gene=SeqID_51087
aaaaataatttttttttatcattttcccttttttgcaccctttttaattggcaaatattggaaaacaattattatttttcttaaaatttcttttaaattaaaattttaatttaaaaaaatcctggcgaagccaatccgtgatacgtatccctgcatgccatcataaatttgtctgcaaattttcaaaagtgactattttggcgcaatataagttccatgaaaacaaaaaaaaatcgtcgcctgggggtggggtacccccaccaagccgaaattctgggactgtccctacccaatggagcagctcgttccccctccccctgcccgaaaaaattttcagcaagtctttcaaaaaaaatttccagaaaaatcgtttaaaattagaaaaaaaaatttctctgcttaaaaattccttgattagatttttgtaaaattctgttattttcttctctgttgcagctgatcttctgatcaaaaatg

SEQ ID NO: 119058 - DNA, 140 bp, Heterodera glycines
  Promoter: Source sequence=SeqID_9585; Location=2558..2697; Strand=+; Gene=SeqID_71974
aactggcagtttgtcgccaatttcgaacaatcgagaatgtattttcacaaatctcgagtcaaattcagattcagaacaccgctgactgagtaagagaattggaaggttcgataaaggaactcgagaactttacagaaatg

SEQ ID NO: 119059 - DNA, 333 bp, Heterodera glycines
  Promoter: Source sequence=SeqID_5007; Location=1..333; Strand=+; Gene= SeqID_56527
ttttgacccaaacagagcatacgacccaaattcacttgtatttatttcgtaatacatttattttgcttccattatctttgctttttttctttgtagtcaatggagaaaagagtttctggacggccgataccgatccaaacaaccaacccctccttcccccccgcgtgccccatcgcccagctttccaatcccggtcatcgttggtaatttaaatttcagtttttttttggattttgcaaatattccgtttacaggaaatcgtccacaggatgaaaattgtttggttttccacaaatatcttgtctgattttttccattttagggcggcagatg

SEQ ID NO: 119060 - DNA, 381 bp, Heterodera glycines
  Promoter: Source sequence=SeqID_18972; Location=1..381; Strand=+; Gene=SeqID_83704
tggtaagacggacacttcagcttcgtttaagtacagttgccaaatgcacttcctcttcagtgtttatgagttttgtcctctgttctgagtttatcccggcaacgaatgcgaacgaaaacggcagaagcgcgccgtgggggacggagaggtgagaggaaacagaggcagtggataaagcgaaacgaagcggaagaattcgggggggggggggggtcaaatggagagacaacgaaacgaacatccggggagacaaaccgaaccaacgaacacacagctgcttaaggagccttcaaagtcatcgcctttcgtccaaggcgtgccttggacattttggaatcggatggttttggcggatttcggaaaagagcattggatgtgatg

SEQ ID NO: 119061 - DNA, 118 bp, Heterodera glycines
  Promoter: Source sequence=SeqID_1514; Location=943..1060; Strand=-; Gene=SeqID_74123
aagcaccgatcaatgtgaacggcacaacaattggtttcatcctggacagaggtgcggaaatcatcatcatcaatgaagatgattacaacgcaatgggccgaccaccaattcaaatatg

SEQ ID NO: 119062 - DNA, 105 bp, Heterodera glycines
  Promoter: Source sequence=SeqID_25758; Location=712..816; Strand=-; Gene=SeqID_56502
aagaggactgctgatcgatatatgttacaaatgatccaaatcattagtatgtattattagaaaaaaatttcttgtaaaaaattatagggaaataaatgaataatg

SEQ ID NO: 119063 - DNA, 406 bp, Heterodera glycines
  Promoter: Source sequence=SeqID_18694; Location=257..662; Strand=+; Gene=SeqID_83362
tttggcttttctccgttagatcagtcgcctttctctcgacggtccgttgggagtgcaccggcgcatcgattcgtccgtctcccaaagttgcggtccccagcgcgaattcaacttcgaccttttgctgggtcctctatggcccggcaatgggctccacagcgacgcgtgttttcagttggaagacggacgcggcaccaatttgggttgttcctgttcgaatgttcgtgcgggcaaattaaatccatcgcagtgattccctttgcttgtgtagaatggctgcaaccggctgattccataccccatcgacttgtctcgaaaaagggtcaaatgccatttggacggcccattattcgccccttcccgtgccgacttttgtcttggacatttctgttttactcaaagaatg

SEQ ID NO: 119064 - DNA, 111 bp, Heterodera glycines
  Promoter: Source sequence=SeqID_4839; Location=2871..2981; Strand=-; Gene=SeqID_55903
tacggagggttattttcttcacatttgactccgtctcagaaatcactttaaaatagatatggggcggcaagttacggtggatacggtggtgccggaggatacggcagcatg

SEQ ID NO: 119065 - DNA, 1003 bp, Heterodera glycines
  Promoter: Source sequence=SeqID_9414; Location=838..1840; Strand=-; Gene=SeqID_71328
catgtacatgtgagctatttataccccacacatttgtcttgtcctctttctctttggaggggggtgggttcgcacaggacacggcggcacattcgacactgtgtgggtgtgttaccgagaagaacctatgtgttttatggttgcttatgtatggatggatgatggatgggtgccattttttatgaaatttaagcgaagagtagagcgaaaacgggggaggacaatgaatgttctctctcggcgcatgctcactcatggtgccaaaatttgtatgtatgtgagtgtgcgcgtgtgtgccgtgccgtccgtccgtccatccatcattcatcataccattcattcattcaccgctcacgcagcagcagcagagaggcaaccgaccggacagggccgcattgttagttggcttcttcatcaaaaaataagtgtaatacaaaaagggcgacggcactcatcacgcacattggcgagatgaatgaaaatgccatcattgcacatacacgtccgcacagcagcggcgcaattcacacacacttgaaaaaaaaatttttttcattaattcctttctctatgacaaccctttgccctcctccctccgctcggctgaacacacaaattgcttcttcgtattattatcacaattgaactgttagtgccccctggggaattttaatctggccctcatttcagtttttgatgggggtttttttagtaagatcttttcaatgcccaattaatcattgttgcaaaatacaataattgtaatctaataatccgtcggggatgatccttaatctcttgataaatccattttaagaccgcttcttccattataatttccttgtattctttggattaaacaccggattaattttgaaattaaattacaccctttttataatttttttttttgcttcagccataattaatttatccaaaaaattctacaaaaatagctcctgatcaatcattgttgccagaaaaaaaaagttaaaaaaatatg

SEQ ID NO: 119066 - DNA, 481 bp, Heterodera glycines
  Promoter: Source sequence=SeqID_37598; Location=533..1013; Strand=-; Gene=SeqID_66625
ggttgacccccccccttcccttttttcatgtatgataatttttcaaaaaatgcaattttgagtagcgctacggaaaattgtgttctttcacatataaagatttgtgagaacttaaatcctttaaatttaatttttaattttaatttataatttttgatttctatataaataaatctttatttaaaagattgaagaaatcgttcaatgaattggaccgagaatcgctggccaagaatcttgcatttacagcaggtagcaaaacatactaacgaataacaaatctattaccgattgatccttttctttcatagtccgtctcgacagtgatggtgttgacaaaatacagaactcatttttgcgttatttggtccaaatggaattggccaaaaaggagcgagaaacgaaaatgtgtgattcctttttttaatattttgattgaccaagctaaactatttccatttccaggcgtggaattccgatg

SEQ ID NO: 119067 - DNA, 108 bp, Heterodera glycines
  Promoter: Source sequence=SeqID_5932; Location=1700..1807; Strand=-; Gene=SeqID_59720
ggagaggtacaacagtgattaaaagaggaagaacagtgatcagaagaggtacaactgtgattagaagaggtacaactgtgattgattagaagaggcacaacagtgatg

SEQ ID NO: 119068 - DNA, 616 bp, Heterodera glycines
  Promoter: Source sequence=SeqID_2680; Location=2756..3371; Strand=-; Gene=SeqID_81055
tatttttaatttgaagctttgttcggaaaatctttggcctccgacgaacactccgatgggtcggtcatttgccactgatttaacggaaaaagcggccgatcgatttctgccaatggttggaaaatcagcaaaagcaaaggcggaaattctttcactttcatatgacaaagtgccatcgccaaatggcttaatcaaaatcagtgaataaaacaagcaaatttctcctctttatttatttattaattatttttaaatgctttcgcattttataaaggacggtaaatttaataaaaaagtttaacatttgtttttttcacttttttcattcccagcagataatttttatttaacattaatagagcaaaagatattttttatgaaaaatgtaagaggataaaaaacattctcttctgcttaatgatgacaaattaaatgtcatttatcataaaaatgtagtttaaatattaaaaatatatgatttgtgaacaattcaaaggcatcgaaagtcattgctttaatatcactcctgaaacctttagtttataaatttgtgcactttcctggaagtacgactcataataattcattcttttcagaataattatctataaaaatg

SEQ ID NO: 119069 - DNA, 69 bp, Heterodera glycines
  Promoter: Source sequence=SeqID_24034; Location=883..951; Strand=-; Gene=SeqID_54734
acaaaattggaagttgagactgaaaatgttcgggtttcggagttccttctgctcaacatttggccaatg

SEQ ID NO: 119070 - DNA, 724 bp, Heterodera glycines
  Promoter: Source sequence=SeqID_1323; Location=967..1690; Strand=-; Gene=SeqID_72489
aatgatcggacgaacgggcaagggccaataggtccgaatatcttcttacggattttcgtaatccattttatcacagtttattatcccggaagaggaagtaaaaaaatgttaaaaatctgtttaaatgtaatcagttattattttttaaattgtaatcaaaaaaaggaaaagaaaatagattttaaataaaaaatgaattttaatttcaataaatcataaaactataattataaaaaatttaaattattgcataaaaatttcaaaatgctagaaaaaattaaatgaaagattgtttgaaacacataattttgtattattacatcataatttcataaaaaaatgatcaattggtcaaacattaacgatttggaaattgatgattcaattaaaaatgtgaattcattcattaactgacaaaagaaaattgctttgcaattgtacgaaaaagtgataaacgacaattcaatcaaattttgtcgttatattttatgcgataacgatactcttcaatcaaatttcgtcgttattttgtgggctgcataactttttacattttttgtggccaagacagaaaacgcctgccttcaatcagcacagcagcagccttgtcccattcttttatttaaattgtcaaaaaaattttataaaagcaatcatttgcttctcatgcccatttacattaatttttcttttttatttttatttttaaattatttaggaaatg

SEQ ID NO: 119071 - DNA, 1003 bp, Heterodera glycines
  Promoter: Source sequence=SeqID_8284; Location=1196..2198; Strand=+; Gene=SeqID_67567
ttttgctcaatttttggctgaaaattatgtcactattcgtcactatttcggaatgtttgccactattttgtcactattttaacatttttaccaactattttagttaactatttcgggattttttgtcactaaaattcacagccctaataataacccatttaattggctcggtttttatgggtttaataagtacgaatgataaaataaatttatctttaatttttatgttatttaaaccaaaacaatttaaaatccttttattcgcactttaaaattgattaaacattttaaaagcaaattactgtatttaactttagtatttttgaattagcaattttgcacaattctgttaacatttcccactaaaattttcaaaatttttctccgtcggacttcattgatttgtgatatatgtgttaaatatattgatatcaagaatcttaataatcgtaaagttaaaaaatttttgctcattcattactgtgtttgataaattttagctcattttcagaattttggcctttagacttgttgttccaattcaattcgggtatttcaatttgtcgaaatggatgtcgtaatctgcaccctgaaaaccccagacaaaattctgacaatacaaaaatgatgataaatggatagtgaatataggatttagcaattttcgccattatggaatcaaattctgcaaaaaatacaaatattgggtctggtctgtgccaagtgaccccgacggggtaatagtcaagtcggcaaaattaatgcagcattgttgtgcgaaagagcggacgtaatttgaacaaattaatcaattcatcaattaatcatggataattaatttccaaacaattaattattttaattattatttttcctcatttttttaagattcccgtcaaagtgtccgccctgaggaatcaagtctacaaggtgcagcagaacaaaaagatatcaccgaaacggggtaattaatttattttagggcatttacacgccattgatg

SEQ ID NO: 119072 - DNA, 59 bp, Heterodera glycines
  Promoter: Source sequence=SeqID_15767; Location=690..748; Strand=+; Gene=SeqID_80094
aggggatggttcccatattaggtttacttgggaatgtgattcgtttcgttaaaacaatg

SEQ ID NO: 119073 - DNA, 1003 bp, Heterodera glycines
  Promoter: Source sequence=SeqID_18883; Location=571..1573; Strand=-; Gene=SeqID_83585
gaaaaagaaaagaaaagtgggcacagaataaaggacgagtgatggaacagcaaataagtatacagtaaacggactaagttattcccatctctgagtaatggcactcttctgtaaatgctgtttattggtttaaaatgccattttggcaaacattttttgtgctgtttttttgctagcatagattgtatccatcgacatttccatcgatttttctctgattttttatgtattggcatttttctctgcttttccaattgattaatttcacaattcattgccatttcgtattttaataaaatatttttttttgcctttttagagacactcattcaatcaagtcagtttcaaagtgatcagagtaaaccgtcttttgatttttcaacttttttctgcgaaatgaccgccctttctccggtggtaattcgcctttcgtcgtctccattatgaaaagcttttccccctcttctcgacccctcccccttcacattggtctcgtcattgtcgtcactttcaactccattttcttaattttcctcttttttggtatttttgtttttcgtataaaatgcttttgtctccctttttagtgccttttgtctcttccaaattgagctcctttcccccgccgccaatggccgtggcatcacttaagaaagtgcacttgaaaaaattagtgtcccattcgcatgcgatgccgacgaaatcggcacattttggcaccaaaactaatcggccaattcgggcacggaaaatgcgacttcggcgcattagcgttaatacattaaaggggattaagggcaaaaaactgagacgagtgcgattggtaccaatgccaatgcaaatgattccaatttaccatccgccgctgccggtgataatcagaagaattaggaggatacaaattcaaaaaaggcacagaaaacgggggacaaaaggcagaaaaaggcgaacggagaaggaaaggcacagcaaaaagaaaaagccaaacaacgggaggaaaatg

SEQ ID NO: 119074 - DNA, 124 bp, Heterodera glycines
  Promoter: Source sequence=SeqID_25024; Location=1..124; Strand=+; Gene=SeqID_55753
caaaaaaattagttaaataaagattgaaaatttatagacgaaagatttttttcttattcatagcgcttgctttttgccattcagaacaattctgttgatttatattgaattgacaaattaaatg

SEQ ID NO: 119075 - DNA, 59 bp, Heterodera glycines
  Promoter: Source sequence=SeqID_9731; Location=3353..3411; Strand=-; Gene=SeqID_72513
actaaattgaaaaaaataataattatatattttattacaaaaaataaacatacagtatg

SEQ ID NO: 119076 - DNA, 1003 bp, Heterodera glycines
  Promoter: Source sequence=SeqID_6816; Location=3548..4550; Strand=+; Gene=SeqID_62982
ctttcatcgtgaaattgagaaataagcagactctatatttataaaaatgctatttttatatttatatgaagattagtgacctcatattcgtttagcgtgttgttaagattttcatctagtgctaaatataatttatttcttggtctaggtttcgatttcccatttttaatttttatgatgcggtcatctatttcagacataactgtttggaaaaaatttaaaaaaacgggtaccgtcgcattacgaacactgcttggttcccttccctaaaaccttttagttgcatttgttcatggagtttttttaatgttttaatttctttattttgatagcgtttgacaagttctatagctttgtgattttttataaattcttcaaaaccggaattggtagaggtcgaatactcaaatcgaaataacaaaaaaataaaaataaaagtcttattcattttctaaattataattttattaaacatataaaaatttattgtattaattttacattttcagtggtagcccaaaattatatgtattgatggttattgatttcaacgtggatgttaccaatacaataattaaatttattattttaaatttattattttattttatcaatcactgagctttttgtggaacgcccacactgagctttttttgtggaacgcccacactgagctttttgtggaacgcccacactgagcttttttgtggatcgacctagcaccgaaatgttctatttatttacaaattttatttttcctacaatttttttaagtaaaatgtattgttgttaattttgattttggctttttaataatgtatatggaagattttattgccggaattcagtatataaagatataattattaaaaatttttacgtgaaaatttaatcctttttcgatttttctgggtttacatattctataccaattgatttccgtactctccattcattcactacaagtagcttatatttttgttttttattagtgtaatacatg

SEQ ID NO: 119077 - DNA, 324 bp, Heterodera glycines
  Promoter: Source sequence=SeqID_17349; Location=3055..3378; Strand=-; Gene=SeqID_81830
gcagtgccgataggcgccgccgggaaaattttttgaaaattggaatgcaatttgttaacaaattttgtacaaaaaatgaacaaaatttgcgatcttgggctaaattttaagaaaaaagataggaattttgggggccggcagtgccgataggcgctgccgggggaaaattttaagaatttatatgaattttgttaacttagccaaaattttcagaaattttcctcttttagatgaaaataaggcattacccccaaattagaacatttcttagaaataagaacataaagaaaccctgtattaatcagaaaaaaataaatacaaatg

SEQ ID NO: 119078 - DNA, 60 bp, Heterodera glycines
  Promoter: Source sequence=SeqID_4513; Location=1069..1128; Strand=-; Gene=SeqID_54731
aatacccatcgacattgttattttgtatgcttccatcattcattcatttgacaaaatatg

SEQ ID NO: 119079 - DNA, 165 bp, Heterodera glycines
  Promoter: Source sequence=SeqID_14454; Location=213..377; Strand=+; Gene=SeqID_78497
ttttgctttgtgtgcttcactttctgattagcatttaatgcacaaatattttacatctcatttccgttttgaaattttacggggagaggggcaataatcaatttttttttttaattattattgacattccgtcgtgacttttcccgaaaaatgttttaggtaatg

SEQ ID NO: 119080 - DNA, 459 bp, Heterodera glycines
  Promoter: Source sequence=SeqID_21839; Location=544..1002; Strand=+; Gene=SeqID_52473
tattttggcaattaggggattttataaattttgttttgacatcctaagattttttttttttgcattcatatttttcgcttcatggtaacgacacgggccaaatgaagcaacacaaaacttgaacattttgtgaaaattgagtttaagagggaaactttagtaaaattctataatataaaaactgtccaatttcgtttttgtgtcccttaaacttcgctcgaattgggtaaataatagcgtataatattaataattcagggaccaaaaaatggcattgcatttctttttacaaatattttttcggaaatctttttttcatttcttgtcagattcgactcttcgtccagctcttcatcgtcctcctcctcctcctcagatgaagcggatgaatggggggcggccaacacaaatgggaacagcggtggtagtgcaaaacaaattcagcagcagccgaggatg

SEQ ID NO: 119081 - DNA, 120 bp, Heterodera glycines
  Promoter: Source sequence=SeqID_7834; Location=1539..1658; Strand=-; Gene=SeqID_46480
ctcatttgtgcctctccacttcaaattcgctgttcatttaccctcaggcgctttcatcatttcatgccgatttagtgaattagaaataggattaattcattctttaaattttgcagaatg

SEQ ID NO: 119082 - DNA, 467 bp, Heterodera glycines
  Promoter: Source sequence=SeqID_7765; Location=4193..4659; Strand=-; Gene=SeqID_65875
aaaatttctaataaatgagaaatctgacagttaaattcggttaatttttaaaaataaaatcccgttaaaaagagaaagatcatttcactactataccgtagtgagttcttttcattacctagactagactggcgccggaccagaatcagcttggtttatctgctgcgacttatacgcttgctttaataattaattttagaaaaatacaaatttttaaatatcactttttttcttatctcagtgctcacaaaaccgaacatttgtacaaaagagccagtaaaggtaacaacttagttaaaatccttaatattggaattctaataaaaatttaaaaaatgtcgttttgatatatgaaatttctattttctaaataaataactttattaagcttagagatttattgtaattgaaatgatttttcattttagtttttagatggatcgttctcaaacaaaatcagcaaaatg

SEQ ID NO: 119083 - DNA, 361 bp, Heterodera glycines
  Promoter: Source sequence=SeqID_6013; Location=2609..2969; Strand=-; Gene=SeqID_60022
tctcgtgtccaagtcctgtgatcagggattagcttagtcgatcggaccaatgatcagagtaagccaaaaaatagtaaattgaaccaaaagtaaatattccccaccgccgctgatctgtcactgactgatccttttttatcacagacccgaaaaaacacctctctcacccaccaaattctcgaactcgagattttagaggctatcactaatggaattgtggcattaatttattctcaaccattggtttctggaattggaaaggaaaataaaaggcttggcttgcttattgttaacctaaatctagcttacataaccagtttaggtgtttttcaaacacaaaaaaacttgaagcaatacgatg

SEQ ID NO: 119084 - DNA, 1003 bp, Heterodera glycines
  Promoter: Source sequence=SeqID_31797; Location=861..1863; Strand=+; Gene=SeqID_62087
tttaatgtccttgaaaataaggatgagtcggtgccgtgacattagtcaaataaccatcaaatgaaaatactttttgatataactttgctcaaaaacaatcaagttttaaaatattgatatcattccatagctccaagtgttttcaattatcctgcaaaatttttaaaaatttcgtttactttcaaggaagttatgatttttttggaacttaacgaattttttttttgaaacttttgcgggataatagaacacacttagggctatcgaataataccaatatttaaaaatttggggtcatttgggcgaagttatgaataattttctgtcaaaaattttccatttgatggtccttgcttgactatccgtcaacggcaccgatgagtcttgtgccttccggttttgaaatttaaaaatattttcgtccttgattttctctaattatatgcccgtctccattagtctgcccgtctccaattatctcctcctttctgaggaggttgaaaaataatactcgggcatataattcgataaaatacggtaggataaaaataggtgcctaggcattaagcagaaaaagccaaaaataggcaaaaataggcattatataagtcatcgtaaactccctaaactaaacggaaaatgctttttttcgtgcttatctctgagtgtatcatgtgcgcagaaattttatccgtgatttttggttttttaaagaaaaatatacaaaactcgaaatataaacagaactttagttcatacaggttttgggcgctgttttagataaaaagaatacaataagccgtacgatttaatagtattataaaaagccttaatttataaaaaaaataaagtgtattcaatataacattttaattccatttgtttttaaataatatataataattcaatttttatatattttaactataaaatttccattgaataggaagtgtcattcgaattgccttttgccgaatctaatgaccgtaaaaagaaaataatg

SEQ ID NO: 119085 - DNA, 1003 bp, Heterodera glycines
  Promoter: Source sequence=SeqID_19023; Location=642..1644; Strand=+; Gene=SeqID_83759
atacctctaaattgttgtggctttccggtttatttctgtattttgtttgtttttatcaagaaatggaaaaacaaaatatttagaaagatataaaaatagcatacaaaatgagttgatccaattaacgaatatctatcctttaaactattataattataatttttgggattagaagattttttgattattaattttgttaaactcgaaattctaagaattaaatattttaataaatttatttgtttagattaaatatttcaaaatctcttaaaatgatcttctggagtattttgaagtgtcatttttattatttttatcttttttgaatttattcttttactttgaatttgttttttatttgtttttcttgtctttggttttttaaaatcaattttcattcagttcaatcaaatcaaagattttaattattgttttgaattttacttcttatccatccctttaataatgatatacaaatgcaataaaaaaatgacaaaacattatcaattagatgcaataacattttgaacaaaaaaaaaatatataaaatttttaaagtgtttaaatttatttcaattttaaatatgttatttttaaagcatttttttgtgaaaaattgtttaatatttagcagatgtgaaggtcatatgggatacaataatatttaatgaattgtgtgctacttaagcataggaaaaatagatccaaatcatattgctaaattaaataaataatatacatcataattaatggcactgctcatctatatgtaagaatgcttttttattaaattatattaatgtaaataaatttattttaaattgttttttcattaataatcacttgtttctgcaacgcttattttctatttgttggagacattttaataatcacattttttataattttgactaataaaaaataatcaaaatattggagggaaaatatatatagaactaattcattaattattatttttaaattcaaaaattagacttacatg

SEQ ID NO: 119086 - DNA, 413 bp, Heterodera glycines
  Promoter: Source sequence=SeqID_43611; Location=1..413; Strand=+; Gene=SeqID_71233
tatttgtactttgttctccacgccctttccccccttctcattgtgtttataaggagaccattcccctcctttttggactcttccctcattcattcgtttttattattatttgcatttgtccaccgaccgatcaataaatatttttattctttgtgtgttcaattggaggaacacaacaacaattaaattatttatgtcattttaaaatgaatatgaaaattgaccacgttcattttttatttttggtgctacaaatgacgaaattaaaatttttttacagaatacatttgggaaaattaattttttttttttctgaagaaaagtatattttttttaaatcggtgaaacaattgtttttagaagtaaactaatttttgtggtcttacttgaataattatgaaattgaggaaatg

SEQ ID NO: 119087 - DNA, 55 bp, Heterodera glycines; identical to SEQ ID NO: 99576
  Promoter: Source sequence=SeqID_5871; Location=948..1002; Strand=-; Gene=SeqID_59504

SEQ ID NO: 119088 - DNA, 542 bp, Heterodera glycines
  Promoter: Source sequence=SeqID_10795; Location=1..542; Strand=+; Gene=SeqID_74057
attctgaaatagttaaataaatattcaaaagccaaaaatttttgcaatattgaaaacaaataactttaagtgacaatattaataaaaatgaattatggttgataattttcctatttttaggcgttttttgtaaaaaaaaaaaatgctgaagttatcgttttatttttttattgtgaatattctataaaaatatccttacaatttatttaaattgttatttgcgaagtaaattatatttaaatttaattgttattttactttttcttgccaatatttgttcagtagaatttcattttaatttgagaataaaataacagataatgtgaaatcgatgggagatgagaaggaccaccgattgaaaacagcacaattattcatccgctttgtgttgagggatatgcatacattgaatcaatcgttcatttctctctctccaatttttcgttccaattaattagtcatccattgattcttatattatttaaaaaactttaaaaacattaaaatactttatttaaacttaaatttgcctcttaaatatg

SEQ ID NO: 119089 - DNA, 116 bp, Heterodera glycines
  Promoter: Source sequence=SeqID_45402; Location=1..116; Strand=+; Gene=SeqID_72700
aaatgggcgttgtctaagttttgtattaagttataattcaaccgaattcacctttaatatttaaattatgttatttgaaatagttactgagcacaactccttcttcgaatgtcatg

SEQ ID NO: 119090 - DNA, 274 bp, Heterodera glycines
  Promoter: Source sequence=SeqID_22642; Location=1..274; Strand=+; Gene=SeqID_53315
gtgatggacaaaaatttcccaaaaaatgtctcttgacattttctttttgattggttgactcattcctacaatttgtttaattgaaaaacaatttggcgaacttatcaattaactagcatatgtatatgtttttatttacctgctcctgatggattgatttccttcccccaattaaacgttaattaccgctcgacaaattagccaaaaatgctcccccccccctccggcgacgcccccgccgttcgcgtgcccctcccaattttttgagcacatg

SEQ ID NO: 119091 - DNA, 304 bp, Heterodera glycines
  Promoter: Source sequence=SeqID_13188; Location=1..304; Strand=+; Gene=SeqID_47112
accagtcgaaggctctcctctctcttggacgctttgaccataaaaaagctaactgtagccgaattctctgccgatttgttcaaaagccgcagaaaaaaattgttgagagaatttcaaagcggtgcggtgagtgccgagtttatcctttggacacagcgtccggaaacagctcctgtaccaaaaaagatttgcatgtgtggctcagtggtttttgtaggaaagtcaagggacaaagggcggaggttcgagtccgttgtgctacatgaatatttttatttatttttgtgcaaaaaattaaaaaatg

SEQ ID NO: 119092 - DNA, 905 bp, Heterodera glycines
  Promoter: Source sequence=SeqID_484; Location=9484..10388; Strand=-; Gene=SeqID_54030
tctaccgtataacattaatctaccatagtcatgtagacaacgtacgcatcaagaataaatatgtgttgatggacgtacgcatttctggagcgttgaatatcgtgagtatgtggatgcgtacgcacgcatctaccgtaaaacattaatctaccatagtcatgtagacaacgtaggcatcaagaataaatatgtgttgatggacgtacgcatttctggagcattgaatatcgtgagtatgtggatgcgtacgcacgcatctaccgtataacattaatctaccatagtcatgtagacaacgtacgcatcaagaataaatatgtgttgatggacgtacgcatttctggagcgttgaatatcgtgagtatgtggatacgtacgcacgcatctaccgtatacattaatctaccgtagacatgtagtcaacgtacgtatcaagaatacgtatgcgaagatggacgtacgcatttatggagtgttgaatatcgattggatgcttacgcacgcatctaccgtagacaacgtacgcattaagaatacgtatgcgttgatggagtttctgcgtacgcacgtagaacctttcatatatagaatccggaggaggcggcccgcaaaaagtttttaaatcgattagtcgctcattttttttttgttgccgcaggaaggtgtacaagactatatcgattggttgattggtttataagaaggtgggagttcacctttcttctcattcgttcatttttttaatactaaatttcgtctccctgtcctctattaatattttaattaaaaattttaagcattaaaaagaattaaatcaatgtcaactcgacccaatagctttttcaacgccgccatgccgccccttggacaggtagaacaacttgttcaacccatgttcatcaatg

SEQ ID NO: 119093 - DNA, 222 bp, Heterodera glycines
  Promoter: Source sequence=SeqID_12008; Location=1690..1911; Strand=-; Gene=SeqID_75533
ccccccccctccccccaaagattccttcgcacgtgaaatttaaaaactacaaaataatagcaatgaaaatcaaaaaaaaaaaaaggttgtcgcccaggggtgtccccccccccccaagccgaaatgccgggaccgttcctggcacatcatttaaatatggcaaggaaaatttttaattaattttttttagcataatttattaaaaatttaagttttcaaatg

SEQ ID NO: 119094 - DNA, 178 bp, Heterodera glycines
  Promoter: Source sequence=SeqID_44578; Location=1..178; Strand=+; Gene=SeqID_72051
cggtgtagcgacggacggaggaacgcccaattcgatgtccggctctttcgcgtcgtcttccgcatcgtcggcatgtcgtgcagcgacttccagggccggccaccagcagcagcagccgcaatttgagcagaccaaaaggggcggcacggcacagccgggcgaagggaacgcactgatg

SEQ ID NO: 119095 - DNA, 554 bp, Heterodera glycines
  Promoter: Source sequence=SeqID_19992; Location=1294..1847; Strand=-; Gene=SeqID_84763
cctcatcttttctctctccctcctcgctctctatcctctaatctctcctctcctcaatctctctctatcgtttcctctcttctctattacttctcttctcctttatctcctctctctctcttcattttaacaaagaatgggcaaccgttgggttggcaaaaataataaattaaatttaaatttttggtgatggaaatgcatttttttaagacaccgtcgatttgtttgtttgtccgtccgctctaattcggtcgctttcattaattcattttgtcatttaaaagttttttttgtctgtcatttgttaatttattcatttatttatgcattcattcattttgcttttgctgcatttatcacattttctcatctcattgtccaatgatttattccgtccaattgatttggccttacattttttactatttagtccaaattccatttattcaaaagacaaattgactaataacctaaaaagcctataattagttaattacatttaattatttaacactaaattaggtgaataattataattacgcttttaaaatatg

SEQ ID NO: 119096 - DNA, 385 bp, Heterodera glycines
  Promoter: Source sequence=SeqID_4244; Location=2806..3190; Strand=-; Gene=SeqID_45752
cgagcaaaaagaagcgcaatcgaattgccgggtacggcaaatattttgtttgttttcgtttccgaactttagtggttcaggtttcgtttaatgtaagctgtagtaaaattcatggctttgacaatttaaaaggaagaccaaaaaataaaaatgttatgacttaaaatgtatatacttgtaaatccggtgatgtacagtctgattcaatagtttgtttaggtcttaaaacaaattggatttctaacatttttttgtcctattacaaattgtaaaaaaataggacgagaggtactcaattcttttgttgaaaaaattattttgtagggtcattcaatgatttgaagtaaaacacttgggactttgcaggtttatcacccatttgatg

SEQ ID NO: 119097 - DNA, 157 bp, Heterodera glycines
  Promoter: Source sequence=SeqID_25345; Location=1808..1964; Strand=-; Gene=SeqID_56094
tgtaagcaatcgggataagagacgacccgacagacgacgcggatgcgcaagcagtgatacaattcgaacgatcagtgcgccaactcaacgacgggcgctactccattcgattgccatggcgggagtgccaccccgctttgccaccaatttcagcatg

SEQ ID NO: 119098 - DNA, 628 bp, Heterodera glycines
  Promoter: Source sequence=SeqID_3249; Location=1154..1781; Strand=+; Gene=SeqID_83908
ttgtagtgaaaaaaaagaaatgaatgaataaatgcatgcataggttggctttaggatgcatgataccagaaggcgatgccgttccctcgggaatcagtgaaaatttgaattggctttgaaaattatcgattgtttgcaaacatctgttaccatatggcatttcccagagggaaatgcaaattgattcgccgaaaagttatcgattaatgggcggagacaccagctttaaaagcgagactgtacagagaatttttcatttgttccttacccttaattatattcttaataaaaattttccatttccaattttgctgttaaccagggcggtagctcgacctacagagtaccgtttatcctggcagcaattttgttaatttgttttttagatcttgaggtaatgcttttgacttgtctaattcccagagctgtttaggtgccctgtcgtcttgtgcttcatggatggcagtgcgcggctcatcaggccaagattggtttatttaagtgttaaatttcactcaatttcatcacttttccttccccattttgtatttgttacgagctcggctcatataaatatgcccttcctattgttgatttatcattttaataaagcattagattaaaaatg

SEQ ID NO: 119099 - DNA, 383 bp, Heterodera glycines
  Promoter: Source sequence=SeqID_14511; Location=2585..2967; Strand=-; Gene=SeqID_78563
aattttgatcatttataaacaggttttcactgaaaattagccaatttataggtaaaattttgaaaaattttatgggaatttaatccaattcttagggatgtaaaagtcgcttttcgcgccaaaaagcgaaatgcgaaacgctaaaaaatgcgaataatgcgaaaagcgaaacctaggcacatccctgttatgtacatatttggaccatttttgtacatatttttggcagccctactcgaatgccgtcaaaaccgataaatttcatcatattatttttttaataagcaaactaaaaattgttggcgatatttacaaagcgtagtattttgaaaaaatttttcacttttttttctttgttttttttttgttttttacacataatg

SEQ ID NO: 119100 - DNA, 313 bp, Heterodera glycines
  misc_feature (13)..(13): n is a, c, g, or t
  Promoter: Source sequence=SeqID_31077; Location=1..313; Strand=+; Gene=SeqID_61449
cccccccccctcncttcccttccccttccccctcatattccgtatcaattttccgatttcaaaacataatattgcacaaatgtttagcttctttcaaagatttgtaatcgtaaaattaattaactggcgctttaatacaattggcctgttttttgaatctgtttttatttttgattttctaccttgagaatttttttggtgttgcacagttaaaatccaaatatgagtatttaaaaataataaatttgtagaaatttttataattattatttattctgtcaaatgaatttgattgctcaaaaaacaaagaatg

SEQ ID NO: 119101 - DNA, 784 bp, Heterodera glycines
  Promoter: Source sequence=SeqID_18354; Location=430..1213; Strand=-; Gene=SeqID_82955
taggtaagaaaaatctcagaataggtacttaaataggtaaaaaaaaatctcaaaataggtattaaataggtataaaaattccaaaataggtaccaaaataggtaaaaaaaaatttttattaacgattttttagtggaaaaaagcaaacaaagagggaaaattttggttctacatatctctttgtaaacgaaaatttaaatatattaatattttcttagataatattgacattttaaattaaaaattttgtcaatagaaaaaataaataaattttgggataaatttttgagaaatttttccaattcttagggtgcatttttgaaaatttttttggtcgattcttatgggtatattttttgattttattgcatttttgttaagaattttttgaaaatccttaaaataggtaaccaaaatgccgaaataggtataaaaataggtacctaggtaataggtagaaaaatcccgaaataggtaaaaataggtattataaaagtgggtgtagaagctccaaaccaagctaaaaactcgttttttatgcttatctcaacgttacaagtgcgcaaaaattttaggtatttacctaaaaatcgaagccctatttatcagacagaatgacaatttaaaatttctatcttgttgaattggcatcacttgaaaaataaatatgaaagcaaacaccttaatttatgtcttgtacatatttaatcatttctcgtccaattataatttttctaaaattaatttgaatacaaatttaaaccatttttattttggcagaatg

SEQ ID NO: 119102 - DNA, 795 bp, Heterodera glycines
  Promoter: Source sequence=SeqID_14811; Location=1732..2526; Strand=+; Gene=SeqID_78961
aaattgacattgttttaattttgaaatatctcaaattaaaatcataaaatttatgtaatattttggaaaataataaataaatttaaatatctttaattaaatgaaattattttgagcgcaataaatggtaccggaagccatgcaagagaaattacagtactcatgtgttttttagttcttggtaattcttttcgacatttattcgggtttataaaatgtcttattaattccattggtaggaagccacttacaaaagaaattacagtataccaagtgtttttgagttcttgataattccattcgacatttattcggtataaaatatcttattaattccatctaattataaataagtattcactttttacacaattcaactttacattgctcaattccacaaacacacagtatcactgccgcattttcgcttttcccattttggcactgatttttaatatttcactaaattcaaaaaaaaaaaatttgacacaaatttctctttcgtaaggtttcttttttgtccatccctttctttattcatcgcttttacattttgtcaccctatcaaataaattttcttgcttgcatattaagctttttgctgattcattacttttttctgcttccattttttcctccgttggccgtctttttaagtcatcttctgccgccgatggcgaaacaaatatttcttcttttcctcacattctatcattcatatatgtacataaaattgtaattttatttatttatttaaatttttatttatttatttttctttttttagcaaaaatg

SEQ ID NO: 119103 - DNA, 153 bp, Heterodera glycines
  Promoter: Source sequence=SeqID_22190; Location=2738..2890; Strand=-; Gene=SeqID_52851
gaaatttgatacgtgcgcaaataaataattatagttttgcgagggatcttcagcacagcagcggtactttatggggcacctttccattgaacttaaaagggtgtggcgctggggtcactataatgaaaagttttggacggaaatttaacaatg

SEQ ID NO: 119104 - DNA, 1003 bp, Heterodera glycines
  Promoter: Source sequence=SeqID_13496; Location=90..1092; Strand=+; Gene=SeqID_77383
ttggtgtcttaaaattgtaaaattcaaaaattacaaatttctcctcacacggaatggcgcggacggcgccgctgcaaagtgtgcacagccgactctccccccccccccccccggcgacatttggccccttcctccggcgcacggctaattatttacgcttgttaaaaataaacaaaaaaaaaattggctaaacgaggtgctgacctgtgcacattatttagacaatgaatgtgcattttggtcattgttttggcactacgattttttgacaaaaatgcttttaaaatattaatatgcttttaagtcacaaattgagccaagagtaacggcataaaaaagtgaaaattagttaaaaatttaatactgttaaatttatatttatatatcatcataaatttcatacagaatatctaaattttagaaagttttaggaaagttaataaatttttcagctaataaaattatttttttaaatttcttttcaattaattaaacacaaaaggcaccaaaaatgccaaagaaaaggcaatttatttttggaataataaaaattcattcccgtgttctggcattcattcattgtctgtgtttacattccaattaattaaatgttggcgcgcaaatgccattcatctgtcaaaataggccataattattcgaaagcaaatgccaacaaaagtcaaattgttcgacgtgggcacaaatgtttctttaggccatagattgtgctgtggtttttccacatttggccaaaagatcaccgttatgctattaatattgttctgtttctaaaaatgccatggcaaaagaaatgccaaatgtttgaatgcttttcacatggcaccgcaatcggttgcatataaatacgtcagacggagacagccaaacaaatcattctgactcaaaatttgaaaaacttttctttcctaaaaccaaaaatgtttgccccaaaatttttcttatttttctggtctgtgttgcttttgccattggtcatccaatg

SEQ ID NO: 119105 - DNA, 916 bp, Heterodera glycines
  Promoter: Source sequence=SeqID_1951; Location=1209..2124; Strand=+; Gene=SeqID_76979
tgtaacccacgaatctgaaagaattttttgacaaaaattaaattgaaaaaagttgtgggacctcaaaatcgttaaaactatttttaaaccagtagtcagtgaatttagcttattgcgctaaaacgtgctgagtcgaagcacgaaaaagtgcaaagtgaacaaattaaagcaaaataattattaataaattaaaagcaaaataattattttaaataataataataatctacttaattaatgcgtttattttataatatttttaaatctcaataaaactaacatttatagttttctcattttttattaaaaacaaaaaatcagagacttttagagggatggggtcatttcagtacagaaaattatattaataaataaatttaattattttaaatgtatttttaaatattttccatattggttcgaggcaataaaatccatcaatatattttttgcccattaagtggattgcacttttatttttattcacaattgtatctttatataagcttttttgccatgccagccgaccactttttaacgagacgtaggaaaagccgacgaaaggaaagcaaatgctaattacagaaatttatctcgatcttaattttttcttctctcactgattttttgtttttaataaaaaatttttgaaaaatggaggccaaaatggcaaaaaaaaattaattttttggcgaaaaacggcgaaaaattttgtaaaatacaccccataattcaggatttcaaaaaaccaaaaatacacccctaaaaatcgacttaaaaaagaaaaatacacacctaaaaatcgaattttagacttcagcccccccccccaaagccaagggtctggctacgcccttggacgacggtaaggaattaattattaatataaaaaaattacaattttggtctccaaatg

SEQ ID NO: 119106 - DNA, 111 bp, Heterodera glycines
  Promoter: Source sequence=SeqID_9731; Location=3175..3285; Strand=+; Gene=SeqID_72514
cctaaataatttcttttttatttctcaattattttgtgaataaaatattaaaaaaatttttttagatttttccaaaaatttcgaaaccataccttgtgaaccattgcaatg

SEQ ID NO: 119107 - DNA, 199 bp, Heterodera glycines
  Promoter: Source sequence=SeqID_34221; Location=1..199; Strand=+; Gene=SeqID_64063
aaaattaaataggaaataccaatttagaagggatctctcttctcgacatcaaatcccgagtctcgacagtatgatttgaatcaggcccgtatcagaaaatttttctgggggggggggcaccgaagcgctcttttttcttgctgttcgggccaaaaaatatttttcccagtgttatttttcaaaattttcaggattgatg

SEQ ID NO: 119108 - DNA, 219 bp, Heterodera glycines
  Promoter: Source sequence=SeqID_45545; Location=1..219; Strand=+; Gene=SeqID_72824
ggaagaaccgaccgaggacgactttgaatggatgaagcaaatcatcggcgaattcgtcgaggaaaccgactcgaaaattggcacgcgcattttaaacctttggcagatggaaaagaccaaattcattaaggttgggtttgacgatttacaaattggacaatctaattttgctgttcccagattttcccgaaggactacaaaaaggcattagcccaaatg

SEQ ID NO: 119109 - DNA, 271 bp, Heterodera glycines
  Promoter: Source sequence=SeqID_38984; Location=1..271; Strand=+; Gene=SeqID_67660
aatttttttttttaaaattatttataaaaatttttttttaaaatattcaaaaaaaaaaatttttaaaaaaacaatttgacgaacaaacattaattattggataaaaaaattattattattttaagtacttttgatgcagcaaaaaatgataaaacgtcaaaatcaccacaaaaaaaatatttgactattttggagctcggcgaaagagattttggaagaagaattatgcaaacttgatcgacgattatcccttgaagagtataaaaaaatg

SEQ ID NO: 119110 - DNA, 295 bp, Heterodera glycines
  Promoter: Source sequence=SeqID_13391; Location=2622..2916; Strand=-; Gene=SeqID_77271
tctaaagagcagaaatggtcgttgacaaatgttttaacgttaattgcctcattagaaattattaaaatattataatttatttatcacacaattttatacggttagactctaaccgttagagaaaggattttgggacatgcaattattcaaataaaagtcataaaatgacaacaaacaaaaaaaattgaaaaagggtaataaaattagcattttcctcaaaatgaaagcttttctaagatttatataaaataattcttcaattttaaagataacgtccaaattgaacaccaaaatg

SEQ ID NO: 119111 - DNA, 1003 bp, Heterodera glycines
  Promoter: Source sequence=SeqID_6844; Location=669..1671; Strand=+; Gene=SeqID_63079
ttattacataaaattcccattcctaattattagtttttttctccacctgtatgtaaattcgggcaaattcaatgtaaaagaaaaattttttatttcaaaaaaaattcaaatatgtataaaagaaaacgtatttttctctgcgctctctttttatttcgttttgatttagtagtatacatatcaaatcattttgacaggattatgtgttctttaacgatacaatttaacgatttttattattacagtacataaacggatggaagtgggattttgcacacttctctgaacatatgggttttttaagtatgactcaactacagtatgctcttaccatatatggtaataacattttttttaaaaatatgttttattttttcaaggctatagttttactaccccgttttttaacattctgctacaccatttcgatcgaactaaatctggtattttttttttgctttaaaaatacatccttcaaaaggacgaatttacttcgatgattttattcatcttggcataactctaaagcgtcttacgccacccttccgtaatgctgacacggaccgtgacgggcgcgtaaatatacgtaagcaaaattttatctcatttttaggtgccaactcgttaatttttagtaataacataaaatttttcctccaattttttttttgcactaaataaaaatctaaatcagtttgcatctaaataaaatatttttcaacgaattatttaattttgtaaatctttgaagatttcgaggatttcatcttaatggtcttgaccgctgaagtttgatttctctacacaacccaatataaatagggatgatttgattaaaaatatcacttattctatttatctgtataaaattcttaattttaaaatcaaaaaaagcaattgcaaatatataaaaatatatttatgatatttaatacttatatggcaaatcatacacttgctaattcaatgtttacaccctcgtacccattaagcaaaaaaaatg

SEQ ID NO: 119112 - DNA, 696 bp, Heterodera glycines
  Promoter: Source sequence=SeqID_12945; Location=644..1339; Strand=-; Gene=SeqID_76697
agaagagaatgaagataaagatgattcgttaaaactataaataaaaatctttaatgataattaaaaaaaaatgaattttttatctgtgttaattttattctttttggtggtaaggggggagggttgttgttgtctttcaaaagaagaaaaacagcaattggatatctccagaagggctgttgaagaagcaattaaagatataattaggtaactaatgaggccaaagacttttcattttctgctcataatacaattgttgaagctcaaaatattaaggatagaaatcgggaaaatctgaaatcatatgttggcatgaaaaactattaaatggagtaagaaaaatacactcacaatttgataaaataaaaaatgaggaaaagaatataaaaaatattaaaaaggcatggaaaaatgtctagacagaaaggacccagtgatgtgtcaagaaaatgctgaagatgtcaaacaatcaatagaaatagctaaaaatataggcatgaaattggacagacttatcgtaactcttattcacagccagatttgggaattggaaacatggccaataaaataaaagaaataatgcgagaaaatcaaataaattttgaaaagccaaggcccccagcagaatttagagacgaattcattgcctataaaatataattaggcatagaaaatagaaataaataaataaaaatg

SEQ ID NO: 119113 - DNA, 76 bp, Heterodera glycines
  Promoter: Source sequence=SeqID_26338; Location=734..809; Strand=-; Gene=SeqID_45991
ggtaatggcatggcgtccaaattgatcgccgttgtgtgtttgacactctgaccacatcattttttcagcgagaatg

SEQ ID NO: 119114 - DNA, 51 bp, Heterodera glycines
  Promoter: Source sequence=SeqID_7254; Location=4503..4553; Strand=-; Gene=SeqID_64267
caatggagcgtgtttcggggagaaggatttgaagtattggacgacaaaatg

SEQ ID NO: 119115 - DNA, 435 bp, Heterodera glycines
  Promoter: Source sequence=SeqID_5025; Location=918..1352; Strand=+; Gene=SeqID_56615
tgtaattaacaaataccagcagaagttaataagctcgaataatgcacaggtcggaagttatactcaatggaaggacagagtcttcgcgtgacatttaaacgctaaaaaagcaacattttgtagtgaccacaataaatccgtatgtaataaactttcaaaagaaacctcgaacattatccaagaagatattgtcgtaacatcataataaaaatcaattctcttgacaaaattcattgtgtccttaacacttccaaaataaaattatttcactttagtatttgggttattttatacatttacatataatgccaagaaattataaaaatgacgtagctaacaataaacctataactagctagctacaatttgcatgtgcataaatcaacaatatttgtggatttgattacagaattaaatagttaaattgatcaaatg

SEQ ID NO: 119116 - DNA, 561 bp, Heterodera glycines
  Promoter: Source sequence=SeqID_8689; Location=1035..1595; Strand=-; Gene=SeqID_68858
accatttgcagtcgcggcttgagaaactgcgaaacacgcgaagaccgatttgaacaaacttttaccaaagagagagagaggcaccggaggaatttggcgggaaatggattgtgatgtgacttttcattccgtcttagggtattcgttgcccctgaaaattggcaaattaccgggcaaaatgattttaatggatgggatgcaaaatgtatcatcctttgggatggaattgccaaattaacttcgaatttaatcgctattttccgtctttctgtgcctcactttcgtttctcttcccttcaatttttgctctccaattctttccgcgtgcatttccccgaattctgtgccttttgtcccttaatcatagaatccccaacaaagatgcttagtttgtccttttattttgtctataattggcgtaaaatgataattaaactaatttagaagaattggttaacaataagttttataaatggaatttaattttttcaaatttactttacgtttaataattaagcggacattaattggcaattaattaagtcgttttgtttttaaatg

SEQ ID NO: 119117 - DNA, 138 bp, Heterodera glycines
  Promoter: Source sequence=SeqID_25206; Location=1762..1899; Strand=+; Gene=SeqID_55949
tatgctctattagtcttactgaaaattgactatttctaggataaattttctaaaaattaataattgctctgacaaaaggccaaaaaatttaattttttttttcataaaatctacatttttacttcatacgcaaaaatg

SEQ ID NO: 119118 - DNA, 350 bp, Heterodera glycines
  Promoter: Source sequence=SeqID_43858; Location=924..1273; Strand=-; Gene=SeqID_71436
aaaggtgattagaaaaggtacaacagtgattagaagaggtacaacagtgatcagaagaggtacaaaagtcattagaagaggtacaccggtgattaaaaaggtacaaatgtgattagaagaagtacaaaagtgattaaaagaggtacaacggtgattaaaagaggtacaaaagtgattagaagaggtacaacagtgattagaagaggtacgacagtgatttgaagaggtacaacagtgattagaagaggtacaacggagattaaaagaggtacaacagtgattaaaagaggtacaacagtgattaggagaggtacaacggtgattaaaagaggtacaaaagtgattaaatg

SEQ ID NO: 119119 - DNA, 702 bp, Heterodera glycines
  misc_feature (24)..(24): n is a, c, g, or t
  Promoter: Source sequence=SeqID_15139; Location=1..702; Strand=+; Gene=SeqID_79329
aaatgcaaaatgacaatttacgcncaaattacaaaaaatataaaatttagcttttcagaaaaccattcgaaaaaaataatttttaaagtaacacattaattaaggttcaaattgggggaaatttttgctgttaattacatgaaatgacactattttgatcatattattttttccaatattttgagaaatatgcaaacaaataaatgctcgtaatatatcaacaaaagagaatataatgttttcatggtcaagcgattgattgcttctgatcactgctgatcattgcgtccacgcgacttgaacaatttgttggaggccaacgcgcgtctgagttagtaccgcgccaccgcacgcttcataaacgaaatgtcgcgcgcacgcgctttaactgacgcctctgaataaaataaaataatttaaaaaatgttattgtctctttcaaatgcaattgctttaactttttctgccggtggccgaacgtttcgtcactgaacctttcgtcactaaacttttcgtcactgaacctttcgtcactgaaataaaataaagaattatttattagtgaaaactatttttttttaaataaagttatgtatttgaaattttggagtgtctgatcagtgatcaccgtaaaaaatttttaatggacgtcaaaatttctcgtttcccaaacatgagtgcctaaatgtaattccccaaatg

SEQ ID NO: 119120 - DNA, 354 bp, Heterodera glycines
  Promoter: Source sequence=SeqID_2377; Location=1465..1818; Strand=+; Gene=SeqID_79409
aatttcaaaatttggaaaaaatcgtcacgggttttaaattcaaaaaaaatagctaccaaaaaagtaacaaaattcttcaatattaccaaaatataaaatcattttatttttttaatttttttagcatcaatatatcccgacaattttcgataaaatttgcactttaagtcaaaagactgactaaaaattctgttctcctctcctccacacccctccaatcgttttaccacctccaattgtttattctgcccaacagtcaacatttccccgtcccaccatttttcataaaaagaaattggtgtctcgattgacaaacaaacaaaacacattataatgttgtgtatggaaaatatg

SEQ ID NO: 119121 - DNA, 337 bp, Heterodera glycines
  Promoter: Source sequence=SeqID_4400; Location=1..337; Strand=+; Gene= SeqID_54320
acacaaaaaataatatggccatctttcacaatttaatagtttatatagttttctctctccgtcaggacgccgatttctacaccctctaatacccggattttgagatttcttaagacaaaaacgaaatcttttagttttgcatttttgagaatttggatttccaataataatttaaggaattccaaaaatcaagagtgttcatcggacgaattctatttttttttttggcaaattttatttgaaggaaccgattaaattccatatttttgagctatttcaattaagaataatgctttgttgttttgatcaaatttaagctgccagtaatttttaaatg

SEQ ID NO: 119122 - DNA, 266 bp, Heterodera glycines
  Promoter: Source sequence=SeqID_7272; Location=942..1207; Strand=+; Gene=SeqID_64313
ggtaattattcattctgtgcattatgcccaaaaaggcattttgtcattgtctgcccattaattgcgtaattaactaattaattaacccaagggaattgccccgcgggagagattcgcaccgattgtcggccggtgtgtggtgaaaagaattgcgcagacgttctatcgccggacagtgcgaggggcaattgcttttcgttgcgctgtttcccggggtgcgtttgtgcgagcggaattcggcactttgggaagggcggcggcgaatg

SEQ ID NO: 119123 - DNA, 1003 bp, Heterodera glycines
  Promoter: Source sequence=SeqID_15741; Location=1352..2354; Strand=+; Gene=SeqID_80068
ccacaaaacatattttatgcctataattctaaaaaatgaaaaaaatacttgaagaaaatcaaagacttgacaaaaaaatcaaagattagatgatgtcatatgacaattatgatatcatattcgtgatcagcggcctcgataaccctcgaatagaacgaataatcgtaaaaggccgtctttttatttcctttttttatgggaccagtaaaagtcattattaccggaaattttaaaaattttgagcggtttttttctgctcttatttaatcttaaaaaaaaattttttttttttggaaatttccaaacatttaaaaatagatttttcaatacttttcaagcctttagaaggtcaggaaaaagtaggacaaatcttaaaaatccatgtctaacaagtttaatgggttcaactttgggtaatggtggagatcatgagactatgaatatcacaacataactgcatctccttccttctcagtcgtttccgacattcgccacaaaattatattaagaactttgctgttcttttagcaatacatggacgaatatatgtgccgccagttttatggaaaaaaacccttttggcattcgaaaatatttttgtccatattggtcagttttatgttgtcaatgcttaaatattgtgcatttttcgtgcaataaacaagccgagctcatttttgagctaaataattgagttagaattggaaaaaatacttgatgaaaaatcatagacatggcgaaaaatcatagatttgatgtcgtcatatgacaaatctgatggcatattcttgctcagcaccctcgataacccccgggtgaagtgcaaaatcattaaaatcgggctttttttccctttttttatgggaccaatgatctccaccaactttgtacatagctttttctatagttaggaaatcctaataaagttgtttttacgtgtgtgtatgtgtgtatttaaatgttttattaaattaatttaagaaaagtttattttaaagcgatg

SEQ ID NO: 119124 - DNA, 103 bp, Heterodera glycines
  Promoter: Source sequence=SeqID_34084; Location=1045..1147; Strand=-; Gene=SeqID_63965
ttttgggtcattaggaggttttaattataaccgtaatttttcgatttcagttaattcctcgaagggttgcgatatcagccaattgaattggtgtgcagatatg

SEQ ID NO: 119125 - DNA, 310 bp, Heterodera glycines
  Promoter: Source sequence=SeqID_26515; Location=1841..2150; Strand=-; Gene=SeqID_57248
aataacaaatttagattttgaacgaataaaatgatgtttaatgctttttgaagtaaattggtcaagtttacgaatacatttcggttggaacttttttggggaggaagatgaagattgggctttagagacacgcttcatatttattagtttttattaattgattgggtaaaatatggatatatgaataaaggaaagtttttaaattttatgaagtaaagtttttataaaaattttatgatttaattaagtttattggagtttttatatttttcaaattgagggatttatattaaaattaagtggtgaaatg

SEQ ID NO: 119126 - DNA, 53 bp, Heterodera glycines
  Promoter: Source sequence=SeqID_41434; Location=1..53; Strand=+; Gene= SeqID_69553
acggtatcaaattgccgactgaaggagaccatcccatttcgagagtaggaatg

SEQ ID NO: 119127 - DNA, 729 bp, Heterodera glycines
  Promoter: Source sequence=SeqID_2440; Location=526..1254; Strand=-; Gene=SeqID_79731
tgcatttttgtgaaaaaattatattttttctattatttatatttattattcttgtaacaaaagaactgacaagtgtgtcaggtgttgttattcttaaatccccccccctcccccatcgctccttttttcttatgccgtctaagttttcttcttcctataattccatcttttaataaacattcaaattgttattttattttaaaaatttacctctctaacaattcaacttttatttttgagtctaaattaattcactaagtttttattcttattttttaaaattaatccgcgcattgccattaaacaattttctcttttggattaaaataccgcaaattatgcgtttgttttgaatgaaaagtgcgtaaagaacatgcaatcacagcggggaagcagcagccggtcgaagacgacgacgacactatggaataatttatatttatgtgaattgggggggacggaattatgggcaagacaaattggacgggggggggggggggaaagtgcgcatgaaaaaaatgggaaaagcaaaaaataaattaaaaagggaaaataatttaaaaataccaaaaatatttaaaatataaagggatgttgacaattgctaattaattttaagaagcttaaaacactcctaatcacataacataaaatggtaattgttgtgttgtctttttgcccatttctccaatttcgttttttgttattattgtgtaattaaggctaatg

SEQ ID NO: 119128 - DNA, 651 bp, Heterodera glycines
  misc_feature (30)..(30): n is a, c, g, or t
  Promoter: Source sequence=SeqID_9510; Location=4305..4955; Strand=-; Gene=SeqID_71691
agaataaaataataaaataagagaaaccanacggaagaaagaaattataatttaattagtgtgatgtttttaaaaataaaataattaaaactctcataaatatttacatattttggataattctactgaaggataagccattttatcatgtgaaattgggctgaataagatcaccccacccacgtacatcagcagctaaaaattgattcgtttataaagcaattcgatatgacacttttttaaattattaattaaatttcttaataatttaagcatttataatttcattcatttgcttataatttggcttgaaaaaaaatttgaaatatatttaatgcaacaacaattatatctttaaatttttctgatacaatagagcatcaatttaaatttatttagggagagttggaatatttcagtaaaataatattatcgaaaaaatttgcattggatcagcaaattcagaaagtcaaaaccacaaaattatgctctctaattcaaatacaaattaataaataaattacgtgaaattataatttaaaaaatttccattttttttttgccaaattgccaattctttcccaaaccgctcataaacagcacatttaaaaaatccgtaaaaaaaataatttgttttctgcagcttctatg

SEQ ID NO: 119129 - DNA, 107 bp, Heterodera glycines
  Promoter: Source sequence=SeqID_10469; Location=3622..3728; Strand=-; Gene=SeqID_46873
ggttttgcattgctttttcgacattattttacgagtgggaataatgtattaggcactaattagggaaatgaataatttccccccccccccaaaaaaaatttgagatg

SEQ ID NO: 119130 - DNA, 188 bp, Heterodera glycines
  Promoter: Source sequence=SeqID_5138; Location=1287..1474; Strand=-; Gene=SeqID_57049
ttagtcaccataattggcatatttttgccattttttcccattgttggcacattttgtccctttattgccatagttggtccaatttttcaccacaagttggcgtatttttcatcaaaatttggccaactttttcaccaaaatctgacccaatttttcactcacccacaaggagttggagacggatgatg

SEQ ID NO: 119131 - DNA, 1003 bp, Heterodera glycines
  Promoter: Source sequence=SeqID_16634; Location=491..1493; Strand=+; Gene=SeqID_81045
ttgttaactatttctttataattatttgcaaaaaaaatgtttccaaaaactacattttcattccttttggctttctgaattgtgccatttttatttttattttttaatctacattattttaattaggtataaatgataattataattaatattttaatgtgccaatttggaatgtataaataattttatattaagaatccaataaattttcctgcttccaacccacataaaagtaaaataatttatattgattttaatagaaaacatgtattttaaaaaggctctacccgtatttcgtaaacaaaaactcaggaaaaccaaggcccaggaaaacccaggatgaaaaaaattcctgaactatggtccgtaaaacccaggacgggatcaatgaccctcgtttatttctagttttaaagcctgcacccgaattttgtatagaaaaattcaggtaaatccagtcacagtaaaaagtcagggtgccaaaaaaatcatgaacttcacgaattttttgccaaatattttttgcgtaaaaaacaaactcgatgtttatctggcatatggcaacaggaaatttgtcgtagtgatctgtgtcaattaaaaaggtgtgtaatttaacttcattatgtaatttgggaacaattaattaattgcatgctaattgttacaaaatgccaaactcggccctttcaataaaaaaagataatattttccgtcaaaaaaaaagatcaattatgaagcaaataatgttaaattttttattaaaaaataatcaatcaaaaatggagctctcattaatcgcgaaatatggcaaattataggaatattagttataatatatattttttatttatattttatatgtcataaataaaaatattttaataaaataaatatcatcgtttttacataatatttttatttttatttctgatttagaagataatccatgaaattgactcataataataataataattttaggcaaagtatcattacaagaatg

SEQ ID NO: 119132 - DNA, 683 bp, Heterodera glycines
  Promoter: Source sequence=SeqID_1401; Location=1750..2432; Strand=+; Gene=SeqID_73290
tttttctttttattaaaatattttcattttatcataatatgtcaattatttctattaatctattactttttaaaaggtgctttttaaattgaaagctttcaaaagcccacaattaaataattaaagaatgggcggcttcttttcttgttttgagactccgaccgtttcttttgtttgtattgtttacaattagtcgggtcattagtgaacagtcgtcactttgaagtggacaccatcattattctgttctcattgcagacaggaaatcccacacattttgttgcaattagtgatgatcaatttacattaattgctttggtattatggtcatttctgaatattcaaaatcatttggataattttttgataaaattgccatgaaattgtcgattaattatttctgtatcattcattttgttaccgcgtgcactccgacggctaaaattatgggaggagaaataatcatgacgacgatggaaggcaataaaatgaatattttgacaatttttcattgtttcctccctttttcctttttagcatttgcttcacctgccccaattaccaataggccaactgacggcaatcaaagtgtgccgatgccaatcatttcgccaacaacaaattcattgaccacaaccaccggtggtgaatcatcaagcacatccacggggatttctacaatg

SEQ ID NO: 119133 - DNA, 1003 bp, Heterodera glycines
  Promoter: Source sequence=SeqID_15354; Location=252..1254; Strand=+; Gene=SeqID_79606
tcagtaatataagaattcgtattttctttgtcaattttaaaaagtttttcccatttttgtagcacttcttcaattttttcattcattccttaaattttttgattgtcttttttccgttttatttatttatttttattgcaaattgctgttaaagttttgtaaaatcaaattaatgaacatttttggtactaaatttagtcacattattcgggatggatttaatatattctattctaaatttattctaattttcactggcctataataattattaaagtaattatgccattatcaacttgccaatttccaaattttttgtttctgctttttctctgctctgcctttttgattttgactttccaactccctaaaaaatgcattgataagtcattctctcagctgatttggaatttttggcccaatttattcttaaaattttgcaaattttttttatatttttagtctattttttctcaaaaataacgacattgagtctcggtggtgagggaaaaaggatccatccaaaaaaggaatttaaattgaaaaatatataaaaaggattatttctatggattatttaaagcaacctgcacaattaaagtgaaagaatacaaatataagagaatggcaagtgttagatgaccaataataagcattttaagcaaaaaattaatacggaattctcaaaaatatttataacgacgatttttggagatgaaaattcgtaaaatgggatgaatttagttaaaacaaatggagcaaattttcttcaaatttttcagattgatataaaataggatcgatttacacattgaaaatgtaaaaaaaatttatagaatacaagtgcattcattcttcatataattgatattttttagtaattttttttttgctgaacaaaaaaaagaaatttacaaaataataaaatgcaaattaaaagttaaaaataatgcatcattaaaaaatcaaagtgaaaattattattaatttagccaaacgaatg

SEQ ID NO: 119134 - DNA, 858 bp, Heterodera glycines
  Promoter: Source sequence=SeqID_3998; Location=1414..2271; Strand=+; Gene=SeqID_52756
attgttcacaacttttaggacgacatgtgttatgttcatttaacgtgaagtaataaaaccattattatccgagtcgattaattgttgttaagtaatctttgcttatcaccattttggttctccgtttattcgctttaaatggtttccgttcaccgctaatgtaagaaaacctaaaagtgaaagggtttgttggtttaataattaataaatttttcgtgtttgattaagtctcgattgttgacttgactaaaaacaaaatttcattctttagctatacataaatataattttattgtgtcaatttgaaaaatgtcaaatcgtaaaaggatgggaatgttcgaccatgccaaatattctaagccggttcttcgcagcattactgagcctgtccaaagggcggtcggttcttttcgtttccgtcattttttgtttcctcttgtgacttggtaaaggtcaaacgcgacatcaacaaactgttggactatggcgcggcgtcggtgcgcttccgccagcccgaaaaatttgattcggaagtgagcgtggtggaggacagctttgagcagcagcagcaactggaagaggaggaggaagcggagagagaggcgaagcagcagcagtgccggaagaagttttgtccggaaattatcgacttggacaaggcgagactattggttgacaacgggcggactattctaacagtttgtcataattcacttccttaagccgcccatcgtttgggcctcttccttgcgcccgcccgaaaaatcgttcgccttgggccgtgacccgtcattcgctgcggttcgggacgcgctgctgagagcggcccctgcccgggggagagagtcgccgaaaatg

SEQ ID NO: 119135 - DNA, 322 bp, Heterodera glycines
  Promoter: Source sequence=SeqID_27485; Location=1..322; Strand=+; Gene=SeqID_58175
gaaatgcctttgtcagaatttccccccccccccccgttaaaatttgagtaggaaatgaaccagcatctttcacgctcacccgacgaccgaaccccacagccgacctgatgaaatggactttgatcagataagtgccgttgggggggtcgaccctcctttcaaattttttgtcaccaatttgtgcaattttggaaatttctaaaatgtcctcataacggggttttgagcagtgttgttcttttcccaccaaaacagggactgacctttggtcattcggcgcccgaaaaccggaccacactgacgcggcatttccatcgaaatg

SEQ ID NO: 119136 - DNA, 389 bp, Heterodera glycines
  Promoter: Source sequence=SeqID_3615; Location=1..389; Strand=+; Gene= SeqID_51128
attaattaattaaaatcattgttcggtactgaaatgacccgcctcttctgatcatcactcattcgcacttttgtcacttcgcccacattcggcactttgtcactttgacccagcaccgaccaaatcatgtaaaagttaaaaaaatccattcaattggcataattttgatggatacgcacgcattcacagaaaacatttgctatattcgacgtgggaatatgcgcgaaggcatcaataatcagatatttctacatcaaaaatgtggaattttctgaagaagccagcaattaaattgtaaattttaatttattttatttttttgttttatatatgacatttataaaacataaatatttggaagaaataaaattaaatttatagacaaaatg

SEQ ID NO: 119137 - DNA, 659 bp, Heterodera glycines
  misc_feature (90)..(90): n is a, c, g, or t
  Promoter: Source sequence=SeqID_35331; Location=346..1004; Strand=-; Gene=SeqID_64908
aatgcaaaaatggccaaatatgcattattctcgaaaacccccaaaaattaagcattatatgcactaaaaccttgaccaaatcaaaaattntaacgcagaaatgctattttgggcccctttcttcatagcatatgcgcagaaaaaatatgcaaaagcatataatttatagccctagttataaatattgagcaacctaaacatcattttcaatttactaaataaataaatatggacaaacaatgaaaaatcaacgattgcaaaaatcattgctttttaaaatcacttaacaaatttctgacggcaaattcggcaattttcattattgagtttgggtttgaaaagatgagaaaataattttttccaaattcccgaatagaaaaaaaatcgttagtttttgagcaaataatttttttcccaattcccgaatagaaaaaaatcgttaattttttccaaaaatccacaaaaactaacaaattttcacgagatccgttacaaaaaaacaaatttttttccgcgcaaatctttaattcaaattctttaaatttttttaattttccaggtccgtctctttcatacgcccaaattgtgcggcctcctcaaaagtgcgttgcccgaacggaccaacgaaatgttggcctacagcacatgaaagaggaatg

SEQ ID NO: 119138 - DNA, 148 bp, Heterodera glycines
  misc_feature (16)..(16): n is a, c, g, or t
  Promoter: Source sequence=SeqID_44997; Location=1..148; Strand=+; Gene=SeqID_72393
atgaaaaaaataaatntcattgatttaaaatattttaatcatcacatataaattaattctatctgtatagtgaattgagaatcgagctcaatttagcaatttctttttgatttgttaccttatacaaacatcaaattcttaaaaaatg

SEQ ID NO: 119139 - DNA, 885 bp, Heterodera glycines
  Promoter: Source sequence=SeqID_24465; Location=1455..2339; Strand=-; Gene=SeqID_55196
ccaaaatattttattaatagaatgtccaaaatatgttttttattttataaaaaatcgctctgattgaaaagaaaactcgtaaaaagctaagtttgagcttttcatgcgataaaatattagcaacaacaaaaaaaaacatataaaaaattaaatccgagccctgtggttatggcaatgttaattaattttttaaattcttattatcattcgaaagttcttgacgactttaatttttttttaactttttggaatgtcgaactgtaaaaagaaatataaaaattctcactttttttttgcattttgagttgcataataaaatagtttggcctgagttttaccaaagcgcgagatttttgttctcaaatcattccccaattttcaataaaagttcacaaaaaacaagaaattaaaaatattttaataaaaatggctgggaaccaaacaaaaattcggcaataaaaagtaaaaacgagaagtttatttttaaaactttttgttattctttaataaaaagggttcaaaataaaagcccctccattagaagcccctccccctcataagtgggcttgttaaattgaagccccggggtttatagcctgctggtgagccaacaaaataaatgacaacaaaatttaaaaaagaaaaataaatccaaaaatcaccgaaagttatgaattaaaaaaaagtaaaaactgagaccgacagagtttattttgcacaccctaactaaagaatttgaccattgttaaaaatttgaagaaggcaattggtcaaattttaccgaacgtaattggaaaagctccaattgatgccgaattaattcagcaaattcaaattggtgacaaatcgaaggaaaacccaacgactgaatttgataaaaaaatg

SEQ ID NO: 119140 - DNA, 94 bp, Heterodera glycines
  misc_feature (66)..(66): n is a, c, g, or t
  Promoter: Source sequence=SeqID_26659; Location=1..94; Strand=+; Gene= SeqID_57412
gacaaatggcactccaacgagacgttacgattcattgtttatagaaactccattctttgttcgatntaaggttcaaattgaagttgagacgatg

SEQ ID NO: 119141 - DNA, 166 bp, Heterodera glycines
  Promoter: Source sequence=SeqID_4766; Location=2495..2660; Strand=-; Gene=SeqID_55645
tgatcagaacagaacataaataataaatagccatccaaatgttttcatttcccattaattctttgaaccactcgctgcaaattaaaaggcaaaaatttttaatcaaaattaaaactaattaaattgggttattttaagactcgtgtttaagccaaacgcacaaatg

SEQ ID NO: 119142 - DNA, 1003 bp, Heterodera glycines
  Promoter: Source sequence=SeqID_17087; Location=62..1064; Strand=+; Gene=SeqID_81517
taccttactaactttttgctttgaccgtctctcttacactctcttttcccattcttttctctaaccttcggattgacatttagtttctatgccacattttctttcgtcgccttaaggctgcttcttcttcctcttcctttttttcactcgtctgaccatctttttgctttgtccgtctctcttacactcttttctcccgtccttttctctgattttaacaaaaaaaaaatcggtcggattaaaatgttgtctgtccattcgcttaaatcttgcgttctctctgtctctcactttaaacagtctctcggacagtggcagtcatcactttctttgatttgtgctgcttgggcttgggcttgggctgggcgagggcacagaaagtggggcaagtcgacgtgtcgcatcgctacgcattttctccacacaaattatacgtggccatcccatcgcatcgacccgtcccctttccatcgcattttattcgggaattttcttccttctcgtcagcacagatgacccatttaaatttgattttctttatttgatttgtcactcactgttttcaattagtattttatgaaaacaagttggactaatttgggcatattttaattatacatgttacaactcgggcttcaacctgtgcatacgggccttaatttcttcctcagatgcaacataatagcaattttttcattttgatagtaagacatttaaaaaaaggcttggatttttgcataagaatgcttcctgggttttttgtctagaaaatccaggttcgagagggctctatttttgctaatgtaaccccattttttgatttttttttaggtctcccgaattaaaatttcattgctttcgctttgaattccttttttaattgaaaaatgaaatttagatttcaaacttgatacttgttgttgttgaacatatttctatacctcacagttcgtccacattttgactttcggacaaaaacaaaagacaaaaaacggtggcaatg

SEQ ID NO: 119143 - DNA, 53 bp, Heterodera glycines
  Promoter: Source sequence=SeqID_1203; Location=2011..2063; Strand=+; Gene=SeqID_69861
agtaaatcacaatcaaaaaacatccagtacggttaatttttaaggaaacaatg

SEQ ID NO: 119144 - DNA, 1003 bp, Heterodera glycines
  Promoter: Source sequence=SeqID_197; Location=1601..2603; Strand=-; Gene=SeqID_77175
caattcccaaattttgtaaggattgattcgttcgtacttaatgagctcatgacttaaagtaaaagctcttttccctcatattgcgccaaaaagatggatttcctttaagaaaaaggcatttttaatcccccatttgccataatcggttattcattagcacagaacataaacattatgggcttttatgcattcgctttatgacctaaaagccccccaaaaatagtttcgataatattttcttcttccttctgaattaaatgttcaaaaattttctacattaaaaaacaacaaaatcttcattacagattttgtcttaaattgccacataggcaaatatttgtgctcaattcttctctagctgcttcattaaacagaattgagatttcattaagcattttaattagggaaatttcctggctcaaaaattttgtgccataaaatagttattattcaattttattaaataataagacaaataatatgtgtttcacctgccaaaataatctgtctgacaatgagattattaatgtttcttcaattttttcatggctctcaattcgcatgctctcaataaaatttaaattaataagatgatttgtttaaaaaattttaattatttgctgacatcattctcatgtcacaattttctgttgtatgaatttccaaaaaaattccacaacctttcctaatttctgataaaattttaattgtccgcaaattcgagtccataattgagagagacaatttatgcatgtttcttcaagattaaatcaaatcagtggaggagacatggaaatgttttctaatatcgatgccacgcagttatcgccttctttgatagctgttcaacacacaatagggccaaatgttgatcagccacagcggcaggcaataaaaaattatttaaaaaatgaaacaaaaatataaataaattaataaatattttataactaataaacataggaatttaaaaattaatttgtaaaaaaaaagaaaacaaatg

SEQ ID NO: 119145 - DNA, 1003 bp, Heterodera glycines
  Promoter: Source sequence=SeqID_1900; Location=5770..6772; Strand=-; Gene=SeqID_76666
tttcaaaaattttccccggcggcgcctatcggcaccgccggcacccaaaaccttatttttataaaaagttggctcaaaatcgcaaaaaattggccttttttggtgaaaatctgttaacaaatcagaattaaattacaaaaatttttccggcggcgcctttcggcaccgccggaccccctcccctcgcacttcccaaaagttttttgaaaaatgcgccgcaaaaaattgttaaaaatctgattttttttatcccgaatgcactaaaattttatgatttgctaatttcctccccaaaattactaaaatcgttacaaaaatatactatatgacacatttttgatcgaataaattgtaaaaataactgtgttcgactgatgaccccgagagagagagacatttatattattttatttacgttatttccctctctctgtctcccgcactatttctctcattttattgtgtctgtgctgcctttgtaaggtcaaacacatctttcctccccgactttgtgacccccgctcatttccaacattcattctgtcttcctgttaatttcccactttttcctccaattgtcctccgccctgctgatttgaagcaatttccttattttgacccaaaaatcttattttttggccttgatgttcttattttgaaaaattttcgatccgagccctgattttcagaccacttcgaactgtattcgaaaaactggtcaaaaaaggcaacaattttcaaaaaacaaatatgtttgggcacatctacaaactcttggctttctaatgacaccagggttgttttggtccgggtccggaaagtgccctgaaaagggaggacaagcacttttggtcggcatttcttccaaaaaaaaaggaaaagggaattaaaattatgattcatttccaaaaatataagccttctccctaattaaaccatcttttattatttattctaagtgcattaaacaaattaaaataaatttttagttaaaattaaaatg

SEQ ID NO: 119146 - protein, 625 aa, Heterodera glycines
  Coding regions on vcDNA: vcDNA=SeqID_45569; Strand=-; Position=1 -1117,4975-5853,10288-10330
  Homolog annotation: Hit_ID=NP_733106.2; Match level="QueryCoverage =99%, HitCoverage=81%, E-value=1e-165, Identity=53%"; Hit description= CG31439-PA [Drosophila melanogaster] gb|AAN14054.2| CG31439-PA [Drosophila melanogaster]
  Essential gene: C elegans homolog=F16F9.2; Phenotype=Dpy
HTKSLHNATTTTRMKNATTTTSMTKNATTTTSMTKKCTTTRTTKTTTTTRMTTTTTTSMTKTTTTTSMTKKSTTTTRTTKNATTTTSMTKTTTTTSMTKKCTTTTRTTKKSTTTTRTTKTTTTTSMTKKSTTTNRMKNATTTTSMTKKCTTTTRMKNATTTTRTTKNATTTTRMTKKCTTTTRTKNATTTTRMTKKSTTTTRTTKKCTTTTRTTKTTTTTRMTTTTTTRMTKKCTTTTRMTKKSTTTTRTTKKCTTTTRMTKKSTTTTRMTKNATTTTRMNKKCTTTTRTTKTTTTTRMTTTTTTRMTKNATTTTRMTTTTTTRMTTTTTTRMNKKCNDDSTTTTRMTKTTTTTRMTKTTTTTSMPKNATTTTRTTKKSTTTTRMTKKCTTTTSMTKNATTTTSMTKTTTTTRTTKKCTTTTRMTKNATTTTRTTKTTTTTRMTKTTTTTRMTKTTTTTRTTTTTTTRMTKKCTTTTRMTKTTTTTRTTTTTTTRMTKKCTTTTRMTKTTTTTRTTKKCTTTTRMTKTTTTTRMTKKCTTTTRTKNATTTTRMTKKCTTTTRMPKNATTTTAQPKNATTTTRMTKKCTTTTRMTKKCPTTTRMNKKCNDDSLALCPKEKTVELCN

SEQ ID NO: 119147 - protein, 190 aa, Heterodera glycines
  misc_feature (36)..(36): Xaa can be any naturally occurring amino acid
  misc_feature (187)..(187): Xaa can be any naturally occurring amino acid
  Coding regions on vcDNA: vcDNA=SeqID_45570; Strand=-; Position=1 -78,4489-4659,4809-4892,5085-5149,5382-5431,5540-5670
  Homolog annotation: Hit_ID=NP_671734.1; Match level="QueryCoverage =80%, HitCoverage=28%, E-value=3e-36, Identity=49%"; Hit description =nuclear receptor binding protein [Mus musculus] gb|AAK97261.1| HLS7 -interacting protein kinase [Mus muscu
  Essential gene: C elegans homolog=H37N21.1; Phenotype=Unclassified
NSDDAKIVIFNYYFSDGVAKIVISKAPLKFIFLNFXAWKSWTRQILTALSYLHSCDPPIVHANLTCNSVFIQQNGLVKIGCVAPKTIHHHVKTFRENIKNVHYLAPEYDHLDQTETTIQADIYSFGVCALEMATTGALQSGCFNGAPPGAVTENHQMAPVVPWHPQPRPVHCRRRSATGQPRLHQLXHHY

SEQ ID NO: 119148 - protein, 375 aa, Heterodera glycines
  Coding regions on vcDNA: vcDNA=SeqID_45571; Strand=+; Position=1 -69,113-136,260-295,346-520,664-770,814-1032,1218-1304,1345-1650
  Homolog annotation: Hit_ID=CAE60292.1; Match level="QueryCoverage =97%, HitCoverage=99%, E-value=1e-108, Identity=57%"; Hit description= Hypothetical protein CBG03876 [Caenorhabditis briggsae]
  Essential gene: C elegans homolog=Y39G10AL.3; Phenotype=Emb
FLMDIKTKKNRRYEKIKHLGEGQFANVYQAKGEGQFANVYQAKDIETGTIVAVKKIKLGIKLGSRHEARDGVNRTAIREIKLLMEIRHDNIITLLDVIGHRTSIQLVFDFMETDLEAIIKDSETILQHSHIKNMLLQVFLGLEHLHLLFILHRDLKPNNLLDLKPNNLLMNTSGRIKIADFGLARYFGSPNRYYTHQVVTRWYRAPELLYGARAYSTGVDIWAMGCIIGELLLRVPVFQGESDLDQLMQIYKVLGIPTETDWPGMTSLPDYVQYGMTSLPDYVQYKIVPGHELTAVFPAASSDLIELIGQCLRFDPLKRWNSTQALQSDYFRSQPFACDDSELPVAGRRKRKQQSLRENVEAGDEPPFSRRRLDF

SEQ ID NO: 119149 - protein, 161 aa, Heterodera glycines
  Coding regions on vcDNA: vcDNA=SeqID_45572; Strand=+; Position=1 -267,1356-1574
  Homolog annotation: Hit_ID=CAE64111.1; Match level="QueryCoverage =46%, HitCoverage=15%, E-value=4e-21, Identity=57%"; Hit description =Hypothetical protein CBG08720 [Caenorhabditis briggsae]
  Essential gene: C elegans homolog=W02D9.1; Phenotype=Emb
MFFGEEITKIPREVGKEDVCKAISHQIEAIDIDQCNLNMYLKPDTGVISLDQFQAMGSKRLTMLRKLEMLKEKFGNANSQDEYKKAFREGAGLSLEGSLEFFRMEFTKKMNNEKFSKEYSYNIRHMYGREGSRIDQRPLSCASIILGSLPTALDCHGCPYK

SEQ ID NO: 119150 - protein, 178 aa, Heterodera glycines
  Coding regions on vcDNA: vcDNA=SeqID_45573; Strand=-; Position=1 -144,197-322,376-557,602-683
  Homolog annotation: Hit_ID=NP_496325.1; Match level="QueryCoverage =97%, HitCoverage=46%, E-value=5e-25, Identity=34%"; Hit description =mitotic phosphoprotein 44 related, Nuclear Pore complex Protein NPP -19 (npp-19) [Caenorhabditis elegans]
  Essential gene: C elegans homolog=R06F6.5a; Phenotype=Emb
MLDEREQQQMEEEEEDSCYWVTVFGFSPDHLQHILELFSRHGDIMAQKTPKRGNWVHIRYSTPIHAKQALGRNGSIFEGQMIGVVPCQDREALEDDLSLSRSATPLIPRHSVTPHDTSRQNGSLLDGNYSIHDDSQMVPSTSQYKTNGLPSRARLSISSRAGMRPLNASAISDGPNQS

SEQ ID NO: 119151 - protein, 174 aa, Heterodera glycines
  Coding regions on vcDNA: vcDNA=SeqID_45574; Strand=-; Position=1 -118,232-403,531-765
  Homolog annotation: Hit_ID=CAE67904.1; Match level="QueryCoverage =48%, HitCoverage=26%, E-value=8e-14, Identity=44%"; Hit description =Hypothetical protein CBG13501 [Caenorhabditis briggsae]
  Essential gene: C elegans homolog=K02D7.1; Phenotype=Unc
MASIVDSAKVNNFGIGTVVEPILVNKNGSTGGGGRRKKKTLFGISQAVHAEHPQQQLSEFAGGISPVDAVPMPTAANDCNNNSIEDIQSDRRRGPIDPTNFDHLVRLSELIRSMADLGTLQPEFGIICGSGLGAIADQMEGARILPFSEVPGFPQPSVIGHKGKTNQRRLINCR

SEQ ID NO: 119152 - protein, 518 aa, Heterodera glycines
  misc_feature (343)..(343): Xaa can be any naturally occurring amino acid
  Coding regions on vcDNA: vcDNA=SeqID_45575; Strand=+; Position=1 -47,99-297,341-469,682-775,829-945,996-1184,1228-1344,1440-1485,1623 -1852,2442-2634
  Homolog annotation: Hit_ID=CAE56536.1; Match level="QueryCoverage =93%, HitCoverage=43%, E-value=9e-79, Identity=37%"; Hit description =Hypothetical protein CBG24263 [Caenorhabditis briggsae]
  Essential gene: C elegans homolog=C23G10.8; Phenotype=Emb
LLLMEVRAKLGPFKNSRMPLISPLTSALRMPLISPLTSALLRPALSNHMICFTPESVLHPFYPTPIRLNVDGDPFPSATHLVAQMAIKFLGVNQSCMEWIMFLGVNQSCMEWIMEPTDGPECWWRLHSVICEQIQLPLEKVQQWYMEERQKALKEAMKIQFDQHPTLLRVLLDTQDAFLVCCCRFSDAFLVCCCRFSAVEAELNIGMRERDLRLWLTQIRQNTKQLMDLCLRPMAFRPPFLMDLCLRPMAFRPPFFGGNRIGLLLMELRREFILNGAFANHLPELPLNVDTILGSDSPMENFVTTAPFDVLNPLNFTAIWATTAPFDVLNPLNFTAIWASTAXQMHIVQIGPLLAQIPTFKHPPLLIKHPPLLISRDDTFVENTLEEMSHEMLRTLYIKVVSVRFFFVSFNKMCSHFRTQISELDEMQQQINVRSRESSRLQELRRTLERTRDQVDEIPTQEGSFAVSPLSSTFPSTPNVLGPFRGHPMDGAVKIPSLFSQELSPLPHSASLSASTQR

SEQ ID NO: 119153 - protein, 319 aa, Heterodera glycines
  Coding regions on vcDNA: vcDNA=SeqID_45576; Strand=-; Position=1 -185,456-715,1057-1178,1225-1404,1460-1670
  Homolog annotation: Hit_ID=XP_217431.2; Match level="QueryCoverage =88%, HitCoverage=88%, E-value=1e-103, Identity=66%"; Hit description= similar to rcd1 (required for cell differentiation) homolog 1; FL10; rcd1 (required for cell differentia
  Essential gene: C elegans homolog=C26E6.3; Phenotype=Emb
MEKLLSPNIANAQSTSTTTTSATASSNNKEENSKEKDAEQICHWIRELREHEKRENALLQISKRREGVEDLAVWLWFSYGTVRCCSNLIPTETAFPSAFSVLLQEIISIYPFILPPTLTAAQSNRVCNALALMQCIASHRNTRKQFLDAKVPLYLYPFLHTTSDSRPFEYLRLTSLGVLGALVKTDEKDVVKFLLSTEIIPICLRIMEQGTELSRTVATFILQKILLDDIGLSYVCQTYERFSHVAIVLGKMVIQLSKEPSHRLLKHLIRCYHRLSENNRALQALAQCLPDQLKDDTFKNLLDQDRPTKHWWKMLMKNL

SEQ ID NO: 119154 - protein, 37 aa, Heterodera glycines
  Coding regions on vcDNA: vcDNA=SeqID_45577; Strand=+; Position=1-113
  Homolog annotation: Hit_ID=NP_491640.1; Match level="QueryCoverage =100%, HitCoverage=50%, E-value=3e-11, Identity=83%"; Hit description= UBiquitin-Like (8.7 kD) (ubl-5) [Caenorhabditis elegans] gb|AAK21382.1| Ubiquitin-like family protein 5
  Essential gene: C elegans homolog=F46F11.4; Phenotype=Gro,Stp,Unc
MMEITVNDRLGKKVRIKCNPTDTIGDLKKLVSTQVGT

SEQ ID NO: 119155 - protein, 93 aa, Heterodera glycines
  Coding regions on vcDNA: vcDNA=SeqID_45578; Strand=+; Position=1 -76,379-584
  Homolog annotation: Hit_ID=AAP92328.1; Match level="QueryCoverage =81%, HitCoverage=26%, E-value=5e-12, Identity=46%"; Hit description =leucine zipper protein [Branchiostoma belcheri tsingtaunese]
  Essential gene: C elegans homolog=H38K22.2a; Phenotype=Emb
MSNQNSSTGGADSRKIDHLFNKYARDAKDKAQKIGPDRIGPNGMVRFLRDLNIEPTSRAVMVLAWKMGAQKQCEFTVQEFRDGISTLMFVSLF

SEQ ID NO: 119156 - protein, 189 aa, Heterodera glycines
  misc_feature (17)..(17): Xaa can be any naturally occurring amino acid
  Coding regions on vcDNA: vcDNA=SeqID_45579; Strand=+; Position=1 -306,664-869,1777-1831
  Homolog annotation: Hit_ID=CAE69760.1; Match level="QueryCoverage =86%, HitCoverage=30%, E-value=3e-70, Identity=68%"; Hit description =Hypothetical protein CBG16041 [Caenorhabditis briggsae]
  Essential gene: C elegans homolog=F53B3.1; Phenotype=Egl
KNGECKFCLFVCFDINXLFPPPGAQIYLCFECVPPRNLCNDVRLYNHRTKFHRGQNSGFKCNLCNQKFLTPRKLRKHKKMSHVFTKTYQCHFCEELFISETAVTTHERIHTGIIKFECKICDYKCNRFLNMEDHVKEDHGYLCSICQSKLSEWGDLKNHMLMDHGGYLSSDAVSGYIESPRVWLMFKGD

SEQ ID NO: 119157 - protein, 175 aa, Heterodera glycines
  Coding regions on vcDNA: vcDNA=SeqID_45580; Strand=-; Position=1 -255,485-649,701-808
  Homolog annotation: Hit_ID=CAF98543.1; Match level="QueryCoverage =97%, HitCoverage=36%, E-value=2e-54, Identity=60%"; Hit description =unnamed protein product [Tetraodon nigroviridis]
  Essential gene: C elegans homolog=T22D1.10; Phenotype=Emb,Lva
MEWREENKAQIIPGVLFVDEVHMFDLECFSFINRYIESDLSPILVMATNRGIVNIRGTSVESPHGVPLDLLDRSLIIRTSSYKENEIGEILKIRASDELVEMEDASIAVLVQIALETSMRYCMQLISTADILRQRRKGEKVTEEDVRKARSLFIDVKRCRKEMEKHGDSFINDFN

SEQ ID NO: 119158 - protein, 470 aa, Heterodera glycines
  Coding regions on vcDNA: vcDNA=SeqID_45581; Strand=-; Position=1 -1326,1803-1886
  Homolog annotation: Hit_ID=CAA33463.1; Match level="QueryCoverage =99%, HitCoverage=76%, E-value=0.0, Identity=36%"; Hit description =twitchin [Caenorhabditis elegans]
  Essential gene: C elegans homolog=ZK617.1a; Phenotype=Unc
MSNPSFFQARNVHKQGCTLSWKPPEDDGGAPIVGYVVEKMDTSRGTWQEVGQFPDCEAKVNRLVPGKAYMFRVKAVNVYGESKPLEGDKEIVAKNPFDVPDAPDAPAIIDFDENRIDVAWKPPTNDGGAPIKEYIVERREKGSSSWIEVGHTPATSFSCTGLRKGQEYEFRVLAVNEAGPSAPSAPSASQICKARFLKPQIITAQRKWKVRAGNTLTLDIEFVGTPDPSVGWVKAGGAGTLPPELIMDVRRPGNTSIFFPAAKRSETGIYELRLKNEVGETEGHFEVLVQDRPAPPKGPLVVDNVTRDSCTLSWQPPEDDGGSEVTNYVVERRDVGSQVWVPVNNFVVGTSSTVPKLQEGHEYEFRVCAENAFGRSDPLNTDSAVLAKDPYGRPGKPGRPEITDHDNNHISIKWTPPTDTGGSPITHYDVQRKDAKTGRWIKVNTHPVYDCAYTDERVQPGHGYEYRIVA

SEQ ID NO: 119159 - protein, 148 aa, Heterodera glycines
  Coding regions on vcDNA: vcDNA=SeqID_45582; Strand=+; Position=1 -360,507-593
  Homolog annotation: Hit_ID=AAP20435.1; Match level="QueryCoverage =82%, HitCoverage=27%, E-value=3e-63, Identity=95%"; Hit description =beta-tubulin isotype 2 [Cooperia oncophora]
  Essential gene: C elegans homolog=K01G5.7; Phenotype=Emb
MSGVTTCLRFPGQLNADLRKLAVNMVPFPRLHFFMPGFAPLSAKGAAAYQALSVSELTKQMFDAKNMMAACDPRHGRYLTVAAMFRGRMSMREVDDQMMSVQNKNSSYFVEWIPNNVKTAQCFAVRHFSIGTLAKEWTKWNLPKRSQT

SEQ ID NO: 119160 - protein, 492 aa, Heterodera glycines
  Coding regions on vcDNA: vcDNA=SeqID_45583; Strand=+; Position=1 -49,96-224,268-417,466-668,734-917,1319-1558,1621-1858,1909-2046
  Homolog annotation: Hit_ID=NP_506559.1; Match level="QueryCoverage =99%, HitCoverage=72%, E-value=0.0, Identity=79%"; Hit description =ATP synthase alpha and beta subunits ; ATP synthase ab C terminal (66.5 kD) (5O835Co) [Caenorhabditis elega
  Essential gene: C elegans homolog=Y49A3A.2; Phenotype=Emb,Ste
FCQESQYGFVYGVSGPVVTAEKMSGAAMYVTAEKMSGAAMYELVRVGHSELVGEIIRLEGDYATIQVYEETSSVTIGDPVLRTGQPLSVTIGDPVLRTGQPLSVELGPGIMGSIFDGIQRPLHDISEMTKSIYIPKGVNVKALNRAVNVKALNRAKRWEFMPRKDLRVGDHVTGGDIIGMVHESALVKHKIMVEPKACGTVKFIAPQGQYTVEDTILEVEFAGHTQKLTMMHIWPVRNPRPSAEKLAANFPLLCGQRVLDALFPCVQGGTTAIPGAFGCGKTVISQSLSKYSNSDAIIYVGCGERGNEMSEVLRDFPELTMEVDGVTTSIMERTALVANTSNMPVAAREASIYTGITLAITLAEYFRDMGLNVAMMADSTSRWAEALREISGRLGEMPADSGYPAYLAARLASFYERAGKVKCFGSPEREGSVTIVGAVSPPGGDFVSPPGGDFADPVTSATLGIVQVFWGLDKKLAQRKHFPSINWLISYR

SEQ ID NO: 119161 - protein, 353 aa, Heterodera glycines
  Coding regions on vcDNA: vcDNA=SeqID_45584; Strand=-; Position=1 -234,314-394,442-630,847-1044,1192-1283,1534-1668,1715-1847
  Homolog annotation: Hit_ID=CAE67868.1; Match level="QueryCoverage =79%, HitCoverage=54%, E-value=2e-12, Identity=21%"; Hit description =Hypothetical protein CBG13460 [Caenorhabditis briggsae]
  Essential gene: C elegans homolog=Y73B6BL.38; Phenotype=Emb
MHSPLFGSMLDNKEYSRHIENFRSSISPPKGITNGLHCHDFRSPSDFDVLVKLAKDPAGVGNRELQQRMDQDQQFRQQVLCAIVNGGKERFLQLCIDCNGCFVIQKLVENGSKETNQMLLNLVRPLAFKMVLNRFACRIVQKVKKDGAGQNSAAETQPTKTQPRHNSALVVNLSGSQVRQLFCQQFKGHENTLVTDQNGNHFVQCVVDHFAPDVYGPFILALANCPTRLSAVFENKYGCRVIQFVLENVVQLVHGTANANNSLENRNVYHLSLLKYSSHVVEQAFKHAEDRCNCLAMLFREVLEGYKPSTDGKQRTALYEMLFNQVNLTYSMTFCMGISLRVPFSTAITSFRG

SEQ ID NO: 119162 - protein, 318 aa, Heterodera glycines
  Coding regions on vcDNA: vcDNA=SeqID_45585; Strand=+; Position=1 -111,154-332,382-492,536-617,841-1001,1257-1354,1415-1629
  Homolog annotation: Hit_ID=NP_741529.1; Match level="QueryCoverage =98%, HitCoverage=87%, E-value=3e-45, Identity=52%"; Hit description =adenylosuccinate synthetase, possibly N-myristoylated (50.2 kD) (5F298) [Caenorhabditis elegans] gb|AAM29
  Essential gene: C elegans homolog=C37H5.6a; Phenotype =Emb,Gro,Pvl,Stp,Unc
IDIVARCQGGNNAGHTVLANGREYHFHLLPSGLASEKVLNIVGNGVVVNLDALFEELESNKIEDSADRLFVSDSAHLVLPVHIATDIMRENALGQNSKLGTTKRGIGPAYSSKCFRNGIRLGELLHQPEKFEQNYRSLVAHFKTLFPDIELDTESDVKQLKVPIRSSLRPIPPSAVASPALAFRRQPSVASSAWSKPTKRVSAPVHSRLNCLTPILAVTKVDILDQFHEIKIAIGYELNGRQIEYPPATVDDWANLCVHYKTFEGWQSPTTSARQWEQLPDKCRAYLEFIQNQLGVPVEYIGVGKGREQLIVCTNNGG

SEQ ID NO: 119163 - protein, 234 aa, Heterodera glycines
  misc_feature (233)..(233): Xaa can be any naturally occurring amino acid
  Coding regions on vcDNA: vcDNA=SeqID_45586; Strand=-; Position=1 -675,1425-1452
  Homolog annotation: Hit_ID=NP_508294.1; Match level="QueryCoverage =99%, HitCoverage=20%, E-value=9e-28, Identity=30%"; Hit description =predicted CDS, endonuclease/exonuclease/phosphatase family and RNA -directed DNA polymerase (XC178) [Caeno
  Essential gene: C elegans homolog=ZK250.3; Phenotype=Clr,Lvl,Sck
GLEISTEKCFVSYLGKNNMKKEYFINSKKISESDNVRDLGIIIDSKLNFSEHISKIVRNAYLRSFQILRVLKSREIKTLTAAYKTFVRPQLQYATEVWNPNLKKDIDKIERVQKFFTRKVFRKCGFVYKKYVERLKIAGLHKLEERRKINDLTTAFKIIKGFASLEAEQNFFFSERPRRPLLLRVKRHTAKTQNNFFHRIVRNWNNLPVVAVQINKAKEFRGLLNALSIHFLXP

SEQ ID NO: 119164 - protein, 328 aa, Heterodera glycines
  Coding regions on vcDNA: vcDNA=SeqID_45587; Strand=+; Position=1 -142,536-1036,1076-1206,1253-1445,1589-1608
  Homolog annotation: Hit_ID=NP_502053.1; Match level="QueryCoverage =82%, HitCoverage=32%, E-value=9e-23, Identity=28%"; Hit description =glucosidase 1 (4L782) [Caenorhabditis elegans] emb|CAA92954.1| Hypothetical protein F13H10.4 [Caenorhabdi
  Essential gene: C elegans homolog=F13H10.4; Phenotype=Gro,Unc
DNEMNKDHSIRQRRGLKQADSSESKLPPKQSSKALTKIILAVIFCIVGDNVKFSWLAHDGRTFGRQVIEDNDLAMQVDWMANGRKSWKVHLSANSTNNYALLFYLALQDKASHFVLQDQQYRKSSNNFGYGFLDGYSHILGQFAMNMNIQGVFSSEAVSKIAYKMTPILDVRHVDELIKVSIGQTEGKLGLQLTQNPEIPDEEANFAAIQFDFSKNIHIELEMLAEGDAKIANFDHIFTRKLETFSNKFDEIFPIDHQEGSDSFNRLGKIALSNLLGGIGVWHGYSLVKIDESDHINSYGPLSLISAVPSRPFFPRGFLWDEDFGFLA

SEQ ID NO: 119165 - protein, 149 aa, Heterodera glycines
  Coding regions on vcDNA: vcDNA=SeqID_45588; Strand=+; Position=1 -80,414-529,931-1185
  Homolog annotation: Hit_ID=NP_507482.1; Match level="QueryCoverage =65%, HitCoverage=30%, E-value=4e-33, Identity=65%"; Hit description =fatty acid desaturase (38.5 kD) (fat-5) [Caenorhabditis elegans] emb|CAB04924.1| Hypothetical protein W06
  Essential gene: C elegans homolog=F10D2.9; Phenotype=Emb,Gro
SSSEGQRIDVGLVRFDLRPVVGIPTKFIPVLLWHESASVAFYTASLFRYTFTLHSTWLINSVAHIVGYRPYDVSISSTESVWTTVLAGGEGGHNYHHTFPQDYRTSEMRTLLNFTKAPNNRKLALFTFAIHFRHSSICLRKSDGPTICE

SEQ ID NO: 119166 - protein, 275 aa, Heterodera glycines
  Coding regions on vcDNA: vcDNA=SeqID_45589; Strand=-; Position=1 -144,212-376,422-559,610-660,715-869,917-1088
  Homolog annotation: Hit_ID=NP_495784.1; Match level="QueryCoverage =73%, HitCoverage=33%, E-value=2e-34, Identity=37%"; Hit description =component of the meiotic and mitotic spindle poles, ZYGote defective : embryonic lethal ZYG-9 (156.2 kD)
  Essential gene: C elegans homolog=F22B5.7; Phenotype=Emb
MFFAKGLRAKFTPHVLLVVPVIFDKFKEKKQLLRDALVECIDVIAAYTSFDHLSKALLEAMTSKQNPSQKSQTDLFIYRVFRSLPAKDIPKGLLKDLVAILSKHGSDADSEVRDSSFAALGAIMKCIGEKALGCFISPELAKDANKMAKIAENRDKALTDSPNGPNDRVELFANANPSSRPVADSAKKRDASTSRLNQTINSTADDPNATKRARSASGRRRSVAVLPNNSMLNDNTDEGNPRAPRRSHFVGSGGLSSAVSYSSNLNTTMTLQSQN

SEQ ID NO: 119167 - protein, 413 aa, Heterodera glycines
  Coding regions on vcDNA: vcDNA=SeqID_45590; Strand=+; Position=1 -132,259-354,635-802,1176-1301,1362-1532,1590-1637,1789-2047,3089 -3189,3476-3616
  Homolog annotation: Hit_ID=CAE56125.1; Match level="QueryCoverage =63%, HitCoverage=28%, E-value=2e-45, Identity=38%"; Hit description =Hypothetical protein CBG23734 [Caenorhabditis briggsae]
  Essential gene: C elegans homolog=R11A5.1a; Phenotype=Unclassified
MIGLLTRYARTQFTSPFKNSETNNEQKELYSSGEESEEKDGGRQFQNEQMHLDPDYNLLIASVRPLLQSRNPAVVMPFLKSFFVRNSDTIHVKRMKLYVLSSLVTEANVQLVVRELQAFHLVPQMLGQLLLIAPMARSCILWLVGTHIDKVPKLAPDLLRIVAKTFCEEADFVKALNLAVRIWAIDSENREGKCALLIKYVFQLARYDRSYDIRDRCRFLRNFLFDKDQNSLKFPLDIFLQERPAPAKCNGYTELPDFPSEQPDPTIRRSAYPLPSDGIVQGTEIAMDEAEEEEEEDSLDEEESEEDEEDEDEEEDEEEEEEEEESEGEKVPDEKITSNIFETEKLMNVLIDTSTATDWNVRMVALLPLVAKNASKNDGQKELRSEHLLLLDIDFAQTTAQSPNEEGEDKMKD

SEQ ID NO: 119168 - protein, 389 aa, Heterodera glycines
  Coding regions on vcDNA: vcDNA=SeqID_45591; Strand=-; Position=1 -201,708-863,1236-1359,1571-1701,1786-1886,1942-2018,2414-2608,2667 -2780,2931-2999
  Homolog annotation: Hit_ID=NP_509849.1; Match level="QueryCoverage =83%, HitCoverage=57%, E-value=1e-71, Identity=47%"; Hit description =putative secreted or extracellular protein family member precursor (60.0 kD) (XL677) [Caenorhabditis eleg
  Essential gene: C elegans homolog=W04G3.8; Phenotype=Gro,Unc
MPQILPPILLAHFPPKSNPDSTTIPTDNIQKAPRKQQQQLQLICCDHFGSSLPFLLHKVLCNDAFGNLPAKPTFMRQADPPRAVPQAATRHLPSPAKQSAPIDVAAMAERSSVPPSSATNGQQAVSTSNPIAALQPVLPLNPVQQKFNPREDATPPPAPPRIPGLTGNHPEGFAGAVKELRSAGIPVQGIPLEHIGGQTVHAPQNEALVQANPKFGNELNTFIESAKAPFNPSGSSAPLPDAKPGENGLIGLLSSSVRKIVKDTGMADALSNSLPNLLGTNTGPNGAADTKSIASALANAAESVSSSAGTSSSSSAAGGGGASSTSGNGIRRQQSPAERAIAGFASALGGGGNANGPAHAGLPRIPGIPILPGGIPRNSQGQIDVVQLI

SEQ ID NO: 119169 - protein, 155 aa, Heterodera glycines
  Coding regions on vcDNA: vcDNA=SeqID_45592; Strand=-; Position=1 -258,544-562,718-808,1033-1067,1114-1178
  Homolog annotation: Hit_ID=E86336; Match level="QueryCoverage=76%, HitCoverage=28%, E-value=4e-09, Identity=31%"; Hit description =hypothetical protein F14O10.11 - Arabidopsis thaliana gb|AAF88160.1| Contains weak similarity to an unknown pr
  Essential gene: C elegans homolog=F59A2.3; Phenotype=Rup
KVTQKAAVLELKPSEEHLRTEKGEESTKNEDEIHTEEAEENEEKGSEASEREGPKSEECSVDEKDSDEEEKERLYEEQMEKEKQKTIALTIWIEVILNVNHSVDIEEDEEYEDEPQAEMEPESVPVSLPHFTISITKNNQSMFFALEMVKTEDGG

SEQ ID NO: 119170 - protein, 287 aa, Heterodera glycines
  Coding regions on vcDNA: vcDNA=SeqID_45593; Strand=-; Position=1 -173,266-531,640-738,788-900,963-1174
  Homolog annotation: Hit_ID=NP_524929.1; Match level="QueryCoverage =98%, HitCoverage=27%, E-value=1e-100, Identity=63%"; Hit description= CG4152-PA [Drosophila melanogaster] gb|AAF53481.1| CG4152-PA [Drosophila melanogaster] gb|AAF44963.1| sy
  Essential gene: C elegans homolog=W08D2.7; Phenotype=Emb,Lva,Unc
AIVPFDVEYQQLKKTNTPAKLYEFKLDMFQSQALKCLDNQQSVLVSAHTSAGKTVVALYAIAMALRDKQRVIYTSPIKALSNQKYRELVEEFEDVGLVTGDVTLNPNASCVVMTTEILRSMLYRGCEIVREVGWVIFDEIHYMRDKERGVVWEETLILLPKTTNLVFLSATIPNAKQFTEWICYLQHKQCNIIYTDYRPVPLQHLVYSAGSDGLWEVGEFKQDNFAKAMSCLEERQPMGGEVRPQHGRRSGANDATQKSNVVKIIRTIRERDMLPCIIFSFSRKECE

SEQ ID NO: 119171 - protein, 205 aa, Heterodera glycines
  Coding regions on vcDNA: vcDNA=SeqID_45594; Strand=+; Position=1 -209,330-416,491-566,681-923
  Homolog annotation: Hit_ID=CAE49237.1; Match level="QueryCoverage =96%, HitCoverage=23%, E-value=2e-49, Identity=50%"; Hit description =novel protein simlar to human and mouse vacuolar protein sorting 35 (yeast) (VPS35) [Danio rerio]
  Essential gene: C elegans homolog=F59G1.3; Phenotype=Clr,Stp
MHFLTGNEQSFDSEGQEALLDSALKVVKNESFEMKRALDRNELMEGLKHAAQMLCELRTSLLTPKFYYRFDRYLGEERKYSVAELYETVQYTGNIIPRLYLLITVGTTYIKSGESSTSNILNDLVEMCRGVQHPLRGLFLRNYLLTSTKELLPDIPSTSSEKSAQNFAASEEEEEQSLGTQINGGTVRDTIEFIMTNFAEMNKLW

SEQ ID NO: 119172 - protein, 353 aa, Heterodera glycines
  Coding regions on vcDNA: vcDNA=SeqID_45595; Strand=+; Position=1-1061
  Homolog annotation: Hit_ID=NP_494224.1; Match level="QueryCoverage =95%, HitCoverage=82%, E-value=1e-40, Identity=31%"; Hit description =predicted CDS, putative cytoplasmic protein family member (2C560) [Caenorhabditis elegans] gb|AAB66195.1|
  Essential gene: C elegans homolog=F19G12.2; Phenotype=Unclassified
MTFHKIDNDSVNSITNALDFFRIPPTNVSVSSSKVFELLPSNPLTDTPYHFKLHSSQNYIDLSKCYLLTEFRIRKENANGQLMDLTIDDENIAPIQMIGQTFIRNIKMSINGREVFNANALMAYKTYFSHELSYSTTAKDSHLNAAGYYRDTGETLETGPGCIQRRDLFAESKTAQFIAKIDTDLFNQPLYLINFCELDVEILPNDNDFVLIAPAIGGVVPRYRFEVMGLKMYVKKVSLMDGLALDIARKLEIKPARYAVRKTMMKSMFISQGRFEFTANLFMDQIPRRITMGLVSNADYSGTITRSPFNFQPFNVREIAIIANGRSYPQAPYDLDYPHGKYVRNVNDMNEAV

SEQ ID NO: 119173 - protein, 114 aa, Heterodera glycines
  Coding regions on vcDNA: vcDNA=SeqID_45596; Strand=-; Position=1 -129,214-429
  Homolog annotation: Hit_ID=AAO14563.2; Match level="QueryCoverage =76%, HitCoverage=15%, E-value=9e-28, Identity=68%"; Hit description =Hsp90 [Heterodera glycines]
  Essential gene: C elegans homolog=C47E8.5; Phenotype=Emb,Ste
MTFSHCIATPVLFIMFAILSGQSGETFSFQAEMPLIINTYSNKEIFLRELISDSSDALDKIHYQALTDPSQMESGKELFIKIVPNKADLVNNHKPGTEAFIEALQVLFFRLVNP

SEQ ID NO: 119174 - protein, 126 aa, Heterodera glycines
  Coding regions on vcDNA: vcDNA=SeqID_45597; Strand=-; Position=1 -96,153-437
  Homolog annotation: Hit_ID=P53021; Match level="QueryCoverage=100%, HitCoverage=100%, E-value=1e-66, Identity=92%"; Hit description =Major sperm protein 1 gb|AAA29146.1| major sperm protein
  Essential gene: C elegans homolog=C04G2.4; Phenotype=Unclassified
MAQLPPEDVATMPTQKVVFNAPFDNKATYYMRVINPGTKRIGYAFKTTKPKRINMNPPNGVLGPKESVNVAVSCDAFDPGSEDTKGDRVTVEWTNTPDPAATAFKLEWFQGDGMVRRKNLPIEYNV

SEQ ID NO: 119175 - protein, 126 aa, Heterodera glycines; identical to SEQ ID NO: 119174
  Coding regions on vcDNA: vcDNA=SeqID_45598; Strand=-; Position=1 -96,150-434
  Homolog annotation: Hit_ID=P53021; Match level="QueryCoverage=100%, HitCoverage=100%, E-value=1e-66, Identity=92%"; Hit description =Major sperm protein 1 gb|AAA29146.1| major sperm protein
  Essential gene: C elegans homolog=C04G2.4; Phenotype=Unclassified

SEQ ID NO: 119176 - protein, 338 aa, Heterodera glycines
  misc_feature (4)..(4): Xaa can be any naturally occurring amino acid
  Coding regions on vcDNA: vcDNA=SeqID_45599; Strand=-; Position=1 -41,2224-2309,2391-2477,2518-2722,2884-3006,3055-3169,3220-3324,3684 -3760
  Homolog annotation: Hit_ID=NP_504268.1; Match level="QueryCoverage =98%, HitCoverage=38%, E-value=3e-56, Identity=39%"; Hit description =PeRoXisome assembly factor PRX-6, PeRoXisome assembly factor related (81.4 kD) (prx-6) [Caenorhabditis el
  Essential gene: C elegans homolog=F39G3.7; Phenotype=Gro
RINXQNKSLYDYKGPVAIPTCKWDIGGLEEAKELLSEALAGEENEENASRLRRRTGILLYGPPGCGKTMLAKAVANQAGLSFVSVKGPELLSQFTMLAKAVANQAGLSFVSVKGPELLSQFVGESERNLREVFSKAKRTAPSVLFFDELDSLVPARGANSDSGGVMDRMVSQFLTELDSCHWTRNKAVFIMGATNRPDLLDPCLLSPGRFDKLVPINPANDPIAKERILRSGRFDKLVPINPANDPIAKERILRSLCKKIKLEDGLSITEIAKKCPEAAKKCPEAMSGAELAGLVSKLGIPADVIMFYHLAVGKTPNEQKDKRTELLQRVRMFLEDTI

SEQ ID NO: 119177 - protein, 259 aa, Heterodera glycines
  Coding regions on vcDNA: vcDNA=SeqID_45600; Strand=-; Position=1 -205,289-472,842-1038,1172-1295,1347-1418
  Homolog annotation: Hit_ID=NP_496756.1; Match level="QueryCoverage =85%, HitCoverage=88%, E-value=1e-24, Identity=33%"; Hit description =lipase, class 2 precursor family member (2N224) [Caenorhabditis elegans] emb|CAB04520.1| Hypothetical pro
  Essential gene: C elegans homolog=F58G1.5; Phenotype=Him
NEFGTFCRNLSIPASVFWHFSSHKWHYFYGIFTISTNYFNDEVEKNIARRDLGTDGSFGGGKGRIKAKKRPVIFVHGLTNLAGELDYVRRLFREKGGYRDSELYATTYGYGMKGWKWLRDAMKCDHVKMWILLATVWDEEQLGPPLTHLVHTFIGVGGANREAVHLCRLFEWAMPCNPVNGMRCHSQFLDDINSKVGYEATTRIFVIRSMDDGTVGTRDCEGRSVSAIDGQNDEIVLRNYSHQMVIFGTGEQQLKLLTF

SEQ ID NO: 119178 - protein, 594 aa, Heterodera glycines
  misc_feature (135)..(135): Xaa can be any naturally occurring amino acid
  misc_feature (511)..(511): Xaa can be any naturally occurring amino acid
  Coding regions on vcDNA: vcDNA=SeqID_45601; Strand=+; Position=1 -187,239-321,694-885,1029-1135,1185-1354,1451-1502,1551-1660,1702 -1887,1944-2132,2206-2477,5573-5597
  Homolog annotation: Hit_ID=NP_499022.1; Match level="QueryCoverage =98%, HitCoverage=41%, E-value=5e-79, Identity=33%"; Hit description =regucalcin gene promotor region related protein like (3K219) [Caenorhabditis elegans] emb|CAA80146.1| Hyp
  Essential gene: C elegans homolog=ZK512.5; Phenotype=Emb
LMAKTPPPADFRSLVSIERVAYLLFFSLYGRYLSVGKFHNVFNREFFKYTSAGDSERVAFLKICRITFEEYKRRVICRITFEEYKRRVIEHNKRAYKLSQKHLFPSLRKIFRNEVKDIIASIKIIQTNHSKLLDXNEIEVFEFLTLRISVRGSELVEMDPRKTLGNIVDPTRSVSTVCIEDLKRFIDAEGRRYVEILESFKGPLLVGHTPSQTPLLFIPLLVGHTPSQTPLLFIQCQINRLLQSDVYPNPSSGDANDCLLIWSLLEMLIRQHGKVTGPDLARLLCSNQPNLRSSSAISRQDSADARSSSAISRQDSADAEPSLDISAIERMTHFLLGGHIDEAIDSAISDGLLFDALLLAHRLFRDIDEAIDSAISDGLLFDALLLAHRLFRDDKDRLEAVEGRLMAYRSPDHPITTLLSVAADQPVPLLTNPTTNPTSYETNGWRSHIAIVLANLQSPTAMNAVYQLGLALAQKEFNSAADFCFLAVNLLYGFDCFSPPYNSSDQRHFAXRGQIHSLRVLGSIDLLRNTLFFSAGILDYQATELFDFALQLANPNSPTLLSKSHYYAKVRLQYAQLLDELGGFKHDYFNCCFI

SEQ ID NO: 119179 - protein, 386 aa, Heterodera glycines
  Coding regions on vcDNA: vcDNA=SeqID_45602; Strand=+; Position=1 -113,506-577,689-769,1386-1490,1992-2204,3004-3234,3810-3931,5136-5352
  Homolog annotation: Hit_ID=AAM75382.1; Match level="QueryCoverage =98%, HitCoverage=41%, E-value=1e-161, Identity=42%"; Hit description= Uncoordinated protein 44, isoform e [Caenorhabditis elegans]
  Essential gene: C elegans homolog=B0350.2f; Phenotype=Dpy,Sma,Unc
LLKYHASVDATTHSGLAPLHVAAFMGCINIVIFLIQQGANVDCETVRGETPLHLAARANQTDIDIVRVLVRNKANVDAQARELQTPLHIAARLGNADIVMILLSAHANPNAATRDQYTPLHIAAKEGQEEVVQLLLEKKSNKTLLTKKGFSPLHLAAKYGNYAVVRLLLERGTPVDIEGKNQVTPLHVATHYNNERVAQLLLERGARADACARNGYTPLHIAAKKNQMEIAHALLAYRAVPNAESRAGFTPLHLASEEGHLQMAALLTENGSEVNARAKNGLTPMHLCAQEDRVQVADHLFNNEADINAQTNAGYTPLHVACHFGQMNMVRWLVSHGANVNAETKSNYTPLHQAAQQGHNHVVQFLLDNGASPNTRTAVRFSYFFA

SEQ ID NO: 119180 - protein, 340 aa, Heterodera glycines
  misc_feature (303)..(303): Xaa can be any naturally occurring amino acid
  Coding regions on vcDNA: vcDNA=SeqID_45603; Strand=+; Position=1 -171,224-301,417-557,599-725,771-838,890-1184
  Homolog annotation: Hit_ID=EAA10943.2; Match level="QueryCoverage =95%, HitCoverage=67%, E-value=2e-50, Identity=40%"; Hit description =ENSANGP00000010696 [Anopheles gambiae str. PEST]
  Essential gene: C elegans homolog=R10E4.2a; Phenotype=Emb,Gro,Unc
ENQNTSESLALSAFVQSSSCSANDQDNNLDGRNSLHENYDNYDSPSVGAPGNRILSETNLYIRGLDETNLYIRGLDEECTDERLRQMCSRFGKIVSTKAILDKATKKCKGYGFVDFESSASARDAIEGLEKEGISAQMAKQQEQDPTNLYIANLPPEYNEDKLTDKQQEQDPTNLYIANLPPEYNEDKLTDLLKEFGMVISSRVLRSQNGSSRGVGGSSRGVGFCRMGCTDSCDSIIAKYNGRKLPKYNGRKLPNAQAHLIVKFADSSSRKFKRSTPSLGPSTRSRAINPKGVFLRFDNTVHXTGKPTNSNLYVNSVFRPFGYQFGGTLPNPSAHYGPSF

SEQ ID NO: 119181 - protein, 85 aa, Heterodera glycines
  Coding regions on vcDNA: vcDNA=SeqID_45604; Strand=-; Position=1 -103,184-338
  Homolog annotation: Hit_ID=NP_502034.1; Match level="QueryCoverage =97%, HitCoverage=78%, E-value=4e-25, Identity=66%"; Hit description =u6 snRNA-associated Sm-like protein (lsm-6) [Caenorhabditis elegans] emb|CAA93428.1| Hypothetical protein
  Essential gene: C elegans homolog=ZK593.7; Phenotype=Emb,Lva,Sck
MTVDETSKKKKESIVDLSRFIDKKVRVKFQGGREAAGILKGYDQLLNLVLDNATEFLRDPEDPLRITDETRNLGLIVARGKNIKE

SEQ ID NO: 119182 - protein, 257 aa, Heterodera glycines
  Coding regions on vcDNA: vcDNA=SeqID_45605; Strand=+; Position=1 -145,227-459,595-757,849-1081
  Homolog annotation: Hit_ID=NP_494782.1; Match level="QueryCoverage =99%, HitCoverage=15%, E-value=1e-41, Identity=37%"; Hit description =protein bap28 (2E721) [Caenorhabditis elegans] gb|AAA83581.1| Hypothetical protein ZK430.1 [Caenorhabditi
  Essential gene: C elegans homolog=ZK430.1; Phenotype=Lva
MAATSLQQQLKRLKSAPTGALAVERDYSSLLFTKKAAAALDRDEFYKIGLAGLSGMKKIDNAFDTYAPELFWKDKKRFNRAMLQKDEAEQFDRRIETFLLRLAAHFHHQCCRQVLEWLIHNYQVLDIHTYNAEALLLAFLPYHSVNSFGRLLHILKFNSTAWDWLTEYQRDAAPIPMNILCRACQVGRSYGLVSTLSNFVQMAIEQLGSTYANDKMQNYFTFLVSLFGILIENSTADGTVDDQLLARLMPFLSVALK

SEQ ID NO: 119183 - protein, 276 aa, Heterodera glycines
  Coding regions on vcDNA: vcDNA=SeqID_45606; Strand=-; Position=1 -39,87-201,259-407,616-811,1241-1379,1667-1859
  Homolog annotation: Hit_ID=AAC59747.1; Match level="QueryCoverage =92%, HitCoverage=69%, E-value=1e-19, Identity=27%"; Hit description =poly(A) polymerase type 3 sp|P51006|PAP3_XENLA Poly(A) polymerase type 3 (PAP) (Polynucleotide adenylyltra
  Essential gene: C elegans homolog=Y32F6A.3; Phenotype=Emb,Lva
MKNREIEKQISKEIQNFVSPKINPIKKEAINHLKLNIKTSVEKWTAQFTAIKPRLLVGGSLLMNGFVDGSDMDLLCVLPDEIEFDQLFGEEDKCLYKFLKKNLNDVISVNWLQGKVNILRIDHQQIEVDFLPVIVPGKYLLEKDIHIEDDQLIKQMTEETSIYPLADKQIYSGIFGYLNGATLSVMASKICILFPDAPLTFLLYQFFSHFANWDWSQAVLLKKLTPVTMNKIVRKWPPLFGISPMTVITPKFPEQNSTFNVNTYTIETIIDELKMG

SEQ ID NO: 119184 - protein, 446 aa, Heterodera glycines
  misc_feature (63)..(63): Xaa can be any naturally occurring amino acid
  Coding regions on vcDNA: vcDNA=SeqID_45607; Strand=-; Position=1 -47,94-266,322-432,484-645,688-807,857-922,1219-1395,1460-1558,1623 -1652,1715-1770
  Homolog annotation: Hit_ID=NP_491066.1; Match level="QueryCoverage =98%, HitCoverage=81%, E-value=1e-140, Identity=60%"; Hit description= actin Related protein 2/3 compleX component ARX-1, actin-like protein 3 (arx-1) [Caenorhabditis elegans]
  Essential gene: C elegans homolog=Y71F9AL.16; Phenotype=Emb
LMHANLPAAVIDCGTGYTKLGYAGNSEPQFIIPSAYTKLGYAGNSEPQFIIPSAIAVKDRIFXKVGGKIPDLDFFIGDEALSPLAANYFVKYPIRHGIVDDWDLMYPIRHGIVDDWDLMERFWEHCIFKYLRAEPEDHYFLLTEPPLNTPENREFTAEIMFETEPPLNTPENREFTAEIMFESFNVPGLYIAVQALLALAASWQTREFNHRSLTGLVVDSGDGVTHCIVVDSGDGVTHCIPVCDGYVIGSCIKHIPIAGRDITYFLQQMLRDREVNVPSEQSYMLRDREVNVPSEQSYEVAKAIKEQFCYVCPDIHKEFVKYDSEPEKWLNTYNGVNNITKKPFAVDVGYERFMGPEIFFHPEFVSSDYKMSISEVVFVSSDYKMSISEVVDQVIQQCPIDVRRGLYENIVLSGGSTMFKDFPRRHQRDDFPRRHQRDVKRLSDQR

SEQ ID NO: 119185 - protein, 223 aa, Heterodera glycines
  Coding regions on vcDNA: vcDNA=SeqID_45608; Strand=+; Position=1 -109,154-312,356-432,563-723,851-1016
  Homolog annotation: Hit_ID=NP_505918.2; Match level="QueryCoverage =96%, HitCoverage=34%, E-value=7e-40, Identity=40%"; Hit description =tubulin-tyrosine ligase (76.5 kD) (5L991) [Caenorhabditis elegans] emb|CAB02862.3| Hypothetical protein C
  Essential gene: C elegans homolog=C55A6.2; Phenotype=Emb,Ste
QRVNHFPRSWILTRKDQLYESIERASVLYGSDWFNFIPEFFCTPMSSAARHSMGQKFQGANLGSDAKFIVKPADGSLGRGIYFLDNGNLNETLETDKKLVVSRYIDRPFLINGLNDGLARFAVHKYDEKDEIDKVEGGVDMNKHLTNYSLNKMSAEFIRNTDCREENMGHKWTLSALLRELEKRGEDVGLLMVRIEDIVIKSLLSVQNSIAAMCRKCKHSVGE

SEQ ID NO: 119186 - protein, 173 aa, Heterodera glycines
  Coding regions on vcDNA: vcDNA=SeqID_45609; Strand=+; Position=1 -59,286-445,492-656,901-1038
  Homolog annotation: Hit_ID=XP_397030.1; Match level="QueryCoverage =86%, HitCoverage=42%, E-value=1e-13, Identity=29%"; Hit description =similar to Bys protein [Apis mellifera]
  Essential gene: C elegans homolog=F57B9.5; Phenotype=Lva,Lvl
MAETTVLINKTSKLPYKLGSLLMGKKRKIRTGAGDVVPVPGPLLKQIEKDKFAKPKSHLHLGNNQKKEDEQGKFIDAALSTKILREASKQWKAEEKKSGEEKALEIEEKSDDEEDICKQAQELAEQIAIDGVNPAVVALFTEVGAVMAKYRSGKVTKAFKMIPAMANWEQILE

SEQ ID NO: 119187 - protein, 298 aa, Heterodera glycines
  Coding regions on vcDNA: vcDNA=SeqID_45610; Strand=+; Position=1 -22,90-928
  Homolog annotation: Hit_ID=NP_500227.1; Match level="QueryCoverage =93%, HitCoverage=29%, E-value=1e-45, Identity=36%"; Hit description =predicted CDS, reverse transcriptase like family member (4D351) [Caenorhabditis elegans] gb|AAK68554.1| H
  Essential gene: C elegans homolog=ZK250.3; Phenotype=Clr,Lvl,Sck
PPPPPRLTSTVCRVFERILSSTVCRVFERILSSKILEFLNNIRFFDKEQFGFLKNRSTTTQILKTMDDIYNSIQMNQQIDIIYIDFVKFLKNRSFNVKIGEELSDSFRIFSGVPQGSVLGPLLFLIFINDLPSFIANEAASVGIKMYADDVKLYYAHENDDHSNQLDKAIEALEKWSKINGLEISTEKCFVLYLGKNNMKKEYFINSKKISESDNVRDLGIIIDSKLNFSEHISKIVRNAYLRSFQILSVEKQGNKTLTADYKTFVRPQLEYSTEVWNPNLKKDIDKIERVQKFFTRK

SEQ ID NO: 119188 - protein, 176 aa, Heterodera glycines
  Coding regions on vcDNA: vcDNA=SeqID_45611; Strand=-; Position=1 -21,319-383,417-466,880-998,1488-1538,1619-1761
  Homolog annotation: Hit_ID=NP_741410.1; Match level="QueryCoverage =100%, HitCoverage=21%, E-value=3e-31, Identity=48%"; Hit description= lin-12 And Glp-1 transcriptional regulator, suppressor of hairless homolog., Lin-12 And Glp-1 phenotype
  Essential gene: C elegans homolog=K08B4.1a; Phenotype=Unclassified
CPHFGQLIALFNRLRSQTVSTRYLHVDENAFVASSTKWGAFHINVVLHVDENAFVASSTKWGAFHINVVDQPEFGGQQSQQQQQQHTVTYGSVIQLVDSQTEMRLPLMRIRKVDKQHVLLDPAGQGEPGEPVSQLHKCAFQMVDVASNGAELFYLCLSQDKIIQFQAQTFQWERRK

SEQ ID NO: 119189 - protein, 90 aa, Heterodera glycines
  Coding regions on vcDNA: vcDNA=SeqID_45612; Strand=+; Position=1 -58,139-319,595-628
  Homolog annotation: Hit_ID=NP_499059.2; Match level="QueryCoverage =84%, HitCoverage=11%, E-value=7e-17, Identity=60%"; Hit description =tenascin XB precursor (64.1 kD) (3K438) [Caenorhabditis elegans] emb|CAA81587.2| Hypothetical protein K04
  Essential gene: C elegans homolog=K04H4.2a; Phenotype=Lva,Unc
MSLMLLRLLLVLLMFAVEAAHQQQLGTPVIGGICKLDTPDVHIGGKQTQFFLRCEPNTDSAQGEGVWVVKSRHAGSTAANKYFGMYFLDF

SEQ ID NO: 119190 - protein, 215 aa, Heterodera glycines
  misc_feature (27)..(27): Xaa can be any naturally occurring amino acid
  Coding regions on vcDNA: vcDNA=SeqID_45613; Strand=-; Position=1 -191,240-400,461-658
  Homolog annotation: Hit_ID=NP_495912.1; Match level="QueryCoverage =99%, HitCoverage=60%, E-value=2e-39, Identity=46%"; Hit description =haymaker protein (32.4 kD) (2J262) [Caenorhabditis elegans] emb|CAA93850.1| Hypothetical protein C18E9.6
  Essential gene: C elegans homolog=C18E9.6; Phenotype=Gro,Sma
MLAAAQFSLEHVGRLSTYGLTLPTRRXVPTIAQGTLVAQMLRRVTKNLDLGAEYIYHRDERFPGKQSNTLSYALRYIQPTWIFSGFPGKQSNTLSYALRYIQPTWIFSGTLAPTELHLCYYHKQSEHLQFGVEFEANFKLQEVNTTFAYEVNTTFAYQIEVPDSLTLRACCDTNWKVGAVLEKKLSKQLPFSLAISGVLDHVKAQGKFGIGLLIG

SEQ ID NO: 119191 - protein, 341 aa, Heterodera glycines
  Coding regions on vcDNA: vcDNA=SeqID_45614; Strand=-; Position=1 -161,878-936,988-1226,1307-1390,1439-1548,1826-1973,2541-2765
  Homolog annotation: Hit_ID=AAH67720.1; Match level="QueryCoverage =88%, HitCoverage=83%, E-value=2e-28, Identity=33%"; Hit description =Zgc:85960 protein [Danio rerio]
  Essential gene: C elegans homolog=Y73B6BL.33; Phenotype=Emb,Sck,Sma
MTIVVLSGLTVEEVVFGKEPGLEGRPTGEGFVRFSTADEAERALQQNNQHMGNRTGYEQRAAGGRPMGRGGYGAGGGGPASHRYSPYPSYPNYGYGTPRQPGGAGGAGGGGYGAGRGGGAAAAAAAMGGGGYDDGYGGYGGGYNANPNAGPTKLYMRGIPFRLTANDIERFFSPLVCVDIQVGTMPDGRSSGDGIVEFQTPADARQAMSKDRECIGNRYVELFPSLSAKIPPHVTYESIGGKGGGGGGRGGAAVGPVMPSAAQQYAQAVQQQVAAFASGNYPPSGASAGGMSGGVGAMAAAGQHHQYGQYPGDYSTAYYGAYGGGDVGAGAQPKTDYNWLV

SEQ ID NO: 119192 - protein, 187 aa, Heterodera glycines
  misc_feature (34)..(34): Xaa can be any naturally occurring amino acid
  Coding regions on vcDNA: vcDNA=SeqID_45615; Strand=+; Position=1 -29,675-1226
  Homolog annotation: Hit_ID=NP_510671.1; Match level="QueryCoverage =99%, HitCoverage=19%, E-value=5e-32, Identity=35%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
NAVNSLRALIKGSVLGPLLFLIYINDLPDALPSXVRIKLYADDVKLYISDTEIMHKALHNLSEWANKWQIRISIKKTFVLHLGNKNPKEIYKIDGNIINVVDTIRDLGINIDNKLQFSNHVAQIIKNAYLRMRSLFRVIKSKSSRIWIILNLCRPLLEYAQEVWNPSLLKILKEKEKCQKYFTKRVL

SEQ ID NO: 119193 - protein, 455 aa, Heterodera glycines
  Coding regions on vcDNA: vcDNA=SeqID_45616; Strand=+; Position=1-1368
  Homolog annotation: Hit_ID=NP_508269.1; Match level="QueryCoverage =97%, HitCoverage=64%, E-value=5e-43, Identity=27%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MSVIKKIDKDSVEGLEGSLSLFSLPPTNVAINKTNVRELLPLSALNQTGPYLFRLFSDSQFCDLSKTYMYLLSSIERKNDAGEWVALSDTDPNDKHVGVIQNFASSFVRSLKVNISGIEVFDSSIYYHYRDYIMKELGYSQEIRKAFHEASCYYADDDDQNSATNPGFTARAARFSGGRQCETMVKLNFDLARQSALMLNNQDVIFTIHRNNDSFLLLTPPYKKPDGTQQENKKEYRIRVHDMRLYVRTVDVTPSLNLAISRQLESTSAKYPLRKIEMRSIFLGTGRTELAHNVFTSTLPRRLICTFVSTDAYSGNRKMSPYKFEHANVRSISVEANGQTFPSTPYLLSFDGVQPRFVRAFVDMYAGLGLDDSDTKTVSIGMQRFLNGWAFFVIPLTSTLEDTPGFELIRQGTCTIKVQFEQPIKADGYEMLVLGEFDSVLSINADRVLSTDGSV

SEQ ID NO: 119194 - protein, 224 aa, Heterodera glycines
  Coding regions on vcDNA: vcDNA=SeqID_45617; Strand=+; Position=1 -105,303-382,443-560,885-972,1025-1091,1413-1629
  Homolog annotation: Hit_ID=NP_509562.1; Match level="QueryCoverage =75%, HitCoverage=32%, E-value=8e-47, Identity=55%"; Hit description =putative N-myristoylated protein family member, with at least 9 transmembrane domains, of fungal and meta
  Essential gene: C elegans homolog=B0416.5a; Phenotype=Gro,Stp
MSAKLETTSPDGAKVSINIHDRNEEKALINSKAVHVIDPAEAANSLGTFKEQEPAAQRIALRTYPRRWAVLAVVALLNCFNTMIWIAFSPISNHVSNFYGEKDSATYFSGIFIFVTIPVGLVAMWSGGRFGLRSSILVAAWANGIGAAIRLASSFLPDSMIHLRFPVGITGQGVAALAYPFIMFLPTKVAAVWFPDTERTLATTIGVKMGKINRKKARLIELTF

SEQ ID NO: 119195 - protein, 304 aa, Heterodera glycines
  Coding regions on vcDNA: vcDNA=SeqID_45618; Strand=-; Position=1 -162,206-866,1498-1520
  Homolog annotation: Hit_ID=NP_740869.1; Match level="QueryCoverage =99%, HitCoverage=69%, E-value=1e-39, Identity=38%"; Hit description =putative RNA binding protein with KH domain(s) family member (1G895) [Caenorhabditis elegans] gb|AAB37791
  Essential gene: C elegans homolog=F26B1.2a; Phenotype=Emb
SRGEIDIKVLVHQSHAGAIIGRNGSKIKEFREQTQCRFKVFQECCPVSSDRVCLITGDPSKLPCAVKQLVDFVKEIPFKLITGDPSKLPCAVKQLVDFVKEIPFKGPHQPYDPHNYNPHMCHAYGGFEGQSMGSAFIDALLLPMEGGPPPPMPPPHFDYPPHHGPPNAPHQPGVGYAGFGPGGPPPHHHGGPPPMGYPGPGGENDHNTGMFFNPDQNVLIKYFKVTIPSKLSGTIIGKRGECINRIRNESGARIEIDTQSDVFGTDERIITITGSPHQIQLAQFLLQQRWFGSIRSRERNGGDT

SEQ ID NO: 119196 - protein, 413 aa, Heterodera glycines
  Coding regions on vcDNA: vcDNA=SeqID_45619; Strand=+; Position=1 -230,411-806,915-1035,1150-1430,1494-1659
  Homolog annotation: Hit_ID=NP_503758.2; Match level="QueryCoverage =100%, HitCoverage=96%, E-value=1e-124, Identity=33%"; Hit description=prion-like Q/N-rich domain protein PQN-43, Prion-like Q/N-rich domain protein, kettin (468.7 kD) (pqn-4
  Essential gene: C elegans homolog=F54E2.3a; Phenotype=Gro
CHAKAPIIDDVQHEQSWQRIQEIEAPKEPLPEPEPAPKVAPKFTSPVLTPGEVNEGQPTHFETTVEPIDDNELKIQWFVNGAPVPDSSRLKQIADFGWVILNINDTELRDAGDWECVATNSVGEARASAKLNVLPRDRLLLEPINQSSLAQIEQLEAPRAGPAEPEAPVYEAPTFTAQLQAPDGLAEGDSAHLEAHYTPVADPKTRVEWYKDGQPIYHSNRQRMVNDFGFGILDILYLLAHDSGEYQIKVINDQGEASSSVQLEVAPTESLLLQPQSEQKAKAVGDLEERLAFRPTKEEVAREGRMPVFVAPLSAPSESEQGDRAHFTARYEPMDDNQLKIQWFLNNKPLLTGSRVKTFLNNKPLLTGSRVKTIDEFGVVVLEIYPVYPEDSGDYVCKATNAQGEAVTSTSLK

SEQ ID NO: 119197 - protein, 258 aa, Heterodera glycines
  Coding regions on vcDNA: vcDNA=SeqID_45620; Strand=-; Position=1 -54,210-313,370-463,656-1006,1197-1368
  Homolog annotation: Hit_ID=NP_493648.1; Match level="QueryCoverage =98%, HitCoverage=53%, E-value=8e-44, Identity=40%"; Hit description =serine palmitoyltransferase 1 (52.1 kD) (2A347) [Caenorhabditis elegans] gb|AAK31446.1| Hypothetical prot
  Essential gene: C elegans homolog=C23H3.4; Phenotype=Emb,Lva,Unc
MMGGKRKKKGKKAELSEEEKEAVIANWEPSPLVPLYSEREQNDPNYRPRSIEGRMGKFVVIDDKRCVNLASTDFFGFIGNQKIEIVRFGGTFTLYCHTVIVIQIDSSWAVKRPFCTATDSPPSQVPSQLIQGGAMSFLRTKVPGSRPIICWPWKIKAMFLGVNFAIQSGLMASRSDILWFEHNDMADLERKMVELEEKDKMNPKRKASIRRLIVVEGIYTNSGDICPLPKLIELKWRHKVRIFIDESFSFGVLGKHGK

SEQ ID NO: 119198 - protein, 283 aa, Heterodera glycines
  Coding regions on vcDNA: vcDNA=SeqID_45621; Strand=-; Position=1 -76,485-701,900-1224,1410-1640
  Homolog annotation: Hit_ID=CAE69324.1; Match level="QueryCoverage =87%, HitCoverage=49%, E-value=7e-50, Identity=50%"; Hit description =Hypothetical protein CBG15399 [Caenorhabditis briggsae]
  Essential gene: C elegans homolog=F53A9.10a; Phenotype=Gro,Slu
MMAKKKEEEELIGQLKRTFRGERREVFSLLIHLPLSSDEEVEEESIAADEVSVQEPAPPKEEEPAPEAEAEAPPAEEKEEEEEEEPGSPGGAGDAPKEEFRRTSVTESVAPTAQLRRAPPPQPKPAEESMTEAEAAMLAVKKRHEEEEEAKMRDNDERRRQELAAVEDELRVLKERQAERRAEREKEEAEFAERRRQDEDRRRKDEEERKARLEAEKAKRDEEKRKRHLMMAGGFGGFVAADAEGAGKNFVVPEKSEKGAQQGMPGQTSKPRGLSKEQHEEAK

SEQ ID NO: 119199 - protein, 365 aa, Heterodera glycines
  Coding regions on vcDNA: vcDNA=SeqID_45622; Strand=-; Position=1 -281,928-1597,1784-1930
  Homolog annotation: Hit_ID=CAE70089.1; Match level="QueryCoverage =17%, HitCoverage=3%, E-value=8e-20, Identity=68%"; Hit description =Hypothetical protein CBG16531 [Caenorhabditis briggsae]
  Essential gene: C elegans homolog=C27F2.8; Phenotype=Dpy,Lva,Unc
MPKMLFVRHQNPFDCLESRRGFSPILFVLFSYTPDFLLTSNEATLQLYMHMNGTPWTFNLVATIPPQLLSVCHAALPRPPFESMMYYTCVLALTLFWRTLNFILFLFSYIWPLVRGGNKAPPMATIGRRKAARATMARKAQQQQQQKIVLAKTQLVDGGQQHDDKDGQKQLQPQKGDDRLSVGDKNAKETAAAKIGTGRVAEKVPTERRTTAPIVTALKYDENDDEDADDDDEEEEEEDDDDEDNDDEDDDVVQHPKDPEHMSNNTTEDAIKNQNVADRHATATAVVHENDGHGPDQDGVDADLLDLSDPYLYMKLCPFFFGCGEKEKRRTVGQGKSGGGEWRKKAAAETAPHFDQQQQYDEDEQ

SEQ ID NO: 119200 - protein, 107 aa, Heterodera glycines
  Coding regions on vcDNA: vcDNA=SeqID_45623; Strand=+; Position=1 -96,509-634,1079-1177
  Homolog annotation: Hit_ID=NP_997676.1; Match level="QueryCoverage =100%, HitCoverage=86%, E-value=7e-35, Identity=69%"; Hit description= similar to 60S RIBOSOMAL PROTEIN L35 [Rattus norvegicus] gb|AAH86116.1| Unknown (protein for MGC:98516)
  Essential gene: C elegans homolog=ZK652.4; Phenotype=Emb,Ste
MTRVKTHELRAKKKEELMKMLEEQKTELASLQVSKVTNGAVSKLSNIHVVRKNIARILTVINQAQKMNLLKFYKGKKYRPIDLRFKKTRAMRRELTKHELSLKTHKQ

SEQ ID NO: 119201 - protein, 252 aa, Heterodera glycines
  misc_feature (228)..(228): Xaa can be any naturally occurring amino acid
  Coding regions on vcDNA: vcDNA=SeqID_45624; Strand=+; Position=1 -136,696-839,984-1118,1312-1415,1900-2148
  Homolog annotation: Hit_ID=CAE61275.1; Match level="QueryCoverage =90%, HitCoverage=46%, E-value=3e-42, Identity=38%"; Hit description =Hypothetical protein CBG05090 [Caenorhabditis briggsae]
  Essential gene: C elegans homolog=W04C9.3; Phenotype=Lvl
LKIDEILLILNRNVSYKYDVDDTPAIRCTDRRVEFSINTRNPFRGNLYVQGEFGLTECRREFYNNEAPFASLEVRLGDCGMIREKRPHGMSDFCIGYSLILITNFHPRFVTRVDRAYKIFCAYQQAERPVGVDLEVGSVPEESVSSDALMVPECEYTMRIGDLNGPLATGTEVGDLIYHRWECQRSDAHGMLVKNCRVFDGNDNVTLLDERGLGLSEKEFIKQIQRPXKGLKIKYIKLEIKSFKFKFNLQMT

SEQ ID NO: 119202 - protein, 280 aa, Heterodera glycines
  Coding regions on vcDNA: vcDNA=SeqID_45625; Strand=-; Position=1 -173,240-268,560-738,994-1113,1169-1234,2416-2670
  Homolog annotation: Hit_ID=NP_491526.1; Match level="QueryCoverage =96%, HitCoverage=33%, E-value=1e-62, Identity=44%"; Hit description =cell Division Cycle related, Metaphase-to-Anaphase Transition defect MAT-1, Metaphase-to-Anaphase Transit
  Essential gene: C elegans homolog=Y110A7A.17a; Phenotype=Emb
VFEEIRRLYPRHLNGMEIYSTALWQLHDSKKLSALASKMAEIARNQPQTWCIAANCFSVEKQHETAIECLERSIRLDHRFAYAYSLLGHELIDMNDFGRAAQAFRKAVQFSPNDYRAWYGLGLVNFKEEQLQMARMNLLRAVGINPNNNVLLCQLAVIEQALHNTDAAMQYLESALAMQYLESALKHSPNNVPCRFHKARLLFDIGKYEAARAELEELRVLSPDEAHVFFLLGRVNRKLGNTHMALLNFRHGFTPKILGTNNLLQQKLKNSVYKEISSEK

SEQ ID NO: 119203 - protein, 115 aa, Heterodera glycines
  Coding regions on vcDNA: vcDNA=SeqID_45626; Strand=-; Position=1 -123,601-824
  Homolog annotation: Hit_ID=CAE73680.1; Match level="QueryCoverage =100%, HitCoverage=74%, E-value=2e-17, Identity=37%"; Hit description= Hypothetical protein CBG21190 [Caenorhabditis briggsae]
  Essential gene: C elegans homolog=ZC395.2; Phenotype=Age,Unclassified
IYAGQLAVLPKTHRLVPIIEQMRREERHHLDEMERLIVKYGHYNDQIKELMADDANANRELMEKLAQFRDEELEHHDTGVQHQGLEAPFYDGSGHNYAPNAIAPKFSALKTIIQT

SEQ ID NO: 119204 - protein, 210 aa, Heterodera glycines
  Coding regions on vcDNA: vcDNA=SeqID_45627; Strand=-; Position=1 -45,318-566,987-1203,1684-1802
  Homolog annotation: Hit_ID=NP_958909.1; Match level="QueryCoverage =97%, HitCoverage=93%, E-value=2e-88, Identity=79%"; Hit description =RAB5C, member RAS oncogene family [Danio rerio] gb|AAH65634.1| RAB5C, member RAS oncogene family [Danio r
  Essential gene: C elegans homolog=F26H9.6; Phenotype=Emb,Lva
RPGNGGAPTKTCQFKLVLLGESAVGKSSLVLRFVKGQFHEYQESTIGAAFLTQTICLDDATVKFEIWDTAGQERYHSLAPMYYRGAQAAIVVYDITNQESFAKARNWVRELQRQASPNIVIALAGNKADLAAKRMVEYEEAQAYAEDNGLLFMETSAKSSMNVNDIFLAIAKKLPKTEGGGGPSGHGRSGVDISAAEAAAQQRRGTCCSK

SEQ ID NO: 119205 - protein, 173 aa, Heterodera glycines
  Coding regions on vcDNA: vcDNA=SeqID_45628; Strand=+; Position=1 -23,419-591,650-877,926-1023
  Homolog annotation: Hit_ID=XP_393173.1; Match level="QueryCoverage =88%, HitCoverage=14%, E-value=4e-79, Identity=95%"; Hit description =similar to Hypothetical protein CBG09037 [Apis mellifera]
  Essential gene: C elegans homolog=F25B5.4a; Phenotype=Emb
MSDWSFVGDRIQHPFNLAIMQIFVKTLTGKTITLEVEASDTIENVKAKIQDKEGIPPDQQRLIFAGKQLEDGRTLADYNIQKESTLHLVLRLRGGMQIFVKTLTGKTITLEVEASDTIENVKAKIQDKEGIPPDQQRLIFAGKQLEDGRTLADYNIQKESTLHLVLRLRGGKN

SEQ ID NO: 119206 - protein, 134 aa, Heterodera glycines
  Coding regions on vcDNA: vcDNA=SeqID_45629; Strand=-; Position=1 -72,865-1059,1125-1261
  Homolog annotation: Hit_ID=CAE57374.1; Match level="QueryCoverage =81%, HitCoverage=38%, E-value=7e-25, Identity=51%"; Hit description =Hypothetical protein CBG00320 [Caenorhabditis briggsae]
  Essential gene: C elegans homolog=T04B2.2; Phenotype=Unclassified
MGQFIFDDLLLLLMESPFSDCPRGQRKVILLKGVSRQKWELAHSTITQGAELGKGAFGVVKRGVFRDPTIGQPVQMAIKEVSQTSTKAQIKEFMNEARIMRHLEHKNVIKFYGVAVGREPLMVLMELASNGSLD

SEQ ID NO: 119207 - protein, 442 aa, Heterodera glycines
  Coding regions on vcDNA: vcDNA=SeqID_45630; Strand=-; Position=1-1329
  Homolog annotation: Hit_ID=NP_508269.1; Match level="QueryCoverage =99%, HitCoverage=66%, E-value=6e-49, Identity=29%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MAFHKIDNDSANSITNALDFFRIPPTNVSVSSAKVFELLPSNPLTDTPYHFKLHSSQNFIDLSKCYLQSEFRIRKENEHGQLIDLAADEVAPIQMIGQTFIRNIKMSINGREVFNSNSLMAYKTYFSHELSYSNTAKDSHLNAAGYYRDTGGTLETGDGCIARRNLFAGSRTAQFMAKIDADLFNQPLYLINFCELDIEILPNDNDFVLITTPSVAQGVAAAPRYRFEVVSLKMYVKKVSLMDGLALDVARKLEVKPARYAVRKTLMKSMFISHGRFEFTANLFMDQIPRRITMGLVANADYIGTISRSPFNFQPFNVREISIIANGRSFPQAPYDLDFPNWKYVRPFNDMNEAVGFANSLESNGISYEQFGKTHCIYVFNLTNSGDDQAALFDLIKNGTTAVSIKFNQAVPAGGIMLVVMGECDSLVMLDKNRSISTDITI

SEQ ID NO: 119208 - protein, 53 aa, Heterodera glycines
  Coding regions on vcDNA: vcDNA=SeqID_45631; Strand=+; Position=1 -339,522-568
  Homolog annotation: Hit_ID=NP_725894.1; Match level="QueryCoverage =100%, HitCoverage=45%, E-value=1e-20, Identity=86%"; Hit description= CG9291-PA, isoform A [Drosophila melanogaster] ref|NP_523794.1| CG9291-PB, isoform B [Drosophila melanog
  Essential gene: C elegans homolog=Y82E9BR.15; Phenotype=Emb,Lva
VHFREIPSHVLQKVCHYFAYKARYTNSATEIPEFFVAPEVALELLMAANFLDC

SEQ ID NO: 119209 - protein, 298 aa, Heterodera glycines
  Coding regions on vcDNA: vcDNA=SeqID_45632; Strand=+; Position=1 -101,204-302,398-538,588-680,893-989,1531-1681,1781-1835,2081-2170
  Homolog annotation: Hit_ID=CAE65324.1; Match level="QueryCoverage =97%, HitCoverage=60%, E-value=3e-91, Identity=56%"; Hit description =Hypothetical protein CBG10258 [Caenorhabditis briggsae]
  Essential gene: C elegans homolog=W08D2.4; Phenotype=Unc
YGHQQHFGSWWWNDVCGYVCGNLMQGFSLGGWKEQHNVHHAAPNVDGRDGDLDLLPLWATIGTQLKRIDRIDSASPLAHLLPFQHLYWSFALPLLRFSWLLQSVQFVCQMRHSFYDIHRQRALVEQCSLALHWSLIHRQRALVEQCSLALHWSLVLVQLYFLPDNLARLQYFLVSNLFAGFLIAHVVTYNHYSTDKFAYDDPILENFACLQLYTTRNMRPGPFIDWLWGGLNYQIEHHLFPTMPRHNLNQQVMPLVKEFCAENDIPYMVDDYFTGFRLVIEHLRRVAEAATETLVSHH

SEQ ID NO: 119210 - protein, 375 aa, Heterodera glycines
  Coding regions on vcDNA: vcDNA=SeqID_45633; Strand=+; Position=1 -71,191-326,658-758,829-999,1102-1290,1347-1368,1577-1789,2481-2663
  Homolog annotation: Hit_ID=NP_610161.1; Match level="QueryCoverage =99%, HitCoverage=10%, E-value=4e-92, Identity=49%"; Hit description =CG2905-PA [Drosophila melanogaster] gb|AAF57342.1| CG2905-PA [Drosophila melanogaster]
  Essential gene: C elegans homolog=C47D12.1a; Phenotype=Unclassified
SINFCHVFLFFSFEQFFTVTISFLISRILANPALQHVCNSFFKHPTTTTPMGNALVKFLLNKLSELGANSEKASLHLMLFKLIFQTVSFYSSESENLLKPFLHRIVQDSMPFLHRIVQDSMQLASTSRECTNYFLLLRALFRSIGTGTHDLLYQQFLPLLPSILQQLNRLQNGAHRQSVHELFVELCLTIPVRLSSLLPYLSLLMDPLVCALNGSPALVQQGLRTLELCVDNLQPEYLDNLQPEYLYDHMMPVRAALMSGLWRTVYASDTQSAVAALRILGKFGGSNRKALLDPQTWTSSTDCCSTTVVVASAAHRSAPSDGAVDEHHRAISSPSSFVCADKISRDIFVEAIRLFIAVFNSDTKNKFCLFKMFTK

SEQ ID NO: 119211 - protein, 106 aa, Heterodera glycines
  Coding regions on vcDNA: vcDNA=SeqID_45634; Strand=-; Position=1 -150,300-426,708-751
  Homolog annotation: Hit_ID=NP_495185.1; Match level="QueryCoverage =84%, HitCoverage=15%, E-value=2e-14, Identity=42%"; Hit description =vaccinia related kinase (67.4 kD) (2G213) [Caenorhabditis elegans] gb|AAK31507.1| Hypothetical protein F2
  Essential gene: C elegans homolog=F28B12.3; Phenotype=Emb,Gro
MAPARKVPRLHDKAVLVKSGTKFVDGRKQEFVVGKEIGQGGFGRIYEGVQSGSRHAVAIKMEPPSNGPLFTEMHVYMRVLKPEHLDKWKKDKVKKKCSCYPAVEKK

SEQ ID NO: 119212 - protein, 240 aa, Heterodera glycines
  Coding regions on vcDNA: vcDNA=SeqID_45635; Strand=-; Position=1 -233,977-1236,1904-2133
  Homolog annotation: Hit_ID=NP_492207.1; Match level="QueryCoverage =62%, HitCoverage=51%, E-value=5e-52, Identity=64%"; Hit description =cytochrome c1 (31.0 kD) (1I600) [Caenorhabditis elegans] emb|CAA99820.1| Hypothetical protein C54G4.8 [Ca
  Essential gene: C elegans homolog=C54G4.8; Phenotype=Emb,Lva
MAKISKKKTHSLQALIPDLDDNGVEILRPGLLNDTLPSPYKNNKAAAAANSGALPPDLSLIMWAREGAEDYVFHLLTGYGFDAPAGIDVEEGKAFNPYFPNGCVLAMPQQLFDEGIDYEDGTPATMSQQAKDICTFLRWAGEQWHDTRKRWAWKVSQFAVVICGVDHAVATAHVCATVRQAQCVGTDEDGEGDLPATARPRVDARVVGAKAAQGRAGAEGDRAAAEAGRLIGPFILISDG

SEQ ID NO: 119213 - protein, 119 aa, Heterodera glycines
  Coding regions on vcDNA: vcDNA=SeqID_45636; Strand=-; Position=1-360
  Homolog annotation: Hit_ID=NP_495784.1; Match level="QueryCoverage =57%, HitCoverage=4%, E-value=1e-09, Identity=47%"; Hit description =component of the meiotic and mitotic spindle poles, ZYGote defective : embryonic lethal ZYG-9 (156.2 kD) (
  Essential gene: C elegans homolog=F22B5.7; Phenotype=Emb
MANDANIFVAASATKCVMLFAKGFGAKFTPHHSFVVPVIFDKFKVEKRLLRDALVECIDVIAAFRSLRAKDVPKGLLKDLVAILSKVCIGERDLRCFISLELAKDANKMAKIAEKRVTA

SEQ ID NO: 119214 - protein, 243 aa, Heterodera glycines
  Coding regions on vcDNA: vcDNA=SeqID_45637; Strand=+; Position=1 -148,1207-1390,1748-1913,2496-2675,3066-3119
  Homolog annotation: Hit_ID=NP_507972.1; Match level="QueryCoverage =65%, HitCoverage=22%, E-value=5e-44, Identity=54%"; Hit description =eukaryotic membrane protein DUF747 (80.7 kD) (5V59) [Caenorhabditis elegans] emb|CAB62802.1| Hypothetical
  Essential gene: C elegans homolog=F26F2.7; Phenotype=Emb
MAKLIAVNSAKGQFCDGYCYHKHKMTKNKTWWKCELYQQGCKGWGFESNDDQVQQQRVHLDDEGQNGTLELDADQFAHSSSTNTDTDSDEIVNVARKKPTVFEYFCMEVSRRYSLQNEKEQYAEKRRKVYAFLRIPVELEKFIYYGFRQCLDAFCHTFTILPIRVLFNLFACSVRLKRWSAADTCDILKLIIIFCASWFMQFVDTSVVYHIVRGQGIIKLYIFYNMLEVADKLFSSFGQVRAC

SEQ ID NO: 119215 - protein, 218 aa, Heterodera glycines
  Coding regions on vcDNA: vcDNA=SeqID_45638; Strand=-; Position=1 -132,194-323,401-594,652-770,837-918
  Homolog annotation: Hit_ID=EAL25332.1; Match level="QueryCoverage =82%, HitCoverage=56%, E-value=2e-79, Identity=53%"; Hit description =GA18673-PA [Drosophila pseudoobscura]
  Essential gene: C elegans homolog=Y106G6H.2a; Phenotype=Gro,Stp
MAQAVAAVAPAPNANAASAQTTQPQVMAPSYPLASLYVGDLHPDVTEAMLFERFSNAGPVLSIRVCRDAITRRSLGYAYVNFQQPADAERALDTMNFDMILNKPIRIMWSQRDPSIRRSGAGNIFIKNLGKEIDTKAIYDTFSMFGSILSCKIATDIEGGSKGYGFIHFETEEAANSAIAKVNGMLLDGKKVFVGKFVPRTAREKQIGDPSRKSPMFM

SEQ ID NO: 119216 - protein, 46 aa, Heterodera glycines
  Coding regions on vcDNA: vcDNA=SeqID_45639; Strand=-; Position=1-138
  Homolog annotation: Hit_ID=NP_974402.1; Match level="QueryCoverage =97%, HitCoverage=7%, E-value=1e-12, Identity=66%"; Hit description =expressed protein [Arabidopsis thaliana]
  Essential gene: C elegans homolog=F38A5.1a; Phenotype=Unclassified
GGGQLAHTILGVDYNVRLGDCQFLVLDPHYTGTENLSEILNGGWCA

SEQ ID NO: 119217 - protein, 150 aa, Heterodera glycines
  Coding regions on vcDNA: vcDNA=SeqID_45640; Strand=-; Position=1 -140,191-285,332-435,483-512,570-650
  Homolog annotation: Hit_ID=NP_498967.1; Match level="QueryCoverage =96%, HitCoverage=22%, E-value=8e-32, Identity=47%"; Hit description =rb related pathway actor, Rb related pathway actor, associated to synthetic multivulva phenotype, abnorma
  Essential gene: C elegans homolog=ZK637.7a; Phenotype=Bmd
MRESFPNLKCTKLRKAEWREIRRLIGKPRRCSQTFLDEECEALEAKRQKIRAIYNGTCTSLDEEFIDLPTHLPRPPIVEYLFIFCQVRTPRDGIYSATVDAITEDGYRVVFDREDILPAAYIKDYEVMFDQPSELLSVNYFLEQNRANGA

SEQ ID NO: 119218 - protein, 90 aa, Heterodera glycines
  Coding regions on vcDNA: vcDNA=SeqID_45641; Strand=-; Position=1 -126,638-784
  Homolog annotation: Hit_ID=CAB62552.1; Match level="QueryCoverage =95%, HitCoverage=92%, E-value=1e-16, Identity=91%"; Hit description =vacuolar ATPase subunit E [Heterodera schachtii] sp|Q9U1G5|VATE _HETSC Vacuolar ATP synthase subunit E (V-A
  Essential gene: C elegans homolog=C17H12.14; Phenotype=Emb,Lva
MGISDNDVQKQLRHMMAFIEQEANEKAEEIDAKAEEEFNIEKVKIDNEYFLSPESAGGVELLAKDGKIRVSSTLEARLDLIADKVSGKLA

SEQ ID NO: 119219 - protein, 308 aa, Heterodera glycines
  Coding regions on vcDNA: vcDNA=SeqID_45642; Strand=+; Position=1 -93,144-335,391-669,721-939,996-1139
  Homolog annotation: Hit_ID=CAE60278.1; Match level="QueryCoverage =99%, HitCoverage=70%, E-value=2e-63, Identity=43%"; Hit description =Hypothetical protein CBG03859 [Caenorhabditis briggsae]
  Essential gene: C elegans homolog=T04B2.2; Phenotype=Unclassified
MYTVDLNSDKGFRTIERFVDHYLRTGTSVTSERFVTLRKAVHRANWELSHSSITVSAELGRGAFGVVKKAVLTERNGNNSQVAVKEVSQTSTKEQIKEFMNEARIMRQLDHPNVIRFHGVAVGQEPLMIVIELASDGSLTDYLKTQRRSARTRLFMCVGAAAGLTHIHSKGIIHCDIAARNCLYSNGVVKISDFGMAHRGPVKKMEPNARVPVKWLSPEALAERCFTAKSDTWAYGVMCWEIFTNGEVPYSQMVGSDVAVSLINGQRLDFPRDAPSKFVEFILQHIWDAETSGRYSMAAVHDWLKRHT

SEQ ID NO: 119220 - protein, 367 aa, Heterodera glycines
  Coding regions on vcDNA: vcDNA=SeqID_45643; Strand=+; Position=1 -168,215-266,316-431,483-512,563-698,842-975,1028-1495
  Homolog annotation: Hit_ID=CAE59787.1; Match level="QueryCoverage =62%, HitCoverage=19%, E-value=4e-76, Identity=53%"; Hit description =Hypothetical protein CBG03240 [Caenorhabditis briggsae]
  Essential gene: C elegans homolog=C09D8.1a; Phenotype =Emb,Morphology,defect
DLRTIPLGQSCIAADLTANPSKNRFTNILPYDHSRVKLKPIDDDDGSDYVNASYIPGFNSRREFIAAQGPLPSTRDHFWRLIWEHQVPAVVALTKCIEKGRDKCHQYWPDNNSRSVLYADIEVTLLTESIEYDEFTIRELRLTNMAEPNQPARTVQHLHYQVDQQPYTGVGRSGTFIALDRLVQHIESGRPIDVFGTVYEMRLERCHMVQNEQQYIFIHHCLQYLLENFYPFLLCPSSQQLQQQQQHTVGHRPLSSPNPHAPFGSSISSPICADYFGCGSSSSVLSNASRGDGGGWSSKVPMTSSSNNSGAGINCYWPPTSAQNKSTDSCDGIVTTIKHSPPKIEVHHPQRNDGFLEDDEGIAESGL

SEQ ID NO: 119221 - protein, 70 aa, Heterodera glycines
  Coding regions on vcDNA: vcDNA=SeqID_45644; Strand=+; Position=1 -72,465-603
  Homolog annotation: Hit_ID=NP_492799.1; Match level="QueryCoverage =97%, HitCoverage=39%, E-value=2e-23, Identity=69%"; Hit description =genes associated with retinoid-IFN-induced mortality 19 like (20.1 kD) (1L262) [Caenorhabditis elegans] g
  Essential gene: C elegans homolog=C34B2.8; Phenotype=Emb,Lva
NDAFEEQDLINALEPFLMAERDRSVLRIMKRNRELENEVMKDVPGWKTGTWYGEPVYFTLGDKWIEPNAM

SEQ ID NO: 119222 - protein, 232 aa, Heterodera glycines
  Coding regions on vcDNA: vcDNA=SeqID_45645; Strand=+; Position=1 -607,710-801
  Homolog annotation: Hit_ID=NP_510671.1; Match level="QueryCoverage =84%, HitCoverage=19%, E-value=5e-29, Identity=34%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
MYADDVKLYIFHQNDSNTNDLSEAIKILEKWSKSNGLEISVEKSQTLYIGKNNSKKEYFLNGKIIPSLEKVKDLGVIIDSKLSFADHINKIIKNAYLKAYHILRIMKTRELKTIIRMYKTYVRPQLEYAVEIWNPNLKKDIERIEKVQKFFTRKAFKKCGLLHRSYSERLEICQLIELAKRRNIADLTTAFKIMKGFTSLDATKNWNKLPIVPIQADKANQFRALLKAMYEF

SEQ ID NO: 119223 - protein, 155 aa, Heterodera glycines
  Coding regions on vcDNA: vcDNA=SeqID_45646; Strand=-; Position=1-651
  Homolog annotation: Hit_ID=BAA88337.1; Match level="QueryCoverage =96%, HitCoverage=15%, E-value=2e-18, Identity=36%"; Hit description =ORF2 [Platemys spixii]
  Essential gene: C elegans homolog=ZK250.3; Phenotype=Clr,Lvl,Sck
KTIIRMYKTYVRPQLEYAVEIWNPNLKKDIERIEKVQKFFTRKAFKKCGLLHRSYSERLEICQLIELAKRRNIADLTTAFKIMKGFTSLDASKLFTFSDRPTRRPLLLRMRRTTTKSKNNFFNRIAKNWNKLPIVPIQADKANQFRALLKAMYEF

SEQ ID NO: 119224 - protein, 319 aa, Heterodera glycines
  Coding regions on vcDNA: vcDNA=SeqID_45647; Strand=-; Position=1 -144,234-417,580-696,1267-1338,1411-1500,1566-1691,1749-1874,1931-2031
  Homolog annotation: Hit_ID=NP_728273.1; Match level="QueryCoverage =46%, HitCoverage=98%, E-value=2e-34, Identity=48%"; Hit description =CG14206-PB, isoform B [Drosophila melanogaster] ref|NP_608324.1| CG14206-PC, isoform C [Drosophila melano
  Essential gene: C elegans homolog=D1007.6; Phenotype=Emb,Lva,Ste
MLMPQGDRKKIYEHLFEDGVCIAKKDYCLKSHPEIKGVKNLYVIKALKSLASRGLVKEQYAWHHYYFYLQPEGIVHLRAYLGLPDDVLPNTHKQRTDAIQKAFADKGGRGPIRADTDRGGYRAAADKQAEAGPGAAPISHRQGFGRGGAIHPNYGTLVNLDTEIFAKEQQAKDAKRMPPPAPPKPSPPQTVAAAPGGPRFVSTQDPNYATLGQLDPNIFEKNAPTKPPQQKQQQTKEGQMIFVSTRNPNYPTLAKLDPDICVKNNAPTKTAPIKQQAKGGGRGYATTTDPNYATPGQVDSKIFDKNNEKTGTDDDSESS

SEQ ID NO: 119225 - protein, 727 aa, Heterodera glycines
  Coding regions on vcDNA: vcDNA=SeqID_45648; Strand=-; Position=1 -106,155-438,621-1318,1382-1469,1751-2758
  Homolog annotation: Hit_ID=CAE68937.1; Match level="QueryCoverage =37%, HitCoverage=17%, E-value=1e-48, Identity=40%"; Hit description =Hypothetical protein CBG14917 [Caenorhabditis briggsae]
  Essential gene: C elegans homolog=T19B4.7; Phenotype=Unclassified
GVVAETVSSSQIRLSWADPNENAFNQMYTIKYGISNSDESQHKQLNITETEHIFDGLRPDTLYEFAVRLVQSSHWSLNALNRTHPAPPSSPPRDLTVIGPQFNNQHENADPGTITLTWQPPKYANGEIQEYIMLFSDRPHLPDRDWSMESVKGDRLSIELRNLRPRLTYHFKLQARNVKGYGPFTPVTSVTTADTFTSNPTSNGPRNSVNAGSNSEAFEILMGQFLSGLRWSSIAQMHTISHLRCLHRSNLVFVLIGIVVAVVVLLLFIALCSLCFYHNKNSASSTAAAANRPQQRSKKEQRNKRSKHHQQAYIPGRKMSVSTPSAVAELDDDLWLVHQQRNSAANPGGARFATIVNASNVDGYGSSVDDETGILLIDGQQRAFFAPANAAGRTEDREKGISVGGGEFYGGGSLMESFHSMTTVGDSPKSSNKSRKLHRNSLPPHICPSNSTTMSPPFATNNKSPQPNQHWQHNCHAFGKHDHFGIRGGTQNIAETKFGRRSDSPYGTRFPCQQGVAGIRTHCCGHLSSLNALDLSISPRLGHTLRQTNGPNSIERTAALLNELDEKHETVLPLQRFRVGIGLPSMPLQVKQAKRKTTAHYEATTAVTRKQAAPTKSVNFASKLVIVSSDDDDNGGYNKWSKKTKRQWNGSKDDKGISFIDNSLVDDVDEDYKYANADTENRQQKETEIENANTTMKKQQRNAADEKLNGCDDGSKNVPPPSVVDLA

SEQ ID NO: 119226 - protein, 204 aa, Heterodera glycines
  Coding regions on vcDNA: vcDNA=SeqID_45649; Strand=-; Position=1 -212,262-455,504-569,981-1124
  Homolog annotation: Hit_ID=NP_493980.1; Match level="QueryCoverage =57%, HitCoverage=11%, E-value=2e-18, Identity=42%"; Hit description =putative endoplasmic reticulum protein of eukaryotic origin (104.8 kD) (2B780) [Caenorhabditis elegans] g
  Essential gene: C elegans homolog=H17B01.4a; Phenotype=Gro
QIEQLHRFFFTTANRFVQTLEMFINGDFRFSALFGQLFGLGPAPEGMLSDGRLERDCFNMRKVIVVSTLPGTLFGISNENGHLLWSLYLGNDFAPYHNERHSVEAAREGKVPLLIQRGTAFYQWPSQAAAVFNAKDSADSVVLFFNPITGTQIERVRLGHKVEFSADGNARLSEQWMTQLPWSDSESIYAIVGKSANGEPKSTH

SEQ ID NO: 119227 - protein, 130 aa, Heterodera glycines
  Coding regions on vcDNA: vcDNA=SeqID_45650; Strand=-; Position=1 -203,287-470,570-575
  Homolog annotation: Hit_ID=CAE59397.1; Match level="QueryCoverage =98%, HitCoverage=41%, E-value=3e-17, Identity=40%"; Hit description =Hypothetical protein CBG02760 [Caenorhabditis briggsae]
  Essential gene: C elegans homolog=F58G1.5; Phenotype=Him
MNLALFVAICQFLLLFFGTFPPTNGTISTAFSQFLRNYFNDEVEKNIARRDLGTDGSFGGGKGRIKAKKRPVIFVHGLTNLAGELDYVRRLFREKGGYRDSELYSTTYGYGMKGWKWLRDAMKCDHVKMS

SEQ ID NO: 119228 - protein, 192 aa, Heterodera glycines
  Coding regions on vcDNA: vcDNA=SeqID_45651; Strand=-; Position=1 -178,225-319,368-468,522-568,797-822
  Homolog annotation: Hit_ID=CAA04528.1; Match level="QueryCoverage =82%, HitCoverage=98%, E-value=2e-68, Identity=62%"; Hit description =calmodulin-like protein [Branchiostoma lanceolatum]
  Essential gene: C elegans homolog=T21H3.3; Phenotype=Emb,Ste
YTTGCMLLSFSEFKEAFSLFDKDGDGTITTKELGTVMRSLGQNPTEAELQDMINEVDADGNGTIDFPEFLTMMARKMNGTIDFPEFLTMMARKMKDTDSEEEIREAFRVFDKDGNGFIVFDKDGNGFISAAELRHVMTNLGEKLTDEEVDEMIREADIDGDGQVNYEEIREADIDGDGQVNYEEFVTMMTTK

SEQ ID NO: 119229 - protein, 262 aa, Heterodera glycines
  Coding regions on vcDNA: vcDNA=SeqID_45652; Strand=+; Position=1 -313,355-592,860-1097
  Homolog annotation: Hit_ID=NP_498068.1; Match level="QueryCoverage =86%, HitCoverage=30%, E-value=1e-29, Identity=32%"; Hit description =putative protein, with a coiled coil-4 domain, of eukaryotic origin (3G119) [Caenorhabditis elegans] gb|A
  Essential gene: C elegans homolog=R144.2a; Phenotype=Emb
MAFGQHKQVLIDGDLHTLRFGAPSRELFMGNFPFKGAFGGPPIIATINQRRHEIRLCGPPPEVRIDPEPSYELMRYMPAVRQQQPTMVQPTKTDGTEGDRKRKRESPPIDVSRLLKRLKETGLLTQPPNEAERNQRKKQVEIEANAAPIPSNHRLDNIERRATPMSGLEQFSMRSLIMSVFGVCRYDSVIDAIHRPRVVCQYCGIAFQKLYNEAYQRHADWHLQKTIRIEDQKLNKGPKVVKGTSSQPWYMVEVGNATRKWR

SEQ ID NO: 119230 - protein, 262 aa, Heterodera glycines
  misc_feature (218)..(218): Xaa can be any naturally occurring amino acid
  Coding regions on vcDNA: vcDNA=SeqID_45653; Strand=-; Position=1 -784,1444-1471
  Homolog annotation: Hit_ID=NP_508294.1; Match level="QueryCoverage =99%, HitCoverage=22%, E-value=2e-38, Identity=31%"; Hit description =predicted CDS, endonuclease/exonuclease/phosphatase family and RNA -directed DNA polymerase (XC178) [Caeno
  Essential gene: C elegans homolog=ZK250.3; Phenotype=Clr,Lvl,Sck
LYADDVKLYISDTEIMHKALHNLFEWANKWQIRVSVQKTFVLYLGSKNPKETYKFDGNTINAVDTIRDLGVNIDNKLQFSDHVNKITRNAYLRMRSLFRIIKSKSSKIWITLYKTYIRPLLEYAPEVWNPSLQKNIKKIEKCQKYFTKRVFFKCSLPPIPYQNRLEYLQLPTLENRRKLFDLFMAHKIVYGRTDLKLFSIFKHALTSPFTDLTQNIKXAKNSFPLPGGTKLWNQLDKELIKTNSLNQFKTKLNVFPLYSILT

SEQ ID NO: 119231 - protein, 162 aa, Heterodera glycines
  Coding regions on vcDNA: vcDNA=SeqID_45654; Strand=-; Position=1 -84,505-657,1046-1117,1790-1874,2168-2259
  Homolog annotation: Hit_ID=NP_496966.1; Match level="QueryCoverage =93%, HitCoverage=46%, E-value=9e-30, Identity=39%"; Hit description =mevalonate decarboxylase (41.5 kD) (2O512) [Caenorhabditis elegans] emb|CAB54454.1| Hypothetical protein
  Essential gene: C elegans homolog=Y48B6A.13a; Phenotype=Emb,Sck
MNRGGGFHITIQAPVNIALIKYWGKRNEELVLPLNDSIAITIDELSATTHITIGPDVSTDSVTLNGVGIDIAGSSRFRNQIREYSNRKRKLKGEHASKGWHTKAAGFAAIAFGLGKIFRLPERDIVRMARMGSGSACRSIQGGFVHWKAGTHQQNDSDCLCE

SEQ ID NO: 119232 - protein, 436 aa, Heterodera glycines
  Coding regions on vcDNA: vcDNA=SeqID_45655; Strand=+; Position=1-1311
  Homolog annotation: Hit_ID=NP_508269.1; Match level="QueryCoverage =99%, HitCoverage=66%, E-value=3e-51, Identity=30%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MAFHKIDTDSVNSITNALDFFRIPPTNVSVSSSKVFELLPSNPLTDTPYHFKLHSCQNYIDLSKCYLLTEFRIQKENANGQLVNLTIDDINIAPIQMIGQTFIRNIKMSINGREIFNANALMAYKTYFSHELSYSTTAKDSHLNAAGYYRDTGDSLEMGDGCTARRDLFANSNVAQFIAKIDTDLFNQPLYLINFCELDIEILPNDNEFVLIAPTGGRYRFEVVGLKLYVKKVSLMDGLALDIARKLEVKPARYAVRKTMMKSVFISPGRYEFTANLFMDQIPRRVTMGLVANTDYVGSIRRSPFNFQPFNVREISIVANGRSYPQAPYDLDYPNGKYVRPFNDMNEAVGFANSSESNGITFAQYGKTHCIYVFNLTNSGDDQAALFDLIKNGTTAVSVKFNHPVPEGGIMLVVMGECDSLVMLDKNRSISTDTTI

SEQ ID NO: 119233 - protein, 450 aa, Heterodera glycines
  misc_feature (255)..(255): Xaa can be any naturally occurring amino acid
  Coding regions on vcDNA: vcDNA=SeqID_45656; Strand=+; Position=1 -445,526-632,678-1105,1190-1413,2038-2177
  Homolog annotation: Hit_ID=XP_415229.1; Match level="QueryCoverage =100%, HitCoverage=65%, E-value=1e-51, Identity=33%"; Hit description= PREDICTED: similar to DEAD (Asp-Glu-Ala-Asp) box polypeptide 51; Dead box protein 73D-like [Gallus gallu
  Essential gene: C elegans homolog=ZK686.2; Phenotype=Lva
PVWVTESKRFSAPFGGDTDNEQKVDNLRPEFLHVLQKSISFWFPVQRFVLPTLLQMANSAHAIWSFAHQPVISYIFPILIFFPQGSGKTLCYVLPILNALRICPFSTSSVFALVVAPVRNLAEQIFKVFPRRKIPENFALFAMAPTAMAPTKSFNSNSFRSVLFPNGMKSSKAHVIVTTPGRFVEHLMDENGHLDLFVEHLMDENGHLDLSMLRYLVVDEADRMQDTARMEWLGFVEKYANGKFIFSDFHTIFSXSVPSVCTLNVSCLRIIPTTILQRILVSATLSMDVHSLHKWNLRCPILFQAKEIKVNQQTENSAEPAVLLPNSLTHKLVQIDLNFDKWNRIIVFVNKKFVVYLTMVNFRQTSRRLSSLLDALSKITVAEFSADLFKSRRKKLLREFQSGAVRVLIACDVLSRGIDVLDVDCVINYDLPINERIYVHRAGRTARARK

SEQ ID NO: 119234 - protein, 144 aa, Heterodera glycines
  misc_feature (143)..(143): Xaa can be any naturally occurring amino acid
  Coding regions on vcDNA: vcDNA=SeqID_45657; Strand=+; Position=1 -141,459-578,628-744,1116-1148
  Homolog annotation: Hit_ID=NP_491193.1; Match level="QueryCoverage =93%, HitCoverage=23%, E-value=3e-43, Identity=63%"; Hit description =calcium Channel, Beta subunit (ccb-1) [Caenorhabditis elegans] gb|AAB53056.1| Calcium channel, beta subun
  Essential gene: C elegans homolog=T28F2.5; Phenotype=Egl,Unc
PVFVPQVSQDSNFSHHHDIDLEQRNREAIKSNAERQAAQQLENAKYNPVLFAVQTNVDFDGTIDDDAPVHGCAVSFKAKEFLHIKEKYNNDWWIEKYNNDWWIGRLVKESCELGFIPSPAKLEAVRQAQQGGKFMLTNKCTNXC

SEQ ID NO: 119235 - protein, 360 aa, Heterodera glycines
  Coding regions on vcDNA: vcDNA=SeqID_45658; Strand=+; Position=1 -627,670-895,946-1174
  Homolog annotation: Hit_ID=CAE71193.1; Match level="QueryCoverage =96%, HitCoverage=64%, E-value=2e-46, Identity=26%"; Hit description =Hypothetical protein CBG18050 [Caenorhabditis briggsae]
  Essential gene: C elegans homolog=R10F2.1; Phenotype=Gro,Lvl,Prz,Unc
MHFRQGNSPGIELLQLRASDGDLGKNGRVEFRLAVETDLLSVDPDSGLVRAERTFDREELGDRVTVPVMALDRGTPSRATFANLTILLTDQNDEAPQCGKETHRFSVAEDAPNGQLVGTFNNFLVNYIPKVGCLDAYDSDEFGTSNSQIRFELAQSDANGPFRVHAETGCLFLDLPGLPLDFEQRSTYNLSVRLKDMGKPPLEAVKPCQVQILLEDVEENAFPPQFNAMALEASVEENAPAHTEVIRVHAEDPEGAAVRYRLVAGNGLCCFQIDPKSGVISTKKELDHELQQHYWLTVRAEDTPFSAIGRMLRAHLQLFIRVLNQNDRLPLFSQPIYRIGIAENSEENKAKTALMQRCQI

SEQ ID NO: 119236 - protein, 363 aa, Heterodera glycines
  Coding regions on vcDNA: vcDNA=SeqID_45659; Strand=-; Position=1-1092
  Homolog annotation: Hit_ID=NP_498735.1; Match level="QueryCoverage =95%, HitCoverage=80%, E-value=8e-44, Identity=29%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MKNLLAADDVSCCQLIGHTLWKNCRMSINGTQVFEGNDLMAYKSVMDYELTYPDTVKRSYLNVAGYYADDENSQLAGDGYTARRQLLALSRTAQFMARLDVDPCNQPRYIVNQCEVDIELLPNSSQFVLLAPNAPQAPPDQVRRYHLEVISCKLYVKKAEVMDSLALDISKRLELRPARYPLRKTSLKALFISENRTEFTANLWSDQVPKRVVLGLVSNESYVGTIGTSPFNFQPFDVRDISICANGRNYPQAPYSLDFPNGRFARAYHDMHEAIGYAGTVESNGISVKRYAEGGQCFFVFNLTPSAESSADTFDLIRKGTTAIRISFNTPVPARGIVLIAMAEIDSLIMLYKNRSVATDVQV

SEQ ID NO: 119237 - protein, 197 aa, Heterodera glycines
  Coding regions on vcDNA: vcDNA=SeqID_45660; Strand=+; Position=1 -243,303-485,705-872
  Homolog annotation: Hit_ID=AAL78213.1; Match level="QueryCoverage =54%, HitCoverage=43%, E-value=3e-38, Identity=70%"; Hit description =probable protein kinase Hgg-20 [Heterodera glycines]
  Essential gene: C elegans homolog=R90.1; Phenotype=Lva,Unc
MTLVGRPLDKLLREAGDRFSPGTTIGISIQMLNAIKTLHKVGFLHRDVKPGNSAIGLVESNEQRLLYLIDFGMARSYIRSDGQQRRPRATSQFRGTPIYAPISAHTRRDYSRKDDVESWFYVMVKFFKGTLPWKHIAGGRDEDALQLEDRPCYEMIELLLRGYLAQNNIEEHPYDWEIGRRNSDREKTQIEKPAEKQ

SEQ ID NO: 119238 - protein, 171 aa, Heterodera glycines
  Coding regions on vcDNA: vcDNA=SeqID_45661; Strand=+; Position=1 -270,596-841
  Homolog annotation: Hit_ID=CAE60278.1; Match level="QueryCoverage =51%, HitCoverage=20%, E-value=1e-15, Identity=50%"; Hit description =Hypothetical protein CBG03859 [Caenorhabditis briggsae]
  Essential gene: C elegans homolog=T04B2.2; Phenotype=Unclassified
MKEVRIMRQLQHPNVVQFIGVAVGQEPLMIVMELATDLRRYLDMSRRHRLNMRAKLFMCLGAAAGLDHIHSKDIIHCDIAAKNCLYADRMQGAVLERVINLVHHESSSENDNQQIAAPFSASSSSSGTENAPQNDQLLLITGGEMPSHGSDSGSATAGQVPSHVSESAIAE

SEQ ID NO: 119239 - protein, 89 aa, Heterodera glycines
  Coding regions on vcDNA: vcDNA=SeqID_45662; Strand=+; Position=1 -111,166-321
  Homolog annotation: Hit_ID=CAE67815.1; Match level="QueryCoverage =94%, HitCoverage=17%, E-value=6e-11, Identity=42%"; Hit description =Hypothetical protein CBG13395 [Caenorhabditis briggsae]
  Essential gene: C elegans homolog=M176.2; Phenotype=Emb,Lva
MEKFFTDEPQRVAALRDVFTGLWGLENDDAVTNAVIEDAIQRPRDYVLKAQMGAGKGNFFDDEMVEKLKTMSLEERRAYILMKKNWPVA

SEQ ID NO: 119240 - protein, 374 aa, Heterodera glycines
  Coding regions on vcDNA: vcDNA=SeqID_45663; Strand=-; Position=1 -72,127-251,387-510,1245-1411,1617-1722,1884-1940,1989-2228,2329-2421
  Homolog annotation: Hit_ID=CAE56616.1; Match level="QueryCoverage =93%, HitCoverage=82%, E-value=1e-100, Identity=54%"; Hit description= Hypothetical protein CBG24372 [Caenorhabditis briggsae]
  Essential gene: C elegans homolog=ZC250.3; Phenotype=Unc
IKFAVLIWLTVQNAVHALLLRYSRVRDVPAMYFSTVAVFWTEVIKLVRDVPAMYFSTVAVFWTEVIKLSVCLIMVCHHSNGGIFEWVLRRQVFDQPRDTLKVCLPSMLYILQNNLFYTAASHLNAATFMIVSQLKIFSAAIFSILLLNRSLARAQWVSLCVLFVGVCFVQFQPEEPRKSENRKHFSGFIAASIACGLSGFSGVFFEKILKGSAPVSLWMRNVQMSVFAIPASFFAAIVQDGSKIREHGFMYGWDSVVWLTIVQDGSKIREHGFMYGWDSVVWLTSFWYAVGGLSVAVCIKYADNIAKNFATSVAIILATLGSIQFFGFQPNLLFTLGALLVIMSIFLYSSSSIFLRHFNIYGSSSASRPSYFSS

SEQ ID NO: 119241 - protein, 244 aa, Heterodera glycines
  Coding regions on vcDNA: vcDNA=SeqID_45664; Strand=+; Position=1 -37,78-177,511-756,1068-1333
  Homolog annotation: Hit_ID=CAG08675.1; Match level="QueryCoverage =81%, HitCoverage=30%, E-value=1e-74, Identity=63%"; Hit description =unnamed protein product [Tetraodon nigroviridis]
  Essential gene: C elegans homolog=C49H3.5a; Phenotype=Slu
KMSSDDQSDKEVECPLCMEAFDIDDINFYPCNCQSDKEVECPLCMEAFDIDDINFYPCNCQYQICRFCWHRIRTNENGLCPACRQSYPEDPVNFQPLSSADVRKIKSEKKQKVQQQKNKVVESRKHLAEFRVLQKNLVYAVGLSHRMADPELLKKPEFFGKFGKIIKIAVGAAPAINSAQPAVHTAYITYTRSEDALRAIHAVTNMMVEGRFLKASLGTTKYCSNFLKGQACHKPASFSIKHIS

SEQ ID NO: 119242 - protein, 440 aa, Heterodera glycines
  Coding regions on vcDNA: vcDNA=SeqID_45665; Strand=-; Position=1-1323
  Homolog annotation: Hit_ID=NP_508269.1; Match level="QueryCoverage =99%, HitCoverage=66%, E-value=2e-53, Identity=31%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MTFHKIDNDSVNSITNALDFFRIPPTNVSVFSSKVFELLPSNPLTDTPYHFKLHSSQNYIDLSKCYLLTEFRIRKENVNGQLMDLTIDDENIAPIQMIGQTFIRNIKMSINGREVFNANALMAYKTYFSHELSYSTTAKDSHLNAAGYYRDMGETLETGPGCIQRRDLFAESKTAQFIAKIDTDLFNQPLYLINFCELDVEIWPNDNDFVLIAPAIGGVVPRYRFEVMGLKMYVKKVSLMDGLALDIARKLEIKPARYAVRKTMMKSMFISQGRFEFTANLFMDQIPRRITMGLVSNADYSGTITRSPFNFQPFNVREIAIIANGRSYPQAPYDLDYPHGKYVRAFNDMNEAVGFANSSESNGITFPQFGKTHCIYVFNLTSSGDDQAALFDLIKNGTTAVSIKFNRAVPVGGLMLVVMGECDSLVMLDKNRSISTDTTI

SEQ ID NO: 119243 - protein, 127 aa, Heterodera glycines
  Coding regions on vcDNA: vcDNA=SeqID_45666; Strand=-; Position=1 -100,463-742
  Homolog annotation: Hit_ID=NP_508905.1; Match level="QueryCoverage =96%, HitCoverage=47%, E-value=5e-52, Identity=75%"; Hit description =putative secreted or extracellular protein precursor (XF957) [Caenorhabditis elegans] gb|AAA82455.2| Hypo
  Essential gene: C elegans homolog=C26B9.3; Phenotype=Egl,Pvl,Unc
YSFVTLGLALFCGHVRTEDRAEVDIRVSGACSPIYLSRRGIELSKYRPLIRFNPEKIRLVPKNPVIPGCVKIKAEGVEILRPIRNLLAEVEMRIGGTPDPNNPTLPCTKKIDDKVNQCPCAKAEGTC

SEQ ID NO: 119244 - protein, 289 aa, Heterodera glycines
  Coding regions on vcDNA: vcDNA=SeqID_45667; Strand=-; Position=1 -86,136-311,569-657,943-1191,1293-1331,1418-1565,1667-1749
  Homolog annotation: Hit_ID=XP_218546.2; Match level="QueryCoverage =97%, HitCoverage=78%, E-value=3e-66, Identity=43%"; Hit description =similar to eukaryotic translation termination factor 1; sup45 (yeast omnipotent suppressor 45) homolog-li
  Essential gene: C elegans homolog=T05H4.6a; Phenotype=Emb,Lva,Unc
MASSEGEADHNVELWKIKRLIKSLEMAKGNGTSMISLIIPPRDQIARIQKMLGDEFGTASNIKSRVNRLSVLGAITSVQARLKLYTRALLADDNKFGFIVMDGNGSLFVTLQGNAREAKIIKTVDISYGGENGFNQAIDLAADALADVKFIKEKKLISAFFDEISQDTNKAIYGVKETLTAIGNGRHRNSDLLGEFGSDKPDEKDRSNFVDPETGTDYEIESSTPLLEWLANNYKRFGAALEIVTDKSQEGAQFVRGFGGLGGVLRYSVDIPQLDELENGVDEIDLSEY

SEQ ID NO: 119245 - protein, 313 aa, Heterodera glycines
  Coding regions on vcDNA: vcDNA=SeqID_45668; Strand=+; Position=1 -237,285-428,473-801,846-927,991-1139
  Homolog annotation: Hit_ID=NP_004429.1; Match level="QueryCoverage =99%, HitCoverage=27%, E-value=3e-83, Identity=52%"; Hit description =ephrin receptor EphA4 [Homo sapiens] sp|P54764|EPA4_HUMAN Ephrin type-A receptor 4 precursor (Tyrosine-pr
  Essential gene: C elegans homolog=M03A1.1a; Phenotype=Unclassified
MYVDPTAYADPTEVLAEFTNEICASNIEVNAKTAVIFFPSFLSLFCYLNSKVTRTIGTGEFGEVCCGRLTVEDHYGHKQQQIVAVKTLLPGSDPKAKANFLMEASIMGQFEHENVIHLIGVVTKTEPVMILTEYMLYGSLDQFLRSNSNGRLSICQMTKLLQGVASGMKYLNDKGYVHRDLAARNVLVDDRLTCKIADFGLSRGLRKFVSGNDCDGCAPFEQQGEYTTQQGGKIPIRWTAPEAIMQHKYTTASDVWSFGVVMWEVMSFGERPYWDWTNHKVIHEVVQNGFRLPPPQDTPKRLYEMMLACWQAE

SEQ ID NO: 119246 - protein, 658 aa, Heterodera glycines
  misc_feature (540)..(540): Xaa can be any naturally occurring amino acid
  misc_feature (634)..(634): Xaa can be any naturally occurring amino acid
  Coding regions on vcDNA: vcDNA=SeqID_45669; Strand=+; Position=1 -115,182-399,447-674,724-858,923-997,1059-1163,1226-1420,1472 -1511,1607-1740,1789-1892,1945-2048,2103-2218
  Homolog annotation: Hit_ID=CAE71967.1; Match level="QueryCoverage =99%, HitCoverage=62%, E-value=1e-151, Identity=28%"; Hit description= Hypothetical protein CBG19038 [Caenorhabditis briggsae]
  Essential gene: C elegans homolog=K11C4.3a; Phenotype=Gro,Unc
LLQKHALLESDLNIVADQIQLVSREAEHFTREEGPDGKGYKPVEPAVVQEYKPVEPAVVQERVQFLDQRYQELLELAARRKANLEANKRLCQFNWDLTDLDTHFREQEQVLAQKDKGRDIVSVNRLLAKHKNAENNLADLGRGLDQSVNRLLAKHKNAENNLADLGRGLDQLQQQGQQLVDEQIPGSGPVPLRLAETRTYYDHLRRLADERRKELEGAVEYYQFFHDADDVEAYFFHDADDVEAYLLDTLRVVSTDDVGHDESSVNLLIKKHDGVSDELERFDRERFDRQIQQLETQADALPEEARAHPNIASRINGTQQRKSDLVEVANIASRINGTQQRKSDLVEVARLRKQRLLDALSFYKLVADLVADIESVESWIDEKGKLLKTLIPGPDLEEVEIMKHRFETLQNDMHNQKAKVDTINTMARDMQKAEHPNSDDILARQNAAEHPNSDDILARQNALNARWAQLSDMVSQKKEELNKAHRMETFRIDCQETITWIEEKTRVLEDTDEMTGDLTGAMVLEDTDEMTGDLTGAMKXPRPLSMMERDLAAIQAKLHSLLHSLPTQSNAIERQKPQETAPNPQNMTRIHSLADLLNPLVREQECKLLNPLVREQECKLIYAGDLSRSLLHSXHIKAKILMFRPYIVAPSIPSAISA

SEQ ID NO: 119247 - protein, 265 aa, Heterodera glycines
  Coding regions on vcDNA: vcDNA=SeqID_45670; Strand=-; Position=1 -66,214-322,387-509,568-615,680-790,852-1130,1193-1254
  Homolog annotation: Hit_ID=NP_492537.1; Match level="QueryCoverage =90%, HitCoverage=81%, E-value=7e-17, Identity=32%"; Hit description =putative protein family member (1K150) [Caenorhabditis elegans] emb|CAB02815.1| Hypothetical protein C36F
  Essential gene: C elegans homolog=F27C1.3; Phenotype=Lva
MTFPSSPSAVFLLLPVHLLLMLQNGEALPPPPTQFTMVGGVPVALSPAQTAAGVQFVPKNDSKYETLASLDANIFVKSGSPQPAPNDFQSKVAGSKFAPNPNPQQAKAGGSQFAPKHDPKYETLARVDPNIFAKNAPPAAPKPQQSKAPQQLVKDSKYQTLAGLDANIFVKNAPPAAAPKPQQSKAPQQLGQGKRNRSNFNQILMSVVPSFSVKDSKYQTLAGLDANIFVKNAPATPAKAAPQAPVKDSKYQTLAGLDHNIFVKK

SEQ ID NO: 119248 - protein, 234 aa, Heterodera glycines
  Coding regions on vcDNA: vcDNA=SeqID_45671; Strand=-; Position=1 -228,276-505,639-885
  Homolog annotation: Hit_ID=RGKWB; Match level="QueryCoverage=93%, HitCoverage=64%, E-value=1e-114, Identity=90%"; Hit description=GTP -binding regulatory protein beta chain - Caenorhabditis elegans emb|CAA35532.1| G-protein [Caenorhabditis e
  Essential gene: C elegans homolog=F13D12.7; Phenotype=Emb
MLNRVQEARKQAKDTTLALAAANLESNGRIQLRNRRILRGHMAKIYAMHWASDSRNLVSASQDGKLIVWDSYTTNKVHAIPLLSSWVMTCAYAPSGSFVACGGLDNICSIYSLKTREGNVRVSRELPGHTGYLSCCRFLDDNQIVTSSGDMTCALWDIETGQQVTAFTGHTGDVMSLSLSPDMRTFISGACDASAKLWDIREGMCKQTFPGHESDINAVSVRTISNENAVDWET

SEQ ID NO: 119249 - protein, 421 aa, Heterodera glycines
  Coding regions on vcDNA: vcDNA=SeqID_45672; Strand=+; Position=1 -330,377-750,818-1379
  Homolog annotation: Hit_ID=NP_498735.1; Match level="QueryCoverage =93%, HitCoverage=99%, E-value=1e-37, Identity=26%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MTCAKRISQQSALAFNSALNIFAVPPTNVSVARSFFRELLPLSTISQEGPYLFRMYNDSLWADLSRVYLYLELSVEKANAQGIMEPIDSVVDKEVGVCQSIGQTFVQQLKVEVQNTELYDSGTLYPFKAYISNELSFPANAKSHFMASNGYYVSRTHDDANDDGFKKRCARFSGGCKAEFISRLDFDLGNQELYLLNNMDVLFTIYRSKDAFLVHSLGAGAAATSYALRVHDIKLRPPMLYDARRFKSCFLTAGRTEMDHNIFSAAIPRRLTIALVANRAFNGAYAHTPFNFRPYDIRAISVHAGGNTYPAIPHRMNFVGAAYVRPFVDMYEALGMANSERSMDITLEQFRDGWTFFVVPMTSTLDDSCGFELLRSGTTSVRLQFNREIPQGGVEMICLGEFDQLIMIDYNRHIVTDSKIA

SEQ ID NO: 119250 - protein, 300 aa, Heterodera glycines
  Coding regions on vcDNA: vcDNA=SeqID_45673; Strand=-; Position=1 -584,655-877,962-1057
  Homolog annotation: Hit_ID=NP_509290.1; Match level="QueryCoverage =26%, HitCoverage=12%, E-value=6e-38, Identity=83%"; Hit description =zinc finger protein 208 like (XI252) [Caenorhabditis elegans] gb|AAA68307.1| Hypothetical protein F26A10.
  Essential gene: C elegans homolog=F26A10.2; Phenotype=Stp
MQMEHSAGVGSPDDESIHLAALFHTRRPQSEKAHRQQFFNGDGLLEEDELVDLQELGTLSDGDLCMGRQLVANSMALANERAENEGTKKSESVAEQQRHLISEQLQHQQRSERVPNIAAEDCLGRFVPVVKAEFLPTEAVEQFLLGMNSNGYGEEGQAMAAGAASAMSEETPQGEQSEQQPKEKKQKRASSSEESRTAARSPSSEFSAPPPPPIIISPQDVDNLSITLEKNQQCACKDCGKLFNSVWYLKQHAVKHSNDRPFKCRFCMKTYKFRSNLYQHKCPERSRLLLTGEFNMVGHP

SEQ ID NO: 119251 - protein, 310 aa, Heterodera glycines
  Coding regions on vcDNA: vcDNA=SeqID_45674; Strand=-; Position=1 -185,1545-2292
  Homolog annotation: Hit_ID=CAE71161.1; Match level="QueryCoverage =81%, HitCoverage=67%, E-value=1e-56, Identity=45%"; Hit description =Hypothetical protein CBG18017 [Caenorhabditis briggsae]
  Essential gene: C elegans homolog=Y54E10A.16a; Phenotype=Egl
MPSARTFVRNCASHPCRKCHTECALVLLAAAQTFAATCHQMERGMPCHIRAKELGLKCTFVTRDGVETSNRISVRFGSFFDKSHLSMNQVLRLAYFWAEHPTSTFGAIKREMNINTDHTVVDFYNFMRDLCQGWADRIQTNELLGGVGRVVEIDETKYFRAKYNRGRMLNRNHDWIFGILERNTNKVRLFPVAKRDANTLLPIISANVAPGTLIISDGWAAYGGIRNLQQQFEHRWVNHRLFFVDPQDPQVHTQGIEATWRAVKNGLRHLHGTNPEPLQSYLYQYMFRRSNNNEKIFQQILEEIRIQYPV

SEQ ID NO: 119252 - protein, 254 aa, Heterodera glycines
  Coding regions on vcDNA: vcDNA=SeqID_45675; Strand=+; Position=1 -33,88-277,427-590,731-864,911-1082
  Homolog annotation: Hit_ID=NP_611539.1; Match level="QueryCoverage =85%, HitCoverage=71%, E-value=3e-58, Identity=55%"; Hit description =CG10540-PA [Drosophila melanogaster] gb|AAF46660.1| CG10540-PA [Drosophila melanogaster] gb|AAL39229.1| G
  Essential gene: C elegans homolog=D2024.6; Phenotype=Ste
MIGEELTDVDKARIASDILLQSPPGEFNEVFNDARIASDILLQSPPGEFNEVFNDVRTLLQNDALLEKGVCLEAVRRYNKAQFVPVNPEPGAEHPALITEHNELPDGRFVDPKTGRVFKYDHLRKEAADAQPSGPKEIDEKLEPWRKALQKELDEYIYEHYLTGVATVFTPLQHQKAKLILCIESHQFQPKNYWNGRWRSENGRWRSEWHFPNFDGSSKTAECTGKLRLQVHYYEDGNVQLISEKEATVEVKMT

SEQ ID NO: 119253 - protein, 152 aa, Heterodera glycines
  Coding regions on vcDNA: vcDNA=SeqID_45676; Strand=+; Position=1-459
  Homolog annotation: Hit_ID=CAE59528.1; Match level="QueryCoverage =94%, HitCoverage=44%, E-value=3e-48, Identity=60%"; Hit description =Hypothetical protein CBG02923 [Caenorhabditis briggsae]
  Essential gene: C elegans homolog=B0491.2; Phenotype=Dpy
MLILYHHSFNCPAGPQGQPGPIGRTGPKGHPGAKGQPGHGGRDGNPGPPGESGAPGPAGQVGPPGLPGEKGRDTEQQIGRQGPRGPRGLQGAEGIAGESGLNAPPGLPGPAGEAGTQGVPGVQGAQGRPGEEGPTGRPGPDAEYCPCPQRSG

SEQ ID NO: 119254 - protein, 69 aa, Heterodera glycines
  Coding regions on vcDNA: vcDNA=SeqID_45677; Strand=+; Position=1 -84,947-1024,1173-1218
  Homolog annotation: Hit_ID=NP_491560.1; Match level="QueryCoverage =68%, HitCoverage=8%, E-value=2e-11, Identity=61%"; Hit description =ezrin, Radixin and Moesin family, Ezrin/Radixin/Moesin (66.0 kD) (erm-1) [Caenorhabditis elegans] gb|AAB37
  Essential gene: C elegans homolog=C01G8.5a; Phenotype=Emb,Gro,Stp,Unc
MSEEERSRLLTEIAMQESRVSEMRFEVKLLTKELDNARDERAITDFDVLHMENKKQGRDRYKTLRQIRS

SEQ ID NO: 119255 - protein, 64 aa, Heterodera glycines
  Coding regions on vcDNA: vcDNA=SeqID_45678; Strand=+; Position=1 -110,288-372
  Homolog annotation: Hit_ID=NP_499964.1; Match level="QueryCoverage =98%, HitCoverage=30%, E-value=1e-22, Identity=79%"; Hit description =ribosomal Protein, Large subunit (24.1 kD) (rpl-15) [Caenorhabditis elegans] gb|AAC24397.1| Ribosomal pro
  Essential gene: C elegans homolog=K11H12.2; Phenotype=Gro,Stp
TIRRNPDTQWITKPVQKHREQRGLTSAGRKSRGLGKGMKHTKTIGGSRKKCWKRQNTVEFHRKR

SEQ ID NO: 119256 - protein, 159 aa, Heterodera glycines
  Coding regions on vcDNA: vcDNA=SeqID_45679; Strand=-; Position=1 -206,992-1229,2053-2092
  Homolog annotation: Hit_ID=XP_527197.1; Match level="QueryCoverage =99%, HitCoverage=19%, E-value=5e-30, Identity=42%"; Hit description =PREDICTED: similar to DEAH (Asp-Glu-Ala-His) box polypeptide 29; nucleic acid helicase DDXx; DEAD/H (Asp-
  Essential gene: C elegans homolog=Y37E11AM.1; Phenotype =Dpy,Emb,Lva,Unc
QSLPVDQHRSEFISALEKHKFVCVIGSTGCGKSTRIPAFCVNWETGTKNAVVCTMPRRIAATTVASRVRHEIGMQRTVEFGNALNVGYSVRFDSRGMKNAELFYCTDGILLNMIREDYYLGKFAVVIVDEIHERSINSDLLIALLKTFLEARTRLSSIT

SEQ ID NO: 119257 - protein, 559 aa, Heterodera glycines
  Coding regions on vcDNA: vcDNA=SeqID_45680; Strand=-; Position=1 -48,164-438,1244-1501,1528-2627
  Homolog annotation: Hit_ID=NP_508269.1; Match level="QueryCoverage =77%, HitCoverage=64%, E-value=4e-39, Identity=26%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
APYTEFISSVFHVEKREEEVSFEKLVAKQQKESTAAEFVFNDLAQRFVLITGAGVVHVDVSKHLAYVLGFDNTRLFHGEQARYMPDLSGGVKQLYVYAPKLIEECIIVQTTLMSVIKKIDKDSVEGVEGSLSLFSLPPTNVAINKTNVRELLPLSALNQTGPYLFRLFSDSQYCDLSKTYLYLLSSIERKNGAEPEDKRVGVIQNFGSSFVRSLKINISGIEVFDSSIYYHYRDYIMKELGYSHEIRKAFHEAACYYTDEDDGQDSGTNDGFIARASRFSNGKQCETMVKLNFDLAHQNALMLNNQDVIFTIHRNNDSFLLLTPPWKKADGTLQENSKEYRIRVHDLRVYVRTVDVTPSLNLAISRQLESTSAKYPLRKIEMRSIFLGKGRTELAHNVFTSTLPRRLICCFVSTDAYSGNRRLSPFKFEHANVRSICAEANGQAFPSTPYLLSFDDAQQRFVRAFVDMYAGLGLDDSDTKTVSIGMQRFLSGWAFFVIPMTSTLDDTPGFELIRQGTCTLKVQLEKPIKEDGYEMLILGEFDSVLSINADRVLSTDGSV

SEQ ID NO: 119258 - protein, 285 aa, Heterodera glycines
  misc_feature (57)..(57): Xaa can be any naturally occurring amino acid
  Coding regions on vcDNA: vcDNA=SeqID_45681; Strand=+; Position=1 -176,242-313,381-428,472-615,678-911,1123-1212
  Homolog annotation: Hit_ID=NP_492521.1; Match level="QueryCoverage =100%, HitCoverage=57%, E-value=4e-83, Identity=55%"; Hit description= SynTrophiN (49.0 kD) (stn-1) [Caenorhabditis elegans] emb|CAB03025.1| Hypothetical protein F30A10.8a [Ca
  Essential gene: C elegans homolog=F30A10.8a; Phenotype=Unclassified
IRCSSATEADAWFEAIHSCADTLLTQALAQVNLILGQSPQVLRMGWMAEQVVPNGQXMWRAVFVALTVWRAVFVALTVNDLLLYESVPAVKQEWANEWANPSFTRPLIATRVVQTTARSFPVIMGVQTTARSFPVIMGLSDIISFSTRTGTQEGVRTHLFRLETHRELASWVKAIIQNAIIQNTYVACEAIQQVSAPCVWNDQQCELSIQLDRGIKLSTSDGQMLWQYPFEAIRATGDDGQQFLWMDFGEPIGEQEVDLLCSPKAVVFILHSFLATKVYQLCLYA

SEQ ID NO: 119259 - protein, 109 aa, Heterodera glycines
  Coding regions on vcDNA: vcDNA=SeqID_45682; Strand=-; Position=1 -183,248-325,375-443
  Homolog annotation: Hit_ID=XP_397091.1; Match level="QueryCoverage =98%, HitCoverage=50%, E-value=3e-46, Identity=74%"; Hit description =similar to Protein C14orf111 (CGI-35) [Apis mellifera]
  Essential gene: C elegans homolog=F30A10.9; Phenotype=Lva,Lvl
MDCLYAKVVPYISDCVLGELEKMGRRFKLALKIIKDNRFQRLQCTHKGIYADDCIVQRVTQHKCYIVATCDKDLRQRIRKIPGVPIMYVRDHRYTIERMPDAYGAPKLG

SEQ ID NO: 119260 - protein, 334 aa, Heterodera glycines
  Coding regions on vcDNA: vcDNA=SeqID_45683; Strand=+; Position=1 -157,209-314,472-536,610-693,1037-1192,1362-1452,1511-1742
  Homolog annotation: Hit_ID=NP_495838.1; Match level="QueryCoverage =94%, HitCoverage=36%, E-value=1e-100, Identity=44%"; Hit description= carbamoylphosphate synthetase 2/aspartate transcarbamylase/dihydroorotase; rudimentary homolog, PYRimidi
  Essential gene: C elegans homolog=D2085.1; Phenotype =Emb,Gro,Lvl,Mlt,Unc
LKISPLFSIKALKEMGLRTVLVNPNVVTVQTTKGFADRVYFLPIIKEYVTEVIKKERPTGILCTFGGQTALNCAVIKKERPTGILCTFGGQTALNCAVDLHNTGVLSEYGVTVLGTSIETIMRTEDRELFKEFVLKIGEKEFVLKIGEKVADCRAANTIEEAEKAAEQIGYPVLVRAAYALGGLGSGFAETRDELMAIARQALAHSKQVLIDKSFQGWKEIEYEVVRDAYDNCITVCNMENVDPLGIHTGDSVVVAPSQSVVVAPSQTLNNEEYFRMRQTALKVIRGLGIIGECNIQYALNPNKMEVGFSSQSAKSNGSLSLFLLIILKIVQKK

SEQ ID NO: 119261 - protein, 171 aa, Heterodera glycines
  Coding regions on vcDNA: vcDNA=SeqID_45684; Strand=+; Position=1 -216,441-740
  Homolog annotation: Hit_ID=NP_501878.1; Match level="QueryCoverage =99%, HitCoverage=27%, E-value=4e-72, Identity=78%"; Hit description =transketolase (66.0 kD) (4L9) [Caenorhabditis elegans] emb|CAB02889.1| Hypothetical protein F01G10.1 [Cae
  Essential gene: C elegans homolog=F01G10.1; Phenotype=Emb,Gro,Lva
MTISATADVDKLQDAANRMRISSIEQTCAANSGHPTSSCSAAEIVATLFFAEMRYDVKDPRSASADRFILSKGHACPILYAAWEEAGLLSRDQVLSLRKIDSDIEGHPTPRLNFIDVATGSLGQGLSCAAGMAYTGKYVDHSSYRVYCLMGDGESAEGSVWEAAGELKIHG

SEQ ID NO: 119262 - protein, 89 aa, Heterodera glycines
  Coding regions on vcDNA: vcDNA=SeqID_45685; Strand=+; Position=1 -39,90-274,659-703
  Essential gene: C elegans homolog=C45G9.5; Phenotype=Lva
MAPYTQVLYFNSNIIYVCAEEKSDLSVFRIFSLDGTNEHEHIIDGKVQSVAISQNGDLYMTKQPTHGTEESAIWRQCIKWVATKDCRII

SEQ ID NO: 119263 - protein, 173 aa, Heterodera glycines
  Coding regions on vcDNA: vcDNA=SeqID_45686; Strand=-; Position=1 -91,154-254,301-393,738-974
  Homolog annotation: Hit_ID=BAB22465.1; Match level="QueryCoverage =75%, HitCoverage=81%, E-value=7e-20, Identity=41%"; Hit description =unnamed protein product [Mus musculus]
  Essential gene: C elegans homolog=Y48A6B.5; Phenotype=Gro
MEMSTSFLDSLPGFSVVDFNGSHEKRTCVPVSSGYHAGNGCYEFHGSICASLAGFLHVYSLRDSQDTETNIVEVRRNIDERSNVLPSQGKIVTARVELHKFVQPGDIILARVLGYGEAHTSYLLTIAEAELGVVIGRSQNGERLLPENSEIMKVPGSEYRETRKVAQLPIVNK

SEQ ID NO: 119264 - protein, 152 aa, Heterodera glycines
  Coding regions on vcDNA: vcDNA=SeqID_45687; Strand=+; Position=1 -62,113-317,370-507
  Homolog annotation: Hit_ID=NP_504822.1; Match level="QueryCoverage =90%, HitCoverage=14%, E-value=7e-36, Identity=58%"; Hit description =cleavage polyadenylation factor (95.6 kD) (5H661) [Caenorhabditis elegans] gb|AAB71322.1| Hypothetical pr
  Essential gene: C elegans homolog=F09G2.4; Phenotype=Emb
VIDTAGRVLEIAHLLDQLWQNKEAGLMTYNLVKEAGLMTYNLVMMSAVASSVIESAKSQVEWMSDKILRIFETGRHNPFQFKHVKFCHTLTDLNRVRSPKVVLVSGVVLVSGLDMESGFSRELFLEWCTDTKNMVIVSECGLREILWLIITF

SEQ ID NO: 119265 - protein, 314 aa, Heterodera glycines
  Coding regions on vcDNA: vcDNA=SeqID_45688; Strand=+; Position=1 -103,305-477,519-908,1408-1686
  Homolog annotation: Hit_ID=CAE73166.1; Match level="QueryCoverage =100%, HitCoverage=96%, E-value=5e-76, Identity=56%"; Hit description= Hypothetical protein CBG20562 [Caenorhabditis briggsae]
  Essential gene: C elegans homolog=C37C3.2a; Phenotype=Emb,Lva,Ste
MPRILAKVEGKGNGIKTVIANMPEIAKALSRPPTYPTKYFGCELGAQTNFDLKNERYIVNGEHDANKLQDILDGFIRKFVLCPSCDNPETVLTVKRQVINGKCKACGHAFIVDPKQKLSTFILKNPPPPDNIESEKEVKSDGGLPAEESNDVPVVDNSGGCDAGSNGEDDEDWAPEPVEDEEKLSGQIGKLVIDKDLDKSVDERLDLLHQFFLKAVKNNTIQPSKKFADKEVVKEMIKVAQPVLKWLKEAEEGSDESEDDDLDVAFDDRSRNIGMTVEVEKGAKDGVTRVQNGQIATNGKMDDGNADDIDIDNI

SEQ ID NO: 119266 - protein, 258 aa, Heterodera glycines
  Coding regions on vcDNA: vcDNA=SeqID_45689; Strand=-; Position=1 -288,339-607,1121-1338
  Homolog annotation: Hit_ID=CAE71301.1; Match level="QueryCoverage =93%, HitCoverage=51%, E-value=5e-41, Identity=36%"; Hit description =Hypothetical protein CBG18190 [Caenorhabditis briggsae]
  Essential gene: C elegans homolog=C26E6.8; Phenotype=Pvl,Rup,Stp
MDNETSLMDQQQKRYDRQIRLWGDDGQLSIQQARVCVFGSNSLAAETLKSLVLAGIGSFHIIDKALVDHADFGQNFFVEEGSLGSSRAECLVKALKELNHSVHGQHHPISFGEFKRQDFQMLLQFSLVIGTSLTANEARQLDQFLFEHAIPFVYANVCGMMGHLRLSFREHYIFENHAENAAYDLRQTKANDKALFPDITSFKTRKEFEQILMKMRQPDDKGSLDEQNFTEAKQNLLKGMRKSNVRINESYGNYRNMS

SEQ ID NO: 119267 - protein, 142 aa, Heterodera glycines
  Coding regions on vcDNA: vcDNA=SeqID_45690; Strand=+; Position=1 -117,182-408,534-617
  Homolog annotation: Hit_ID=NP_740892.1; Match level="QueryCoverage =100%, HitCoverage=17%, E-value=5e-66, Identity=87%"; Hit description= n-ethyl maleimide Sensitive membrane Fusion factor related (nsf-1) [Caenorhabditis elegans] emb|CAB09531
  Essential gene: C elegans homolog=H15N14.2; Phenotype=Emb
MRKLFSDAEEEWRRCGPNSGLHIIIFDEIDAICKQRGSMAGSSTGVHDTVVNQLLTKMDGVEQLNNILVIGMTNRKDMIDEALLRPGRMEVQLEISLPDEYGRVQILKIHTARMREYNKLDTGVNVEDIAKRTKNFSGAELE

SEQ ID NO: 119268 - protein, 147 aa, Heterodera glycines
  Coding regions on vcDNA: vcDNA=SeqID_45691; Strand=-; Position=1 -131,2992-3054,3108-3234,3290-3414
  Homolog annotation: Hit_ID=AAB02100.1; Match level="QueryCoverage =68%, HitCoverage=46%, E-value=4e-22, Identity=54%"; Hit description =isoform 2 sp|Q26537|1432_SCHMA 14-3-3 PROTEIN HOMOLOG 2 (14-3-3-2)
  Essential gene: C elegans homolog=M117.2; Phenotype=Emb
LDLIRKNVPKAVLETSGLISQSTSHAKDLAARVQFALERVLPEGFKSYREELESELLVNCRGVLEFLDSTLIPNATTNLEAKVFYLKMKGDYSRYISEIALGEDRTTAIEEAKQSYNQAAEHAAQLTPSDPTRLAVALNMSVFYHSS

SEQ ID NO: 119269 - protein, 93 aa, Heterodera glycines
  Coding regions on vcDNA: vcDNA=SeqID_45692; Strand=-; Position=1 -99,294-473
  Homolog annotation: Hit_ID=AAN84543.1; Match level="QueryCoverage =100%, HitCoverage=26%, E-value=3e-39, Identity=83%"; Hit description= heat shock protein 70 A2 [Panagrellus redivivus]
  Essential gene: C elegans homolog=F26D10.3; Phenotype=Lva,Ste
MASCKAIGIDLGTTYSCVGVYQHGKVEIIANDQGNKTTPSVVAFTDTERLIGDPAKDQMARNPTNTIFEAKRLIGRPWDDPMVQRDIRQWPFK

SEQ ID NO: 119270 - protein, 88 aa, Heterodera glycines
  Coding regions on vcDNA: vcDNA=SeqID_45693; Strand=+; Position=1 -94,158-243,633-719
  Homolog annotation: Hit_ID=CAE56013.1; Match level="QueryCoverage =65%, HitCoverage=44%, E-value=2e-09, Identity=46%"; Hit description =Hypothetical protein CBG23568 [Caenorhabditis briggsae]
  Essential gene: C elegans homolog=T02H6.11; Phenotype=Age,Gro,Lva,Ste
MAKGVKFDHDNAFVRFCRYYLWHYCWSGRQYGLQFYDQAFEPHPVVQEALRRLRLKDPYQTLCCERLGAEEKHIAFVGTVAGEKLIDE

SEQ ID NO: 119271 - protein, 244 aa, Heterodera glycines
  misc_feature (218)..(218): Xaa can be any naturally occurring amino acid
  misc_feature (243)..(243): Xaa can be any naturally occurring amino acid
  Coding regions on vcDNA: vcDNA=SeqID_45694; Strand=+; Position=1 -58,118-290,423-652,807-845,906-981,1027-1092
  Homolog annotation: Hit_ID=AAK38746.1; Match level="QueryCoverage =88%, HitCoverage=15%, E-value=3e-47, Identity=43%"; Hit description =WD repeat membrane protein [Mus musculus] ref|NP_700440.1| WD repeat membrane protein PWDMP [Mus musculus]
  Essential gene: C elegans homolog=ZK520.1; Phenotype=Gro
QSAWRSFAETAMTNGNIELAVRIFVRIFRHLGDVAMVWALEQLLNIEDQQTLSGHVAALLGNFDEADDFFSNSSQPKLALEMRRDVQHWERALELARQTAPDELPGIAKEYAVQLEFAGQHAEAFRYYEEALITSSSGNASKMSEEQREEHNWVCSAGLARMALHMGDLKRGGVEIALKLPSRLAKRDCGIVLEQLRQFDEAGSVYEAGQFYDRAAVXEQLRQFDEAGSVYEAGQFYDRAAVXL

SEQ ID NO: 119272 - protein, 75 aa, Heterodera glycines
  Coding regions on vcDNA: vcDNA=SeqID_45695; Strand=+; Position=1 -41,484-596,1159-1232
  Homolog annotation: Hit_ID=AAK26376.1; Match level="QueryCoverage =94%, HitCoverage=16%, E-value=2e-32, Identity=91%"; Hit description =beta-transducin repeat-containing protein [Heterodera glycines]
  Essential gene: C elegans homolog=K10B2.1; Phenotype=Emb,Lon,Lva,Pvl
PPPPMGGGGSKSIRLWDIECGNCLRVLEGHEELVRCIRFDSKRIVSGAYDGKIMIWDLAAALDPMTPPNSICIKT

SEQ ID NO: 119273 - protein, 124 aa, Heterodera glycines
  Coding regions on vcDNA: vcDNA=SeqID_45696; Strand=-; Position=1 -192,250-327,360-464
  Homolog annotation: Hit_ID=NP_492322.1; Match level="QueryCoverage =87%, HitCoverage=71%, E-value=7e-25, Identity=53%"; Hit description =RAN (nuclear import/export) related (15.1 kD) (ran-4) [Caenorhabditis elegans] emb|CAA99890.1| Hypothetic
  Essential gene: C elegans homolog=R05D11.3; Phenotype=Emb,Lva
MATYNPNYESIGQAFVQHFYTKFDVPDGPTRTVGLHDLYDAEHSFMTFEGNQVKGRQAILDKYGALPFRTIQHGITKVFSKLVFCLSFFSTDSQPLPDGSILVTVIGQLKVSFTVVYLFNCSLL

SEQ ID NO: 119274 - protein, 211 aa, Heterodera glycines
  misc_feature (191)..(191): Xaa can be any naturally occurring amino acid
  Coding regions on vcDNA: vcDNA=SeqID_45697; Strand=-; Position=1 -100,396-540,867-1052,1400-1616
  Homolog annotation: Hit_ID=AAD01597.1; Match level="QueryCoverage =89%, HitCoverage=45%, E-value=4e-44, Identity=48%"; Hit description =peptidyl-prolyl cis-trans isomerase [Brugia malayi]
  Essential gene: C elegans homolog=F31D4.3; Phenotype=Emb,Rup
VGTTNGRVFLDASLDYVLGEGLDHGLPDGVDKALKRMDRGEKSRVTLKGFGYGKCPPAELGLGIYEEIVFMLHLKDYEKVKATWELTDEEKLDRVKAYKDRGTDFLHQGKFALALAKYDTVIYMMEFAKNQSATGRSNLMVLSQLNSALAHLRMGDPIETIKHCEKVLERQPNNVKAIYRKAQVCRSYIFXEGGRPPPPPPSLAKGASEGG

SEQ ID NO: 119275 - protein, 347 aa, Heterodera glycines
  misc_feature (12)..(12): Xaa can be any naturally occurring amino acid
  Coding regions on vcDNA: vcDNA=SeqID_45698; Strand=-; Position=1 -59,1140-1270,1312-1371,1410-1589,1630-1764,1845-2132
  Homolog annotation: Hit_ID=AAB62321.1; Match level="QueryCoverage =100%, HitCoverage=48%, E-value=2e-64, Identity=41%"; Hit description= RanGTPase activating protein [Xenopus laevis] sp|O13066|RGP1_XENLA Ran GTPase-activating protein 1
  Essential gene: C elegans homolog=C29E4.3a; Phenotype=Emb
IGNEQISLKGRXLKNHTFDSGEKIAAKIRECAGLEVLEMRGNTLGVGATAPIAEALECQSNLKRALWSDMFTGRLKEEIPRTLRALWSDMFTGRLKEEIPRTLKTLCDAMILSGARLKTLCDAMILSGARLTELDLSDNAIGPMAVPGIKEFLAGEAAFALKTLKLNNCGLGIAGKVTIAHCLIECHRRSVSHGTPLTIAHCLIECHRRSVSHGTPLCLKIFVAGRNRLEYTSTAALAEAFQIIGTLEEISIIGTLEEISMPQNGISAEGILKLSESVRQNASLKILNLGDNTFGESGASAMASALEKLARLEIVDFSDCLCRDRGSVLIARSMAASKSPLTELNLS

SEQ ID NO: 119276 - protein, 452 aa, Heterodera glycines
  Coding regions on vcDNA: vcDNA=SeqID_45699; Strand=-; Position=1 -64,110-393,445-681,918-1055,1108-1194,1243-1618,1665-1835
  Homolog annotation: Hit_ID=CAE72910.1; Match level="QueryCoverage =96%, HitCoverage=45%, E-value=1e-126, Identity=52%"; Hit description= Hypothetical protein CBG20228 [Caenorhabditis briggsae]
  Essential gene: C elegans homolog=D2013.5; Phenotype=Emb,Lva
MRNSVRDGKTVSNEVISLTVKGPSLPRMVLVDLPGVISTVTTDMARETKEDIAKMCKQHMENPNAIILCIQGIAANLSHSFPFLSDGSVDAERSNVTDLVTNVDPDGQRTILVLTKVDLAEKNLSNPHRIKKILDGKLFPMKALGYFGVVTGMDKRDASIAEIRKYEEDFFESSKLFRDGVLKATQMTTRNMSLAARGEVLDEVVNLSLVSADEWEVLLRAHLWNAICPQVFDQILMPASTVESTSSFNTVVDIKLKHWAEKELANRSVQVGWETLSQIFRRQVSGEERGGQTLKSNRTHGSQKSPDGGNLLKALKAAVVSAVLEQHRWDSKALDYLVIGHRLSLQIILVGVQRVIQLNAVADQVVPDRRAWDQSCAFLANAASDRIRELKKTLEESRGPSGWSRWFGWGSPTPEQLVNQTVQDELRALLVNNPVASLNPSPKLIVNESVTK

SEQ ID NO: 119277 - protein, 184 aa, Heterodera glycines
  Coding regions on vcDNA: vcDNA=SeqID_45700; Strand=+; Position=1 -168,590-978
  Homolog annotation: Hit_ID=NP_598842.1; Match level="QueryCoverage =94%, HitCoverage=77%, E-value=4e-23, Identity=31%"; Hit description =DnaJ homolog, subfamily C, member 9 [Mus musculus] gb|AAH23787.1| DnaJ homolog, subfamily C, member 9 [Mu
  Essential gene: C elegans homolog=T24H10.3; Phenotype=Unc
KKAYYRQSILWHPDRFASAQHDETTRELAKQKFQVIGRAYVILGDSEKRKAYDETGSQEEIDEVKEAYQKHKGNMDKIMQSVVGAEHPDEDRIREIVRHGIERGELRAYARFVNEPASARTRRAARAQREEVEAQQALEELRQREDVSKGTDGDDSLGALIRAKQRKRAEKNGSVCCFRTLERF

SEQ ID NO: 119278 - protein, 160 aa, Heterodera glycines
  Coding regions on vcDNA: vcDNA=SeqID_45701; Strand=-; Position=1 -99,265-324,555-878
  Homolog annotation: Hit_ID=NP_492360.1; Match level="QueryCoverage =96%, HitCoverage=86%, E-value=1e-49, Identity=51%"; Hit description =proteasome Alpha Subunit (28.2 kD) (pas-4) [Caenorhabditis elegans] emb|CAB02269.1| Hypothetical protein
  Essential gene: C elegans homolog=C36B1.4; Phenotype=Emb,Lva,Unc
MERYDRAITIFSPDGRLFQVDYAQEAVKKGSTAKSIPTLQDERTIRKIHALDSRYTQTTGRRPFGISMLVGGFDSDGTPHLFKTEPSGVYYELLAGSIGRNEKIVKEYLEKEYGNDNTADEESTLKLMLKSLAPVVQSGAQNIEIAVNTKIHVNLLAIHF

SEQ ID NO: 119279 - protein, 318 aa, Heterodera glycines
  misc_feature (79)..(79): Xaa can be any naturally occurring amino acid
  misc_feature (98)..(98): Xaa can be any naturally occurring amino acid
  Coding regions on vcDNA: vcDNA=SeqID_45702; Strand=+; Position=1 -24,202-380,434-569,631-783,892-1086,1264-1398,1521-1557
  Homolog annotation: Hit_ID=NP_496100.1; Match level="QueryCoverage =98%, HitCoverage=35%, E-value=5e-57, Identity=38%"; Hit description =transducin -like 3 (2K34) [Caenorhabditis elegans] emb|CAB16490.1| Hypothetical protein Y53C12B.1 [Caenor
  Essential gene: C elegans homolog=Y53C12B.1; Phenotype=Emb,Gro,Stp
KKWIRFCPKLSASATVVAHSKDINSVDISANDRLCVTASMDKTAKLWHIDRKTGQLSAGGTLGGHIRNIAVLEFSYVFXLVATCSGDIAVLEFSYVFXLVATCSGDLTIKLFSLLDKTCTRTLEGHQFAVLSILFIDNGSKLVSVILFIDNGSKLVSVDGGGLIKLWDVKKGICVRTEEAHSDKIWSLRELPPAEEFMTGATDGQFAIWTDISEEVKAEKRAEQTKRTEDEQRLSNLLDQDRLGDALLLTLDLGQPFQCVFLAMDGPQSEESDAKLLALFRRLSAAQLSILLDYAAQWNTNTRTYAVAQLVLNCVLKC

SEQ ID NO: 119280 - protein, 274 aa, Heterodera glycines
  Coding regions on vcDNA: vcDNA=SeqID_45703; Strand=+; Position=1 -114,293-498,1127-1317,1358-1469,1533-1671,1721-1783
  Homolog annotation: Hit_ID=CAE67591.1; Match level="QueryCoverage =97%, HitCoverage=30%, E-value=4e-32, Identity=36%"; Hit description =Hypothetical protein CBG13133 [Caenorhabditis briggsae]
  Essential gene: C elegans homolog=F45E12.2; Phenotype=Lva
MTKEESEDPPAFRESKRKQHEEKRRKEEEIVAESALKEFEPVRLEVEQALLKRFKRSPYAKMIANGLVDDTVPELSQASDMLQEEVIDTVYQLAEEHQQQPGAISNSGHYALYGPSLASLGISKDQNQQRTQQHQQISSFPSSDSPAICPPTVGNQSNDTIISNEDLDLTGIDDNEINSYILTDVETTIKEKYWMKQNSKHLEVMEERKRQRQEEQEQRQNKESGPKRRKRAPNVRKREVNAVTHNDAMLHVIQERNLSSKINYDILKQLDDES

SEQ ID NO: 119281 - protein, 94 aa, Heterodera glycines
  Coding regions on vcDNA: vcDNA=SeqID_45704; Strand=-; Position=1-285
  Homolog annotation: Hit_ID=P53021; Match level="QueryCoverage=98%, HitCoverage=73%, E-value=5e-45, Identity=90%"; Hit description=Major sperm protein 1 gb|AAA29146.1| major sperm protein
  Essential gene: C elegans homolog=ZK546.6; Phenotype=Emb
GINPGRKRIGYAFKSTNRKRINMNPPNGVLGPKESVNVAVSCDAFDPGSEDTKGDRVTVEWTNTPDPAATAFKLEWFQGDGMVRRKNLPIEYNV

SEQ ID NO: 119282 - protein, 227 aa, Heterodera glycines
  Coding regions on vcDNA: vcDNA=SeqID_45705; Strand=-; Position=1 -211,509-624,877-1078,1600-1698,2134-2189
  Homolog annotation: Hit_ID=CAE58420.1; Match level="QueryCoverage =88%, HitCoverage=72%, E-value=4e-68, Identity=58%"; Hit description =Hypothetical protein CBG01551 [Caenorhabditis briggsae]
  Essential gene: C elegans homolog=F42G8.12; Phenotype=Emb,Ste
MLPNSSSMLLFHNLRKQSVNALPLGRQAVHNDVQFPNFDAYRNELTKDPAQPSHVTEDRRKGVSSFIFYGVGGAITLMTAKFAVRKAVTYKWMPRDQAAMAATEIDLSLVPLGKTKTFEWRGKPVFVKHRTAKEIERERAVEVGKLRHPERDEDRVLKPEWSVLIGVCTHLGCIPLSGKGEFGGYFCPCHGSHYDASGRIRKGPAPLNLEVPKYEFLSDTLIKVGSD

SEQ ID NO: 119283 - protein, 330 aa, Heterodera glycines
  misc_feature (2)..(2): Xaa can be any naturally occurring amino acid
  misc_feature (248)..(248): Xaa can be any naturally occurring amino acid
  Coding regions on vcDNA: vcDNA=SeqID_45706; Strand=-; Position=1 -330,973-1112,1264-1347,1411-1620,1966-2162
  Homolog annotation: Hit_ID=CAE71867.1; Match level="QueryCoverage =91%, HitCoverage=41%, E-value=7e-57, Identity=43%"; Hit description =Hypothetical protein CBG18919 [Caenorhabditis briggsae]
  Essential gene: C elegans homolog=F13H6.1; Phenotype=Gro,Unc
VXTVSDLFQPQILAAIQQYYIQQHTQQNIQRENVSSILRAIFFTIFHFQAAAVGALLQAVTTKSAGAASSSGNATPIPFLPPASSTTSAAAAASTAFLSNLMAAAVAKREEEEGQQTVEGEGDGDELSDRLIVVDGDEACEPAAKRDPKARKDRCTFCQKVFTNRSNLIVHLRSHTGEKPYKCQLCPYACAQSSKCQLCPYACAQSSKLTRHMRTHGQQGKEVYNCNICQMPFSVHSTLEKHVRKSIXERERRERKNIGERGEIVEEEDGAEGDCDRTAPLATASATAGAPLPANIAQSNRLVLNWLQVVNHMIGSGSIISKIGRHERSK

SEQ ID NO: 119284 - protein, 218 aa, Heterodera glycines
  Coding regions on vcDNA: vcDNA=SeqID_45707; Strand=-; Position=1 -31,81-179,244-769
  Homolog annotation: Hit_ID=NP_497247.1; Match level="QueryCoverage =95%, HitCoverage=14%, E-value=1e-21, Identity=34%"; Hit description =putative protein, nematode specific, GEX (Gut on EXterior) Interacting protein GEI-16 (gei-16) [Caenorhab
  Essential gene: C elegans homolog=T17H7.4d; Phenotype=Lva
MANTNYGIRIDEHHWVPVVRQPPYKAEMRDFVPDEPEQQIKGHGTGPLEDVARRQTTGVIMPSPDGSHRPRTEFDGARKPPAGGFVPHAPNVVRRARTRAPHADEAAMIHYETDTVTPRRRRHAAASDSARVRHASAAPSTARGAVMQRRHDVHSEDDDYDHDHYQRLQQQQHPPADDWDAAPEMPRRHPRRQHTSTIVTLGPLPCADVRRKIRAIEG

SEQ ID NO: 119285 - protein, 168 aa, Heterodera glycines
  Coding regions on vcDNA: vcDNA=SeqID_45708; Strand=-; Position=1 -121,500-719,1397-1561
  Homolog annotation: Hit_ID=NP_495140.3; Match level="QueryCoverage =99%, HitCoverage=21%, E-value=7e-55, Identity=62%"; Hit description =general substrate transporter family member (2G77) [Caenorhabditis elegans]
  Essential gene: C elegans homolog=K05F1.6a; Phenotype=Unclassified
ALSDQSAPGRVLFSGNFFLNNAVAGAIELPTLIFCVYLMKYGRKRSQIFTLVAAAIFILCAMASMSANRSMLSLGLMLLGKIFIQGGFNILYIFTSELYPTVIRNRYARPVPMIARFGSGVSSYIAILSDVTLSIVPMIIFATFSLFAGTLVMLLPETRDQPLPDTLQ

SEQ ID NO: 119286 - protein, 263 aa, Heterodera glycines
  Coding regions on vcDNA: vcDNA=SeqID_45709; Strand=-; Position=1 -152,198-372,424-579,632-692,742-841,1133-1277
  Homolog annotation: Hit_ID=CAE67428.1; Match level="QueryCoverage =67%, HitCoverage=21%, E-value=6e-81, Identity=80%"; Hit description =Hypothetical protein CBG12918 [Caenorhabditis briggsae]
  Essential gene: C elegans homolog=Y113G7A.3; Phenotype=Emb,Ste
VQRFGDYHKEDPASLKLTDKFSLFPQFMFHLRRSQFLQVFNNSPDETVYYRHILMGENVFESTTMIQPQLFSYSFNGPPEPVLLDSSSILPDRILLMDDFFHVLIYHGQTIAAWRKANYQNDPQYASFKQLLDAPVQDATAIIQDRFPVPRYIVTEYEGSQARFLLSKVNPVVDTQQPVFSGGRCPRVHGRRFHASVHGTPAKVGSFRFVMSVALTVEVMLDVLKFMDYYQNCKMELTSIGFRSVIDRYRNELALCQFFQIQL

SEQ ID NO: 119287 - protein, 65 aa, Heterodera glycines
  Coding regions on vcDNA: vcDNA=SeqID_45710; Strand=-; Position=1 -92,183-290
  Homolog annotation: Hit_ID=CAE56013.1; Match level="QueryCoverage =98%, HitCoverage=47%, E-value=5e-10, Identity=51%"; Hit description =Hypothetical protein CBG23568 [Caenorhabditis briggsae]
  Essential gene: C elegans homolog=T02H6.11; Phenotype=Age,Gro,Lva,Ste
LQFYDQAFEPHPEVQEALRRRRLRLKDPYQYDLRLQRILLASQLGSKNERLPKNMWTKWDDETFT

SEQ ID NO: 119288 - protein, 432 aa, Heterodera glycines
  Coding regions on vcDNA: vcDNA=SeqID_45711; Strand=+; Position=1 -180,374-462,513-577,718-818,1045-1167,2507-2646,2834-2933,2996 -3160,3616-3761,4042-4231
  Homolog annotation: Hit_ID=XP_168590.4; Match level="QueryCoverage =79%, HitCoverage=82%, E-value=1e-42, Identity=31%"; Hit description =PREDICTED: zuotin related factor 1 [Homo sapiens]
  Essential gene: C elegans homolog=F38A5.13; Phenotype=Emb
MALAHYGFLAPKRRIEPAGISYEFSLIKDRLILGLSTLPVLQIVFQNSRTTDGDDIDGAADSVDWLDRDDSKFRKYISRLDPNEWKKQDHYKVLGLSKLRYQATAAQLKTAYRRKVLKYHPDKGKATETEDKLLRNEAVFACIQKAYEQLGLSEERRRAFDSVDPQFDDSMPDSVDTANFFELLGPVKQQRKKAMAAQRRQLRTMASNANYWMENGTALDNRRMASIAEQIERICLSAEFDELTALCEGLAIVQTFDEAQKLLVECAIKKDFADGKAGGEGPSTNAQNKAPVASKIWSMNELQLLIKAVNLFPPGTNERWKVKLLKSNPSSNLAPPPTVVTKNAETNASATLTAPSAASDDQEWSAEQQKQLERALKATISVDAKERWDKIATMVDGKDKKECIRRYKMVAQLVKKAKMDGGGGQQQQQQQK

SEQ ID NO: 119289 - protein, 1078 aa, Heterodera glycines
  Coding regions on vcDNA: vcDNA=SeqID_45712; Strand=+; Position=1 -248,459-1454,1671-2666,2879-3874
  Homolog annotation: Hit_ID=CAE73801.1; Match level="QueryCoverage =98%, HitCoverage=99%, E-value=1e-108, Identity=27%"; Hit description= Hypothetical protein CBG21351 [Caenorhabditis briggsae]
  Essential gene: C elegans homolog=ZC247.1; Phenotype =Gro,Sck,Sma,Ste,Stp
MDGHPVDGRVSAYHHVSSNIGTPSGPKDTITTKLTSIFKKTTAHEDEYPPKTEPFLGPVAQTDRQRELEAVPVVDRIERIPKGFYEEGELHPVVVHEEKELTPSEAEKRPGTLERITHLFKRTATEGEWPMVTEPFTGPHAETSRKGELEARPLGELVAAYASGRSDEVGPMQTIETQAATTTAREHYPATVSYEGPLSATTRKWELEGAPLNSHVTVYHHGRSDLAAAEQQQPVAEKVTTKISSLFKRKPHHEDFPVSEPFTGQLEETARVSELFHEPIDARVSVYSAGRSDEHVVVQPTTIAEAEPVPLVEYPRTTAYDGPLQSTSKGAEMEGQPLDAHVSAYHHGRSDMAPPAAPKETITTKLTSIFKKTTAHEDEYPPKTEPFLGPVAQTDRQRELEAVPVVDRIERIPKGFYEEGELHPVVVHEEKELTPSEAEKRPGTLERITHLFKRTATEGEWPMVTEPFTGPHAETSRKGELEARPLGELVAAYASGRSDEVGPMQTIETQAATTTAREHYPATVSYEGPLSATTRKWELEGAPLNSHVTVYHHGRSDLAAPEQQQPVAEKVTTKISSLFKRKPHHEDFPVSEPFTGQLDETARVSELFHEPIDARVSVYSAGRSDEHVVVQPTTIAEAEPVPLVEYPRTTAYDGPLQSTSKGAEMEGQPLDAHVSAYHHGRSDMAPPAAPKETITTKLTSIFKKTTAHEDEYPPKTEPFLGPVAQTDRQRELEAVPVVDRIERIPKGFYEEGELHPVVVHEEKELTPSEAEKRPGTLERITHLFKRTATEGEWPMVTEPFTGPHAETSRKGELEARPLGELVAAYASGRSDEVGPMQTIETQAATTTAREHYPATVSYEGPLSATTRKWELEGAPLNSHVTVYHHGRSDLAAPEQQQPVAEKVTTKISSLFKRKPHHEDFPVSEPFTGQLDETARVTELFHEPIDASVSVYSAGRSDEHVVVQPTTIAEAEPVPLVEYPRTTAYDGPLQSTSKGAEMEGQPLDAHVSAYHHGRSDMAPPAAPKETITTKLTSIFKKTTAHEDEYPPKTQPFLGPVAQTNRQRELETVPVVDRIERIPK

SEQ ID NO: 119290 - protein, 51 aa, Heterodera glycines
  Coding regions on vcDNA: vcDNA=SeqID_45713; Strand=+; Position=1 -36,91-168,1588-1627
  Homolog annotation: Hit_ID=CAA92630.1; Match level="QueryCoverage =100%, HitCoverage=37%, E-value=4e-17, Identity=69%"; Hit description= Hypothetical protein ZK792.6 [Caenorhabditis elegans] pir||A36290 let- 60 ras protein - Caenorhabditis ele
  Essential gene: C elegans homolog=ZK792.6; Phenotype=Lva,Lvl,Unc
LVVVGDGGVGKSALTIQLIQGQFIEEYDPTIEDSYRKQEEYSAMRDQYMRT

SEQ ID NO: 119291 - protein, 118 aa, Heterodera glycines
  Coding regions on vcDNA: vcDNA=SeqID_45714; Strand=+; Position=1 -84,438-710
  Homolog annotation: Hit_ID=NP_510529.1; Match level="QueryCoverage =77%, HitCoverage=8%, E-value=2e-28, Identity=51%"; Hit description=2 polypeptide (XP854) [Caenorhabditis elegans] emb|CAA93776.1| Hypothetical protein F39B1.1 [Caenorhabditi
  Essential gene: C elegans homolog=F39B1.1; Phenotype=Unclassified
MSDIWLSEQLDLRMVLFRCLPTGSKKGLVFKLIFKALENFRRSCAGWCVATYVLGIGDRHNDNILVTTNGHVFHIDFGKYMGDWQMAAGFKRCAIIVIKIHSLKFKNSKMELIYSIGL

SEQ ID NO: 119292 - protein, 110 aa, Heterodera glycines
  Coding regions on vcDNA: vcDNA=SeqID_45715; Strand=+; Position=1 -152,416-491,908-1010
  Homolog annotation: Hit_ID=NP_510529.1; Match level="QueryCoverage =81%, HitCoverage=5%, E-value=4e-12, Identity=44%"; Hit description=2 polypeptide (XP854) [Caenorhabditis elegans] emb|CAA93776.1| Hypothetical protein F39B1.1 [Caenorhabditi
  Essential gene: C elegans homolog=F39B1.1; Phenotype=Unclassified
MLFTQMIMDSLQSKFPRLNFLAHTLAQFRGNPLGGRSEDMNRLSFISELYNEKNEGRLESVHVNSYEKWKNPEKIYRLFALSDEVAHSELVYTFMHSIYRDTEPEAHKQS

SEQ ID NO: 119293 - protein, 433 aa, Heterodera glycines
  Coding regions on vcDNA: vcDNA=SeqID_45716; Strand=-; Position=1 -96,1021-1095,1202-1376,1481-1635,1872-2074,2101-2160,2352-2553,2619 -2759,2811-2849
  Homolog annotation: Hit_ID=XP_319999.1; Match level="QueryCoverage =96%, HitCoverage=46%, E-value=6e-95, Identity=45%"; Hit description =ENSANGP00000010547 [Anopheles gambiae]
  Essential gene: C elegans homolog=C29A12.3a; Phenotype=Emb
QNPGPGTGTSDDREFPARSRGTLVLSYNFSKQSSRIPYLALAKTLERIEATSSRLENIRILSGFFGAAIRLSPSDLSPAVHLCLNKLGPSYEGLELGIAEAYLIKALAGATGRTVNMIKKDLKVKGDLGIVAQQSRSTQRMLAKPPPLTVPLVFNRLREIAKMAGISSMDKKVKAIQALLVPCIECEARFLVRCLQAKLRIGLAEQSLIVALANAFTKTELREKSDLLSQMKCTNDEKLKDRMAEDAQTLKTVYSTNDEKLKDRMAEDAQTLKTVYSECPNFDRIIEVALRSGISSLADECRLTPGIPLKPMLAHPTKGIQELLDRFGTAEFACEWKYDGERCQIHLLSDGTFKIFSRNQEIHLLSDGTFKIFSRNQEDHTGKFPDVARRLDALKRGEVTDFIADGEVVAWDPKQKQILPVVAWDPKQKQILP

SEQ ID NO: 119294 - protein, 80 aa, Heterodera glycines
  Coding regions on vcDNA: vcDNA=SeqID_45717; Strand=-; Position=1 -105,910-1045
  Homolog annotation: Hit_ID=CAA32443.1; Match level="QueryCoverage =56%, HitCoverage=15%, E-value=1e-09, Identity=65%"; Hit description =Eg1 [Xenopus laevis] sp|P23437|CDK2_XENLA Cell division protein kinase 2 (CDC2 homolog EG1 protein kinase)
  Essential gene: C elegans homolog=F18H3.5a; Phenotype=Lvl,Pvl,Unc
MRPPVDEDYRPIRVLGQGAYGEVWLVTSKENEREQIADFGLSRNYGLHATFTTEVVTLWYRSPELLLQCKYGTAVDLWSA

SEQ ID NO: 119295 - protein, 340 aa, Heterodera glycines
  misc_feature (2)..(2): Xaa can be any naturally occurring amino acid
  Coding regions on vcDNA: vcDNA=SeqID_45718; Strand=-; Position=1 -113,162-352,403-564,623-837,882-960,1007-1087,1130-1157
  Homolog annotation: Hit_ID=CAE63048.1; Match level="QueryCoverage =96%, HitCoverage=20%, E-value=7e-82, Identity=49%"; Hit description =Hypothetical protein CBG07319 [Caenorhabditis briggsae]
  Essential gene: C elegans homolog=ZK1248.10; Phenotype=Emb
QXLLLMIHQMNGIQHEKRVKKLLQKARESSPTLPTFESRSGSFHVRSGSFHVDEYGFRHSFAEIPLAVHFIATQLNQHYQSKSTGHAQLKANWRVLLREQPNALSDRSREIRLLCREIRLLCRRGIPRALRPRVWRLLINQQVADLKEKHGQYYYKNLCSSQGTAAEKHYSSAHQKQVNLDLLYSSAHQKQVNLDLLRTMPSNVHFMSASCKGVTHLQSVLRAFCLHNPSIGYCQGMNFLVATALLFMGPEDAFWFLVAVTEFLVAVTERYFDSSYFDQTLTGAQADQEVLKEIEVLKEIVEQKFPRLAQHLDECEIDLTTVTLNWFIALTVTLNWFIAL

SEQ ID NO: 119296 - protein, 341 aa, Heterodera glycines
  Coding regions on vcDNA: vcDNA=SeqID_45719; Strand=+; Position=1 -174,238-612,677-856,917-1033,1092-1271
  Homolog annotation: Hit_ID=AAP94888.1; Match level="QueryCoverage =95%, HitCoverage=98%, E-value=6e-75, Identity=46%"; Hit description =P34 [Ascaris suum]
  Essential gene: C elegans homolog=R90.1; Phenotype=Lva,Unc
MEELVALSPGIRVGRWTITKKLGAGAFGAVYLCVNDQGEQAALKTEPVNTPHPLLVMEAHVMTKLDALRDGDGKHFCRCLDLGRDEQRDQQSGQMKKFNYIVMSLVGRGLDGVVKDAGGRLSLGSAVGVSIQMLAALRGLHTVGYLHRDIKPGNSTIGRPESNEIRLLYLIDFGMARKYTRDDGSQHRPRAVTNFRGSPRYAAISAHLGREYSRKDDIESWFYCMIELLKGALPWANVGEMKAIGEAKIKRQKKQPEAVRRQAIADLLSGCPNEFGQVLKYIDDMKYTDKPDYDWIIATLRSSLSNAGVQEFPYDWETGKRNAAPGAGGGGGGGGGDSYFN

SEQ ID NO: 119297 - protein, 338 aa, Heterodera glycines
  misc_feature (12)..(12): Xaa can be any naturally occurring amino acid
  Coding regions on vcDNA: vcDNA=SeqID_45720; Strand=-; Position=1 -61,314-518,567-734,885-998,1040-1108,1189-1340,1565-1672
  Homolog annotation: Hit_ID=CAE65814.1; Match level="QueryCoverage =96%, HitCoverage=45%, E-value=5e-93, Identity=52%"; Hit description =Hypothetical protein CBG10925 [Caenorhabditis briggsae]
  Essential gene: C elegans homolog=F41C6.1; Phenotype=Unc
LRVNLPVTRFFXCGLKVTRSFCVLANSAEGLLREKCELCDPSVAQLAHPAALLTDLNNANNLTCWVSEPTTAFPHNVSLTLSLGKKFEITYVSLHFCGRLADSLAIFKSANEITYVSLHFCGRLADSLAIFKSANRGRTWTPMQFYSTECEKVYQRTKEVPISKENEQVARCTDSHILSPLSDRIAFATLEGRPSAMEFEQSPVLQDWVTATDIRVVFNRLSMDQAILNQDWVTATDIRVVFNRLSMDQAILNRIRRDNGSVLELPDDRVRERYFYAMAELAVGGRCKCNGHASRCVIDRMGRYSCDCKHATTGLDCEKCRPFHFDRPWARATADDAC

SEQ ID NO: 119298 - protein, 307 aa, Heterodera glycines
  Coding regions on vcDNA: vcDNA=SeqID_45721; Strand=-; Position=1 -142,195-418,485-695,743-923,1209-1293
  Homolog annotation: Hit_ID=CAE59095.1; Match level="QueryCoverage =100%, HitCoverage=23%, E-value=1e-130, Identity=76%"; Hit description=Hypothetical protein CBG02387 [Caenorhabditis briggsae]
  Essential gene: C elegans homolog=EEED8.5; Phenotype=Emb
TSCEILYERMKKLGSDVPELIILPVYGALPSEMQTRIFEPAPPGTRKVVIATNIAEVVIATNIAETSLTIDGIYYVVDPGFVKQKIYNPKSGMDSLVVTPISQAQAAQRAGRAGRTGPGKCYRLYTERAYRDEMLPTPVPEIQDEMLPTPVPEIQRTNLASTLLQLKAMGINNLLEFDFMDAPPAEAMITALYQLYQLSALDEDGLLTRLGRRMAEFPLMAEFPLEPSLAKMLIMSVELGCADDILTIVSMLSVQNVFYRPKEKQELADEKKSKFHQPEGDHCTLLAVYNAWKHHHYSPQWCQEHFV

SEQ ID NO: 119299 - protein, 377 aa, Heterodera glycines
  misc_feature (371)..(371): Xaa can be any naturally occurring amino acid
  Coding regions on vcDNA: vcDNA=SeqID_45722; Strand=-; Position=1 -32,115-250,291-492,550-657,920-1037,1249-1589,1710-1849
  Homolog annotation: Hit_ID=NP_499076.1; Match level="QueryCoverage =97%, HitCoverage=97%, E-value=2e-55, Identity=37%"; Hit description =tyrosine phosphatase (41.1 kD) (3K532) [Caenorhabditis elegans] emb|CAA80156.1| Hypothetical protein F54C
  Essential gene: C elegans homolog=F54C8.4; Phenotype=Emb
MVRTSRKIPTDWIKYQPLWIKYQPLGASIEGSRIFAFKTPLLPELQTSIPKECRFSTLTLLQQLAFSNRSLGLAFSNRSLGLVINCNNTKRYFCRRDIEGLGICYKEIPCPGRGFLYRTDAVKTFIKTIDDFLELNSDNDLLLLIAVCCSNGINRSGYLICNYLINRLGWSSHDALNAFESARGYSIERGSYVQALHKVDRERRSKTYWFSANNSIDNMLQFFLQEFKQVAETAAHSSANSSPALVASTAPQQQNTALPSQKSGAANSTISARQSLKITAKKREKTLNQSVSSSSAILNQPDIGVEQAEIGDTECVSDEEYDEDNSSSPNTAITKSQMRRQRRQKREKMFAVMKRGHFWEINEMRKEMQEXLHICTT

SEQ ID NO: 119300 - protein, 175 aa, Heterodera glycines
  Coding regions on vcDNA: vcDNA=SeqID_45723; Strand=+; Position=1 -57,1239-1345,1403-1547,2010-2225
  Homolog annotation: Hit_ID=CAE75096.1; Match level="QueryCoverage =90%, HitCoverage=70%, E-value=8e-35, Identity=50%"; Hit description =Hypothetical protein CBG23018 [Caenorhabditis briggsae]
  Essential gene: C elegans homolog=F58F6.4; Phenotype=Emb,Stp,Unc
MRTPAKSIDEIVTNQIARTGPPGCGKTTSVWALARDMLGEKVRDACLELNASDERGIDVVRDRIKRFASTKVTLPENTHKIVILDEADSMTEGAQQALRRIMEALNNLQCTAAGYGTITKDYVYRVCDEPHPEKMCNIFDCCINGRTQEAFDLIDELCCLGYSVDDLVGVMFKTA

SEQ ID NO: 119301 - protein, 58 aa, Heterodera glycines
  Coding regions on vcDNA: vcDNA=SeqID_45724; Strand=-; Position=1-184
  Homolog annotation: Hit_ID=CAE63322.1; Match level="QueryCoverage =100%, HitCoverage=10%, E-value=1e-11, Identity=53%"; Hit description= Hypothetical protein CBG07713 [Caenorhabditis briggsae]
  Essential gene: C elegans homolog=H13N06.4; Phenotype=Gro,Slu,Stp,Unc
MWGWTLWSVELPISEATIRNGRMELVCKATDRSYNTQPETGIALWNVRGLLHNAWHRV

SEQ ID NO: 119302 - protein, 81 aa, Heterodera glycines
  Coding regions on vcDNA: vcDNA=SeqID_45725; Strand=-; Position=1 -51,111-305
  Homolog annotation: Hit_ID=AAO31780.1; Match level="QueryCoverage =54%, HitCoverage=47%, E-value=2e-17, Identity=90%"; Hit description =ribosomal protein L37A [Branchiostoma belcheri tsingtaunese] gb|AAK52799.2| 60S ribosomal protein L37A [Br
  Essential gene: C elegans homolog=Y48B6A.2; Phenotype=Lva
KFIEFTFLFGFVRQQEMAKRTKKVGIVGKYGTRYGASLRKTVKKMEVSQHAKYTCAFCGKVCIPHIMLQFASDKKTDTIKH

SEQ ID NO: 119303 - protein, 311 aa, Heterodera glycines
  Coding regions on vcDNA: vcDNA=SeqID_45726; Strand=-; Position=1 -292,349-992
  Homolog annotation: Hit_ID=AAK61480.1; Match level="QueryCoverage =72%, HitCoverage=60%, E-value=2e-11, Identity=26%"; Hit description =glycoprotein gp2 [Equine herpesvirus 1]
  Essential gene: C elegans homolog=ZK945.9; Phenotype=Gro
MSLLQTQQVNSTAVTTTTTANANCPTWTAATTTMSTVANISGTTMAIAAKPGALKSGLLGIGGASVRGQLTSGSTMVFSGAKTVPTATNAVQQHNQKILANGTISSATTKFAAVVPQRVGSVVAPLTPPIEAKEPQREYTTSTSSITCTTFTTTTEMSASSLDKFADTVNRVAAGTEISPPHPSMQQQIVVAYSSAATATTLASSTAILTTTTTASSTAAAIQPPIATMAKGQPPQLGTERGQQMLKPKAPKKKKAPAAPKAKNGATNGIDEGAEQRNTTTISVVDMQQQQQLQQASKGNCSARATRKLLG

SEQ ID NO: 119304 - protein, 196 aa, Heterodera glycines
  Coding regions on vcDNA: vcDNA=SeqID_45727; Strand=+; Position=1 -163,995-1101,1165-1279,1616-1744,1798-1874
  Homolog annotation: Hit_ID=NP_509669.2; Match level="QueryCoverage =63%, HitCoverage=15%, E-value=1e-14, Identity=35%"; Hit description =metalloprotease precursor family member (85.2 kD) (XK564) [Caenorhabditis elegans] emb|CAB01675.2| Hypoth
  Essential gene: C elegans homolog=C17G1.6; Phenotype=Bmd
MAYNFMKRNSDDSDNLGLTYVWKSAKIILKMKFLIRILARQCITLAKALAKIVKDSPFCSNVGFLMAGKWAGTITTGQLQPNTECYWRIIPHKHEQRIKITITKLEFPCSDACSSYLEVKAKKKKISTGARLCCGTPTTIFSDVDTDVILILKVSNNLNGTFHGANFEYKSVKASITVPQTIQVMYKFNFENLLFF

SEQ ID NO: 119305 - protein, 246 aa, Heterodera glycines
  Coding regions on vcDNA: vcDNA=SeqID_45728; Strand=+; Position=1 -178,255-404,448-623,717-952
  Homolog annotation: Hit_ID=NP_497067.1; Match level="QueryCoverage =92%, HitCoverage=31%, E-value=1e-47, Identity=42%"; Hit description =eukaryotic Initiation Factor (83.1 kD) (eif-3.B) [Caenorhabditis elegans] emb|CAA21681.1| Hypothetical pr
  Essential gene: C elegans homolog=Y54E2A.11a; Phenotype=Lva,Ste
VLLFEYQTKEAANAVLPIRDGHRLDKNHTFSAYPFTAIRSMKEPEKDWKKPERQPYVDLGDPWSWLQNPKCLDQFGLLYESGQGGTLRLDVFWNVRNGEPTPVDNASRENWSNDLFKWSPHGTYLATMNNDKRNQRLGAVIWGGEKFDRFQRFSHEGVNYLDFSPNEKFLVTYACDQNSTRDNENCLRIFEVFTGELKKAFSPSLRSAGRLHDWPFLKWSHDEKFFAFCRLRGNCVNNCSTDDFML

SEQ ID NO: 119306 - protein, 1246 aa, Heterodera glycines
  Coding regions on vcDNA: vcDNA=SeqID_45729; Strand=+; Position=1 -2133,2415-2622,2823-4222
  Homolog annotation: Hit_ID=NP_508269.1; Match level="QueryCoverage =35%, HitCoverage=64%, E-value=2e-42, Identity=27%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MEDFYIVLPSNTPGPGNTASNFTVRLPHTLELDSKWSVALSAIIYPYSFPSISVDEDDSISVKLVNPNYREDAGNSDEESQKFINLSVKIPNVQFQSVQSLQKTLNQIIQNAYDTKFGGSSSLNDGTTNKRAKRQTELSETGAGVIEVENFFTRNPFDYWQQIGELRKKHYQLRERVEKMAKEYNSTADGERKTFLSTELGVFQGRETFLKEHLHLIEEEAKRRDGEQQEANEQRLIDRFFARYPDNYREQLDEWRSSYLRDVLDLQTKMGEYEGVKDLKRLEELNSQTERMRNSIHVFGRKMEILNNAALQRDQKRSQEEFERTSHEQNLTFVQEFFQANPVNYWQAIQKNYEALQLEYTKKRELREKLEFETDATERESLQRQIESIQRLIDYRRKRFAALEYEAKKRDAQTGKTNSGLSAVAEGSNSTSSTPIDSFSPADEPANPDEENATNSKNNHQQNITTTATATLSSETPAEQILADQDNSIDEKDEAGTPPSSGLGQSGDASATSVTQVEDGRNLPQAAALTSNNPKIVAKQSTVATERRKEKIIEKLIDEQVDRMVDGTHAQQKMLQEEGKDNESQHRISTYKLIEEVLHGEHGQLMSQQRESKMAAEFAYNEITQRFGIRMGPGVMHVDLSKQLSYVLGFDRKTRIYNNQSAKYPPDLSGGVRQLYVYAPKLVEDSIIGDRMAPLLRVVNVSGTPGLDMPERGGGLLQNISRFLMPVATNLLKSASKEGISAGTRMLDDLAQGKAFKESLKTQAKQGFENLAEKLNQCGKEKHTNQKTQWKMSVIKKIDKDSVEGLEGSLSLFSLPPTNVAINKTNVRELLPLSALNQTGPYLFRLFSDSQFCDLSKTYMYLLSSIERKNDAGEWVALSDTDPNDKHVGVIQNFASSFVRSLKVNISGIEVFDSSIYYHYRDYIMKELGYSQEIRKAFHEASCYYADDDDQNSATNPGFTARAARFSGGKQCETMVKLNFDLARQSALMLNNQDVIFTIHRNNDSFLLLTPPYKKPDGTQQENKKEYRIRVHDMRLYVRTVDVTPSLNLAISRQLESTSAKYPLRKIEMRSIFLGTGRTELAHNVFTSTLPRRLICTFVSTDAYSGNRKMSPYKFEHANVRSISVEANGQTFPSTPYLLSFDGVQPRFVRAFVDMYAGLGLDDSDTKTVSIGMQRFLNGWAFFVIPLTSTLEDTPGFELIRQGTCTIKVQFEQPIKTDGYEMLVLGEFDSVLSINADRVLSTDGSV

SEQ ID NO: 119307 - protein, 106 aa, Heterodera glycines
  Coding regions on vcDNA: vcDNA=SeqID_45730; Strand=-; Position=1 -132,386-572
  Homolog annotation: Hit_ID=AAC52274.1; Match level="QueryCoverage =71%, HitCoverage=17%, E-value=6e-10, Identity=39%"; Hit description =PAF acetylhydrolase sp|Q60963|PAFA_MOUSE Platelet-activating factor acetylhydrolase precursor (PAF acetylh
  Essential gene: C elegans homolog=C52B9.7a; Phenotype=Emb,Ste,Stp
MGHSFGAASSLSACAEYPSLFNACVLLDAWLYPVERRMYPATVQPVLMLNASKWQWPRNVRRMQRLLAKATTSTNDDKTATETTTTTAPQQQSQDGAATTAALPQP

SEQ ID NO: 119308 - protein, 436 aa, Heterodera glycines
  Coding regions on vcDNA: vcDNA=SeqID_45731; Strand=-; Position=1-1311
  Homolog annotation: Hit_ID=NP_508269.1; Match level="QueryCoverage =99%, HitCoverage=66%, E-value=3e-51, Identity=29%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MAFHKIDNDSVNSITNALDFFRIPPTNVSVSSSKVFELLPSNPLTDTPYHFKLHSSQNYIDLSKCYLLTEFRIRKENANGQLINLDIDDINIAPIQMIGQTFIRNIKMSINGREIFNANALMAYKSYFSHELSYSTTAKDSHLNAAGYYRDTGDTLEMGGGCTARRNLFAGSNVAQFIVKIDTDLFNQPLYLINFCELDIEILPNDNDFVLIAPTGGRYRFEVVGLKMYVKKVSLMDGLALDIARKLELKPARYAVRKTMMKSMFISQGRYEFTANLFMDQIPRRVTMGLVANTDYAGTILRSPFNFQPFNVREISISANGRPYPQAPYDLDYRNGKYVRPFNDMNEAVGFANSTESNGITFAQYGKTHCIYVFNLTNSGDDQAALFDLIKNGTTAVSIKFNQPVPVGGIMLVVMGECDSLVMLDKNRSISTDTTI

SEQ ID NO: 119309 - protein, 1051 aa, Heterodera glycines
  Coding regions on vcDNA: vcDNA=SeqID_45732; Strand=-; Position=1 -114,155-286,697-836,1252-1527,1569-1770,1828-2054,2135-2396,2449 -2674,2724-2845,4000-4228,4287-4421,4470-4660,4724-4889,5118 -5351,6939-7001
  Homolog annotation: Hit_ID=CAE57182.1; Match level="QueryCoverage =99%, HitCoverage=81%, E-value=0.0, Identity=42%"; Hit description =Hypothetical protein CBG00021 [Caenorhabditis briggsae]
  Essential gene: C elegans homolog=C27D11.1; Phenotype=Emb,Ste
MRPNFHQKPEAALQRAYEFLSVGKQKDALQALHDLIKDRRHKQWTQTYEQIMMLDRRHKQWTQTYEQIMMLYIELCVILRNSPLAKDGLYQYKIITQQVSVKSLESVLEKFLQLAEQKAVEAQKHSIEKIEEIDDLDVADVPEKCLLLSVSGAVAQDRMDRTVLSPWLRFLWDAYRNCLDLLRNNVYVENLYHQIARQSFAFCTKYQRRNEFRKLCEMLRQHLVQIQKAQQSTALHPLRIRLSNTESLGHMLETRLIQLDTAIPLRIRLSNTESLGHMLETRLIQLDTAINMDLWQEAFKSAEDLHSFMQLGKEKDKKIIRPTSYANYYEKISLVFWKGGNILFHAASLLQISLVFWKGGNILFHAASLLQRFCIFKDMRRQFGGEEAMDQATRVLLATLSIPEGAESASMLTKHLDIEEQHSANIRILSSLLRLPITPSRSGILKEIVRLNIPELASPAAYALYKCVEMELNPLRTAVNVQMHLSDIEKLGHLEYNQYAEPVKDVVTARVFKQLSALYETLSLTRLLSALYETLSLTRLHKLIPFYEVIELEHRLVNVCKQQSLKARVDHRTKCVRFGHIENGFANDLDEVDTNTSEVGKSFFLGFEGRSHLEEMYKELSGKSFFLGFEGRSHLEEMYKELSQFNTKERSIMQEKVHSKRLENKIFIYQNQKDADFERILARRKRIELYKETNEQVKREKLQKEQAQANKQEEQRRREELKKLQEENKENERRRKLNEQEEIQRKLQSEKLKKYQAHPEEIQRKLQSEKLKKYQAHPFFQQLVKEHGEAIFDKVDPDKLIREKRIRFDAERREQQTKLQNLRIRFDAERREQQTKLQNLEKKYDHTVRAFHLEEMALWKHLSDERQRIYPGLHEAYETKRIEKAVKERELSFEKYAYLKERELSFEKYAYLVSAKEGAKEFMRSVIQSHAEEFKEQQAAWKQRVEEARNKTLKDRAERRKEQRKKEAREAEQQQEHRRRRKRRRSKDRRNSHKSRGKSSSSKRHRHSNSPRRQEDEQQQQAAQSQQQPQKEPTPAKGPKFGPAFYQLSAF

SEQ ID NO: 119310 - protein, 420 aa, Heterodera glycines
  Coding regions on vcDNA: vcDNA=SeqID_45733; Strand=-; Position=1 -210,254-360,463-928,976-1203,1247-1498
  Homolog annotation: Hit_ID=NP_504291.1; Match level="QueryCoverage =96%, HitCoverage=62%, E-value=0.0, Identity=86%"; Hit description =heat shock protein (70.8 kD) (hsp-6) [Caenorhabditis elegans] gb|AAB42371.1| Heat shock protein protein 6 [
  Essential gene: C elegans homolog=C37H5.8; Phenotype=Emb,Lva
MFFRKVVPYKIVKASNGDAWLEAQGKLYSPSQIGAFVLMKMKETAESFLGTSVANSVVTVPAYFNDSQRQATKDAGKIAGLHVLRVINEPTAAALAYGLDKAEDKVIAVYDLGGGTFDISILEIQKGVFEVKSTNGDTFLGGEDFDNVLVHHLVAEFKREQGIDLTKDPMAMQRVREAAEKAKCELSSTTQTDINLPYVTVDSSGPKHMNVKLSRAKFEQLTADLIKRTIEPCKKAMHDAEVKPSDIKEILLVGGMTRMPKVQQTVQEVFGKQPSKAVNPDEAVAIGAAIQGGVLAGHVTDLLLLDVTPLSLGIETLGGVFTKLITRNTTIPTKKSQVFSTAADGQTQVEIKVFQGERDMALDNKMLGQFSLVGIPPAPRGVPQIEVAFDIDANGIVNVSARDRGTGKEQQSLTLRYEEL

SEQ ID NO: 119311 - protein, 333 aa, Heterodera glycines
  Coding regions on vcDNA: vcDNA=SeqID_45734; Strand=-; Position=1 -106,184-338,517-882,954-1208,1272-1391
  Homolog annotation: Hit_ID=CAE75167.1; Match level="QueryCoverage =97%, HitCoverage=62%, E-value=1e-134, Identity=68%"; Hit description= Hypothetical protein CBG23104 [Caenorhabditis briggsae]
  Essential gene: C elegans homolog=H19N07.1; Phenotype=Emb,Lva,Unc
MYLTGMVDKRTLEKYEKEAKEKGRESWYLSWALDTNEEEREKGKTVEVGRAFFETDQKHFTILDAPGHRSFVPNMIAGAAQADLAVLVISARKGEFETGFDRGGQTREHVMLAKTTGVKHMIILVNKMDDPTVNWDVGRYSQIQEELTPFLRKCGFNPKNDIMFMPCSGLTGAFLKERPSSDLCPWYTGMCFLEYIDSLPLIARDFNGPDMGTVVSGKLESGSISKGQTLTLMPNRVSVQVLNSFVNDVETELVYAGDSFQLKIKGVEDTEIMSGFVLCTSDSPCPIGRIFDAEVLILDYKSIITSGFGCVLHIHEAVEEVTVKVTDQFVWPL

SEQ ID NO: 119312 - protein, 184 aa, Heterodera glycines
  misc_feature (177)..(177): Xaa can be any naturally occurring amino acid
  Coding regions on vcDNA: vcDNA=SeqID_45735; Strand=+; Position=1 -152,194-557
  Homolog annotation: Hit_ID=NP_115701.2; Match level="QueryCoverage =89%, HitCoverage=88%, E-value=3e-25, Identity=35%"; Hit description =hypothetical protein MGC11102 [Homo sapiens] dbj|BAC04293.1| unnamed protein product [Homo sapiens]
  Essential gene: C elegans homolog=ZK856.11; Phenotype=Lva
MSKTSKKNFVTKQLVKEIVIPADNEFVGKILASRGNNLHEVETDEGENFLVSMPTRFRKKLWVRRGTYVISMPTRFRKKLWVRRGTYVILQSIEEGDKVRAEIVHVLDPENIAFLMEKEVWPERFIVEAAQLTKRGQRTEENDDSDPENSAEESSSLVSEDVALNGQTNAKDETTIXKKFNFVA

SEQ ID NO: 119313 - protein, 197 aa, Heterodera glycines
  Coding regions on vcDNA: vcDNA=SeqID_45736; Strand=+; Position=1 -308,1103-1202,1386-1470,1555-1655
  Homolog annotation: Hit_ID=AAC47348.1; Match level="QueryCoverage =46%, HitCoverage=32%, E-value=6e-39, Identity=70%"; Hit description =cysteine protease precursor [Onchocerca volvulus]
  Essential gene: C elegans homolog=F32B5.8; Phenotype=Emb
MSTESTTRPLIATSTSHNVRKELETEENRGKKTKLRKKYSDKFNLFAFLFKNVRNFWVQVFIQKDWRADADAVKRRYRDKFLKFLALLLIEISHQKLPIKPGAAEIYHHGPIACGVAATPRFDNYSGGIYKERTNEVVGWGKDAASGVPYWIGRNSWGTAWGEQGWFRVVTSEYRDAGNKYNLKIEEDCTWGEPIII

SEQ ID NO: 119314 - protein, 363 aa, Heterodera glycines
  misc_feature (5)..(5): Xaa can be any naturally occurring amino acid
  misc_feature (18)..(18): Xaa can be any naturally occurring amino acid
  Coding regions on vcDNA: vcDNA=SeqID_45737; Strand=+; Position=1 -204,517-704,747-823,869-976,1055-1161,1208-1284,1704-1807
  Homolog annotation: Hit_ID=CAE60550.1; Match level="QueryCoverage =83%, HitCoverage=43%, E-value=2e-60, Identity=44%"; Hit description =Hypothetical protein CBG04177 [Caenorhabditis briggsae]
  Essential gene: C elegans homolog=K09H9.6; Phenotype=Lpd
QEKLXDKKNLVNQQISVXVLKRNKLKDFVVHSQFLGVSHLIILSRTELSTHLRIIRNPQGPTLHFRVEKYSLARDVLSVQKRPVIYEELFQHAPLVVMNGFSSEDGSKKHLQLVQTVVQNMFPSIDVDRVKLASIRRTLLLNYDTEDGLMIDVDRVKLASIRRTLLLNYDTEDGLMEFRQYSIKSVPAGVSRSAKKLMQSKSIKSVPAGVSRSAKKLMQSKVPDLSKYKDISDFMLKPEQLSDSEFEGEPEQLSDSEFEGEQTELELTQDIGGRGKKRGQQTKLRLMEIGPRMTLRLMKIEEGVNLMEIGPRMTLRLMKIEEGVNAGTALYRVEHSRFATVNFRLFWHTASGSEKSDQSFEKS

SEQ ID NO: 119315 - protein, 216 aa, Heterodera glycines
  Coding regions on vcDNA: vcDNA=SeqID_45738; Strand=-; Position=1 -103,708-839,901-927,1084-1213,2047-2293
  Homolog annotation: Hit_ID=AAS91567.1; Match level="QueryCoverage =89%, HitCoverage=16%, E-value=4e-39, Identity=41%"; Hit description =transformer-1 [Pristionchus pacificus]
  Essential gene: C elegans homolog=Y47D3A.6a; Phenotype=Pvl,Stp
WKGCERGDAPSPAIYMLVQHFRGHTGEKPYKCEWASCEKRYARLENLKTHQRTHTGERPFQCTICGRSFTNISDKMKHEKRVHHEKRVHKKKKQYSCVVLGCANAYTDPSSLRKHTLRSHGTNPWMEYKARRSKVPPNRRRRKRKRSTEANGRISERETVQRELKGQEKGKRKCKRKECKRKRLRQSNPSEKPTFDFFLVDPVSGPSPLFPASLST

SEQ ID NO: 119316 - protein, 115 aa, Heterodera glycines
  Coding regions on vcDNA: vcDNA=SeqID_45739; Strand=-; Position=1 -88,144-184,286-504
  Homolog annotation: Hit_ID=NP_495248.1; Match level="QueryCoverage =73%, HitCoverage=64%, E-value=4e-14, Identity=37%"; Hit description =putative protein family member of bilaterial origin (17.5 kD) (2G537) [Caenorhabditis elegans] gb|AAA6835
  Essential gene: C elegans homolog=T24H7.3; Phenotype=Emb
MAPYVKTIAISEILSRTPELIFLNIVTLENESYCVELTQRGWRLEMHVTYYDAIEQLLDSLSEQYRENFGAALSSKLAALQTEQKQRQQDGESEGNGGGAAERSDAGQRTDDEPN

SEQ ID NO: 119317 - protein, 270 aa, Heterodera glycines
  Coding regions on vcDNA: vcDNA=SeqID_45740; Strand=-; Position=1 -125,190-294,348-458,509-583,679-831,911-986
  Homolog annotation: Hit_ID=NP_497586.2; Match level="QueryCoverage =98%, HitCoverage=21%, E-value=7e-91, Identity=72%"; Hit description =AdaPTin or adaptin-related protein (105.3 kD) (apt-3) [Caenorhabditis elegans] gb|AAF36038.2| Adaptin or
  Essential gene: C elegans homolog=Y71H2B.10a; Phenotype=Emb
RAIGRCAIKVEHSAERCVNTLLELIQTKVNYVVQEAVVVIKDIFRKYPDIFRKYPNRYEGIISTLCENLDTLDEPEARASMIWIIGEYAERIDNADEIIGEYAERIDNADELLESFVEGFHDENTQVQLQLLTAVVKLFLKRPTDTQQLVQRVLTLTAVVKLFLKRPTDTQQLVQRVLTLATQDSDNDSDNPDLRDRGYIYWRLLSADPQAAKEVVLAEKPLISEETDLLEPSLLNQLVCHIGSLVCHIGSLASVYHKPPSSFVDSTIIL

SEQ ID NO: 119318 - protein, 223 aa, Heterodera glycines
  Coding regions on vcDNA: vcDNA=SeqID_45741; Strand=-; Position=1 -247,300-574,632-781
  Homolog annotation: Hit_ID=CAE61909.1; Match level="QueryCoverage =81%, HitCoverage=21%, E-value=4e-21, Identity=31%"; Hit description =Hypothetical protein CBG05905 [Caenorhabditis briggsae]
  Essential gene: C elegans homolog=F49E8.3; Phenotype=Emb
LYTLDVFVPCSSAVCHISPSTDYSNGTSKFNALIEKGVDVVPDLRELIFRAVGSTNDEKIIAALKNLMETSGYAQVELSCVLGLGQCSDLKMLEDIFNYGVIQGKIRDQDLYLLFAATEMAPMACCGHFAWDFFKNNFALLIEKYGSVNSNVFLHCFDCVTSGFCSNAMAEDIMEFFKKELDEHSLKTLERPLRQAVESIKVKESLLKNNVPDLDKYLQNVGY

SEQ ID NO: 119319 - protein, 122 aa, Heterodera glycines
  Coding regions on vcDNA: vcDNA=SeqID_45742; Strand=-; Position=1 -173,520-695,845-880
  Homolog annotation: Hit_ID=NP_871865.1; Match level="QueryCoverage =88%, HitCoverage=30%, E-value=2e-30, Identity=53%"; Hit description =putative endoplasmic reticulum protein family member, with at least 5 transmembrane domains, of ancient o
  Essential gene: C elegans homolog=F28B3.5a; Phenotype=Age
KNMKFKNFLFLMGYMFYHFQVFLNIFQVNEYWFNWSQLLFLIWNAINDPLFGYLQDVGGTWMKDRGKIFTYFGPFLVLSFLITWFPWRSAPNSLEGLHLIVSLFLYDAFFSNFSAFFLAKFD

SEQ ID NO: 119320 - protein, 138 aa, Heterodera glycines
  Coding regions on vcDNA: vcDNA=SeqID_45743; Strand=-; Position=1 -132,196-293,345-489,862-903
  Homolog annotation: Hit_ID=NP_505654.1; Match level="QueryCoverage =80%, HitCoverage=69%, E-value=1e-21, Identity=46%"; Hit description =glucosamine phosphate N-Acetyl transferase (18.5 kD) (gna-1) [Caenorhabditis elegans] emb|CAA94884.1| Hyp
  Essential gene: C elegans homolog=T23G11.2; Phenotype=Emb,Ste
MTSSVHNSPNSVVLPQLPSDYVLRPLSLNDVNFGFIELLEQLTSVKPLSVEQFKERFNQLNEQKPRAYHIYVIEKESTKKIVATATLVLEWKFIHSCGARGRIEDVVVDSEERGKHFGHILNEYLNYKSYTRRSVMNK

SEQ ID NO: 119321 - protein, 76 aa, Heterodera glycines
  Coding regions on vcDNA: vcDNA=SeqID_45744; Strand=+; Position=1 -69,130-288
  Homolog annotation: Hit_ID=NP_496488.1; Match level="QueryCoverage =93%, HitCoverage=19%, E-value=2e-11, Identity=43%"; Hit description =protein RAD23 repair 23 (2L942) [Caenorhabditis elegans] emb|CAA93780.1| Hypothetical protein ZK20.3 [Cae
  Essential gene: C elegans homolog=ZK20.3; Phenotype=Sck,Ste
MPELLFKTITQQSFTIEVEETATIGEVKRKIQQVKGAEYPAENQKLIFNGRMLEDAMLVSELNFAAPKFIVIMVMR

SEQ ID NO: 119322 - protein, 178 aa, Heterodera glycines
  misc_feature (131)..(131): Xaa can be any naturally occurring amino acid
  Coding regions on vcDNA: vcDNA=SeqID_45745; Strand=-; Position=1 -178,468-549,1048-1108,1165-1229,1557-1697
  Homolog annotation: Hit_ID=NP_499164.1; Match level="QueryCoverage =97%, HitCoverage=58%, E-value=2e-41, Identity=45%"; Hit description =xylosylprotein beta 1 4-galactosyltransferase 7, SQuashed Vulva SQV -3 (33.8 kD) (sqv-3) [Caenorhabditis e
  Essential gene: C elegans homolog=R10E11.4; Phenotype=Emb
FAQFLGHHRHRPTTPLHLRSTNQEDAPRFNRAASINIGALEAERVGCDYMAIHDVDIVPLNPNLSYHYPEDGHIMHVAAGQYHPMYDYKNFIGSVLVITLADFKKVDGMSVDGMSNEFWGWGLEDDDFYLXMAGMANKIRRPSNLSTNRSNTFLHLHTRSRQRDFSVDEYRKNKRKGK

SEQ ID NO: 119323 - protein, 232 aa, Heterodera glycines
  Coding regions on vcDNA: vcDNA=SeqID_45746; Strand=+; Position=1 -68,157-301,473-642,721-836,885-1044
  Homolog annotation: Hit_ID=NP_495513.1; Match level="QueryCoverage =98%, HitCoverage=64%, E-value=3e-38, Identity=37%"; Hit description =biogenesis factor 13, PeRoXisome assembly factor PRX-13 (35.8 kD) (prx-13) [Caenorhabditis elegans] gb|AA
  Essential gene: C elegans homolog=F32A5.6; Phenotype=Lva
VHTFRAVAGVAQQFRAFKIYVISFLVSLPIFRWCRFLWRHLLSLLRVRPRNYANSEAIWTNIHQQQQSRAPLSSVPFSSPNFASLFFWLIALGGPFLLFKCVLRLAEREAEANKWTTGQTEHYTAQALFDFCALFDFCAANANELSLTAFDVIRIAPKSAQPNVKDWLLASTLDGSKVGLVPTLDGSKVGLVPINYIKLIGKCNDSANHMTSPNIGLTDNSILFHFVNLNVS

SEQ ID NO: 119324 - protein, 354 aa, Heterodera glycines
  Coding regions on vcDNA: vcDNA=SeqID_45747; Strand=+; Position=1 -252,304-626,1149-1335,1770-1932,2086-2225
  Homolog annotation: Hit_ID=NP_871838.1; Match level="QueryCoverage =81%, HitCoverage=60%, E-value=9e-37, Identity=33%"; Hit description =DEAD/DEAH box helicase and helicase, C-terminal (1G216) [Caenorhabditis elegans] gb|AAO38637.1| Hypotheti
  Essential gene: C elegans homolog=F55F8.2a; Phenotype=Lva
MTECCSSAVSDNGTAPSSSSWAELGLSAATLNALGTMKSRRFSINNFLNYLFSSFSFPFPTPIQNAVIPIAVKLKKDIIGAAETGSGKTLAFAIPILEHWLTNAIATNAQHSPAKGSLFALIISPTRELAVQVDSCICFSLQIAFLTQFSLFCQIKEVLIALSVQIVPRAPKIVAIVGGMSEQKQQRLLKAKDKKEQKIRISIASDQTADPSDGIALPPLQTLIFSATLTFTHHIPLRRGKKEAQQMATDPKQKDSNLLYLLKRHGGRTLVFANSISAIRRMHSLLKKLALPNTALLHGRMKEKERLKTSDDSVLLATDVAARGLDFYGVQNIVHYQCPKTTEVRKNWICSFPV

SEQ ID NO: 119325 - protein, 117 aa, Heterodera glycines
  Coding regions on vcDNA: vcDNA=SeqID_45748; Strand=+; Position=1 -25,439-566,1204-1414
  Homolog annotation: Hit_ID=NP_001008463.1; Match level="QueryCoverage= 95%, HitCoverage=20%, E-value=1e-29, Identity=53%"; Hit description =similar to silencer-associated factor [Gallus gallus] emb|CAG32754.1| hypothetical protein [Gallus gal
  Essential gene: C elegans homolog=Y48G1C.4; Phenotype=Emb,Sck,Stp
SFFNKQKKVRLFHTPKLRGLLKSALPERTNEIVGLQHMKFFVFDDTVLITGANLSDQYFVNRRDRYLLIEDCPLLADFFVDLFRLVGDNSFRLLADGRVEFTAGATHPETGTKMGRG

SEQ ID NO: 119326 - protein, 225 aa, Heterodera glycines
  Coding regions on vcDNA: vcDNA=SeqID_45749; Strand=-; Position=1 -38,542-675,1704-1747,1804-1927,1977-2051,2337-2429,2563-2620
  Homolog annotation: Hit_ID=NP_495709.1; Match level="QueryCoverage =93%, HitCoverage=36%, E-value=1e-49, Identity=49%"; Hit description =zinc finger protein REF-2 family member (51.8 kD) (2I438) [Caenorhabditis elegans] emb|CAA88310.1| Hypoth
  Essential gene: C elegans homolog=F10B5.3; Phenotype=Stp
PNAMFGNSSSEPSAPSLPTSLSLSSAVSSSTSSSSPSSSIYSSGSVNFRPMPNNENQGWCRNKKYIQIVKKGYRCLVCNKVYGRYNSVSYRCLVCNKVYGRYNSVSYHVTIYHRNPPIRCEEEGCQFTTREARYIHFHKYYRHQIALPESEARYIHFHKYYRHQIALPESIDLGNRKCPLLGCKHVSKSPAMLDKHIHRHVADCLKGGAKGQQLMSDRKNDQVGG

SEQ ID NO: 119327 - protein, 229 aa, Heterodera glycines
  Coding regions on vcDNA: vcDNA=SeqID_45750; Strand=-; Position=1 -276,335-546,609-807
  Homolog annotation: Hit_ID=CAA60046.1; Match level="QueryCoverage =98%, HitCoverage=35%, E-value=6e-56, Identity=50%"; Hit description =cytoplasmic intermediate filament protein [Ascaris lumbricoides]
  Essential gene: C elegans homolog=F38B2.1a; Phenotype=Lvl,Unclassified
MEPPSVASSDYRSAISSRPYFSRPRPLSPTRYSSDGGGTRVLKMVSESSSISSRPLSPYPASTTATAIRDAREREKKEMSELNDRLATYIEKVRFLEAQNRKLATDLDFLNKRWGKDTSNVREMYETDLRQAKKLLEETQRQKDELEKKAKAMEEEMDTLKKKNANAVTAHEGDKKLMEELLQSLSSLEAELAMLKRRLEILDEDLKALRRENQHLNGEMQKARTDLDQ

SEQ ID NO: 119328 - protein, 166 aa, Heterodera glycines
  Coding regions on vcDNA: vcDNA=SeqID_45751; Strand=+; Position=1 -196,439-656,1117-1210
  Homolog annotation: Hit_ID=CAE57640.1; Match level="QueryCoverage =83%, HitCoverage=82%, E-value=4e-29, Identity=46%"; Hit description =Hypothetical protein CBG00625 [Caenorhabditis briggsae]
  Essential gene: C elegans homolog=F36A2.7; Phenotype=Emb,Lva
LQICALLSFVASPRPICRISLPFGIAERPKPAKIQLPPPGNEKGHWHYEREYSRDTRYTKPLRGGEFPRSILLEPIKHKELYPMFALPIFAVTLGSVVLLISAFKIEVWLDRTGNTPPWDWARVRDKYWKLPTQMYDPTGVTHERLLVMEQLEDELVEAAQKRGTR

SEQ ID NO: 119329 - protein, 74 aa, Heterodera glycines
  Coding regions on vcDNA: vcDNA=SeqID_45752; Strand=-; Position=1 -165,347-406
  Homolog annotation: Hit_ID=CAD91448.1; Match level="QueryCoverage =100%, HitCoverage=61%, E-value=6e-16, Identity=59%"; Hit description= ribosomal protein S17 [Crassostrea gigas]
  Essential gene: C elegans homolog=T08B2.10; Phenotype=Lva
MKRIERGPVRGISIKLQEEERERRDNYMPEISYLDAQNHQTISTDQETKDMIEYLGLGLNLEVKGPVPTGAGRR

SEQ ID NO: 119330 - protein, 103 aa, Heterodera glycines
  Coding regions on vcDNA: vcDNA=SeqID_45753; Strand=-; Position=1 -63,174-320,488-589
  Homolog annotation: Hit_ID=NP_509231.1; Match level="QueryCoverage =100%, HitCoverage=100%, E-value=3e-52, Identity=99%"; Hit description=histone (his-38) [Caenorhabditis elegans] ref|NP _507034.1| histone (his-1) [Caenorhabditis elegans] ref
  Essential gene: C elegans homolog=ZK131.1; Phenotype=Unclassified
MSGRGKGGKGLGKGGAKRHRKVLRDNIQGITKPAIRRLARRGGVKRISGLIYEETRSVLKVFLENVIRDAVTYCEHAKRKTVTAMDVVYALKRQGRTLYGFGG

SEQ ID NO: 119331 - protein, 213 aa, Heterodera glycines
  Coding regions on vcDNA: vcDNA=SeqID_45754; Strand=-; Position=1 -132,188-413,458-553,599-784
  Homolog annotation: Hit_ID=NP_502293.1; Match level="QueryCoverage =93%, HitCoverage=25%, E-value=4e-82, Identity=66%"; Hit description =cleavage polyadenylation factor specificity (4M854) [Caenorhabditis elegans] pir||T20738 hypothetical pro
  Essential gene: C elegans homolog=F11A10.8; Phenotype=Emb
MGPYISDDNSEIQQPLTMDMALAEPPKHLTDVEEMLIEQRGVRELPFPGMDKSGRGVCLKNEVKACMFGALCPLRHIIKDKQVVCKHWLRGLCKKGDQCEFLHEYDLSRMPECFFFSKYLACSNRECPFRHIDPESKIKDCPWYDRGFCRHGPFCKNRHRRRVLCQFYLLGFCTDGPVCKFSHPSFNLPMPEPAPKLNFRPNYAVTCHNCHER

SEQ ID NO: 119332 - protein, 280 aa, Heterodera glycines
  misc_feature (4)..(4): Xaa can be any naturally occurring amino acid
  Coding regions on vcDNA: vcDNA=SeqID_45755; Strand=+; Position=1 -198,297-404,648-702,744-927,982-1021,1091-1231
  Homolog annotation: Hit_ID=CAE66814.1; Match level="QueryCoverage =95%, HitCoverage=50%, E-value=7e-60, Identity=46%"; Hit description =Hypothetical protein CBG12179 [Caenorhabditis briggsae]
  Essential gene: C elegans homolog=C43E11.4; Phenotype=Emb,Sck,Stp
SLSXGVFTCPTRNLSRKCKVRKMRNSFIWPFPQLAYKREKPHLNVGTIGHVDHGKTTLSAAITKVLSRQKKARFVSYEDIDKGAEERARGVTINIAHIEYESDNRHYAHTDCPGHIDFIKNMITGTAQMDSAVLVIAADDGVMDFIKNMITGTAQMDSAVLVIAADDGVMPQTREHLLLAKQIGLREIIVFVNKTDLVDTDVMELVEIEAREIEARELLTAYGFDGENAKIVFGENAKIVFGSALRALADDDDKCILELINALDGLEEPVRTEVLLGLRM

SEQ ID NO: 119333 - protein, 229 aa, Heterodera glycines
  Coding regions on vcDNA: vcDNA=SeqID_45756; Strand=+; Position=1 -168,212-375,630-738,885-1035,1220-1317
  Homolog annotation: Hit_ID=AAN84839.1; Match level="QueryCoverage =82%, HitCoverage=31%, E-value=8e-20, Identity=30%"; Hit description =Hypothetical protein C43E11.11 [Caenorhabditis elegans] ref|NP _491339.2| putative nuclear protein, with 2
  Essential gene: C elegans homolog=C43E11.11; Phenotype =Gro,Unclassified
MATNSAFERLDDYIWGRADEGEFLRGVVADERLDTEKLLSRVQNIQREMNSRLRQGVEENYPSLLEQVSTIEQLDSAHSHVQREMDAVVRRADALAKTMEEQVNNGEAAIGCEELVDAWRAETDLIRRTEHITEVNAIVKANDKLRHLKWLQYRCLFSLSEMNSRTRQDLVVQLRSALRSLNASGVSAVVKALQQLLVGRSLGTGEDSQTVAAVGQQIAHAIGTVSIVG

SEQ ID NO: 119334 - protein, 295 aa, Heterodera glycines
  Coding regions on vcDNA: vcDNA=SeqID_45757; Strand=-; Position=1 -558,609-935
  Homolog annotation: Hit_ID=NP_498735.1; Match level="QueryCoverage =62%, HitCoverage=44%, E-value=2e-18, Identity=30%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MDGLALDIARKLEVKPARYAVRKTMMKSMFISQGRYEFTSNLFMDQIPRRVTMGLVANADYVGTIRRSPFNFQPFNVREISIVANGRSYAQAPYDLDYPSRKYVRPFNDMNEAVGFAISSESNGITFAQYGKTHCIYVFNLTNSGDDQAALFDLIKNGTTAVSIKFNHPVPDGGIMLVVMGECDSLSACHIILFHKINKMFSKKLGLILFLLRVSLPIVSSSSSSSLREQHTENIYSDYLKNLTLSRHQHEPDYSYSEYLRRLSLFKRTTAIVSTTPAPLTNSSPKSDKLIDERG

SEQ ID NO: 119335 - protein, 432 aa, Heterodera glycines
  Coding regions on vcDNA: vcDNA=SeqID_45758; Strand=-; Position=1 -147,214-303,353-423,469-490,532-695,753-936,1223-1406,1465-1664
  Homolog annotation: Hit_ID=NP_509204.2; Match level="QueryCoverage =93%, HitCoverage=21%, E-value=1e-120, Identity=54%"; Hit description= laminin gamma-1 (XH764) [Caenorhabditis elegans] gb|AAC48152.2| Hypothetical protein C54D1.5 [Caenorhabd
  Essential gene: C elegans homolog=C54D1.5; Phenotype=Bmd,Emb,Lvl
EFAAQPAEKTPSVDPHHYKPSQSSCYDERTQPQRCVPDFINVAFNLEVEVTNTCGVRQPTRFCVQTVTNTCGVRQPTRFCVQTGHIGKGQTSKVCDTTFKAFAHPASTTFKAFAHPASYLTDFNIKDNETWWQSETMAWQSETMAEGIQYPQTVNLEGIQYPQTVNLTLHMHKRYDITYIRLKFASPRPESFVVYKKNRAEDDWIPWQYYSGSCRSTFKLQDKAPILPGSCRSTFKLQDKAPILPGNEAVAQCTREFSDISPLTGGDIAFSTLDGRPSAENFEESEVLQWVAAEQIRISLVRMNTFGDEIFGDSRVLRSYYYGISDFAVGGRCKCNGHANQCVKSTDGEEQLVCDCQHNTAGVDCQQEQLVCDCQHNTAGVDCQQCAPFFVDRPWRPATSMEANECLRRFGLRILTAFDSFVFPSFCTHFCA

SEQ ID NO: 119336 - protein, 54 aa, Heterodera glycines
  Coding regions on vcDNA: vcDNA=SeqID_45759; Strand=-; Position=1 -48,158-230,287-331
  Homolog annotation: Hit_ID=NP_495899.1; Match level="QueryCoverage =100%, HitCoverage=18%, E-value=1e-14, Identity=61%"; Hit description= mitochondrial ribosomal protein L50 like (32.9 kD) (2J221) [Caenorhabditis elegans] emb|CAA92691.1| Hypo
  Essential gene: C elegans homolog=T21B10.1; Phenotype=Lva
HQRRFHPNDKTAPHGGITAFPGEGGKVLGLRNKRLLREYRPKKHWYEFEDVVFD

SEQ ID NO: 119337 - protein, 256 aa, Heterodera glycines
  Coding regions on vcDNA: vcDNA=SeqID_45760; Strand=-; Position=1 -192,261-325,387-511,572-810,884-1033
  Homolog annotation: Hit_ID=NP_491237.1; Match level="QueryCoverage =99%, HitCoverage=82%, E-value=5e-73, Identity=50%"; Hit description =protein phosphatase 1A (34.6 kD) (1E406) [Caenorhabditis elegans] gb|AAB42233.1| Yeast glc seven-like pho
  Essential gene: C elegans homolog=W09C3.6; Phenotype=Ste
MQPTLVRIHPPAVIVGDIHGQFADLKKIFSTHGLPPEQQYVFLGDYVDRGPQSMETIILLFCYKVKYPSNFMLLRGNHECANINRVYGFYDEIDRRYPRPGARRLFDLFNQVFAWMPFVGLVGEKILCMHGGISNQIRSLDQLSNLLRPQTEPLLRSLEIDLLWADPSTSITGVAPNNRGAGVMFGADVVESVRNLLGIDYIVRAHQLVMDGVEYFANRHLITLFSAPRYTGKNNTGATLLIAPDLSHTITRFPPA

SEQ ID NO: 119338 - protein, 341 aa, Heterodera glycines
  Coding regions on vcDNA: vcDNA=SeqID_45761; Strand=+; Position=1 -174,238-612,677-856,913-1029,1088-1267
  Homolog annotation: Hit_ID=AAP94888.1; Match level="QueryCoverage =95%, HitCoverage=98%, E-value=1e-75, Identity=47%"; Hit description =P34 [Ascaris suum]
  Essential gene: C elegans homolog=R90.1; Phenotype=Lva,Unc
MEELVALSPGIRVGRWTITKKLGAGAFGAVYLCVNDQGEQAALKTEPVNTPHPLLVMEAHVMTKLDTLRDGDGKHFCRCLDLGRDEQKDQQSGQMKKFNYIVMSLVGRGLDGVVKDAGGRLSLGSAVGVSIQMLAALRGLHTVGYLHRDIKPGNATIGRPESNEIRLLYLIDFGMARKYTRDDGSHHRPRTATNFRGSPRYAAISAHLGREYSRKDDIESWFYCMIELFKGALPWASVVGMNEIGEAKVKRQKKQPEAVRRQAIADLLSGCPNEFGQVLKYIDDMKYTDKPDYDWIIATLRSSLSNAGVQEFPYDWETGKRNAAPGGGGGGGGGGGDSYFN

SEQ ID NO: 119339 - protein, 208 aa, Heterodera glycines
  misc_feature (10)..(10): Xaa can be any naturally occurring amino acid
  misc_feature (191)..(191): Xaa can be any naturally occurring amino acid
  Coding regions on vcDNA: vcDNA=SeqID_45762; Strand=+; Position=1 -135,391-549,896-1226
  Homolog annotation: Hit_ID=CAE61757.1; Match level="QueryCoverage =78%, HitCoverage=16%, E-value=8e-42, Identity=51%"; Hit description =Hypothetical protein CBG05716 [Caenorhabditis briggsae]
  Essential gene: C elegans homolog=T22D1.9; Phenotype=Emb
LLSNAEIDAXDLLIETDQLDKLLELVKEPKFADMDYGRICLYLLSCVPFMPDPENTKLIKVAKELYLNYGKQIEALRCAMKMNDVGAVSAIFGECKDRTLKMQMAMMLGRQQIFLELPDGEDGLLGELNANSHLHKHFLALARELDIMTPKSPDDVYKMHLEQARPFTHQVGTTARVYSSIFNTFYENLYXVFLPDSKKLKKECMYVY

SEQ ID NO: 119340 - protein, 379 aa, Heterodera glycines
  Coding regions on vcDNA: vcDNA=SeqID_45763; Strand=-; Position=1 -768,814-1182
  Homolog annotation: Hit_ID=NP_498735.1; Match level="QueryCoverage =97%, HitCoverage=89%, E-value=4e-41, Identity=27%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
IHPITSYVDLSKVFVCTEFKLKKVADDGVVVDVPANAAVGLIQMPGATFIRNLKVHINQREVYDSNQLYSYKVFLDTELSYPVTAKDSYFGVAGYFRDSDPTKVNDRRKKAVEESKGFQAISKLSADIFNQDLYMISNVEIDIELALQSDDFMIHQEAANRDKYTLEIVDCRLIVKTVDLMDGLSLDIAKKLDLEPARYGIRKTLMKSLFITGGRYDFSANLFTEEVPRRVIIGLVPNQNYIGHNQKNPFYFNHHNVRDIELTASGRTYPQFPYNLDYKNNRYARAYHDTQEHLGMACTTESNGISYSMFKTAYCLYVFQMTNAQEDSPGFELIKEGCTAVNIRFAEAVPNEGVTLIAYAEADGLILIDRNRSITSDLT

SEQ ID NO: 119341 - protein, 177 aa, Heterodera glycines
  Coding regions on vcDNA: vcDNA=SeqID_45764; Strand=+; Position=1 -104,1131-1294,1371-1411,1958-2182
  Homolog annotation: Hit_ID=NP_499680.1; Match level="QueryCoverage =38%, HitCoverage=6%, E-value=4e-11, Identity=55%"; Hit description =UNCoordinated locomotion UNC-71, ADAM (disintegrin plus metalloprotease) protein (114.2 kD) (unc-71) [Caen
  Essential gene: C elegans homolog=Y37D8A.13; Phenotype=Unc
MSDYFEGAKPADEQCFLHNSRGLEYGHCGRDVEGRRKSSVRAYGREQNGQAKVADEEDCGKDEGTAGRAIKFGQMPSYREEKMKRKANKKIYGALQRITEANEGVGTFAAPPPRLPHIQMLMRRLEGSMGEEFDVDEEGHISSRTPSVGGNIPCPAASTDSGHPGSNFDVSGMERVP

SEQ ID NO: 119342 - protein, 155 aa, Heterodera glycines
  Coding regions on vcDNA: vcDNA=SeqID_45765; Strand=+; Position=1 -67,150-316,410-488,689-843
  Homolog annotation: Hit_ID=NP_497890.1; Match level="QueryCoverage =66%, HitCoverage=27%, E-value=3e-27, Identity=50%"; Hit description =swi Snf related matrix associated actin dependent regulator of chromatin subfamily b member 1 (42.8 kD) (
  Essential gene: C elegans homolog=R07E5.3; Phenotype=Emb
MFKTYGPRPESFTLDDGERYYVGADVGQYLKYHRGTLYKRYPQLWKRMASVEEKKKIQELGCATSYINSNIMLVKANEVEDIFDGQEEKYRASVSGGSAYGRAEGTVPGFFLGGGTAALGDDLLFLLLNLHEEGLGGRTNKENRKVLVRSRFVLS

SEQ ID NO: 119343 - protein, 188 aa, Heterodera glycines
  Coding regions on vcDNA: vcDNA=SeqID_45766; Strand=+; Position=1 -67,134-273,483-559,634-807,1273-1380
  Homolog annotation: Hit_ID=NP_609217.1; Match level="QueryCoverage =100%, HitCoverage=68%, E-value=2e-61, Identity=54%"; Hit description= CG17293-PA [Drosophila melanogaster] gb|AAF52654.1| CG17293-PA [Drosophila melanogaster] gb|AAL39226.1|
  Essential gene: C elegans homolog=C33H5.7; Phenotype=Pvl
TIRYLSLYDNKYLRYFGGHSKKVVTLCMSPLDDLFLSGSMDKTIRLWDLKSSNCQGLMQLVSRPIAAFDPEGLIFGAGIGNDVIKLYDLRSFDKGPFNTFKINDTGLNCNWTGMKFSPDGKSILIMTDGGMLRLVDAYYGNVTHTLSHENPKESGRKIREIPTSHSGNIEQVAFNPKYFMLASACTQL

SEQ ID NO: 119344 - protein, 171 aa, Heterodera glycines
  Coding regions on vcDNA: vcDNA=SeqID_45767; Strand=-; Position=1 -69,131-378,424-466,537-692
  Homolog annotation: Hit_ID=CAE75060.1; Match level="QueryCoverage =92%, HitCoverage=8%, E-value=9e-52, Identity=62%"; Hit description =Hypothetical protein CBG22974 [Caenorhabditis briggsae]
  Essential gene: C elegans homolog=K12H4.8; Phenotype=Rup,Unc
MIEKFVNFCKQKDFLHCANFDDEIFMVTEDEIDEGHEEDVEVPKAMGDIFESVAGAVYLDCGMDLDIVWRVFYGLMHEVIEKCCTNPPQSPVRELFERKNCKAKFAKLERKLETGKVRVTVTVNDNLQFTGMGRGYRIAKCTAAKRALQHLRKLDAEKIKKEADKNVPSTI

SEQ ID NO: 119345 - protein, 558 aa, Heterodera glycines
  misc_feature (1)..(1): Xaa can be any naturally occurring amino acid
  Coding regions on vcDNA: vcDNA=SeqID_45768; Strand=-; Position=1 -256,339-493,541-947,1342-1477,1511-1617,1665-1828,1886-2092
  Homolog annotation: Hit_ID=CAE67118.1; Match level="QueryCoverage =99%, HitCoverage=61%, E-value=1e-139, Identity=53%"; Hit description= Hypothetical protein CBG12532 [Caenorhabditis briggsae]
  Essential gene: C elegans homolog=D1081.8; Phenotype=Emb
XDEILKAAIMKYGKNQWSRIASLLHRKSAKQCKARWYEWLDPRIKKTEWSREEDEKLLHLAKIMPTQWRTIAPIVGRTAAQCLERYEHYEHLLDEAQRRAEGIDEADTMKEAKKLKPGDVDPTPETKPARPDPIDMDEDELEMLSEARARLANTQLEMLSEARARLANTQGKKAKRKAREKQLGEARRLASLQKRRELRAAGIMIGSGFAYKMRRHRLLDYNAEVPFEKEVPAGFHDPGEDFDKRQRTMVEDRRRDWQERDDRRKDKDKLRKRKYCLTGIALIQTKSQTKHEKKRSKLLLPEPQISDKELDDIIKIGHASDSVRELVDDNPTRLSFFSTLLHDYNESSRVSAISARTQRTTRLSFFSTLLHDYNESSRVSAISARTQRTPAGAIDSVARAADDLLALTNVETPAADDLLALTNVETPLKGGLNTPLHTLDFSAPGTTRQPIATPNTVLSSVAATPKNINSGLSAQFGLRPTPAHSSTVINSGLSAQFGLRPTPAHSSTVAGTPFRDQLNINPSEGRMNRKELQKQFETLPKPRNEFELAPIAEDEEER

SEQ ID NO: 119346 - protein, 380 aa, Heterodera glycines
  Coding regions on vcDNA: vcDNA=SeqID_45769; Strand=+; Position=1 -87,137-236,794-898,1017-1167,1230-1416,1783-1850,1932-2002,2062 -2207,2369-2596
  Homolog annotation: Hit_ID=NP_989988.1; Match level="QueryCoverage =83%, HitCoverage=82%, E-value=1e-120, Identity=61%"; Hit description= mitochondrial branched-chain alpha-keto acid dehydrogenase E1-beta subunit [Gallus gallus] dbj|BAB32666.
  Essential gene: C elegans homolog=F27D4.5; Phenotype=Unc
MLSLYTMLEFSLLVLNGIAIINRERVLNKYLKNRQHSFGAESEQSVVFRLVNLIFAVQTVLRVTERLNLCQSINKAMHIAMEEDKNTICFGEDVAFGGRERVFNTPLCEQGIVGFGIGYAVAGHRAIAEIQFADYIFPAFDQVPCRQIYLTIKCPFPQIVNEAAKFRYRSGNQWACGGLTIRATWGAVGHGALYHSQSPEAYFGHTPGLKVVIPRGPIQAKGLLLSCIESPDPNAVEEVPIDKYLLPLGKAEVVKLGTDVTLVGWGTQLHVLLETAELAQQRLGVSCEVIDLQTILPWDVETVAESVAKCGRLLVSHEAPITSGFAAEIASTIQQRCFLSLEAPIARVCGWDTPFPHVYEPFYLPSKWRCLEAIRGLIDY

SEQ ID NO: 119347 - protein, 889 aa, Heterodera glycines
  Coding regions on vcDNA: vcDNA=SeqID_45770; Strand=+; Position=1 -90,139-222,270-397,440-587,633-844,1048-1193,1417-1488,1540 -1714,1780-1846,2027-2315,2458-2625,2683-2854,2903-3176,3244 -3392,3600-3684,3749-3833,3880-4091,4217-4330
  Homolog annotation: Hit_ID=AAK94490.1; Match level="QueryCoverage =100%, HitCoverage=100%, E-value=0.0, Identity=86%"; Hit description =PAZ/Piwi domain protein [Heterodera glycines]
  Essential gene: C elegans homolog=F55A12.1; Phenotype=Emb
MATTTAAEIPRKSPQQRKREEMAQLLESRKVDQGATFVEPRKPSGTAGQKGRMKLITNAHILKLLGTQAIYHYEVTINAVSSRSDRKFCVSEPSGPRDRDDFPLLNRRDKCREVFSAFYRTMEQSLKDTGNLLYYDLSKTIFTLKKLQIESEGKFMFNIGTVPTAERPDAARFKHYEFIIRPATGFEVNDLSFITNDVSKMERSLEQFLDIATAQKANMDGKQFIGFTSSRVYLLAPTDYGFGANECPVFDSNHSFLGVGVNKGCRIVEENQGRFETGDFTQSDYEALCNGLVGIYAEPRYGTSGRFFRISDITKPNTGNGLNSENTYITHQVSGKISVKQYFEDTYQKTLQYPKAPLLVNYRRIGDPAYYPMEEMIKETAIPPTVLRVHNERVKESLQLVNNEYLTKASVHFDTTPLHVDYRVLGPPATLYRNNHRVTPAASNCEWRPGDALVNAQIGNWVAYAFGNPAGEMRNKGIVCVPPVRVSFCWFTSVNEVLNVLHKEALNGVEFCLIGHAKGFEGDDVHVTIKAFEQQTEIVTQAITFDVLKDVLDKGSPLTVANCIHKTNVKMGGLNYALHMDDPSVAQLFDGQTLFLGFAMNFPGGFAPSESAAPINGANGSVPSGSKAGPTLQNGANGVAATGANTIPLGSNGNVVPSAPVPRVGSSLPPPSCIGWAATIGKRHKDEYIGDFVYQAPRREEKIDVIASVVRRCIESFKKNRNKLPYEIPLVKKELEELGCTAKLTVIVPNRLQDVRFLRQDAKPEDKSNEQNIPPGTVVDTVVVHPKRSEFFLNSHVAIKGTACTPHYTVLRDENDMSMDTLQTMVHYLCFGHQIVTKPTSLPSPVYIADEYLFAKNKGVEWPLRTYADMTKVLSFLNTTYLRELRINA

SEQ ID NO: 119348 - protein, 199 aa, Heterodera glycines
  Coding regions on vcDNA: vcDNA=SeqID_45771; Strand=-; Position=1 -145,484-588,843-977,1547-1628,2006-2138
  Homolog annotation: Hit_ID=CAB48391.1; Match level="QueryCoverage =99%, HitCoverage=99%, E-value=5e-99, Identity=87%"; Hit description =peroxiredoxin [Globodera rostochiensis]
  Essential gene: C elegans homolog=F09E5.15; Phenotype=Sck,Sma
MSSSSKAFIGKPAPNFMADAVVNGDFQTISLEQFKGQYVVLFFYPLDFTFVCPTEIIAFSDKAGEFKKIGVQLIACSTDSKFCHLEWINKPRKQGGLGEMNIPVLADTSHKISRDYGVLMEEAGIAYRGLFIIDDKGVLRQITINDLPVGRSVDETLRLVQAFQYTDKHGEVCPANWQPGTDTIKPDPKGSQAYFDKKG

SEQ ID NO: 119349 - protein, 106 aa, Heterodera glycines
  Coding regions on vcDNA: vcDNA=SeqID_45772; Strand=+; Position=1 -114,177-380
  Homolog annotation: Hit_ID=NP_498134.1; Match level="QueryCoverage =83%, HitCoverage=17%, E-value=8e-11, Identity=42%"; Hit description =putative nuclear protein, with a coiled coil domain, of bilaterial origin (52.8 kD) (3G399) [Caenorhabdit
  Essential gene: C elegans homolog=F52C9.7; Phenotype=Dpy,Emb,Sle
MADEAQSPPKDGGGKNMQWMYEGAKSVVNREDYLLGKKIDKNFEMFSDVVVHDQEEEKRDAFFQQSLLKPSTSAHTAAPFVARNQHKVSALDTRVVRTEDPLVALK

SEQ ID NO: 119350 - protein, 313 aa, Heterodera glycines
  Coding regions on vcDNA: vcDNA=SeqID_45773; Strand=+; Position=1 -86,554-820,1291-1614,1678-1942
  Homolog annotation: Hit_ID=NP_505402.1; Match level="QueryCoverage =86%, HitCoverage=40%, E-value=9e-80, Identity=59%"; Hit description =glycoprotein V like (63.5 kD) (5J766) [Caenorhabditis elegans] gb|AAA82419.1| Hypothetical protein ZK682.
  Essential gene: C elegans homolog=ZK682.5; Phenotype=Gro
TDQSAYDSDHSAAYRPRTKRTAFGNNFEYFFRFFKPKCQFPSREVLQKLEFRGNKLTDQSLNEGGAAGEGGQQQGMFGALKNLQELSLETNGLSAVPSVALSAQRGTLTNLNLGLNQIKEVPVGALNFPELTSLSLEFNGLPMIVPHAFQHVPRLQYLYLTGNKFPAWSPDMFRFVPDLRTLGIGETPISVIPANAFIVCLFGLILKDGHSFQHTPNLMRLEMSEAAVDSIEPGAFQRTPMIQAIVLNKNRLTRQWSMSILNIQQLFRVRADIFQGLGELYSLDLQGNRLEEVEPRGFANLAALRHLDIRSGF

SEQ ID NO: 119351 - protein, 1849 aa, Heterodera glycines
  Coding regions on vcDNA: vcDNA=SeqID_45774; Strand=-; Position=1 -1366,1449-2134,2417-2624,2825-4216,4268-4408,4774-5735,5844 -6158,6218-6695
  Homolog annotation: Hit_ID=NP_508269.1; Match level="QueryCoverage =24%, HitCoverage=68%, E-value=8e-42, Identity=26%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MEDFYIVLPSNTPGPGNTASNFTVRLPHTLELDSKWSVALSALIYPYSFPSISVDEDDSISVKLVNPNYREDAGNSDEESQKFINLSVKIPNVQFQSVQSLQKTLNQIIQNAYDTKFGGSSSLNDGTTNKRAKRQTELSETGAGVIEVENFFTRNPFDYWQQIGELRKKHYQLRERVEKMAKEYNSTVDGERKTFLSTELGVFQGRETFLKERLHLIEEEAKRRDGEQQEANEQRLIDRFFARYPDNYREQLDEWRSSYLRDVLDLQTKMGEYEGVKDLKRLEELNSQTERMRNSIHVFERKMEILNNAALQRDQKRSQEEFERTSHEQNLTFVQEFFQTNPVNYWQAIQKNYEALQLEYTKKRELREKLEFETDATERKSLQRQIESIQRLIDYRRKRFAALEYEAKKRDAQTGKTNSGLSAVAEGSNSTSSTAPDSFSPADEPANPDEENATNTDQDNSIDEKDEAGTPPPSSGLGQSDAAATSVTQVEDGRNLPQAAALTSNNPKIVAKQSTVATERRKEKIIEKLIDEQVDRMVDGTHAQQKMLQEEGKENESQHRISTYKLIEEVLHGEHGQLMSQQRESKMAAEFAYNEITQRFGIRMGPGVMHVDLSKQLSYVLGFDRKTRIYNNQSAKYPPDLSGGVRQLYVYAPKLVEDSIIGDRMAPLLRVVNVSGTPGLDMPERGGGLLQNISRFLMPVATNLLKSASKEGISAGTRMLDDLAQGKAFKESLKTQAKQGFENLAEKLNQCGKEKHTNQKTQWKMSVIKKIDKDSVEGLEGSLSLFSLPPTNVAINKTNVRELLPLSALNQTGPYLFRLFSDSQFCDLSKTYMYLLSSIERKNDAGEWVALSDTDPNDKHVGVIQNFASSFVRSLKVNISGIEVFDSSIYYHYRDYIMKELGYSQEIRKAFHEASCYYADDDDQNSATNPGFTARAARFSGGKQCETMVKLNFDLARQSALMLNNQDVIFTIHRNNDSFLLLTPPYKKPDGTQQENKKEYRIRVHDMRLYVRTVDVTPSLNLAISRQLESTSAKYPLRKIEMRSIFLGTGRTELAHNVFTSTLTRRLICTFVSTDAYSGNRKMSPYKFEHANVRSISVEANGQTFPSTPYLLSFDGVQPRFVRAFVDMYAGLGLDDSDTKTVSIGMQRFLNGWAFFVIPLTSTLEDTPGFELIRQGTCTIKVQFEQPIKADGYEMLVLGEFDSVLSINADRVLSTDGTQLEIILKRLHPTKNKFIGVFPSDRIPKRVSKFPHCMVVNTDKEGTRGLVLSRVPSLLQSELINVDLTVDNQNYFDSGKYRTFSKDATAAQHFGYSWNTACRIEKCERDSEWAVSLQNVYTLHSYQSVFFEMKSLVKMSPLACFEYNGHSFTFFEDSESGETTIFRGHQHKIVQRLSKHGRIVFDHLSGRLFLIDKYQRRISEIELEYLEHWWLRKNQSSAHTILKSNFVAFLPPDKSDFTMVDNHVFVIRDQRIYKFYIADYAKGNRALTFVTNSNDVRFNYLIYKPKDQNASRGVFAHLRMSDAWIPISYLFNLFLIVLCTYILKQLRRVDRKSPLNVSDSADYYSSPFIDDAYSSQHQQLLNIPYKSYFISIIVTIYLPGYCMQRAIRYLIDSYGLSSVDDLYTCLKEEIKSGPEGGNCLYPNPLCAVDCVHISNEDYPNQPVHIDGSLELIADVELYSTCYPKRKFEGIERTSVCGAEGPEDLSGRLAAVSITPFRTTEQQQQQHEPDSRRAGSIQLLERRRTRKRDYNLVRVLCRFNNCGPYRLAKQLQKRRMENLTYLNQLDIETAHLRKNIKVIPDALCPNGANRVFAYRGFLGITVQQHLYSRHRVTLKYPGLPCVVQFGGGYH

SEQ ID NO: 119352 - protein, 566 aa, Heterodera glycines
  Coding regions on vcDNA: vcDNA=SeqID_45775; Strand=+; Position=1 -266,363-974,1073-1319,1405-1540,1585-1712,1772-1859,1913-2018,2080 -2194
  Homolog annotation: Hit_ID=CAE64340.1; Match level="QueryCoverage =99%, HitCoverage=59%, E-value=0.0, Identity=55%"; Hit description =Hypothetical protein CBG09023 [Caenorhabditis briggsae]
  Essential gene: C elegans homolog=ZK328.2; Phenotype=Emb
MDSDLYDEFGNYIGPELDSDDDEEIQPVGGNEEEEEQKDDIMEQVNLIVQTKNHFHKRRMRKRTENRQLFLAVKLCCTRTRNIMPLPWKWPALLFRRKTINVSKCQAQEHLLPETVYKKDFLVDMTNHPELIRNIAIAGNFHHGKTAFIDCMVEQTHPDFFRYEDRDVRFTDTLFIEQQRGCSIKALPITLVMQNSRNKSFLLNIFDTPGHVNFSDECTAAFRLVDGVVIMVDVHEGLMMNTERLLRHAIQEHLPITICLNKIDRLILELKLPPADAYAKLKFTLDQINNFVQTFGEDDIPLFSPLMGNVIFASGRYSICFSLESFANIYAAKHSQLNAEKFSRRLWGDMFFDTALKKFTKKPQLGGATPTPRSFVVGDVDTCLPKLQQHLGIKLNKEEQRMNVRPLITLICQRFFGSFTSFVDLVVNNIKSPIENGPRKVQHCYSGDATSQLPTELANCSPNGPLYIHTTKNYATQDTTAFHVLGRVFSGTIHSGDEVKILGENYSIQDEEDCRVMTVGRLWLPVARYTVEVNSVGAGCLVLMEGIDQPVTKTCTIVEKDYDQDE

SEQ ID NO: 119353 - protein, 149 aa, Heterodera glycines
  Coding regions on vcDNA: vcDNA=SeqID_45776; Strand=+; Position=1 -199,428-678
  Homolog annotation: Hit_ID=AAR06361.1; Match level="QueryCoverage =79%, HitCoverage=69%, E-value=1e-13, Identity=45%"; Hit description =histone H3.2 protein [Oryza sativa (japonica cultivar-group)] ref|XP_ 493701.1| histone H3 [Oryza sativa (j
  Essential gene: C elegans homolog=ZK131.7; Phenotype=Emb,Gro
MARTKQTARKTQSQKGFSSSSGSQHMQSQLHNLRKQLATKRPNPKRGIGYKELPPVKIAQKRHHKKGALALKEIRKYQKSVNLLIPRRPFMRLVREVTQDMSQSTDLRWQGLALLAIQVFANPSSLSVVTQTGQSCFISTENFFETRKF

SEQ ID NO: 119354 - protein, 231 aa, Heterodera glycines
  Coding regions on vcDNA: vcDNA=SeqID_45777; Strand=+; Position=1 -52,106-201,247-308,372-420,461-516,603-668,850-954,1008-1034
  Homolog annotation: Hit_ID=CAE71615.1; Match level="QueryCoverage =95%, HitCoverage=98%, E-value=9e-70, Identity=64%"; Hit description =Hypothetical protein CBG18577 [Caenorhabditis briggsae]
  Essential gene: C elegans homolog=Y75B12B.2; Phenotype=Emb
SARPKVFFDVMVGGKSTGRIVMELFSDIRIVMELFSDIVPKTAENFRALCTGEKGMGKSGKPLHYKGSKFHRVIPSFMLQSGKPLHYKGSKFHRVIPSFMLQGGGGDFTRGNGTGGESIYGEKFPDENFKEKHEKFPDENFKEKHTVPGLLSMANASMANAGPNTNGSQFFITTVKTEWLDGKHVVFGRVVEGMDVVKQVEAQGNQSGKTANEITIADCGQLITIADCGQL

SEQ ID NO: 119355 - protein, 136 aa, Heterodera glycines
  Coding regions on vcDNA: vcDNA=SeqID_45778; Strand=+; Position=1 -89,566-660,721-765,819-933,992-1057
  Homolog annotation: Hit_ID=NP_510512.1; Match level="QueryCoverage =99%, HitCoverage=27%, E-value=6e-42, Identity=57%"; Hit description =putative protein family member, with a coiled coil-4 domain (60.0 kD) (XP722) [Caenorhabditis elegans] em
  Essential gene: C elegans homolog=F09B12.1a; Phenotype=Mlt,Prz,Unc
AALNCDFEGQPCCWANVPTPTDDQIDWVQIAYATSASPSDEAQLSSCAIACASSSIRVRARHMQTTNVLLQVCQRESFPPSLGFNPLLNCQEFPTSSDRMINTELVLPKASYVDIIIVASNFINERGDIALLDDIQ

SEQ ID NO: 119356 - protein, 300 aa, Heterodera glycines
  Coding regions on vcDNA: vcDNA=SeqID_45779; Strand=-; Position=1 -183,232-404,452-555,614-853,916-1025,1112-1201
  Homolog annotation: Hit_ID=AAL78223.1; Match level="QueryCoverage =44%, HitCoverage=53%, E-value=9e-26, Identity=49%"; Hit description =hypothetical protein Hgg-29 [Heterodera glycines]
  Essential gene: C elegans homolog=ZC373.5; Phenotype=Unc
MPLKALRGISPCTKSTYDREEKEELRAALKKEEEAKKKLEIRKKMSVVVERVNDDGTEGWSDNVPITKARMAELIRHFYNLGWMRDNGAGMAVRFKCPKTGELLILNSSNSLAKEIFNENEHFVMKSAGTILKRPADPDRTPTAPYYLLRDNPDLVCVVHTHTKWGNLITQLIQGDKFMISGQEMIQVKPSRTDGQNWASFLFQLRGAKTVRPNAEWKMLTLWWCRSSKRKSTTSTDEDFVQISRSEWRSRPGARLLRIRQQHVATDQNDVGVLRISVRVGLRNAALEVPLVKNDEDQNT

SEQ ID NO: 119357 - protein, 86 aa, Heterodera glycines
  Coding regions on vcDNA: vcDNA=SeqID_45780; Strand=+; Position=1 -141,744-860
  Homolog annotation: Hit_ID=CAE71175.1; Match level="QueryCoverage =97%, HitCoverage=63%, E-value=2e-26, Identity=55%"; Hit description =Hypothetical protein CBG18032 [Caenorhabditis briggsae]
  Essential gene: C elegans homolog=F35G12.9; Phenotype=Mei,Ste
FQVRIKRLDIVGSWRWVDGKEDACGICRTPFETCCMDCKFPGDECPLVLGQCKHPFHMHCIVKWTNTQSGQKPACPLCRQEWKFAT

SEQ ID NO: 119358 - protein, 173 aa, Heterodera glycines
  Coding regions on vcDNA: vcDNA=SeqID_45781; Strand=+; Position=1 -162,741-1038,1690-1749
  Homolog annotation: Hit_ID=CAE70231.1; Match level="QueryCoverage =37%, HitCoverage=17%, E-value=2e-19, Identity=76%"; Hit description =Hypothetical protein CBG16718 [Caenorhabditis briggsae]
  Essential gene: C elegans homolog=ZC247.3; Phenotype=Gro
MDCGNKRPRTTISAKSLETLKLAYQDSKKPARHVREQLASQTGLDMRVVQVWFQFHCPQKDNERRLAAAHHQHQHGGGGAGVGADPHHRSGSGSTVSSSGGGGCGGGPGSVSGSSGMPMGTGAMLFGRSGGSGGGALGDSDSGASNEAESPFYAYTNPEASSDVDGHSMSEFY

SEQ ID NO: 119359 - protein, 96 aa, Heterodera glycines
  Coding regions on vcDNA: vcDNA=SeqID_45782; Strand=+; Position=1 -15,197-472
  Homolog annotation: Hit_ID=AAN78300.1; Match level="QueryCoverage =100%, HitCoverage=14%, E-value=3e-51, Identity=100%"; Hit description=heat shock protein 70 A [Heterodera glycines]
  Essential gene: C elegans homolog=F26D10.3; Phenotype=Lva,Ste
MEDSNLKDKISEDDKKKVLEKCGEVLAWLDANQAAEKEEFEHQQKELEGICNPIITKLYQAGGAMPGGPMPGGGMPGGGGAAGAGGAGGPTIEEVD

SEQ ID NO: 119360 - protein, 123 aa, Heterodera glycines
  Coding regions on vcDNA: vcDNA=SeqID_45783; Strand=+; Position=1 -142,216-308,366-502
  Homolog annotation: Hit_ID=P46436; Match level="QueryCoverage=96%, HitCoverage=56%, E-value=7e-23, Identity=51%"; Hit description =Glutathione S-transferase 1 (GST class-sigma) gb|AAB30767.1| glutathione S-transferase, AsGST1 [Ascaris suum,
  Essential gene: C elegans homolog=R05F9.5a; Phenotype=Unclassified
MVQQYKLYYFDLRGVVEPIRLLLHYVGQPFEDIRFKDFEEWEKTYKPKFFYGKAPVLEVDGKPLAQSSAILRYLAEKFGLAGKDECEKAKANEIIDFQKDANSELMPYLMVKIGRQEGDLVKK

SEQ ID NO: 119361 - protein, 117 aa, Heterodera glycines
  misc_feature (40)..(40): Xaa can be any naturally occurring amino acid
  Coding regions on vcDNA: vcDNA=SeqID_45784; Strand=+; Position=1-516
  Homolog annotation: Hit_ID=NP_741301.1; Match level="QueryCoverage =82%, HitCoverage=18%, E-value=5e-26, Identity=58%"; Hit description =RNA-binding region containing 2 like (47.5 kD) (4B771) [Caenorhabditis elegans] gb|AAM97977.1| Hypothetic
  Essential gene: C elegans homolog=Y55F3AM.3a; Phenotype =Gro,Pvl,Stp,Unc
MPFTPRRSPPRDARMDMTSEERDERTVFILQVGSSFSDYXEILLIKLARQTRPRDLEEFFSSVGHVRDVRVITDTKTRRSKGIAYVEFWEREAVPLVTFFLLKWANPHKEFACIPPT

SEQ ID NO: 119362 - protein, 208 aa, Heterodera glycines
  Coding regions on vcDNA: vcDNA=SeqID_45785; Strand=-; Position=1 -57,342-397,715-903,959-1067,1113-1328
  Homolog annotation: Hit_ID=CAE68285.1; Match level="QueryCoverage =63%, HitCoverage=23%, E-value=2e-43, Identity=66%"; Hit description =Hypothetical protein CBG13969 [Caenorhabditis briggsae]
  Essential gene: C elegans homolog=Y55F3AM.3a; Phenotype =Gro,Pvl,Stp,Unc
MAEDEVDDLLEEAFKNVDEGFVARAKAAFSVREQQKKTQIVLSYMELICNFSSRDRRRSRSRSRDRRRSPISRRRSRSRSPLEKRRSPAPRRLPGPERRDVLDSLSMPFTPRRSPPRDARMDMTSEERDERTVFILQLARQTRPRDLEEFFSSVGHVRDVRVITDTKTRRSKGIAYVEFWEREAVPLVTFFLLKWANPHKEFACIPPT

SEQ ID NO: 119363 - protein, 368 aa, Heterodera glycines
  Coding regions on vcDNA: vcDNA=SeqID_45786; Strand=-; Position=1 -112,169-255,317-480,665-1174,1488-1721
  Homolog annotation: Hit_ID=CAE71182.1; Match level="QueryCoverage =80%, HitCoverage=26%, E-value=2e-33, Identity=35%"; Hit description =Hypothetical protein CBG18039 [Caenorhabditis briggsae]
  Essential gene: C elegans homolog=F35G12.3a; Phenotype=Emb
IENILIDQRNAHEKSTYILCDFGSSTTKVLSKEHYTHAFMEEEIQRYTTLSYRAPEMIDLYSGIPIDTKSDIWALGILLYKLCYFSLPFGESALAIQNGLFTFPESPPISDQIKAIISGFIKSLRIELSEAVQILKMRNKLGSDYARLYEKAFNDFEAQRRRHTAPSVGRGPGEVIEERHSRDGMQRTFVAGIKPSELPGHRTDDCSAVCSSSSALLAASEGMIVNTASSHCTETHRRATTTSVNPRLRPKPQAVLVNSTPMSQRKETADERGEMPLSGQQQLKQQTVANAPCMSTIDHHMDDNAFGECFDEMRRSCVVEQQSDFQSEINRPNILGLDLTSMEQQISDDPFGNAPPLLPYQFFRKPLD

SEQ ID NO: 119364 - protein, 290 aa, Heterodera glycines
  Coding regions on vcDNA: vcDNA=SeqID_45787; Strand=+; Position=1 -70,832-1110,1152-1264,1466-1876
  Homolog annotation: Hit_ID=XP_392715.1; Match level="QueryCoverage =72%, HitCoverage=36%, E-value=3e-34, Identity=35%"; Hit description =similar to ENSANGP00000013083 [Apis mellifera]
  Essential gene: C elegans homolog=W02A11.4; Phenotype =Emb,Lva,Pvl,Stp,Unc
MNERFDVDFFRQFSLVMNALDNKGGSLILKWICLTKGLGGSRPNEDENEHWGVSKWAELFEDSLFALAERYRGAVKEKRMLIWDKDDEPAMQFVAACANLRAYIFGIGTKPLFDLKAMAGNIIPAIATTNACVAGMIVVEALKIVSGQLSKCRTVIVHVNLNEMLLRTFRQNVLVGALNMLKPDVMDLCQNHRILLSSEEGETDSILDRSLGLLGVLNGTQLECDDYAQQLNFKLILFNDNTLTGEQFKKVEDQATKGAKSISDDKQKRENEIDEEEGVPVKKAKILCET

SEQ ID NO: 119365 - protein, 368 aa, Heterodera glycines
  Coding regions on vcDNA: vcDNA=SeqID_45788; Strand=+; Position=1 -150,350-448,493-769,878-1040,1129-1487
  Homolog annotation: Hit_ID=CAE60362.1; Match level="QueryCoverage =94%, HitCoverage=29%, E-value=7e-82, Identity=45%"; Hit description =Hypothetical protein CBG03960 [Caenorhabditis briggsae]
  Essential gene: C elegans homolog=C10H11.9; Phenotype=Emb
PPLSTYAVKQHCSITSKKSNPDNMLIAKNGHIKLADFGTCVKMNTDGLVRCSSAVGTPDYISPEVLRSQGGEGVYGREVDWWSVGIFLYEMLVGETPFYSDSLEVDWWSVGIFLYEMLVGETPFYSDSLVNTYSKIMDHDRQLQFPADVRISAHAKDIIRKFLSEPNERLGKSGIDPIKKHPFFGNSNWTFDTIQHATPPFVPELKSDDDTSHFEDVEQAEAVNPDNFQIPKAFTGNQLPFIGFTYSSEQGSDVPLINGNQITNCAEIEQLKEEKRLLEVRFGDLQDQWTQSVRHRDKRWANRENGTDRTINDLIRLKLQRDKNILEESATELKEQLERTKNEVRRGKGKANGEMVGQVQVEQLKTDK

SEQ ID NO: 119366 - protein, 957 aa, Heterodera glycines
  misc_feature (19)..(19): Xaa can be any naturally occurring amino acid
  misc_feature (637)..(637): Xaa can be any naturally occurring amino acid
  misc_feature (640)..(640): Xaa can be any naturally occurring amino acid
  misc_feature (644)..(644): Xaa can be any naturally occurring amino acid
  misc_feature (781)..(781): Xaa can be any naturally occurring amino acid
  Coding regions on vcDNA: vcDNA=SeqID_45789; Strand=+; Position=1 -191,238-306,353-476,525-693,747-891,937-1067,1115-1255,1303 -1402,1475-1740,1788-2020,2138-2274,2406-2513,2556-2737,2841 -3041,3087-3194,3250-3279,3356-3424
  Homolog annotation: Hit_ID=AAQ74888.1; Match level="QueryCoverage =94%, HitCoverage=69%, E-value=1e-116, Identity=31%"; Hit description= UBP [Gallus gallus] ref|NP_989802.1| UBP [Gallus gallus]
  Essential gene: C elegans homolog=H19N07.2a; Phenotype=Gro
KVCDLFIVNALQIAIVTLXVNDTIPSLFKGRMKSYIKCKNVDFGSSREECFYDLQLNVKGKSNVLESFRDYIQLEILDLESFRDYIQLEILDGENKYDAGDFGLQPAEKGLKFLSFFGLQPAEKGLKFLSFPPVLHLQLMRFQYDPMMDSNVKINDRFEFSEIMDLNEFAESEGDFEFSEIMDLNEFAESEGDDEAQKNDYTYLLYAVLVHSGDFHGGHYVAFINTNLKGSWCKFDWCKFDDDVVSRVTSRDAVTANFGGENPEGVGRSFTNAYMLVYIKKSATGEVLGSVSEEDIPDHLKVRFESSATGEVLGSVSEEDIPDHLKVRFESEKKREMERRIEREEANNYCEITLILDEDMNAHHEFELFDGRKITLILDEDMNAHHEFELFDGRKIQARKLKVQKSMTYMELYKFVATNMGLKEREFRLWDFQSDNNGLKEREFRLWDFQSDNNQREMMHRFRVENTRPHLELCRGHVGDELGFPNYDKNRNFFLAKTAHIDDLDDVLAFVKFFTAERKVPEFKGTLILTMSSDFPTIAAAINKVLGQPPDTKLNLYVEIKPDKIIQLQSATVKNEIKPDKIIQLQSATVKNSQQYMQQDGVIIIAELDQVSEEASVMQFFKTLYNRIEVIFKKLLXNKXSYTXVEAHLQEFGRVCSWLGSELNYDPAKIMLYKSEFDLFSRFKFAFVLSDVLHGDKPQRIFKFFYAKLPLPMVDFDNHAHVLLHLMNEKFQLTEMSIFVDKNAEMSIFVDKNASVQTLLDEARKEFRFSSMGTKTLRILXTKQRHTKIFFRLVQASADGTFRVLRVEEIPKDQLEVTGEYLLPVAHFDREPNRTFGVPFFIKICNGEKVSSIRERIREMLDVPKKEFEKYKFCIVRQGRYKFCIVRQGRVMREFDNQDEAAVNLSEIPCPYNLSQSAPFLGIQHQSAPFLGIQHFRKNANKRPKNLRLKPLVLVQN

SEQ ID NO: 119367 - protein, 461 aa, Heterodera glycines
  Coding regions on vcDNA: vcDNA=SeqID_45790; Strand=+; Position=1 -125,372-519,565-915,1135-1465,1509-1537,1576-1974
  Homolog annotation: Hit_ID=CAE67897.1; Match level="QueryCoverage =100%, HitCoverage=72%, E-value=1e-162, Identity=62%"; Hit description=Hypothetical protein CBG13493 [Caenorhabditis briggsae]
  Essential gene: C elegans homolog=T07A9.9a; Phenotype=Lva,Unc
MLKRAALGRMVKLLRRQKSSFEYLEQVRQHLSRLPSIDPNTRTLILCGFPNVGKSSFINKVTRADVEVQPYAFTTKSLYVGHLDYRYLRWQVIDTPGILDHPLEQRNTIEMQAITALAHLKASILYMMDISEQCGRTLEEQIHLFESIQPLFSNKPVFVGLNKIDLITRKDLIAEKEAILREKLETAGVPVVELSTLTQQGITELRDKACDALLAQRVEKKLQVKGIAQGGSVISRLFVAYPTPRDDKVRAPHIPETVLKRHAEMEVEDGEKPKRKLERELELEQGREYKLDLNKHYLLKNEGEKYDTIPEIWEGHNIADFIDPKIVEKLLKLRDEEKKREEAGFYDSDMDEDDEETRKLLREAEKITQKEQMRRMEFREKKSTNQPKMSRKIGRKRERSMARLEEELGDLGVDIASKKMRHLSEEQNREQRGKKIRVGRSPSVKAPPKTPRDVQGIPDKK

SEQ ID NO: 119368 - protein, 138 aa, Heterodera glycines
  Coding regions on vcDNA: vcDNA=SeqID_45791; Strand=+; Position=1 -18,115-413,819-915
  Homolog annotation: Hit_ID=NP_499920.1; Match level="QueryCoverage =94%, HitCoverage=38%, E-value=4e-33, Identity=54%"; Hit description =rrp8p like (4B151) [Caenorhabditis elegans] gb|AAK39280.1| Hypothetical protein T07A9.8 [Caenorhabditis e
  Essential gene: C elegans homolog=T07A9.8; Phenotype=Gro
MSKSDKVSKWPVNPLEKIVLDLGSLPPGSVVADLGCGDAEIAKRLGERLRVHSFDLVASNERVLAADMADLPLEAESVDVCVYCLSLMGTNLAQFFREAHRVLKTHGKIKIAEITSRLRSVSLFVLALEKMGFQLKRK

SEQ ID NO: 119369 - protein, 88 aa, Heterodera glycines
  Coding regions on vcDNA: vcDNA=SeqID_45792; Strand=-; Position=1-264
  Homolog annotation: Hit_ID=CAE60034.1; Match level="QueryCoverage =100%, HitCoverage=13%, E-value=8e-32, Identity=70%"; Hit description= Hypothetical protein CBG03543 [Caenorhabditis briggsae]
  Essential gene: C elegans homolog=K10D2.6; Phenotype=Emb
GVCTNFLADRAPGVSTAPVFVRKSTLRLPHRVQQPVIMVGPGTGFAPFRGFLHDRLWHKQQGKEVGEMHLFFGCRHPDHDHIYKEEME

SEQ ID NO: 119370 - protein, 167 aa, Heterodera glycines
  misc_feature (164)..(164): Xaa can be any naturally occurring amino acid
  Coding regions on vcDNA: vcDNA=SeqID_45793; Strand=-; Position=1 -79,304-455,501-609,764-889
  Homolog annotation: Hit_ID=CAE57843.1; Match level="QueryCoverage =98%, HitCoverage=50%, E-value=9e-44, Identity=56%"; Hit description =Hypothetical protein CBG00872 [Caenorhabditis briggsae]
  Essential gene: C elegans homolog=F42A8.2; Phenotype=Emb
CVFRAYLCVLSAQKVSICLKIASLLNSRVMLLSKIPPPFCIALRAASTNPPARGPSVKTFEIYRYNPEKPEQKPFLQKYDVDLNQCGPMKYDVDLNQCGPMVLDALIKIKNEMDPTLTFRRSCREGICGSCAMNIGGENTLACICNIEKKTKYSTKIYPLPHMXVGK

SEQ ID NO: 119371 - protein, 276 aa, Heterodera glycines
  Coding regions on vcDNA: vcDNA=SeqID_45794; Strand=+; Position=1 -592,636-872
  Homolog annotation: Hit_ID=NP_492315.3; Match level="QueryCoverage =25%, HitCoverage=3%, E-value=1e-12, Identity=57%"; Hit description =abnormal GONad development GON-2, putative TRP homologous cation channel ltrpc1 family member (gon-2) [Cae
  Essential gene: C elegans homolog=T01H8.5; Phenotype=Pvl,Stp
PQTAAEHQKDINESSSSSSDSSSSSSSSDSESDGDESDAGERGGATAEERRRTSHSHGSMQSLNFTSVKHSICLHMVYLRLFFRSLKVSASAVVLPTRVLPPRPKRTLRWANRGTEVGGCLEWSNPRSTTHNFCLDCQCLLVTSRSTPIKEGPTLKAVDEDGAGAKQRKSKGREGRGVRALVAHSTIGAAAVPSATNSTGGSPLLSHAPLPLNNAINHAWPTPKTYGAINPDGKSPHFLVGSDENIGDSSNEAAYYHPTTTFPTRHRRKKTVLSEN

SEQ ID NO: 119372 - protein, 206 aa, Heterodera glycines
  misc_feature (193)..(193): Xaa can be any naturally occurring amino acid
  Coding regions on vcDNA: vcDNA=SeqID_45795; Strand=-; Position=1 -193,316-397,457-602,671-799
  Homolog annotation: Hit_ID=NP_499156.1; Match level="QueryCoverage =90%, HitCoverage=56%, E-value=3e-45, Identity=56%"; Hit description =Enoyl-CoA hydratase/carnithine racemase, mitochondrial (31.2 kD) (3K842) [Caenorhabditis elegans] emb|CAA
  Essential gene: C elegans homolog=T05G5.6; Phenotype=Lva
CILWMIALKSNLFKIILPLKCAIVSYAQLEMIKVERVGADDVVALITLNRPKALNALCSQLMDELAHSLTYLDKDDGVHAIVLTGSERAFAAGADIKEMVPKKFAEVFGGADIKEMVPKKFAEVFGGGFLENWSQVATVRKPTIAAVNGHALGGGCELAMMCDLAMMCDIIYAGEKAMFGQPEIKIGTIPGTXLGQFCYIKLFQEP

SEQ ID NO: 119373 - protein, 65 aa, Heterodera glycines
  Coding regions on vcDNA: vcDNA=SeqID_45796; Strand=-; Position=1-252
  Homolog annotation: Hit_ID=EAL24647.1; Match level="QueryCoverage =81%, HitCoverage=28%, E-value=2e-14, Identity=67%"; Hit description =GA14932-PA [Drosophila pseudoobscura]
  Essential gene: C elegans homolog=R05D11.7; Phenotype=Egl,Gro
SNPINEIVDVDEDMMRMMGFSNFDTTKNKHVEGNASGESKINRARKYRQYMNRRGGFNRPLDYVA

SEQ ID NO: 119374 - protein, 370 aa, Heterodera glycines
  misc_feature (36)..(36): Xaa can be any naturally occurring amino acid
  misc_feature (321)..(321): Xaa can be any naturally occurring amino acid
  Coding regions on vcDNA: vcDNA=SeqID_45797; Strand=-; Position=1 -119,232-1256
  Homolog annotation: Hit_ID=NP_510671.1; Match level="QueryCoverage =97%, HitCoverage=37%, E-value=1e-65, Identity=36%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
FKCIIYKNYFFMVCKRHCTKNSALTCSKINDKITFXMKYIDCIYVDFRKAFDSLPINILINKLHNIGIKGKLLSWLSEFLRDRFYRVKINNKSSNLHPIQSGVPQGSVLGPLLFLIYINDLPQVIPSGVSIKLFADDVKIYGDERSKLNIALENIGKWANAFGLNISQNKTFILFIGKNNSKQQYKLFNNIINEVESISDLGILIDNKLRFSNHYTKITKAAYLRIRNIAKILKSRSIRIWTKVYKTYIRPLLEYAPEIWNPTNKKDINKLERCQKYFTKIALFKCRLPYIPYKQRLDLFKLEERRKTIDLVQAFKIIISXKRHIPTISGHIPYNLRRKVVLKSQSSKTSNSFINRTELIWCRMKKDIID

SEQ ID NO: 119375 - protein, 73 aa, Heterodera glycines
  Coding regions on vcDNA: vcDNA=SeqID_45798; Strand=+; Position=1 -113,166-208,276-341
  Homolog annotation: Hit_ID=NP_491640.1; Match level="QueryCoverage =100%, HitCoverage=100%, E-value=1e-33, Identity=86%"; Hit description=UBiquitin-Like (8.7 kD) (ubl-5) [Caenorhabditis elegans] gb|AAK21382.1| Ubiquitin-like family protein 5
  Essential gene: C elegans homolog=F46F11.4; Phenotype=Gro,Stp,Unc
MIEITVNDRLGKKVRIKCNPTDTIGDLKKLVSAQIGTRWDKLILKKWYTTYKDHITLQDYEIHDGFNFELYYQ

SEQ ID NO: 119376 - protein, 135 aa, Heterodera glycines
  Coding regions on vcDNA: vcDNA=SeqID_45799; Strand=+; Position=1 -160,305-393,600-758
  Homolog annotation: Hit_ID=NP_498349.1; Match level="QueryCoverage =83%, HitCoverage=45%, E-value=1e-38, Identity=67%"; Hit description =ribosomal Protein, Small subunit (27.3 kD) (rps-3) [Caenorhabditis elegans] gb|AAF99870.1| Ribosomal prot
  Essential gene: C elegans homolog=C23G10.3; Phenotype=Emb
MESYARGCELWVSGKLRGQRAKAMKFVDGVMIHSGNPVTEYIQEAVRHVQMRQGVLGIKVKIMLPHDPKGQMGPRNPLPDHIQVKEPPIDVAPTTPYSEHREPMTTGMPPQTQMPPAHQQQQLPMVGQVPSPAQF

SEQ ID NO: 119377 - protein, 495 aa, Heterodera glycines
  Coding regions on vcDNA: vcDNA=SeqID_45800; Strand=-; Position=1 -250,295-545,587-1192,1249-1419,1483-1692
  Homolog annotation: Hit_ID=CAE71710.1; Match level="QueryCoverage =100%, HitCoverage=81%, E-value=6e-49, Identity=29%"; Hit description= Hypothetical protein CBG18687 [Caenorhabditis briggsae]
  Essential gene: C elegans homolog=R06C1.3; Phenotype =Egl,Emb,Lva,Pvl,Unc
MRKAFKSCNIIDQHSLDRQTLPQSLLEQYQNCDPPPQLNQLNPYREDEKEALCYYTDPSYFFELWRNKTLKECDGGLAEKKRAGRSSTSPSRQRRRQQQQQHNFPQHNDLSAHHVSSRSTDYSRFEPQIGHQNGKSQQHKLRHGFGPAHFSVSSVAADVLHFPAEYQTPQSLMIGNRITHNQHPPPGMSMVTTNEGTVTQQHHKQIKPNEHSPFNLSSNHSSGNSNQQFRVKERTIDGKADAMNTTQTDNTSKNDAAHAVASRMDVMFLDDEDDELPPPPQNILSSTVNTRNFPRIAPSVSSSSPVGSTNSSLAAPTNEPLKSKFEFISTNGSTETSELGTTRHITNEQQSINVAVIEQRPNQLHSIQQIPPSVCNAPAPPPPPPPPPPNFSLKIANEGTKTFGGQNENEQPKDLQRKSSNTSGAQDNRSLLLMQIQEGVKLRKVRQQEELEEKRAVATSNDVAAILRKRMEHCLGDSDSSSEGSPSPEDNEWDD

SEQ ID NO: 119378 - protein, 281 aa, Heterodera glycines
  Coding regions on vcDNA: vcDNA=SeqID_45801; Strand=+; Position=1 -123,177-297,400-598,651-788,845-1008
  Homolog annotation: Hit_ID=NP_502255.1; Match level="QueryCoverage =98%, HitCoverage=71%, E-value=9e-79, Identity=51%"; Hit description =fatty acid desaturase, stearoyl-CoA desaturase (39.1 kD) (fat-6) [Caenorhabditis elegans] emb|CAB08356.1|
  Essential gene: C elegans homolog=VZK822L.1; Phenotype =Gro,Ste,Unc,Unclassified
MSVSHSNDHSKSEKCGNSEGQFLSMEVDELQELEEKAKKTQFKTQIVWRNVTQFKTQIVWRNVILYLILQTGALIGVYQLFTSSKWLTVFWCLFLWMVSGVGITAGPHRLWSHKSYKAKWPLKALLVAMNCVSFQNDIIEWSRDHRCHHKWTDTDADPHNINRGFFFAHMGWHNINRGFFFAHMGWLLVKKHPLVKEKGASLDMSDLTSDPLLMFQRKYYLPLVGIFYYLPLVGIFCFLLPTAIPVYLWSESVWVSFCTSALFRYCLNKHATWFINSAAHT

SEQ ID NO: 119379 - protein, 711 aa, Heterodera glycines
  misc_feature (79)..(79): Xaa can be any naturally occurring amino acid
  misc_feature (287)..(287): Xaa can be any naturally occurring amino acid
  misc_feature (530)..(530): Xaa can be any naturally occurring amino acid
  Coding regions on vcDNA: vcDNA=SeqID_45802; Strand=-; Position=1 -275,615-813,867-900,993-1154,1482-1618,1960-2314,2381-2449,2546 -3071,3243-3319,3377-3497,3629-3745
  Homolog annotation: Hit_ID=NP_499819.1; Match level="QueryCoverage =97%, HitCoverage=25%, E-value=1e-124, Identity=37%"; Hit description= myeloid lymphoid mixed-lineage like (3O745) [Caenorhabditis elegans] emb|CAB05024.1| Hypothetical protei
  Essential gene: C elegans homolog=T12D8.1; Phenotype=Emb
GSSNVTDKEYIRTCVVTSLEDKFMTEVSMCLVCGSIGRGTEGSMITCSCCAQSFHTYCVLMHDKVGGDHSFSLPFVNRXTFFHSSSYQKKFKTLLFQLNWLKSNFISQLNPTVMKRGWRCLDCTVCEGCGSGEDEPNLLLCDECDISYHTYCLEPPLDCIPRGSWRCKWCIPRGSWRCKWCATCSRCGAQIKLGSDMQRLEGFCEICYSLRKCVKCQASYEIGDLMLKCGRCLRWLHARCEGLTTEEQAENAAENAFRCSFCRPQIFRKFCFPRLQTVTNNFVRKSXKTVRVIFGRHTFTQLANGLVNVTHIKSAFLCYLKDDMELSDELQEQLIASVFAGRGRGCGSGGGRGGGPGRRMLKMGVGGFYVRTPKSRLPFLMGSGANMTPMNSTEPRIRRPRPRIRRPRKLKRPLLEDAYPPQIQESFFGVAAVDSRTLAEQTVDEPTLSDYKKVLPVVSGTKFASELSEHSAELLRTQEMDMLGDIPLVENIMDGLDMEGLDSDLIVGEEDEPMTVESSSNTIDPISGHXLPSPIFGTLFPCSFQMDNAGSSSNLVAHSVVSEVFSPSPAHQSERPVGVRARTTANGGGVLNGDGSLTTERWEEDEPLGDKATKAAVLYANVHHTYLKDKFPIVHHTYLKDKFPIWTDRVRMISRIWRDLNPEKRQELVNHSTTTNGATGSSPKPTTTNAKNSISVLIGQQQPDAPFQGAA

SEQ ID NO: 119380 - protein, 134 aa, Heterodera glycines
  Coding regions on vcDNA: vcDNA=SeqID_45803; Strand=+; Position=1 -25,80-459
  Homolog annotation: Hit_ID=AAA03341.1; Match level="QueryCoverage =88%, HitCoverage=79%, E-value=5e-36, Identity=62%"; Hit description =ribosomal protein L23a
  Essential gene: C elegans homolog=F52B5.6; Phenotype=Emb,Gro,Pvl,Stp
MPPTSKKTGKAVAKAVEAKKKLAKGQHIVRKKNMRTSVHFYRPRTLKLARSPKFPRKAVPKRNKLDSFSIIKHPLTTESAMKKIEDTNTLVFIVDVKANKHQIKSAVNKLYNIEAQKVCPLFVLVKKIEYMQIG

SEQ ID NO: 119381 - protein, 378 aa, Heterodera glycines
  Coding regions on vcDNA: vcDNA=SeqID_45804; Strand=+; Position=1 -543,591-659,708-900,943-1037,1080-1313
  Homolog annotation: Hit_ID=BAA22203.1; Match level="QueryCoverage =100%, HitCoverage=81%, E-value=0.0, Identity=90%"; Hit description =alpha-3 tubulin [Caenorhabditis elegans]
  Essential gene: C elegans homolog=C47B2.3; Phenotype=Emb
MVDLEPTVIGCHLLFFVGLSAVLDEIRTGTYKHLFHPEQLITGKEDAANNYARGHYTVGKEIIDPVLDRIRRIADNCTGLQGFLIFHSFGGGTGSGFTSLLMERLSVDYGKKSKLEFSIYPAPQVSTAVVEPYNSVLTTHTTLEHSDCAFMVDNEAIYDICRRNLDVERPSYTNLNRLISQVVSSITASLRFDGALNVDLTEFQTNLVPYPRIHFPLATYSPVISAEKAYHESLSVSEITNMCFEPSNQMVKCDPRHGKYMAVCLLYRGDVVPKDVNAAIASIKTNRSIQFVDWCPTGFKVGINYQPPTVVPGGDVAKVPRAVCMLSNTTAIAEAWSRLDHKFDLMYAKRAFVHWYVGEGMEEGEFSEAREDLAALEK

SEQ ID NO: 119382 - protein, 35 aa, Heterodera glycines
  Coding regions on vcDNA: vcDNA=SeqID_45805; Strand=-; Position=1-186
  Homolog annotation: Hit_ID=NP_502365.1; Match level="QueryCoverage =100%, HitCoverage=24%, E-value=2e-11, Identity=91%"; Hit description= ribosomal Protein, Small subunit (15.9 kD) (rps-23) [Caenorhabditis elegans] emb|CAA94601.1| Hypothetica
  Essential gene: C elegans homolog=F28D1.7; Phenotype=Ste
GHAVGDIPGVRFKVVKVANTSLLALFRGKKERPRS

SEQ ID NO: 119383 - protein, 115 aa, Heterodera glycines
  Coding regions on vcDNA: vcDNA=SeqID_45806; Strand=-; Position=1 -130,656-727,782-896
  Homolog annotation: Hit_ID=CAE66018.1; Match level="QueryCoverage =95%, HitCoverage=26%, E-value=2e-25, Identity=46%"; Hit description =Hypothetical protein CBG11211 [Caenorhabditis briggsae]
  Essential gene: C elegans homolog=ZK1127.5; Phenotype=Emb,Lva
GVHNELQLEGCNFLRQHIVFSLLTGRTITITKIRSYDDNPGLKEFERIFLSMIKRLTNGTELKLSKNGTELSFRPGLITELSFRPGLIHGGELEFDCGVQRCISYFLEPLILMAP

SEQ ID NO: 119384 - protein, 272 aa, Heterodera glycines
  Coding regions on vcDNA: vcDNA=SeqID_45807; Strand=+; Position=1 -24,86-247,303-662,716-783,1469-1550,1605-1673,2093-2146
  Homolog annotation: Hit_ID=NP_491672.1; Match level="QueryCoverage =91%, HitCoverage=92%, E-value=2e-54, Identity=55%"; Hit description =proteasome Regulatory Particle, ATPase-like, S6a (48.1 kD) (rpt-5) [Caenorhabditis elegans] gb|AAC19196.1
  Essential gene: C elegans homolog=F56H1.4; Phenotype=Emb
MAHPAGDVTDAQVLEMSSDQIDERVRQLDEEIRVMRDEMRKIAYNIKTMGTKTKENNKQMQKYMKMPWLVANVVEILDLADDQAEGEEGSSSDLDARQKKGAVIKISKGLVMFLPRIGRVGPDELKPGDLVGIDNDTYHIIAKLPPHFDRRVKAMEVVERPTETYSEIGGCETQIKELQEAIVLPMTKKELFIKIGIHPPKGVLIKNVNFVELSRCIEDFNGAQCRAVCVEAGMVALRRDSTKILHEDFMDGILEVLKNRIIAKNEKKCQKN

SEQ ID NO: 119385 - protein, 329 aa, Heterodera glycines
  Coding regions on vcDNA: vcDNA=SeqID_45808; Strand=+; Position=1 -164,609-774,830-1189,1243-1324,1398-1615
  Homolog annotation: Hit_ID=NP_491672.1; Match level="QueryCoverage =75%, HitCoverage=56%, E-value=3e-77, Identity=58%"; Hit description =proteasome Regulatory Particle, ATPase-like, S6a (48.1 kD) (rpt-5) [Caenorhabditis elegans] gb|AAC19196.1
  Essential gene: C elegans homolog=F56H1.4; Phenotype=Emb
MHPFKSFLWLLPRHVSIAFAFATLFGLLAAAGAPRQIVVQILQIGIILKGHLKQIPTPKCWRCLPTKLTNAYDRQLDEEIRVMRDEMRKIAYNIKTMGTKTKENNKQMQKYMKMPWLVANVVEILDLADDQAEGEEGSSSDLDARQKKGAVIKISKGLVMFLPRIGLVGPDELKPGDLVGIDNDTYHIIAKLPPHFDRRVKAMEVVERATETYSEIGGCETQIKELQEAIVLPMTKKELFIKIGIHPPKGVLMYGPPGTGKTLLARAVASQTKATFLRLSGTLLNQVGLGDGAKMVQNAFELSKQKAPTISFIVELDTMGARIGEFDAR

SEQ ID NO: 119386 - protein, 93 aa, Heterodera glycines
  Coding regions on vcDNA: vcDNA=SeqID_45809; Strand=-; Position=1 -47,101-218,311-427
  Homolog annotation: Hit_ID=NP_499094.1; Match level="QueryCoverage =61%, HitCoverage=22%, E-value=5e-22, Identity=89%"; Hit description =vacuolar H-ATPase (28.8 kD) (3K599) [Caenorhabditis elegans] emb|CAA81600.1| Hypothetical protein F55H2.2
  Essential gene: C elegans homolog=F55H2.2; Phenotype=Emb
MSGGGKDRIAVFPSRMAQTVMKTRLKGAQKGHSLLKKKADALNMRFREILKKITEGKKCADSEYENPGVFRASDHESDIRFAKIIDFENHRFS

SEQ ID NO: 119387 - protein, 834 aa, Heterodera glycines
  misc_feature (577)..(577): Xaa can be any naturally occurring amino acid
  Coding regions on vcDNA: vcDNA=SeqID_45810; Strand=+; Position=1 -23,999-1064,1120-1206,1329-1453,1528-1883,1986-2137,2206-2361,2440 -2955,3052-3297,3357-3880,3944-4005
  Homolog annotation: Hit_ID=NP_498516.1; Match level="QueryCoverage =97%, HitCoverage=30%, E-value=0.0, Identity=43%"; Hit description =NOT-like, component of CCR4/NOT complex (ntl-1) [Caenorhabditis elegans] gb|AAA21168.1| Not-like (yeast ccr
  Essential gene: C elegans homolog=F57B9.2; Phenotype=Emb
NLRKSMIEDLATAVFSEDIQEEANSYFQQIYAPDGRVSVNDFIAKLKGFRQIYAPDGRVSVNDFIAKLKGFRHSGNIKERELLLCVVKNLFDEYRFFREYPERELRTTAEVYGGIIREEIILNIQFANIQFATAIRRVIESLNDEPGSVLWTFGIVALSACRACLYKYPKVCHMIINTNSYGRFPPGLKDYVSAGALGQLPMNHSAAHDVGLFSSNQQPQPFFPPSSVIQRPNSADGENSMPGLEGNSILNVTNVDTLISATEREGNQVKQPPQQLFEKVAFTCNNLCANNLLDKTQELTQLIRENGDEFTQELTQLIRENGDEFLEWFAQYLVMKRVTVEHNYQQLYNSFLVLINNTSLDNDRQLLKNLGHWIGIITIGRDRPILNKDLDMKYLLFEAFYKGQHELLYIVPFVVKCITASAKSQLFGPHCGWVYAILKVLAEIHNEPDLKLNLRFEIEVLCKELNVNLGSIEVGSYLKEQRRLVSVKQKKIPIKISFKPRLVPPSKLGTAAASSTLAQCQLPPIQPPHIGAYTPGGSQQQVSSITAHQSPPSTTRTLLCNLVHIYPYLIITNFTFXGILQIIVIPPHLMLFQVHPQLKTTCKIAINHAIKDFLGGVADRAISFLGGVADRAISVAIAATEQICRKDFSLDSNEQNLRRGAHQMMRSMTAAIASITCREPLSQQMNSILRMYLTDAMGNVVPGSDQAKMVEEAATAVTDTNINIATNFVVKNACEKAVADIEKGLESEYMSRKTASDDRPFQVDADMAEMSEKIPEMIRLKEGPISEAMLKVYDDFSSKICGFKPFAPEDRFIKICGFKPFAPEDRFIGFTKPG

SEQ ID NO: 119388 - protein, 163 aa, Heterodera glycines
  Coding regions on vcDNA: vcDNA=SeqID_45811; Strand=-; Position=1 -58,137-264,591-711,1982-2097,2225-2296
  Homolog annotation: Hit_ID=NP_501534.1; Match level="QueryCoverage =100%, HitCoverage=13%, E-value=9e-62, Identity=47%"; Hit description= EATing: abnormal pharyngeal pumping EAT-1, enigma (149.7 kD) (eat-1) [Caenorhabditis elegans] pir||T1915
  Essential gene: C elegans homolog=T11B7.4d; Phenotype=Unc
FVLAKGRCWCPEHFVCANSACGRRLLESGFVEEPQENYCPICYECLMAPVCRKCFLPLMENCLNALGDKWHNECFTCTHCRKPFGTLSFFVEDGKPYCEEDWNLLFTTKCSDCLKPIKVGQKWLEALGGQFHADCFKCATCGTGLEGKTYFERDQQPFCRVHA

SEQ ID NO: 119389 - protein, 200 aa, Heterodera glycines
  Coding regions on vcDNA: vcDNA=SeqID_45812; Strand=-; Position=1 -144,191-313,567-625,849-1014,1219-1327
  Homolog annotation: Hit_ID=AAH06364.1; Match level="QueryCoverage =96%, HitCoverage=31%, E-value=1e-29, Identity=35%"; Hit description =TBCD protein [Homo sapiens]
  Essential gene: C elegans homolog=F16D3.4; Phenotype=Pvl,Rup,Stp,Unc
MGAEVVSSVLTKCFSDSAADEANAWHGGCLALAELCRRGCLLPCQVPMVIVDLLPRALTFEQFQLGFMQAVNVRDAACYICWAFARAYEAQLLRDHLPSLAGVLLSVALGFIYFSVAQFGEYIRPMMDHLCELKSIHWDEMVRKLAADAIQRIASFDLDYAYEKIFPVFCARLRSSDSVVKHGAFLGVSALLFALNGTHD

SEQ ID NO: 119390 - protein, 613 aa, Heterodera glycines
  misc_feature (589)..(589): Xaa can be any naturally occurring amino acid
  Coding regions on vcDNA: vcDNA=SeqID_45813; Strand=-; Position=1 -262,307-383,429-539,594-750,804-838,892-957,1022-1145,1189-1295,1368- 1531,1592-1693,1735-1843,1890-2041
  Homolog annotation: Hit_ID=CAE72324.1; Match level="QueryCoverage =92%, HitCoverage=40%, E-value=1e-177, Identity=59%"; Hit description= Hypothetical protein CBG19469 [Caenorhabditis briggsae]
  Essential gene: C elegans homolog=F14B4.3; Phenotype=Lva,Lvl
LYPVVLDGDFVGFIPRKKAAFIERQLRAMKVASHDDRVPAFTELTLIRHSPDSENIQMQFAAFFIYSGLGRLMRPVRNLLFDQIEQIGIFEQVYLSIIIFEQVYLSIIIDPEEAEPGVTMHQELHPSSLFSFALHPSSLFSFAGNLIPFPDHNQSPRNVYQCQMGKQTMGVPVHAWQTRTDNKMYVPVHAWQTRTDNKMYKLQTAQKPLLKLEAHDKYEMDEYPLGTNACVAVISYTGYDMEDYDMEDAMVINKASYQRGFAHGTVVKVQASYQRGFAHGTVVKVQRYEFFESKNAEMVFLGKPNSKNAEMVFLGKPNERNYGIGADGLPIEGRLYQQGDCYYGTFNLVSGQFNEHKFTNSEPLVSGQFNEHKFTNSEPAYCGLVRIVQEADHKNKNVQHVLIQWRIQRNPIIGDKFASRHGQKGINSFLWPPESMPFSESGMVPDIIFNPHGFPFPSRMTIGMMIESMAGKAAAMHGTSYDASPFVFNEQNTAIEHFGKLLAKEQNTAIEHFGKLLAKSGYNYYGNETMYSGIDGREMKVKIFFGIVYYQRLRHMIADKFQVKVKIFFGIVYYQRLRHMIADKFQVRXRGPVDPSEFNDHKKLIKNNLLVYS

SEQ ID NO: 119391 - protein, 231 aa, Heterodera glycines
  Coding regions on vcDNA: vcDNA=SeqID_45814; Strand=-; Position=1 -161,214-363,410-551,607-687,1125-1286
  Homolog annotation: Hit_ID=AAF98156.1; Match level="QueryCoverage =93%, HitCoverage=42%, E-value=3e-17, Identity=29%"; Hit description =putative homoglutathione synthetase [Pisum sativum]
  Essential gene: C elegans homolog=M176.2; Phenotype=Emb,Lva
MKVEINGASTTGFAFSDLTTKLHKNVLSNLGLNMANHVESDTISLTVDALYYAWQKFADTKAIVLIIVAKNRPNYYESWIIKKKLHDKYAINSVVLSLFQCAKMLTLNIKDFSLRLNKQIVVAVVFNQQTMLNENTYQMKARLIIERSTAIKAPSLIAVLAYSKKIQQVIPIKLFWDTALAQPGMVERFFPNPEEAPLIKAIRDTEAKIWTIERDNDKFAEMMKVKNFEFK

SEQ ID NO: 119392 - protein, 964 aa, Heterodera glycines
  Coding regions on vcDNA: vcDNA=SeqID_45815; Strand=-; Position=1 -131,359-556,1409-1708,2100-2202,3225-3535,3640-4377,4751-5221,5589 -6231
  Homolog annotation: Hit_ID=NP_729947.2; Match level="QueryCoverage =92%, HitCoverage=69%, E-value=4e-41, Identity=25%"; Hit description =CG32133-PA [Drosophila melanogaster] gb|AAF49771.3| CG32133-PA [Drosophila melanogaster]
  Essential gene: C elegans homolog=F47A4.2; Phenotype=Pvl,Sma,Unc
GLISGVPPQQQVLSPAQYQQMGYYYKGPGPPPGMMPLGHAEMMSASAHSREEQQQQQKQQHFQQAQQQQQMFQHQHYLLQQQQQQQPPPQGILYTSQQQGTTVAAAGAQQQSNFGAGYGMQQQQQQQAKQAASAAKAAAAAQQMIKSGGGSATAPGAGGGGQSAAAAQPYNQQQQQPMFYNTGQQPQPYQAQQPQQQQQQQQAAAAGQYPMMGMPSQPSAAGYPQMQYPTSADYTQQMAMQRQAYYLQQQQQMLAAAAAGGGGGGTAVPSSAAAAAHIAGGGGAGAGGAPTTAFYHQSYMNPQQHHQQQQYMMQQQQQQFYRELYECDQQLNALLPQAQQNAEAAMRMHRSYLQGHLIQLQQQAAAVAASMASSSNIVPPSLSTAGMVPMQQQQPTATSAGADIIASPSNASSREQPPQQQFMGAQPTAAGTQYAAPSSAYGIAAQPPQQQQPQHGHFPGATGQQQQQPVAAGQIPVQQKLQPSSNQQPTSAPQHQFGGGTSSAPSSYMPPTPQTVVGAAAGYSSPAAGGGTPQQQHQQPTSVGMVVPQQQQQPQGITASHQQQQQQAPQPQFTQQHLAPPSVAVMSASSQVQVNIRPEMPGRTLISVYHSQDMAPPTVVSSSAAPVASLHQQQPQQHAATYSLSSTADASSAAASAIMAQNLAMAAAAAAVKDSIPPEPVPSNIVQEQKRRQQQMLLLQQREEEDQQQQQQQQLEQQQLQKFKQYQQQQQQQQQKQQSFNLGASTMPTKTSSLSTSPPPNAPISPATKARDNEAVQQDAAQHRFRSASSTQMAPSAAPFRHRSHTSAMVPQPEIAVEQLQQQRQHSQQKSPSPYWSSSSQQQRATTPPEFTMPSSHGHARHRQQQSYAGGGGSTMFGNSSKVPTPPSPAVVVRAPPPPPPLLPPAVVVVQNAKVALHFVAKHAASSFASCATVRRIVARESVAGTVKIVPRKPPPEVKKDAAK

SEQ ID NO: 119393 - protein, 149 aa, Heterodera glycines
  Coding regions on vcDNA: vcDNA=SeqID_45816; Strand=-; Position=1 -234,302-517
  Homolog annotation: Hit_ID=CAE71300.1; Match level="QueryCoverage =97%, HitCoverage=97%, E-value=3e-50, Identity=61%"; Hit description =Hypothetical protein CBG18189 [Caenorhabditis briggsae]
  Essential gene: C elegans homolog=F26F4.11; Phenotype=Emb
MNSLYFEDLFTVKNIDPDGKKFDRVSRLFCDSESFKMDLILDVNTQLYAMGINDKFRLMLCTSIRDDGLTEEGEYDKSIENIPRVRMFEYVMYGKIYRIENDEGTAETSRLTAYASFGGLLMRIQGEANNLTGFEQDKNIYLLLKKVPN

SEQ ID NO: 119394 - protein, 209 aa, Heterodera glycines
  Coding regions on vcDNA: vcDNA=SeqID_45817; Strand=-; Position=1 -121,356-488,637-832,1584-1763
  Homolog annotation: Hit_ID=CAE67815.1; Match level="QueryCoverage =40%, HitCoverage=17%, E-value=3e-10, Identity=36%"; Hit description =Hypothetical protein CBG13395 [Caenorhabditis briggsae]
  Essential gene: C elegans homolog=M176.2; Phenotype=Emb,Lva
MNIENVFPQILLILILGIRFLDSAPPKNESAGKYISSSSSGKYTVNAYMGDIEKQLNTFQTEKLIDEVKRWAENMGLKIKLFDQRIGNNGIENLIRRKPGFHSANSNGFLKCERATKLHSFSAMLQVAPFTLFPSPFSGTYFDQAYNAQTAFNLLYFRIMRDYEFLREVYQGLIGHDEIISSAFDIMDQVHSDGIKQPLTLLFQRAVNL

SEQ ID NO: 119395 - protein, 320 aa, Heterodera glycines
  Coding regions on vcDNA: vcDNA=SeqID_45818; Strand=+; Position=1-963
  Homolog annotation: Hit_ID=NP_498735.1; Match level="QueryCoverage =99%, HitCoverage=75%, E-value=6e-40, Identity=33%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MAYKTYLSHELSQSLEAKVSHLTAAGYDREDASNLQNANSEGFKSRRQRYLGGRTAQYIAKIDADLFNVPQYLINHCEIDITIQPHDDNFLLIDTLDPPGQPYSLELVGLKLYCKKVSLMDGLALELAKKLEMKPARYAVRKTMMKALFISPGRYEFNANLFMDQVPRRVTMGLVANSDYVGNIKRSPFNFQHFNVRELSVVANGRSYPQAPYDIDYENWKFVRPYNDTQEALGFANSTYGNGIDYFSFLHTHCIYVFNMTNSGDDHGGLFDLIKKGCTAVNIKFKKPVPDGGITLIVMGEADSIYFLDKNRTIATDTTI

SEQ ID NO: 119396 - protein, 365 aa, Heterodera glycines
  Coding regions on vcDNA: vcDNA=SeqID_45819; Strand=+; Position=1 -509,674-1262
  Homolog annotation: Hit_ID=NP_498735.1; Match level="QueryCoverage =91%, HitCoverage=92%, E-value=5e-28, Identity=27%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MTFHKIDASSIDSITNAVDFFSIPPTNVTVSSSKVFEILPSNPLTDTPYHFKIHSSQNYIDLSKCYLLTEFRMRKLTPPNGEWGHLDATDQVVPIQLIGHTFMRDLKIAINGREIFNSNSLMAYKTYLSHELSQSLEAKVSHLTAAGYDREDASNLQNANSEGFKSRRQRLELVGLKLYCKKVSLMDGLALELAKKLEMKPARYAVRKTMMKALFISPGRYEFNANLFMDQVPRRVTMGLVANSDYVGNIKSSPFNFQHFNVRELSVVANGRSYPQAPYDIDYENWKFVRPYNDTQEALGFANSTYGNGIDYFSFLHTHCIYVFNMTNSGDDHGGLFDLIKKGCKAVNIQFKKQYPMVEYTYCDA

SEQ ID NO: 119397 - protein, 119 aa, Heterodera glycines
  Coding regions on vcDNA: vcDNA=SeqID_45820; Strand=-; Position=1 -54,114-308,1601-1690
  Homolog annotation: Hit_ID=AAK49164.1; Match level="QueryCoverage =98%, HitCoverage=98%, E-value=5e-34, Identity=61%"; Hit description =engrailed [Acheta domesticus]
  Essential gene: C elegans homolog=C13G5.1; Phenotype=Unc
LPSWIFCTRYSDRPSSGRGPRTRKSKRGPRTRKSKRRELTEEEKRPRTAFTTEQLERLKTQFVHSRYLTEKKRQELAHELGLNECQIKIWFQNKRAKLKKSAQRVNPTPHGLLEQPLFK

SEQ ID NO: 119398 - protein, 168 aa, Heterodera glycines
  Coding regions on vcDNA: vcDNA=SeqID_45821; Strand=-; Position=1 -125,175-473,535-617
  Homolog annotation: Hit_ID=CAE71156.1; Match level="QueryCoverage =100%, HitCoverage=45%, E-value=3e-19, Identity=35%"; Hit description= Hypothetical protein CBG18012 [Caenorhabditis briggsae]
  Essential gene: C elegans homolog=T04A8.6; Phenotype=Lva
MRKSKQKLEAGPSSEVAAVQHVVRLRHIPYGFFEKQIHGYFSQFGDVKRVRVMRNKKVRLISLILSDSANRHSILICQGGHNGTAFVEFKEAAVAKIAARAMDNYLLAENRLRCKVLGQEEVPKCIRKGRCFVKIPKIAEKRVKQAKEQNEQRTPEKEKRRMVGKLRK

SEQ ID NO: 119399 - protein, 224 aa, Heterodera glycines
  Coding regions on vcDNA: vcDNA=SeqID_45822; Strand=+; Position=1 -323,499-617,669-763,1396-1504
  Homolog annotation: Hit_ID=AAK60209.1; Match level="QueryCoverage =96%, HitCoverage=96%, E-value=9e-98, Identity=80%"; Hit description =vap-1 [Heterodera glycines]
  Essential gene: C elegans homolog=F49E11.9; Phenotype=Unclassified
QYSYIIPFIRLLTKSSSAVPCSVLALSDSSRVAVLALHNNYRSQLAKGTAANLTGTMPAGSNLIQQKYNTSIESVAQNWANGCSMSHSSSSGMGENLYMTSSSTISEADALKQACDMWWAELKQYGFQSSLVLDMDQFNKGIGHWSQQAWANTAQIQAWANTAQIGCAMARCPSSTWKTWVVCNYKEAGNYLNQLVYKKGTACSQCSDYNGASCNSTGGLCVLP

SEQ ID NO: 119400 - protein, 141 aa, Heterodera glycines
  Coding regions on vcDNA: vcDNA=SeqID_45823; Strand=-; Position=1 -124,561-668,804-878,1316-1433
  Homolog annotation: Hit_ID=NP_492514.1; Match level="QueryCoverage =99%, HitCoverage=45%, E-value=1e-44, Identity=62%"; Hit description =DNA-dependent protein kinase catalytic -interacting (1K48) [Caenorhabditis elegans] emb|CAB03019.1| Hypot
  Essential gene: C elegans homolog=F30A10.1; Phenotype=Lon
FKKLIFTNTFYGMGNTKSKIGELQLWKGRAPFSPQQLDEYQDCTFFTRKDILRLYKRFHQLDSRIVPANIQGGQAQTVKLSMEQISQMPELRENPFKERICQVFSEDGQNLSFDDFLDMFSVFSEMAPLQLKLKYAFQIYE

SEQ ID NO: 119401 - protein, 261 aa, Heterodera glycines
  Coding regions on vcDNA: vcDNA=SeqID_45824; Strand=+; Position=1 -327,393-556,835-926,971-1173
  Homolog annotation: Hit_ID=NP_296369.1; Match level="QueryCoverage =65%, HitCoverage=12%, E-value=2e-17, Identity=34%"; Hit description =partitioning-defective protein 3 homolog [Mus musculus] gb|AAK07669.1| PAR-3 180 kDa isoform [Mus musculu
  Essential gene: C elegans homolog=F54E7.3a; Phenotype=Emb
MSLSEKSQFEVTALLKSKSVGDVIELLISRNVAEEPKQMNAKNEKEDTLEHHQSSDLIFDSLNAHFSGSTDLELHCLEIPLNDTPGAGLGLSLKAQRVGATDAGLFIRSILHGSAAFKDGRLQVNDRLVGIETQNLLNYELNGEALEAFMRTISQLPQSKHSLRSISEKRSLVTRRDPSQLRTYQGIVHQRQISAPALSSTAVANSTRSRRSLYDELRRVRSTHSGPSAKKQRPKTMFYVDESGAAVTSESSLIPNFIVTN

SEQ ID NO: 119402 - protein, 210 aa, Heterodera glycines
  misc_feature (6)..(6): Xaa can be any naturally occurring amino acid
  Coding regions on vcDNA: vcDNA=SeqID_45825; Strand=-; Position=1 -200,254-346,392-532,590-676
  Homolog annotation: Hit_ID=NP_491780.1; Match level="QueryCoverage =90%, HitCoverage=36%, E-value=4e-46, Identity=47%"; Hit description =of inner mitochondrial membrane 44 (49.4 kD) (1G754) [Caenorhabditis elegans] gb|AAB53011.1| Hypothetical
  Essential gene: C elegans homolog=T09B4.9; Phenotype=Lva
YLFAEXLKTSESKDNVSEVLTQISKIDPEFDKSEWLRFCEKEMIPNILESTYQMNFEILRDWCYEKAFNLIAFNLIANSIKEYEKIGFNTRDSRIIDVSKVELVTGNMTDQGPTLVIQFQVLVTGNMTDQGPTLVIQFQVFMTNVVKNSEGKIVQGDPEKAVRVRHIWVICRDMEEFNPATVICRDMEEFNPATAWKLLELHMIKEDLFV

SEQ ID NO: 119403 - protein, 226 aa, Heterodera glycines
  misc_feature (182)..(182): Xaa can be any naturally occurring amino acid
  misc_feature (223)..(223): Xaa can be any naturally occurring amino acid
  Coding regions on vcDNA: vcDNA=SeqID_45826; Strand=+; Position=1-690
  Homolog annotation: Hit_ID=NP_510671.1; Match level="QueryCoverage =97%, HitCoverage=22%, E-value=2e-28, Identity=31%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
KTFVLHLGNKNPKEIYKIDGNIINVVDTIRDLGINIDNKLQFSNHVTQIIKNAYLRMRSLFRVIKSKSTRIWIILYKTYVRPLLEYAPEVWNPSLLKNIKKIEKCQKYFTKRVLFKCSLPPIPYQQRLEYLQLPTLESRRKLSDLFMAHKIIYGRTEIPLKYSNLLNALTFPFIDLTRNINXAKKPFAGRVTKIWNQLDKRLIEINSLNFKNKIKTISIPVKXTGK

SEQ ID NO: 119404 - protein, 372 aa, Heterodera glycines
  Coding regions on vcDNA: vcDNA=SeqID_45827; Strand=-; Position=1 -123,182-271,329-418,523-670,715-756,804-878,935-994,1037-1062,1112 -1144,1186-1243,1287-1393
  Homolog annotation: Hit_ID=CAB85466.1; Match level="QueryCoverage =100%, HitCoverage=100%, E-value=1e-112, Identity=57%"; Hit description=putative cuticular collagen [Ascaris suum]
  Essential gene: C elegans homolog=C46A5.3; Phenotype=Pvl
KSTLRPVAFAAVVFSTVAISSCLLTFPLVFHYVQTLQATVQGEVGEVEYCKSRSRDMWREMVDVEMATLDTEDELGMARRQRRQAEALGMARRQRRQAEALCCTCQQGPPGPDGDPANLGKDGAPGEGPGPPGAPGVDAELHDRVLPVPPQCPCQAPPGPPGPPGPPGNDPPGNDGLPGGPGRNGEDGATGPIGPAGPVGEDGATGPIGPAGPVGPPGQPGPPGQRGPPGEPGQLIQRGPPGEPGQLIPGEKPPPGPPGQPGRPPPGQPGRPGPPGPPGKPGQGPPGPPGKPGQVGKDGENGPVGKDGENGPPGPPGEPGQRGPPGPSGPPGLPGQVPPGPSGPPGLPGQVGQAGAGGSCDHCPTPRLAPGY

SEQ ID NO: 119405 - protein, 493 aa, Heterodera glycines
  Coding regions on vcDNA: vcDNA=SeqID_45828; Strand=+; Position=1 -100,177-396,443-596,643-750,805-948,995-1060,1115-1198,1249 -1338,1395-1547
  Homolog annotation: Hit_ID=NP_503233.1; Match level="QueryCoverage =97%, HitCoverage=90%, E-value=1e-87, Identity=39%"; Hit description =gastric lipase precursor family member (45.8 kD) (5B0) [Caenorhabditis elegans] gb|AAC69088.2| Hypothetic
  Essential gene: C elegans homolog=ZK6.7a; Phenotype=Unclassified
PELIAYWGYPVEVHTVTTEDGYVLQLHRIPYGRSHSAVPSSPRPHSAVPSSPRPVFFLQHGLIASSADWVTNLPSQSLAFILADAGFDVWMGNVRGNFYSDAHINWTKLEKKFWEFTWDEMAFKDLPAMVEKSLNISGQEFTWDEMAFKDLPAMVEKSLNISGQPFLYYVGHSQGTSIIFAKLASENETFAKKIRKVFALAPVASVKNIRKVFALAPVASVKNIDGLIAFLGRYFGRNLWASAAVFGTHDFLPHNWMSIMFAKIIAVFGTHDFLPHNWMSIMFAKIICGMSWRNVLCENVAFQIAGPESNQMNQSRLMVYAEHIPAGTSTWSRLMVYAEHIPAGTSTWNIIHWAQMRNSGKMQMFDFGDKAQMRNSGKMQMFDFGDKRINRKHYGQANPPLYNLSRISVPPLYNLSRISVPIYLYYSDTDWLADARDIEETIETILRSVRPQFIKRALKVTKFNHFDFVWGLLAPEKIYKEIIGTVKRHEKAI

SEQ ID NO: 119406 - protein, 238 aa, Heterodera glycines
  Coding regions on vcDNA: vcDNA=SeqID_45829; Strand=-; Position=1 -93,146-232,921-1108,1150-1351,1414-1560
  Homolog annotation: Hit_ID=CAE69086.1; Match level="QueryCoverage =26%, HitCoverage=62%, E-value=3e-14, Identity=65%"; Hit description =Hypothetical protein CBG15104 [Caenorhabditis briggsae] emb|CAE74544.1| Hypothetical protein CBG22301 [Cae
  Essential gene: C elegans homolog=K12C11.2; Phenotype =Dpy,Emb,Gro,Pvl,Stp
MADESATNAGGAGAAGGAQPAEYIKLKVVGQDSNEVHFRVKYGTSMGKLKKAYAERTGVQVRLLDCGSFAGITLHKPVCSHEVDFTTSPSSSFGHQNELENVQIRAKTLDLPSISQQNGGVHRHSVTCFATEQLPLPGRRNSLSEESNRTISKPQQTHQLGLVENNGNQRGEYDDEQEEENEERLLGSNEVGNGGHDEGGQIGFVEKDPQPFKFSCCIPFDSKQTGMLEVVVKTRNIQ

SEQ ID NO: 119407 - protein, 313 aa, Heterodera glycines
  Coding regions on vcDNA: vcDNA=SeqID_45830; Strand=+; Position=1 -100,177-344,397-578,620-718,758-898,965-1216
  Homolog annotation: Hit_ID=NP_510789.1; Match level="QueryCoverage =95%, HitCoverage=73%, E-value=1e-110, Identity=62%"; Hit description= acetyl-Coenzyme A Dehydrogenase family member (XR830) [Caenorhabditis elegans] gb|AAC69025.1| Hypothetic
  Essential gene: C elegans homolog=K05F1.3; Phenotype=Unclassified
MQPFVHWSKCIFKRPFSNSSKLFSSSFSMGFNFEFTEEQKQLQAAVKKFTQDEIIPKASHYDKTMEFPWEVIKKAHANGFMNVDIPSDCGGLDLELVSNVLISEVIGYGCTGIGTAILGNDLAATPLVIGAKEEVKKKFLSRLIDEPIMASYCVTEPGAGSDVAALKTKAEKKGDEWVINGSKMWITNGGVASWYFVLARTDPDPKASTGKAFTAFVVDGNTPGIVRGKKEINMGQRCSDTRAISFEDVVVPNAQVIGAPNEGFKVAMKTFDKTRPIVAALSVGLAARALDEASKYALERKTFGVPIAQVDKS

SEQ ID NO: 119408 - protein, 168 aa, Heterodera glycines
  Coding regions on vcDNA: vcDNA=SeqID_45831; Strand=+; Position=1 -25,80-405,1030-1185
  Homolog annotation: Hit_ID=AAA03341.1; Match level="QueryCoverage =100%, HitCoverage=100%, E-value=7e-49, Identity=60%"; Hit description=ribosomal protein L23a
  Essential gene: C elegans homolog=F55D10.2; Phenotype=Gro
MPPTSKKTGKAVAKAVEAKKKLAKGQHIVRKKKMRTSVHFYRPRTLKLARSPKFPRKAVPKRNKLDSFSIIKHPLTTESAMKKIEDTNTLVFIVDVKANKHQIKSAVNKLYNIEAQKGRVIRIVNTLYLTVYSSKVNTLVTPDHTKKAYVRLAADYDALDVANKIGII

SEQ ID NO: 119409 - protein, 630 aa, Heterodera glycines
  misc_feature (6)..(6): Xaa can be any naturally occurring amino acid
  Coding regions on vcDNA: vcDNA=SeqID_45832; Strand=+; Position=1 -178,508-645,698-913,962-1054,1102-1285,1330-1388,1465-1550,1607 -1706,1763-1928,1989-2109,2153-2222,2268-2324,2371-2418
  Homolog annotation: Hit_ID=CAE67141.1; Match level="QueryCoverage =95%, HitCoverage=88%, E-value=1e-162, Identity=54%"; Hit description= Hypothetical protein CBG12564 [Caenorhabditis briggsae]
  Essential gene: C elegans homolog=T08B2.9a; Phenotype=Emb,Lva
HSYNRXAYFVMAADNFDAQRILNILAERDNFQSNELADQLAIDHQRLIGAIKSLQVKEGLVCTSEVKIKRIELTTEGEEIIQKGSHEFNVYKIVGEKGISKSEIEKTSFGPIGLGKAMQCGWVGMKTSFGPIGLGKAMQCGWVGMDTTRRSALVVRKVANAEDGAKEQLKLVRKGDQLTAQCVAQLKKRKWIMESAIKALSVAKGPNAIKALSVAKGPNFTTTVQKQELDLTSEMIASGSWRGGSWRGKQFKQYNFSAMGVPPPSGHLHPLLKVRAEFRDIFFQMGFSEMPTNRFVESFWNFDALLQPQQHPLLQPQQHPARDSHDTFFFHGPALGPALSTEFPEDYLESVRKVHSEGGFGSIGYRYDWKLEEAQKNLLRYRYDWKLEEAQKNLLRTHTTAVSARQLYLLAQKPFQPSPFQPSKMFRIDRVFRNETLDAAHLAEFHQVEGVVAERNLSLAHVIGLFTEFFRKCGIENLRFKPTIENLRFKPTYNPYTEPSMEIYAFHTGLNKWVEIGNSGMFRPEMLLPMGLPEDVAPEMLLPMGLPEDVAVAGFGLSRTRPTMIRYGISNIRELFRPTMIRYGISNIRELFGHKIDLEMIYRNPLCRLEQGHKIDLEMIYRNPLCRLEQ

SEQ ID NO: 119410 - protein, 369 aa, Heterodera glycines
  Coding regions on vcDNA: vcDNA=SeqID_45833; Strand=-; Position=1 -102,162-641,694-856,945-1065,1120-1259,1302-1403
  Homolog annotation: Hit_ID=CAE56332.1; Match level="QueryCoverage =76%, HitCoverage=53%, E-value=1e-120, Identity=71%"; Hit description= Hypothetical protein CBG23998 [Caenorhabditis briggsae]
  Essential gene: C elegans homolog=F49E11.1a; Phenotype=Dpy,Emb,Rup,Stp
GPTANKGYRPDEALRIFGSKLTPYEHTELFNYQRVYFVGSQAKKRLCVAGGANNSNFDDENGSYALVSHDHIAYRYEILKVIGKGSFGQVKMEITQFAIQQFSVRQVIKAYDHKHQQYVALKLVRNEKRFHRQAEEEIRILDHLKKQDGDGSHNVIHMLDHFTFRNHKCITFELMSINLYELIKKNKFQGFNLTLVRKFAHSMLQCLELLHRNHLIHCDLKPENVLLKMPNRSSIKVIDFGSSCFDDQLILGAKYGMPIDMWSLGCILAELLTGYPLLPGEDENDQVDWFTFGPFSVSIGHRTFGNAKSETIGGRKAISELLFIQGTPALLPSHSAYGRHHRSDWGTIKKGQTEGTARVTNNAERTEKS

SEQ ID NO: 119411 - protein, 511 aa, Heterodera glycines
  Coding regions on vcDNA: vcDNA=SeqID_45834; Strand=+; Position=1 -38,123-236,325-448,491-804,992-1097,1130-1270,1356-1491,1596 -1655,1706-1800,1849-1999
  Homolog annotation: Hit_ID=CAE74339.1; Match level="QueryCoverage =96%, HitCoverage=83%, E-value=4e-79, Identity=37%"; Hit description =Hypothetical protein CBG22054 [Caenorhabditis briggsae]
  Essential gene: C elegans homolog=C07F11.2; Phenotype=Gro
RKWNDRNQAQSHRDDCSFEKGYVAISLYYLDGPMSTVNLKAQVNRKSKNKVGDVGDLPIRKCAGNALSVFRGHECELSFKDRAHLTEYIRHNAQLFRTDTYLNVLSPTAQLFRTDTYLNVLSPTPYHSFLTANYRARIGSKVWRKRSKKVSERVKAGERKSSQGTGREVPRMAILWSGHKKLDLETVFIHVMGQENGQMRRCSASGQRNADSHQALLLFKKLLVACCDSCERRASLITVRRNAEIDTKANDEEGETKREEGETEEETVRRNAEIDTKANDEEGETKREEGETEEEDRETEEENTFECDEEAKTEVHDTANMYFNTVYFNTVVLPEMEYVEDFVDFLIDAELSDLPVLKRACERYLCGELDSKKELMKKELMTSLILDFFFIAMVFSLPVMKSMTLLPVMKSMTLTELCDRYAELEIVDKLLEQEEYRNVDKRIRQICGERNLHDLVDEEYRNVDKRIRQICGERNLHDLVDECKRFREQCTRVKKVELNKEKASEKGGEGE

SEQ ID NO: 119412 - protein, 352 aa, Heterodera glycines
  Coding regions on vcDNA: vcDNA=SeqID_45835; Strand=-; Position=1 -264,701-834,904-1147,1208-1387,1456-1572,1664-1783
  Homolog annotation: Hit_ID=NP_502093.1; Match level="QueryCoverage =91%, HitCoverage=80%, E-value=7e-53, Identity=37%"; Hit description =tau-tubulin kinase family member (4L926) [Caenorhabditis elegans] emb|CAA97422.1| Hypothetical protein C0
  Essential gene: C elegans homolog=R90.1; Phenotype=Lva,Unc
MPEKRAEDDDDAVSQSPGTASAERKDSYDLVSLSAGTRVSGGRWTIIKELGQGAFGTVFLCSGNTDAGRREAAMKTERADEEPFLWKEAEIMRKVSTVRVGQGSEHFCRCFDEGRDVQRDTQSGELVTFNYVVMSLIGRGLFDLLSKAGDVFSPGTAIGVSLQLLDALRALHKVGYLHLDVKPENATIGRAETNERRRIFLIDFGLARRYISQSGRFRRERSKTHFRGTPMYASIAAHARADYCRADDIESWFYTLVDMYTGKLPWTHVTSERRTGKMKRLRLSHKPKEVQQRALHALLKKCPPIFYDILLHIRPKYEWIDRVLRDYLNTNGIHEFPYDWEKEANRRTRSAT

SEQ ID NO: 119413 - protein, 185 aa, Heterodera glycines
  Coding regions on vcDNA: vcDNA=SeqID_45836; Strand=+; Position=1 -145,218-327,509-623,665-720,766-796
  Homolog annotation: Hit_ID=CAE57843.1; Match level="QueryCoverage =90%, HitCoverage=48%, E-value=1e-60, Identity=66%"; Hit description =Hypothetical protein CBG00872 [Caenorhabditis briggsae]
  Essential gene: C elegans homolog=F42A8.2; Phenotype=Emb
RYVVKDLVPDMTLFYEQYASVQPWLQKNKPTKLGEAENFQSQAERTKLDGLYECILCACCSTSCDGLYECILCACCSTSCPSYWWNSDKYMGPAALLQSYRWIIDSRDDKANERLERLTDPFSVFKCHTILNCTKTCPKHLNPAKAHLNPAKAIGEIKKLLTGMETKPAPKQATNTKPAPKQATN

SEQ ID NO: 119414 - protein, 88 aa, Heterodera glycines
  Coding regions on vcDNA: vcDNA=SeqID_45837; Strand=+; Position=1 -116,673-737,785-877
  Homolog annotation: Hit_ID=NP_495991.1; Match level="QueryCoverage =95%, HitCoverage=22%, E-value=3e-17, Identity=44%"; Hit description =major allergen like precursor (2J632) [Caenorhabditis elegans] emb|CAA87779.1| Hypothetical protein F42A8
  Essential gene: C elegans homolog=F42A8.1; Phenotype=Gro
MFSFECQSKGVDAAEMVAVGCVTNGGEHRRIGHQWQDGDFLFYCKRKAAGLCEKSCLGCLLQGRRLYDGDRFRHGRTVFQCEIRPKRH

SEQ ID NO: 119415 - protein, 523 aa, Heterodera glycines
  misc_feature (521)..(521): Xaa can be any naturally occurring amino acid
  Coding regions on vcDNA: vcDNA=SeqID_45838; Strand=+; Position=1 -49,151-232,279-412,459-492,624-815,932-1053,1154-1280,1349-1429,1503- 1583,1644-1771,1816-1933,1982-2038,2092-2162
  Homolog annotation: Hit_ID=CAE59751.1; Match level="QueryCoverage =98%, HitCoverage=62%, E-value=1e-135, Identity=49%"; Hit description= Hypothetical protein CBG03197 [Caenorhabditis briggsae]
  Essential gene: C elegans homolog=T14D7.2; Phenotype=Egl,Pvl,Unc
SAWATVFHGRRGGRSKSLRVQLLLCFSAARNMKKLVQMPKDLQSTITCMFGLRFLSMVSTITCMFGLRFLSMVWTLVGHSFIFIQAFLSNVDEFKDDLVDHFWNQWITNFTLSVNQWITNFTLSVDVFLVLSGTLTAYSWFRRAQQSHSDESRVGWASWPYWLRFYRHRLVRLWPAYIYTLFAVTTRVSVTHYHPMWPPTDPAVQCPKHWLENVLFINSLTDNRCLPWTWYIGYIGTEFIFYLLSPVFLLALRHSALYGLSLVGLVSAASALANLIIMLQYNFPPTQMLWKQPSNFSPDFIKHHLVIYIHHLVIYIKPWYRIGPYLVGLVLGYVLASPQRKRSDGTHSARFVWVGWSPQRKRSDGTHSARFVWVGWATAGCAGFWSVFGLYPALQGWDCLFRPLYHLFYGSCARTIFALALWDCLFRPLYHLFYGSCARTIFALALGWLIYACHTGIGGPINWVLSLSPLVLSLSPLLPLSVLSYSVYLFHMIPVVFTYMFHMIPVVFTYMIRTPIHYNSXII

SEQ ID NO: 119416 - protein, 193 aa, Heterodera glycines
  Coding regions on vcDNA: vcDNA=SeqID_45839; Strand=-; Position=1 -46,681-790,1491-1592,1930-2019,2299-2532
  Homolog annotation: Hit_ID=CAH96984.1; Match level="QueryCoverage =70%, HitCoverage=23%, E-value=1e-11, Identity=32%"; Hit description =conserved hypothetical protein [Plasmodium berghei]
  Essential gene: C elegans homolog=Y41C4A.9; Phenotype=Gro,Stp
MPQNFCQNGTQFPGHAQTPSNGVVGSIDQALYQYIGRYMDLCCASTGDTDYKDRPFVQRLSRFESEFGDTEGNQIHEKRAVAQDYRELMDGNVDDCFRLGIGLAKKCLKLYTPFNESDFILCSPLGLKMLLDETAPEGDETTPKKQKRQKASAPFLRLGTEKRRKTDEATNDDDGGPNDFLASIELLIVERVI

SEQ ID NO: 119417 - protein, 427 aa, Heterodera glycines
  misc_feature (10)..(10): Xaa can be any naturally occurring amino acid
  Coding regions on vcDNA: vcDNA=SeqID_45840; Strand=+; Position=1 -49,762-2016
  Homolog annotation: Hit_ID=NP_510671.1; Match level="QueryCoverage =90%, HitCoverage=40%, E-value=2e-68, Identity=36%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
KYCHLLIFLXKPFKDPSIVNGPQTQSTQNKIKLSDIELNAGIIWNILRRLPRRNSTSPDNVPYILLKNCAEPITKILADIFRLILDSGQIPEIWRTSLVVPIFKKGEKTDPLNYRPVSLTSTVCRVFERILSSKILEFLNSTIDKEQFGFLKNRSTTTQILKTMDDIYNSIQKNQQIDIIYIDFVKAFDSVPIDLLLKIKKIGIEGKIQNFLTNFLKNRSFKVKIGEELSESFKIFSGVPQGSVLGPLLFLIFINDLPSFITIDGIKMYADDVKLYYAHENDDHSNQLDKAIEALEKWSKINGLEISTGKCFVLYRDMKKEYFINSKKISESDNVRDLGIIIDSKLNFSEHIKKIVRNAYLRIFQISRVLKSREIKTLTAAYKTFVRPQLEYATEVWNPNLKKDIDKIERVQKFFKRKALRKCGFVY

SEQ ID NO: 119418 - protein, 131 aa, Heterodera glycines
  Coding regions on vcDNA: vcDNA=SeqID_45841; Strand=+; Position=1 -149,214-275,546-589,642-753
  Homolog annotation: Hit_ID=NP_505981.1; Match level="QueryCoverage =95%, HitCoverage=34%, E-value=3e-32, Identity=53%"; Hit description =COLlagen structural gene (33.2 kD) (col-158) [Caenorhabditis elegans] emb|CAB02874.1| Hypothetical protei
  Essential gene: C elegans homolog=D2023.7; Phenotype=Emb
CKSRNTCPAGPAGPPGDIGPSGVPGIPGKDGIPGQAAEDSQNAPLKGCFNCPAGPTNCPAGPTGTPGTAGRPGIRGMRGPKGYPGQPGRDGVPGLPGLPGEQGQVGENGLDGRLGPTGFKGKDEEKQLGRK

SEQ ID NO: 119419 - protein, 153 aa, Heterodera glycines
  Coding regions on vcDNA: vcDNA=SeqID_45842; Strand=+; Position=1 -125,621-817,1146-1209,1270-1344
  Homolog annotation: Hit_ID=NP_501452.1; Match level="QueryCoverage =95%, HitCoverage=23%, E-value=2e-12, Identity=30%"; Hit description =gex interacting protein 9 family member, GEX (Gut on EXterior) Interacting protein GEI-9 (68.0 kD) (gei-9
  Essential gene: C elegans homolog=C28C12.9a; Phenotype=Gro,Stp
DQLRTESPTSQEKDKFPAKAHLALAKHKVFAAAVPFEFGGMNFCQKDMLQLSECLGGQDLNLLSTYGAFSLATSLIIQYGTTEQKEHYLPGIASGQWRPAVCIDDETTGPQSNEHVFSAKGQQQFLSATKINVQNAHNANLFIVFANRTVGDV

SEQ ID NO: 119420 - protein, 309 aa, Heterodera glycines
  Coding regions on vcDNA: vcDNA=SeqID_45843; Strand=-; Position=1 -91,759-889,948-1127,1546-1778,2051-2175,2263-2370,2527-2587
  Homolog annotation: Hit_ID=NP_502087.1; Match level="QueryCoverage =98%, HitCoverage=89%, E-value=1e-130, Identity=75%"; Hit description= phosphate carrier protein, mitochondrial precursor (36.7 kD) (4L912) [Caenorhabditis elegans] emb|CAA974
  Essential gene: C elegans homolog=F01G4.6; Phenotype=Emb,Lva
MVGITELAEATKKAFGAGPLIAANCATAENAKSGNEVEFGSMKFYGLCGIGGILSCGITHTAIVPLDLVKCRIQVDPAKYKGIIGGFKVTLQEEGVRGLAKGWAPTAIGYSMQGLGKFGLYEMFKNVYAGMIGEELAYSCRTYLYLAASASAEFFADMMLAPMEATKVRIQTSPGAPPTLRGCAPFIYRTEGLMGFYKGLPPLWMRQIPYTMMKFACFERTVELLYKHVVPKPRAECTKPEQLVVTFIAGYIAGVFCAIVSHPADTLVSQLNKDASADAMGILKKLGPLGVWGGLLPRIIMIGTLTALQ

SEQ ID NO: 119421 - protein, 262 aa, Heterodera glycines
  Coding regions on vcDNA: vcDNA=SeqID_45844; Strand=+; Position=1-789
  Homolog annotation: Hit_ID=NP_498735.1; Match level="QueryCoverage =98%, HitCoverage=61%, E-value=4e-32, Identity=32%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MAYKTYFSHELSYSTTAKDSHLNAAGYYRDPGDVLETGDGCTARRDLFALSNVAQFIAKIDTDLFNQPLYLINFCELDIEILPNDNEFVLIAPLAGAPRYRFEVVGLKLYVKKVSLMDGLALDIARKLEVKPARYAVRKTMMKSLFISQGRYEFTANLFMDQIPRRVTMGLVANADYVGSIRRSPFNFQPFNVREISIVANGRSYPQAPYDLEYPNGRYVRPFNDMNEAVGFANSSESNGITFAQYGKTHCIYVFNLTNSGG

SEQ ID NO: 119422 - protein, 112 aa, Heterodera glycines
  Coding regions on vcDNA: vcDNA=SeqID_45845; Strand=+; Position=1 -198,247-387
  Homolog annotation: Hit_ID=NP_492004.1; Match level="QueryCoverage =88%, HitCoverage=23%, E-value=1e-15, Identity=39%"; Hit description =tyrosine kinase (kin-14) [Caenorhabditis elegans] emb|CAA95813.1| Hypothetical protein F22D6.1 [Caenorhab
  Essential gene: C elegans homolog=F22D6.1; Phenotype=Sma
MSYRGLTKDVPKDEKIPFKWSAPEVWTQNSYTLKSDTWSYGVLSWEIFCDGAEPFHGMNMEAVMRVVNDGYRLQFLDNAPANFINLINDHVWDFDQRNRYSMKRVYELLKEM

SEQ ID NO: 119423 - protein, 752 aa, Heterodera glycines
  Coding regions on vcDNA: vcDNA=SeqID_45846; Strand=-; Position=1 -39,306-1371,1773-2551,2594-2968
  Homolog annotation: Hit_ID=NP_498735.1; Match level="QueryCoverage =49%, HitCoverage=91%, E-value=7e-41, Identity=27%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MDGGHVWHNISQQEEEPEEAPLNPLKNRTKLDQLRLKHERDKKEREEEDKRRQQREEQQQRKQREQQRKQREEQQRKQREEQQRKQQGEQQQKQQEKEQEKAKKSEAERLAKEKKTEKERLATEEVERLAKEKAEEERLANVKKEDERLAREKKEKEDEQLAMEAEEDRLAKLKQRELELLKELKPWRGGYMRLVHGKDPTPDVHYLHEKDDYHFVNAVHKYIVRHPELPWDSPEFNPSANIQQNIAEFWEIFEREVFDENYELKTREEKNELIELVKGFRFYFADELGRFTLRIFSDKISHITLTDQLAYVLGYEQQQEIHNEDQAKYAVDLAGGVSHLCIYLNSGIIESMIFGNSFANLLQVIAVEVFVQIHPITSYIDLSKVFVCTEFKLKKIAEDGVVVDVSANVAVGLIQMPGATFIRNLKVHINQREVYDSNQLYSYKVYLDTELSYPAAAKDAYFGVAGYFRDSDSTKVNEKRKKAVEESKSFQTISKLSADIFNQDLYMISNVEIDIELALQSDDFMVHQDDANKDKYTLEIVDCRLIVKTVDLMNGLSLDIARKLDTEPARYGIRKSFMKSLFVTGGRYDFSANLFTEEVPRRVVIGLVSNQNYIGHNQKNPFYFNHHNVRDIELTASDRTYPQYPYNLDYENNRYARAYHDAQEHLGMACTTESNGISYSMFKTAYCLYVFQMTNAQEDSPGFELIKEGCTAVNIRFAVAVPNEGVTLIAYAEADGLILIDRNRSITSDLTV

SEQ ID NO: 119424 - protein, 96 aa, Heterodera glycines
  Coding regions on vcDNA: vcDNA=SeqID_45847; Strand=-; Position=1 -139,188-318
  Homolog annotation: Hit_ID=XP_311506.1; Match level="QueryCoverage =94%, HitCoverage=93%, E-value=1e-27, Identity=67%"; Hit description =ENSANGP00000022836 [Anopheles gambiae]
  Essential gene: C elegans homolog=Y49E10.15; Phenotype=Emb
MAPPTNKVQKVMVQPINLIFRCLQSRSRIQIWLYENASSRIEGYIIGFDEYMNVFDEYMNVVIDEAEEVQLKSLNRHKLGRILLKGDNITLIQTIQ

SEQ ID NO: 119425 - protein, 50 aa, Heterodera glycines
  Coding regions on vcDNA: vcDNA=SeqID_45848; Strand=+; Position=1-150
  Homolog annotation: Hit_ID=NP_937786.1; Match level="QueryCoverage =96%, HitCoverage=22%, E-value=9e-15, Identity=72%"; Hit description =ribosomal protein L13 [Danio rerio] gb|AAH75977.1| Ribosomal protein L13 [Danio rerio] gb|AAS66969.1| rib
  Essential gene: C elegans homolog=C32E8.2a; Phenotype=Emb,Lva,Ste
LPNAHFHKHWQRRIKTWFNQPARKERRRAARSAKAARLAPRPAGGLLRPV

SEQ ID NO: 119426 - protein, 252 aa, Heterodera glycines
  Coding regions on vcDNA: vcDNA=SeqID_45849; Strand=-; Position=1 -213,271-418,516-643,706-973
  Homolog annotation: Hit_ID=CAE71475.1; Match level="QueryCoverage =86%, HitCoverage=40%, E-value=2e-30, Identity=35%"; Hit description =Hypothetical protein CBG18393 [Caenorhabditis briggsae]
  Essential gene: C elegans homolog=M03C11.4; Phenotype=Emb
MNLKRPLFLRPNLRINTSRGPFHLIRFLNKFVFSEKIVGYKNLKVSVLYSDPTLFLTSLYECEQKEDDSTKCDDIEYRIKDALPQTQLNAYLTIEKFRQKLSEQKNFVPFGELITKFCLKDSEIEHNFILYKFEKKQQNDAQFDQGYKFLERVQALAHWYIDAVSYTDNDDHRYFNYFLFAVRPSSDGDGSSVHRFAGYVNLYRFYHHPDKERVRIAQILVPPTYRRIGLGPRLLRAVYNDLCRAERVFDIT

SEQ ID NO: 119427 - protein, 285 aa, Heterodera glycines
  Coding regions on vcDNA: vcDNA=SeqID_45850; Strand=+; Position=1 -158,330-502,618-727,774-1188
  Homolog annotation: Hit_ID=AAA83354.2; Match level="QueryCoverage =72%, HitCoverage=40%, E-value=9e-87, Identity=73%"; Hit description =Importin alpha family protein 3 [Caenorhabditis elegans] ref|NP _501227.1| IMportin Alpha (56.2 kD) (ima-3)
  Essential gene: C elegans homolog=F32E10.4; Phenotype=Emb,Lva,Unc
EIVVQAQSADPEVQMLAVTQARKLLSSDRNPPIDDLISSGILPILVNCLESPNATLQFEAAWALTNIASGTSDQTRAVVQAGAVPHFLKLLESPNMNVCEQAVWALGNIIGDGPHFRDYCIELGIVQPLLKFVAPEIPLNFLRNVTWVMVNLCRSKDPPPNRQIVQMLLPMLAILIHHQDTSILVDTVWALSYLTDGGNDQIQLVIDSGVRFLLKLTTANIWLKTGCPIFGPSAWPSGSQSANGRTACSWQHCDRDGRSDAIGVGLWGPPNDAGTSLSPKGKDQQ

SEQ ID NO: 119428 - protein, 234 aa, Heterodera glycines
  Coding regions on vcDNA: vcDNA=SeqID_45851; Strand=-; Position=1 -159,374-661,713-829,947-1085
  Homolog annotation: Hit_ID=CAE66826.1; Match level="QueryCoverage =84%, HitCoverage=4%, E-value=1e-53, Identity=52%"; Hit description =Hypothetical protein CBG12193 [Caenorhabditis briggsae]
  Essential gene: C elegans homolog=T21E12.4; Phenotype=Emb
ELADEQIHLNAKLQLMLEAETEKRTSETLLKQIREEKQCIDRKKDEVERELAMVKPEVEKAKSAIAGIRKAQLVEVRSMASPPNAVKIAMEAICLLLGETQTEWKSIRAMMFKGDFISRILQFNTDSITPEIMEKMEQYEGNPEWEFEKVNRASVACGPMVKWARAQLSYAKMLRKIEALENKIQELKEQQLTMIRDGNGDMPCPSSQKRLNDNGEIQCPSSSTSSTFAASTSD

SEQ ID NO: 119429 - protein, 413 aa, Heterodera glycines
  Coding regions on vcDNA: vcDNA=SeqID_45852; Strand=-; Position=1 -251,301-491,556-751,804-890,1260-1304,1357-1452,1506-1736,1850-1996
  Homolog annotation: Hit_ID=XP_321554.1; Match level="QueryCoverage =95%, HitCoverage=32%, E-value=1e-116, Identity=53%"; Hit description= ENSANGP00000018144 [Anopheles gambiae] gb|EAA00907.1| ENSANGP00000018144 [Anopheles gambiae str. PEST] e
  Essential gene: C elegans homolog=B0464.2; Phenotype=Emb
SPCPIVFSSDNECVLSFSYKKGNKERNREKRKDWFTRATLLYTAADKILMYDQNHLLGRAYFCLLEGNKVEQADAQFNFVINQSQGNEGRVIPAMMGKACIAFNRKDYKAALHQYKRCLKQNPNSPADVRVGMGHCFARLGHMDKAKLAFERALQIDPNNVPSIIALAVLELNSGIPEGIRNGIQALGQAYHREPENPMVLNHLANHFFYKQDIEKTHNLASAAHQLADNDAMRAESMYHLARCYHKKQDYHHAFQFYYQATTLSHPKFVLPYFGLGQIYIYREEYENAIVAFEKVLKMVPNDIDTLAVLGSLYTNVPHKDPKIVVERREKAREYLTKLVDSQTERAPVEALIELAQLLEQQDPQVSLNLYTRVANLLKDDIGVDIPAEILNNIGSLHFMLNQLDEAKAIKLT

SEQ ID NO: 119430 - protein, 560 aa, Heterodera glycines
  misc_feature (11)..(11): Xaa can be any naturally occurring amino acid
  misc_feature (424)..(424): Xaa can be any naturally occurring amino acid
  misc_feature (439)..(439): Xaa can be any naturally occurring amino acid
  misc_feature (450)..(450): Xaa can be any naturally occurring amino acid
  misc_feature (460)..(460): Xaa can be any naturally occurring amino acid
  misc_feature (537)..(537): Xaa can be any naturally occurring amino acid
  Coding regions on vcDNA: vcDNA=SeqID_45853; Strand=-; Position=1 -105,176-456,512-589,672-758,873-1018,1107-1220,1301-1443,1501 -1582,1629-2117
  Homolog annotation: Hit_ID=CAE61262.1; Match level="QueryCoverage =93%, HitCoverage=55%, E-value=1e-115, Identity=45%"; Hit description= Hypothetical protein CBG05068 [Caenorhabditis briggsae]
  Essential gene: C elegans homolog=K04E7.2; Phenotype=Unclassified
AIFSNFRSLTXITICQHFISKFRSILADGYLGKFRTTIFFLSLLYAVGQCVLCFASTLNGTSSLHPFLDILGLVIIGVGTGGIKPCVCSFGGDQFEPHQQKMLSVFFSAFYFAINAGAMISTFISPMFRAMPCLGQDSCMPCLGQDSCYPLSFGVPAALMVLATILFMSASFWYIKRPPKENIFREVYQVGKVTLVNKWRSKGNKKRGSHWLDFYFDSHLCDSDPKCEELRTLKDNPNECHKRRLVSDVRGLLRVLVVYLPAPVFWALYDQQGSRWLIQSVMMDCRLVMMDCRLWGDTLLLPDQMLTLNSVLILLFIPMFQVIVYPMVSLLAKITPLRKMVAGGLFAALAFVLSAPLRKMVAGGLFAALAFVLSAIVQFQINTTLPDIPMDGRAFVSAITTLPDIPMDGRAFVSAINAFDNSFXKCAQRMEKGQKSVEXWSHKSKADKGXQHSQNPFRHXQIRTEKGRKCSNWTGDSESGTLKGRGETAGGSIRGRGGPGVECRTHLLDDGQSNGRSVWETDTLKPTGGKGEFKVGXVPKLEGGGPPKGGWTGKSRREGS

SEQ ID NO: 119431 - protein, 350 aa, Heterodera glycines
  Coding regions on vcDNA: vcDNA=SeqID_45854; Strand=-; Position=1 -114,186-311,486-647,993-1181,1803-1865,1909-1986,2040-2166,2208 -2314,2367-2451
  Homolog annotation: Hit_ID=EAA08393.2; Match level="QueryCoverage =97%, HitCoverage=99%, E-value=1e-144, Identity=62%"; Hit description= ENSANGP00000014714 [Anopheles gambiae str. PEST]
  Essential gene: C elegans homolog=K07A1.12; Phenotype=Emb
QMSVPGSQPPQQGEDAEERLINEEYKIWKKNCPFLYDMVMTHALEWPSLTVQWLPDVQRQEGADYTIHRLILGTHTSDEQGEFGGFGTVTGKIEVEIKMNHEGEVNRARYMPQNPVLIGTKSPSSEVYVFDYTKLMRSFSSIITNLIKSGLSWNNNLPGHLLSASDDMTVCLWDIQAATANANFLDAKSIFTAHTAVVNCLSFNPYSEFILATGSADKTVALWDLRNLKLKLHSFESHRDEIFQVQWSPHNETILASSGTDRRLHIWDLSKIGDEQSPEDAEDGPPELLFIHGGHTAKISDFSWNPNEPWVICSVSEDNIMQIWQMADNIYNEEELDPAMVEGVAAASGA

SEQ ID NO: 119432 - protein, 100 aa, Heterodera glycines
  Coding regions on vcDNA: vcDNA=SeqID_45855; Strand=-; Position=1 -123,177-270,344-426
  Homolog annotation: Hit_ID=NP_508588.1; Match level="QueryCoverage =88%, HitCoverage=14%, E-value=5e-25, Identity=60%"; Hit description =chitinase (66.9 kD) (cht-1) [Caenorhabditis elegans] gb|AAA83586.1| Chitinase protein 1 [Caenorhabditis e
  Essential gene: C elegans homolog=C04F6.3; Phenotype=Emb
FCEMLANGAQRYVDRETLVPFLVADNDQWFSYDDVESIRNKLSWIRQNSFGGAFVWTLDFDDFNGQCPGSQLGRYPLIRTIAQELGGIQLSQTPVSALSN

SEQ ID NO: 119433 - protein, 279 aa, Heterodera glycines
  Coding regions on vcDNA: vcDNA=SeqID_45856; Strand=-; Position=1 -33,235-311,431-513,564-681,1638-1777,2219-2342,2627-2674,2726 -2750,2815-2927
  Homolog annotation: Hit_ID=NP_508588.1; Match level="QueryCoverage =100%, HitCoverage=40%, E-value=8e-77, Identity=54%"; Hit description= chitinase (66.9 kD) (cht-1) [Caenorhabditis elegans] gb|AAA83586.1| Chitinase protein 1 [Caenorhabditis
  Essential gene: C elegans homolog=C04F6.3; Phenotype=Emb
AFHHLNGINVRAYDPADLPSDWQPKGMYSRVNALKAFDPVLKTLLSFGGWSFGTRLFQGMSSNEANRKVEANRKVFIDSSILFVRKYGFDGIDIDWEYPNGEAERQNFIAFLQELKDAVGAEASSSGKPRLLITAAVAAGTENIDNGYDIPTVGKLLDFVLLMSYDFHGSWEQQTGMNAPLYGRSKDVPEKRLWNVAGAANYWAEKGMPKSKIIIGIPIIIGIPTYGRGWTLSNPQQFRGLDRGWTLSNPQQFRGLDAPGQAAKATKFVQLAGTGAYFE

SEQ ID NO: 119434 - protein, 232 aa, Heterodera glycines
  misc_feature (9)..(9): Xaa can be any naturally occurring amino acid
  misc_feature (219)..(219): Xaa can be any naturally occurring amino acid
  Coding regions on vcDNA: vcDNA=SeqID_45857; Strand=-; Position=1 -143,237-331,393-556,696-853,1351-1453
  Homolog annotation: Hit_ID=CAD48141.1; Match level="QueryCoverage =73%, HitCoverage=38%, E-value=2e-29, Identity=42%"; Hit description =hypothetical protein [Brugia malayi]
  Essential gene: C elegans homolog=D1069.3a; Phenotype =Gro,Lvl,Pvl,Stp,Unc
RAEFMTIFXSKFLLDVLYKILLIFRVRIFKNFKIWQINSLFPVLFIYERARASTVRLGPYPAIDSMIAENRFTVLTRLMRVVTHFISHMAPEVTHFISHMAPEVICPSLCRSLLYICRSGFSFQESDLRHRVMRERASVEVFADFSKKARIRVVSPFLVESINGVNFALLNGHADIALRALDAAHQRAQYEMMADVLLVCRPIIFTLSICLRRQRRRRXSWRRHQKGGDHAS

SEQ ID NO: 119435 - protein, 384 aa, Heterodera glycines
  misc_feature (376)..(377): Xaa can be any naturally occurring amino acid
  Coding regions on vcDNA: vcDNA=SeqID_45858; Strand=+; Position=1 -202,256-467,773-907,953-1179,1238-1384,1592-1709
  Homolog annotation: Hit_ID=B88612; Match level="QueryCoverage=95%, HitCoverage=29%, E-value=2e-84, Identity=50%"; Hit description =protein Y76A2A.2 [imported] - Caenorhabditis elegans
  Essential gene: C elegans homolog=Y76A2A.2; Phenotype=Gro,Lvl,Prz,Unc
SSNFNLLFDRRLSFKEPSLNTLQQFSVVIGTEKWLTENEIPTENYLMETLHAERQSGNILTLCAVNGKVAAVISIVDQAKREAPLAKVAAVISIVDQAKREAPLAVWALYQMGMKVVLLTGDNAKTAEATAKRVGIREVYAEVLPNQKKDKIKQLQFQNQVVAMVGDGVNDSPALAAANVGIAIARGSDVAIESAGIVLVKNNLVDVVNNLVDVVSAIKLSRKVVRRIRLNLFFAFVYNAIGVPLAAGVFSPWGVHIQPWMAAAAMALSSVSVVSSSLLLRRFKKPTEHSLSSTEFKPTEHSLSSTEFKRYRRNLNDQNGIEVNVYKGLDKREGKRNTEQTDLSAFLSSGSDLSDDDGPNLSDRANARAKLFENVXXRTEELAQ

SEQ ID NO: 119436 - protein, 308 aa, Heterodera glycines
  Coding regions on vcDNA: vcDNA=SeqID_45859; Strand=+; Position=1 -93,144-335,391-669,722-940,992-1135
  Homolog annotation: Hit_ID=CAE60278.1; Match level="QueryCoverage =99%, HitCoverage=70%, E-value=3e-63, Identity=43%"; Hit description =Hypothetical protein CBG03859 [Caenorhabditis briggsae]
  Essential gene: C elegans homolog=T04B2.2; Phenotype=Unclassified
MYTVDNNSDKGFRTIERFVDHYLRTGTSVTSERFVTLRNAVHRANWELSHSSITISAELGRGAFGTVYRAKLTERNGNNSQVAVKEVSQTSTKEQIKEFMNEARIMRQLDHPNVIRFHGVAVGQEPLMIVIELASDGSLIDYLKTQRRSARTRLFMCVGAAAGLAHIHSKGIIHCDIAARNCLYSNGVVKISDFGMAHRGPVKKMEPNARVPVKWLSPEALAERCFTAKSDTWAYGVMCWEIFTNGEVPYSQMAGSDVAVSLINGQRLNFPRDAPSKLVEFILQHIWDAETSGRYSMAAVYDWLKRHT

SEQ ID NO: 119437 - protein, 345 aa, Heterodera glycines
  Coding regions on vcDNA: vcDNA=SeqID_45860; Strand=+; Position=1 -144,228-473,723-759,807-1100,1597-1655,1702-1825,1879-2012
  Homolog annotation: Hit_ID=NP_508530.1; Match level="QueryCoverage =99%, HitCoverage=51%, E-value=1e-37, Identity=37%"; Hit description =homolog of yeast exocyst protein Sec3p like (97.3 kD) (XD714) [Caenorhabditis elegans] gb|AAB54035.1| Hyp
  Essential gene: C elegans homolog=F52E4.7; Phenotype=Gro,Unc
LSNAYLPVQKPEFINVSLPVDTMMPKVGNSQDSGETESKNIEMDSNYQPITQREEADFRRLLSKSNLQIGQAKQFATVLSEQLAQLDTANLSTIMENKQNVGGLIELVDTAIELAECIERQLDEYDTLLSFVRDSVELIEEKDSLRHIEQQNNKRLFDELKDFVFLMEMVHDQHIDALKSANLSDPTGYLLSLFSCAITISQNQLVLSSCSRGRPFSEQKNATQWDESVSDKSGIAEQIDGGSHSLSADNAISSLKPYTDLTETAVAECRTVVESEQKFSIRFFHLNIDILSQVGVEMNKNQNDGRKTVEKQLNDQIKFAIGDIFDSLPTYFYALVSTFKDHNLV

SEQ ID NO: 119438 - protein, 151 aa, Heterodera glycines
  Coding regions on vcDNA: vcDNA=SeqID_45861; Strand=-; Position=1 -132,280-445,498-630
  Homolog annotation: Hit_ID=NP_741562.1; Match level="QueryCoverage =96%, HitCoverage=34%, E-value=1e-44, Identity=57%"; Hit description =tumor differentially expressed 1 like, possibly N-myristoylated (5H541) [Caenorhabditis elegans] gb|AAL27
  Essential gene: C elegans homolog=Y57E12AL.1a; Phenotype=Egl,Gro,Pch
PQGDHHLPVNSLVSLVIWFCCLLYASIRTSSYTALGKIGGAISSGEASMSVEEGDRGTTGRNVYDNEKGSVAYSYSFFHFIFALASLYVMMTLTSWYTPSDDLRYLNPSDDLRYLNDNMASLWVRVISSWLCAALYLWTLLAPVLFPDRDF

SEQ ID NO: 119439 - protein, 140 aa, Heterodera glycines
  Coding regions on vcDNA: vcDNA=SeqID_45862; Strand=+; Position=1 -44,643-1021
  Homolog annotation: Hit_ID=NP_508269.1; Match level="QueryCoverage =69%, HitCoverage=14%, E-value=3e-10, Identity=33%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MVHIVFDPSIAQYDDQNYIDLSKCYLLTEFRIRKENVNGQLVNLTVDDADIAPIQMIGQTFIRNIKMSINGREIFNANALMAYKTYFSHELSYSTTAKDSHLNAAGYYRDTGEVLETGNGCIARRNLFAGSNVAQFIAEN

SEQ ID NO: 119440 - protein, 154 aa, Heterodera glycines
  Coding regions on vcDNA: vcDNA=SeqID_45863; Strand=+; Position=1 -36,1462-1638,1688-1877
  Homolog annotation: Hit_ID=NP_495784.1; Match level="QueryCoverage =93%, HitCoverage=28%, E-value=3e-25, Identity=43%"; Hit description =component of the meiotic and mitotic spindle poles, ZYGote defective : embryonic lethal ZYG-9 (156.2 kD)
  Essential gene: C elegans homolog=F22B5.7; Phenotype=Emb
FAIVWLLHCATADPYDLIEPVDISSKLNINFESPKWQERKEALDALQQLLSQTPRLADSPNYREVIERLAKTVASDANIIVAASATKCVMLTVASDANIIVAASATKCVMLFAKGLRAKFTPHVSLVVPVIFDKFKEKKQLLRDALVECIDVIA

SEQ ID NO: 119441 - protein, 261 aa, Heterodera glycines
  misc_feature (213)..(213): Xaa can be any naturally occurring amino acid
  misc_feature (255)..(255): Xaa can be any naturally occurring amino acid
  Coding regions on vcDNA: vcDNA=SeqID_45864; Strand=-; Position=1-812
  Homolog annotation: Hit_ID=NP_508605.1; Match level="QueryCoverage =76%, HitCoverage=74%, E-value=2e-31, Identity=35%"; Hit description =predicted CDS, RNA-directed DNA polymerase family member (XE132) [Caenorhabditis elegans] gb|AAA96082.1|
  Essential gene: C elegans homolog=ZK250.3; Phenotype=Clr,Lvl,Sck
ADDVKLYSDTEIMHKALHNLFEWANNWQIKVSIQKTFVLYLGSKNPKETYKFDGNTINAVDTIRDLGVNIDNKLQFSDHINQITRNAYLRMRLFRIIKSKSSKIWITLYKTYIRPLLEYAPEVWNPSLQKNIKKIEKCQKYFTKRVFFKCSLPPIPYQNRLEYLQLPTLENRRKLFDLFMAHKIAYGRTDLKLFSIFNPSTRFHPLLQILKIXTGQKIHSLCWEGNKLWNQLDKEIIKINSLNQFKIKLKSSLGXSVRPGK

SEQ ID NO: 119442 - protein, 118 aa, Heterodera glycines
  Coding regions on vcDNA: vcDNA=SeqID_45865; Strand=+; Position=1 -102,374-483,541-685
  Homolog annotation: Hit_ID=CAG04432.1; Match level="QueryCoverage =80%, HitCoverage=86%, E-value=3e-15, Identity=44%"; Hit description =unnamed protein product [Tetraodon nigroviridis]
  Essential gene: C elegans homolog=C50B8.2; Phenotype=Emb
MIDRNSPLHMFVFANRLATFEGRWNYKEGCTAEKMARAGFFCTEKRKKPSDAAKCYICLHEMYWDPEDEPWEEHKKHRPDCPLVTIGKQNEEEFTVREVLLLLAYEHSTKMVGANAIE

SEQ ID NO: 119443 - protein, 87 aa, Heterodera glycines
  Coding regions on vcDNA: vcDNA=SeqID_45866; Strand=+; Position=1 -114,180-278,340-392
  Essential gene: C elegans homolog=F27C1.3; Phenotype=Lva
KDSKYQTLAGLDANIFVKNAPPAAAPKPQQSKAPQQLVKDSKYQTLAGLDANIFVKNAPATPAKAAPQAPVKDSKYQTLAGLDITSL

SEQ ID NO: 119444 - protein, 199 aa, Heterodera glycines
  misc_feature (11)..(11): Xaa can be any naturally occurring amino acid
  misc_feature (198)..(198): Xaa can be any naturally occurring amino acid
  Coding regions on vcDNA: vcDNA=SeqID_45867; Strand=-; Position=1 -139,199-239,285-431,484-516,597-686
  Homolog annotation: Hit_ID=CAE61657.1; Match level="QueryCoverage =51%, HitCoverage=60%, E-value=9e-45, Identity=78%"; Hit description =Hypothetical protein CBG05593 [Caenorhabditis briggsae]
  Essential gene: C elegans homolog=Y59A8B.20; Phenotype=Lon
FAIRRMPKVIXMITPPPHLSTLGQDQIIADLGRLIVENCPPMLCTGLDCAVVTERNGCQLDCAVVTERNGCQLCACPIGSPARGCDPMPFVLWHDLILCACPIGSPARGCDPMPFVLWHDLIVNGCPNITVNTRDSAQKVHRWFRRVNRFSNTDQCEVNRFSNTDQCEPPYIFPYCPELDFNLWRSPRTKQECELVSXL

SEQ ID NO: 119445 - protein, 136 aa, Heterodera glycines
  Coding regions on vcDNA: vcDNA=SeqID_45868; Strand=+; Position=1 -168,1279-1388,1449-1555
  Homolog annotation: Hit_ID=CAE64859.1; Match level="QueryCoverage =99%, HitCoverage=37%, E-value=4e-28, Identity=51%"; Hit description =Hypothetical protein CBG09655 [Caenorhabditis briggsae]
  Essential gene: C elegans homolog=H27A22.1; Phenotype=Unclassified
HITLQLIFLDGEEAFHEWSHLDSIYGARHLADTWERKWYPSTDGSAFELSREIDRIDVFVLLDLLGAKNPHIQSVPGHGAASLFEQLPYTGENWPKLNLLWPKLNLLNRIPRIFYPGTSYFGAVEDDHLAFMRKGI

SEQ ID NO: 119446 - protein, 290 aa, Heterodera glycines
  Coding regions on vcDNA: vcDNA=SeqID_45869; Strand=+; Position=1 -136,182-255,457-628,672-764,811-975,1026-1258
  Homolog annotation: Hit_ID=NP_495006.2; Match level="QueryCoverage =97%, HitCoverage=34%, E-value=1e-71, Identity=45%"; Hit description =exocyst complex component sec6 (90.7 kD) (2F661) [Caenorhabditis elegans] gb|AAA79344.3| Hypothetical pro
  Essential gene: C elegans homolog=F09E5.5; Phenotype=Gro,Unc
YLEACRRRVVDDLRLVRTSLSACFPPEYNIYDRYVKYYHDSISLHIKKLASDALEKNELVQLLSWIQSYTGEQMLGHPKLGIQAQALVHEFPLLPKSTTNHLHDRFIEMTRRDMHEWLDKTMMQEKDDWYKQVPPETDSNKFFYTQLPSILFGMVEDTVSLSKEISQEIVPRVIDVAVDEFIIFSNKYKEAATAYKGKHFEDRSHFQSYTSTVIAIANNLDICVDSTDKLEKHIRLTMESGSIDGLSSPEPTIAYGPPSARSVGFSVINRQELIGKMEQLKKKWQFGIQF

SEQ ID NO: 119447 - protein, 350 aa, Heterodera glycines
  Coding regions on vcDNA: vcDNA=SeqID_45870; Strand=+; Position=1 -153,202-572,623-1152
  Homolog annotation: Hit_ID=CAE57282.1; Match level="QueryCoverage =64%, HitCoverage=35%, E-value=1e-51, Identity=38%"; Hit description =Hypothetical protein CBG00187 [Caenorhabditis briggsae]
  Essential gene: C elegans homolog=C25A11.4a; Phenotype=Emb
SLRAKERREIERLEEEERERQRQDEERRERERRERERLEAMERERQRQLEEQRERDRIAALEASAIERRALRAREEQRARERADLDRRAEELREQEKRERERRDRERAEEERRLAELREAEQRNAGQRERERREAQEREERRRNEGWRSRDRLEQLARERDERERWEAEKRRLLSDYEQGARKRQELTSKETLERLTRKPYYSRENLTQLGTGGEPTEYRGKGIEPPEFTTKVGEASSWHLPFVHSVPGRTTSDRTRRPHFVDRAGDDARLRRIASGELRLFRQHRRHFSVSVGRIGRKHARAHVQPTRRGLSAPRGFTTDVEIPRTNGKSTEGFSAGNGRRRGTISAKC

SEQ ID NO: 119448 - protein, 176 aa, Heterodera glycines
  Coding regions on vcDNA: vcDNA=SeqID_45871; Strand=-; Position=1 -99,182-246,329-453,524-762
  Homolog annotation: Hit_ID=AAO85519.1; Match level="QueryCoverage =99%, HitCoverage=54%, E-value=5e-54, Identity=56%"; Hit description =putative serine/threonine phosphatase [Oesophagostomum dentatum] gb|AAO85518.1| putative serine/threonine
  Essential gene: C elegans homolog=W09C3.6; Phenotype=Ste
MGYPSFTKYMFLGDMVDRGNQSVETIVLLLLYKVRYPTKFYVLRGNHECASINRTYGFYDEINERYGHHNVRPLWERFNMTFAWLPFVGLVSDCILCMHGGIAPEMTNIQQLRMLRRPYIDPPVPSLELDLLWADPSTAVEGTAPNPRGVSILFGADVVASVCKKLNIELVVRAHQ

SEQ ID NO: 119449 - protein, 102 aa, Heterodera glycines
  Coding regions on vcDNA: vcDNA=SeqID_45872; Strand=+; Position=1 -48,375-439,497-633
  Homolog annotation: Hit_ID=NP_004625.2; Match level="QueryCoverage =97%, HitCoverage=6%, E-value=3e-29, Identity=59%"; Hit description =bromodomain and PHD finger-containing protein 1 isoform 2 [Homo sapiens] gb|AAF19605.1| putative 8-hydroxy
  Essential gene: C elegans homolog=F42A9.2; Phenotype=Unc
YLTMIDNDAPCCICNDGEDSNANQIIFCDICNIAVHQECYGVPYIPEGQWLCRRCQMECYGVPYIPEGQWLCRRCQMSPSIPVNCALCPCSSGAFKQTSDGR

SEQ ID NO: 119450 - protein, 253 aa, Heterodera glycines
  Coding regions on vcDNA: vcDNA=SeqID_45873; Strand=-; Position=1 -331,3450-3601,3890-4168
  Homolog annotation: Hit_ID=NP_729142.1; Match level="QueryCoverage =82%, HitCoverage=44%, E-value=5e-48, Identity=48%"; Hit description =CG7018-PA, isoform A [Drosophila melanogaster] gb|AAF50697.2| CG7018- PA, isoform A [Drosophila melanogast
  Essential gene: C elegans homolog=C37F5.1; Phenotype=Unclassified
MAFYTGEAMATTTALIGRHQHNSHSNNNSTNGEADRSNGTGTTVAKIGSPSAAAVEQKRHNSNSSVGRGGGGGTAAQTATGGGGTVAAAAEATVRLQHHGMERRAPATGAENPYEVLGPICSRLAAAGSGQIQLWQFLLELLSNPLNAEMITWEGTHGEFKLCEPDEVARRWGERKSKPHMNYDKMSRALRYYYEKQIMSKVHGKRYAYKFDFDGKNHNSYAYHATFSMALFRTIFLSKWLYDLLCCGWQAFF

SEQ ID NO: 119451 - protein, 220 aa, Heterodera glycines
  Coding regions on vcDNA: vcDNA=SeqID_45874; Strand=-; Position=1-660
  Homolog annotation: Hit_ID=NP_510671.1; Match level="QueryCoverage =100%, HitCoverage=22%, E-value=3e-42, Identity=42%"; Hit description= predicted CDS, endonuclease/exonuclease/phosphatase family and RNA -directed DNA polymerase (XR69) [Caeno
  Essential gene: C elegans homolog=ZK250.3; Phenotype=Clr,Lvl,Sck
MERILSQNIYNFLLKNNKISEYQFGFVRNRSTTSQLITVVEDWYEAIINGKNVDCIYIDFQKAFDSVPHNLLLYKLEKIGIKGKLLMWIKGFLSNRTFRVKIGDSLSSSKKVTSGVPQGSVLGPLLFLIYINDLPDALPSGVKIKLYADDVKLYICYKARADTEIMHKALHNLFEWANKWQIKVSIQKTFVLYLGSKNPKETYKFDGNTINAVDTTRDLG

SEQ ID NO: 119452 - protein, 141 aa, Heterodera glycines
  Coding regions on vcDNA: vcDNA=SeqID_45875; Strand=+; Position=1 -81,136-237,439-546,645-754
  Homolog annotation: Hit_ID=NP_498417.1; Match level="QueryCoverage =96%, HitCoverage=52%, E-value=5e-30, Identity=48%"; Hit description =SET (trithorax/polycomb) domain containing (27.6 kD) (set-1) [Caenorhabditis elegans] gb|AAC77512.1| Set
  Essential gene: C elegans homolog=T26A5.7a; Phenotype=Emb
FRCSVKGRSVRASKCFQRGEFVVEYKGDLISVKTAQLDLISVKTAQLREQRYAKDENVGSFMYYFRHRDNVFCIDATDETPYKGRLINHSYLNNLKTRVFIIGRTFLVLVAMRDIDNGEELLYDYGERRPSVLAVNPWILG

SEQ ID NO: 119453 - protein, 353 aa, Heterodera glycines
  Coding regions on vcDNA: vcDNA=SeqID_45876; Strand=-; Position=67 -246,293-423,477-720,778-957,1004-1120,1173-1382
  Homolog annotation: Hit_ID=AAL78213.1; Match level="QueryCoverage =72%, HitCoverage=100%, E-value=1e-112, Identity=82%"; Hit description=probable protein kinase Hgg-20 [Heterodera glycines]
  Essential gene: C elegans homolog=R90.1; Phenotype=Lva,Unc
MADELVALAPGTRVSGRWTILKKLGAGAFGAVYLCKDGKGTVAALKTEPIDTRQPLLVMEATVLDTLGKKLKNADGQHFCRLLDLGRSEQRNATSGDTVFNYVVMTVVGTPLDKLIRDAGDRFSPGTAIGMSIQLLSAIKALHNVGFLHRDIKPANTAIGRAETNEHRLLYLIDFGMARQFLRPDGTQRRPRASANFRGTPIYAPISAHIKRDYSRKDDVESWFYVMVKFYKGAVPWKFANDVKEIGRMKCRRMEGQPDEIRQQAITELIGGCPPEFTQILAHIDGLQLEDRPNYEMIETMLREHLTRSRVPEHPYDWEVGRRNAMAQAQSEAARRKKDNTKEGGGGKNNTQG

SEQ ID NO: 119454 - protein, 542 aa, Heterodera glycines
  Coding regions on vcDNA: vcDNA=SeqID_45877; Strand=+; Position=1 -243,294-463,517-765,797-960,1007-1367,1435-1570,1736-1841,1895 -1986,2028-2132
  Homolog annotation: Hit_ID=NP_056076.1; Match level="QueryCoverage =96%, HitCoverage=31%, E-value=3e-45, Identity=28%"; Hit description =KIAA0056 protein [Homo sapiens]
  Essential gene: C elegans homolog=Y110A7A.1a; Phenotype=Emb
EVLIEPIVKESEEGAICWRLLALIEEEADLRRLLLRSLIFLHKDKSLPPRLVPRLLSRCSANPELTFPCWMLLSELSKFLDVSPNEAVSYWSDYLTLTHQNRLIGYMADLIANRAKVLSFQQRRFLRESVSGALQQFKIHPTYISSVYHLFARIVNGIGQDASGKAELTKFNQQWFSKCLVELDLLVYANAPPEVDDAESVNSQGSNSTELPGSQRRASQIDNCEKIIRLITSIGECLQYTPALINKQIVNLLQVIIASDVLNRIYQAHNDNEHGDKLGVPSPQRLFSPNTSFHTELPADGPGGTQSNAASEAGGVAASDQNQRHFHMRIKKRIFRGELMSREVRASGVLAIGKLCLLDEQLAKKCIPVFVRQLRENPDHFVRNNIVVVICDLCIRYTSEVDRYSTILASCLWDSSILIRRQTLLLLTNLIKEQYLKWEGTTDILLPQFRERMFFHHFLECMFNFNGVRHVSWIPSAGYELSEEVQKRCSLEGRELFDSRMRLYKYMLNTFEDQQKVYILEKIGLEIFVPIVEGRLKLSDVK

SEQ ID NO: 119455 - protein, 109 aa, Heterodera glycines
  Coding regions on vcDNA: vcDNA=SeqID_45878; Strand=-; Position=1 -32,1770-1813,1927-2075,2217-2325
  Homolog annotation: Hit_ID=NP_006554.1; Match level="QueryCoverage =93%, HitCoverage=27%, E-value=4e-40, Identity=68%"; Hit description =Kruppel-like factor 1 (erythroid) [Homo sapiens] gb|AAB51173.1| erythroid Kruppel-like factor [Homo sapie
  Essential gene: C elegans homolog=Y40B1A.4; Phenotype =Emb,Lva,Pvl,Rup,Stp,Unc
SSFLKFVSAPPKTNLKTWSSKRKAAHRCAHPGCGKAYSKSSHLKAHLRTHSGEKPFRCDWKDCGWCFARSDELTRHYRRHTGYRPFQCAYCSRRFARSDHLKSHVKNRH

SEQ ID NO: 119456 - protein, 149 aa, Heterodera glycines
  Coding regions on vcDNA: vcDNA=SeqID_45879; Strand=-; Position=1 -144,999-1128,1472-1646
  Homolog annotation: Hit_ID=NP_493582.2; Match level="QueryCoverage =68%, HitCoverage=14%, E-value=2e-15, Identity=41%"; Hit description =SeMaPhorin related (78.5 kD) (smp-1) [Caenorhabditis elegans]
  Essential gene: C elegans homolog=Y54E5B.1a; Phenotype=Mab
DRMPMLFANHLFQQMFLLFMISSFHAQLVAVDNLNPRPRQIVNEGDQKVAIQLANGQVLVCGTHAFSPQCRQYEFSQSESRFVERSQFNGQGISPYDPRQNATFAYSNELNAIFIGAISDFSATDPLIYRRKLSNGETMRTQKDDRVLD

SEQ ID NO: 119457 - protein, 129 aa, Heterodera glycines
  Coding regions on vcDNA: vcDNA=SeqID_45880; Strand=+; Position=1 -184,241-391
  Homolog annotation: Hit_ID=BAB71316.1; Match level="QueryCoverage =83%, HitCoverage=99%, E-value=2e-34, Identity=62%"; Hit description =unnamed protein product [Homo sapiens]
  Essential gene: C elegans homolog=F25B5.4a; Phenotype=Emb
LFRFAHRIILKQNIMFQIFVKTLTGKTITLEVEASDPIENVKAKIQDKEGIPPDQQRLIFAGKQLEDARTMADYNIQKESKQLEDARTMADYNIQKESTLQLCLKLFGGARTGKTAHYSRSVSHDYHKR

SEQ ID NO: 119458 - protein, 123 aa, Heterodera glycines
  Coding regions on vcDNA: vcDNA=SeqID_45881; Strand=+; Position=1 -114,390-647
  Homolog annotation: Hit_ID=NP_505724.1; Match level="QueryCoverage =78%, HitCoverage=26%, E-value=7e-12, Identity=39%"; Hit description =somatostatin receptor 2B (5L92) [Caenorhabditis elegans] emb|CAB08739.1| Hypothetical protein H09F14.1 [C
  Essential gene: C elegans homolog=H09F14.1; Phenotype=Unclassified
MNVTVGIEILYVPFGISIFGLLGNTVAFLTIILSDLRKNYVNIYLLVLLCSDSVLLLDIFVQPLFRFDVLTFWTCAITEYLFNASAFVSSFAIISLTGERFFSIIFPLRHLKVHFYLDSFIYI

SEQ ID NO: 119459 - protein, 219 aa, Heterodera glycines
  Coding regions on vcDNA: vcDNA=SeqID_45882; Strand=+; Position=1 -158,206-384,661-873,946-1053
  Homolog annotation: Hit_ID=CAE73752.1; Match level="QueryCoverage =93%, HitCoverage=54%, E-value=2e-30, Identity=34%"; Hit description =Hypothetical protein CBG21286 [Caenorhabditis briggsae]
  Essential gene: C elegans homolog=R08F11.2; Phenotype=Unclassified
MELYLFRPTDYQRLYNCSSYKIDDIPLVNRTHTVLGISFIMQFVLFQLCYIPCMFSIWKHRDQACYKFMFFIGLIDILCLFINCLMHGYFAITGVVFCSYPDLIYLSGIVGFFFWVAESSADILLAVNRCVEMISPVWGERLYHGGRAWLWLIPPLLYATYIAITQMPVLFSGIYFSWFFNPHVGYIDDFGTIVRNAFLYYNSCKSKWCFILVFIMVLG

SEQ ID NO: 119460 - protein, 313 aa, Heterodera glycines
  misc_feature (149)..(149): Xaa can be any naturally occurring amino acid
  Coding regions on vcDNA: vcDNA=SeqID_45883; Strand=+; Position=1 -33,353-456,511-597,667-814,1061-1215,1349-1415,1578-1670,1723 -1834,1898-1954
  Homolog annotation: Hit_ID=CAE64534.1; Match level="QueryCoverage =100%, HitCoverage=26%, E-value=1e-82, Identity=54%"; Hit description= Hypothetical protein CBG09276 [Caenorhabditis briggsae]
  Essential gene: C elegans homolog=C10F3.3; Phenotype =Lon,Unc,Unclassified
SCVAHMCSIFVLLRLPYPLRCFLASVDCCLFLLLLILFSTSVSNVSAPIISCSAPIISCQMTIILVNIIALFLLLLFIARITEYERKVEASCNVAFTEYERKVEASCNVAFKNEERDVQLMQDINKLLIENILPSSVAAKFLSHERVIXELYARDHDNVCVMFASIPNFKNYWSECDQARKLECLRLLNEIVCEFDKLLSKPKFSCIEKIKTVASTYMAAAGLTDSDTADNSGVYLLSTFCMGVNNALQFPNEPNEALISVQKMVELAQAMAAVLDQLNVDSFQNFQLRIGLNVGLNVGPVIAGVLGQKPQYD

SEQ ID NO: 119461 - protein, 335 aa, Heterodera glycines
  Coding regions on vcDNA: vcDNA=SeqID_45884; Strand=-; Position=1-1012
  Homolog annotation: Hit_ID=NP_498506.1; Match level="QueryCoverage =92%, HitCoverage=52%, E-value=2e-52, Identity=37%"; Hit description =RNA-directed DNA polymerase family member (3I9) [Caenorhabditis elegans] gb|AAA21080.1| Hypothetical prot
  Essential gene: C elegans homolog=ZK250.3; Phenotype=Clr,Lvl,Sck
STVFLDIIKAFDKVPHELLIYKIEKIGIKGNLLNWLKDFLTNRTFKVRINQQFSKEFPIKSGVPQGSVLGPILFLIFINDLSPVIPEGISLKLFADDTKIYLCYDTEFQRKKLNEALHCVCQWAQMWGLQFSPEKSASLYLGKDNFKVPYQFNKTIKETQTIRDLGILIDNKLTFKSHISSILQKAYLRSRTLFQKIKSKSSKTWIKVYKSYIRPLLEYSSENWNPHIKKEIIRLEKFQKFFTKKVFLKCHLPVLQYSDRLKYLNISTLENRRKYLDLITAFKIIKQETHLNPLKLYNLSQRRNSPFLRLITKSKITKTEHSFINRTTKNLQELS

SEQ ID NO: 119462 - protein, 272 aa, Heterodera glycines
  misc_feature (86)..(86): Xaa can be any naturally occurring amino acid
  Coding regions on vcDNA: vcDNA=SeqID_45885; Strand=+; Position=1 -29,557-1363
  Homolog annotation: Hit_ID=NP_510671.1; Match level="QueryCoverage =97%, HitCoverage=27%, E-value=6e-59, Identity=43%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
NVFLTGLRKLKNNKISESQFGFVRNRSTTNQLITVVEDWYEAIINGKVDCIYIDFQKAFDSVPHNLLLDKLKKIGIQGKLLNWIKXFLSNRTFRVKIGDALSSNKKVGSGVPQGSVLGPLLFLIYINDLPDALPSGVKIKLYADDVKLYISDTEIMHKALHNLFEWANKWQIKVSIQKTFVLYLGSKNPKETYKFDGNTINAVDTIRDLGVNIDNKLQFSDHVNQITRNAYLRMRSLFRIIKSKSSKIWITLYKTYIRPLLEYAPEVWNPSL

SEQ ID NO: 119463 - protein, 312 aa, Heterodera glycines
  Coding regions on vcDNA: vcDNA=SeqID_45886; Strand=-; Position=1 -416,466-633,754-1107
  Homolog annotation: Hit_ID=NP_498822.1; Match level="QueryCoverage =99%, HitCoverage=46%, E-value=7e-54, Identity=37%"; Hit description =abnormal cell MIGration MIG-10, amyloid beta protein-binding family B member 1 interacting protein like (
  Essential gene: C elegans homolog=F10E9.6a; Phenotype=Emb
RFYEDHENVVENLEDWTSESPNKLHFIRQPQKWALFRHPQHFLIADRNRNNEFPPVESIGEWDTEQKQRLLNAFLREDGGTRVPELEGWLMLKADGKKSWRRHFFVLRSSGLYYVPKAGKPRGPARDLNCLMSVFNNQVYMCTDWRKKYKAPTEFGFAIKHPRIQLKTSKYIKYICCDDEFTFRQWLTALRITKNGCPALYKDFRAAQSRECPLVGPASPARAEVPQVSLQRLSALDSNFATVSSASPRHRPALHLGDFACSSFSTRASSSTPGGSSREGLISRIASPAPSMAFNVFDQDECNTIKRHPEGV

SEQ ID NO: 119464 - protein, 91 aa, Heterodera glycines
  misc_feature (2)..(2): Xaa can be any naturally occurring amino acid
  Coding regions on vcDNA: vcDNA=SeqID_45887; Strand=+; Position=1 -187,235-305
  Homolog annotation: Hit_ID=CAE74488.1; Match level="QueryCoverage =89%, HitCoverage=88%, E-value=6e-21, Identity=58%"; Hit description =Hypothetical protein CBG22239 [Caenorhabditis briggsae]
  Essential gene: C elegans homolog=C44E4.6; Phenotype=Unclassified
IXCVLTLQINKVKTLRTSPSNDELLEIYALYKQATCGDNNTCKPGTFDFRGKAKWEAWKKKQGISQEKISQEKARIDYVKIVEKMVAKYGV

SEQ ID NO: 119465 - protein, 174 aa, Heterodera glycines
  misc_feature (1)..(1): Xaa can be any naturally occurring amino acid
  Coding regions on vcDNA: vcDNA=SeqID_45888; Strand=+; Position=1 -62,288-424,724-854,933-1121
  Homolog annotation: Hit_ID=NP_493617.2; Match level="QueryCoverage =94%, HitCoverage=54%, E-value=5e-38, Identity=45%"; Hit description =i-90 protein (34.4 kD) (1P608) [Caenorhabditis elegans] emb|CAB04261.2| Hypothetical protein F33H2.6 [Cae
  Essential gene: C elegans homolog=F33H2.6; Phenotype=Him
XICPKSVDHQSTGSFGAHKWYAILLDRTAELEGNKARIAKAMEVKTHFERALELNPTDATTWHLLGVWHYELADLSTHKRWLASLVYGSPPETTYDEALRCFERAETLAPCPCFYSANNYYLALVYEKMNRKEEAVKQFKLAYNAPMAEPDDLEYHNKVGEDAKKKIFLIQKSI

SEQ ID NO: 119466 - protein, 108 aa, Heterodera glycines
  Coding regions on vcDNA: vcDNA=SeqID_45889; Strand=-; Position=1 -172,705-858
  Homolog annotation: Hit_ID=NP_492146.1; Match level="QueryCoverage =66%, HitCoverage=21%, E-value=9e-12, Identity=54%"; Hit description =electron transfer flavoprotein (34.5 kD) (1I279) [Caenorhabditis elegans] emb|CAB61027.1| Hypothetical pr
  Essential gene: C elegans homolog=F27D4.1; Phenotype=Emb
MQQYINDNNELLRKRIVKQQKPKECIIISRGATTFAAPAKNDNCGPTFAAPAKNDNCAPDFSPPSPDVVELSAFLGQELSKSERPELGGAKIVISGGRGLKSGENFSL

SEQ ID NO: 119467 - protein, 56 aa, Heterodera glycines
  Coding regions on vcDNA: vcDNA=SeqID_45890; Strand=-; Position=1 -75,128-223
  Homolog annotation: Hit_ID=NP_998660.1; Match level="QueryCoverage =100%, HitCoverage=7%, E-value=1e-15, Identity=69%"; Hit description =zgc:55483 [Danio rerio] gb|AAH48370.1| Zgc:55483 [Danio rerio]
  Essential gene: C elegans homolog=D2045.6; Phenotype=Emb
MRKSLKHQLLVAEVLNQLTTRFQPKVPIIKKCIDSLIEKEYLKRSEEDSDLYEYLA

SEQ ID NO: 119468 - protein, 69 aa, Heterodera glycines
  Coding regions on vcDNA: vcDNA=SeqID_45891; Strand=-; Position=1 -85,342-466
  Homolog annotation: Hit_ID=NP_572165.1; Match level="QueryCoverage =100%, HitCoverage=33%, E-value=8e-26, Identity=75%"; Hit description= CG3564-PA [Drosophila melanogaster] gb|AAF45951.1| CG3564-PA [Drosophila melanogaster] gb|AAL28181.1| GH
  Essential gene: C elegans homolog=W02D7.7; Phenotype=Pvl,Unc
MIRELSAMLTAVKHEQEYMQVRDRVHRSINENTNSRVVVWAVFEAILLICMTIGQIYYLKRFFEVRRVV

SEQ ID NO: 119469 - protein, 193 aa, Heterodera glycines
  Coding regions on vcDNA: vcDNA=SeqID_45892; Strand=-; Position=1 -131,227-345,654-823,880-1041
  Homolog annotation: Hit_ID=NP_499300.1; Match level="QueryCoverage =99%, HitCoverage=28%, E-value=1e-48, Identity=53%"; Hit description =RNA splicing factor (71.2 kD) (3L514) [Caenorhabditis elegans] emb|CAA88957.1| Hypothetical protein M03C1
  Essential gene: C elegans homolog=M03C11.7; Phenotype=Emb
MAERAQKHVEDNRSRKLTREEKAAKAIRKIGEDTTLAVHVTVFKIKSLANPAKKFKVMMNAKQLQMTGVVIVLEDINVVVMEGGPKQQKFFKNLMLNRIRWSAEIAGQKHDRRATHNRANEMGEGTEDGPAEEKRNECVLIWEGVVQKRAFTGEPRFTPVTNHKQARELLEKYGVPHYWDLCYSTTVLLNDET

SEQ ID NO: 119470 - protein, 94 aa, Heterodera glycines
  Coding regions on vcDNA: vcDNA=SeqID_45893; Strand=+; Position=1 -45,88-233,383-476
  Homolog annotation: Hit_ID=CAE66739.1; Match level="QueryCoverage =96%, HitCoverage=56%, E-value=5e-13, Identity=40%"; Hit description =Hypothetical protein CBG12089 [Caenorhabditis briggsae]
  Essential gene: C elegans homolog=R12E2.12; Phenotype=Lva,Unclassified
MPPYEITFFFRPLTKPSLVEAIKRQATLLMDKGAVITKLESLGYRDLPYSRLDRFAKKNVHYANSILMNSSMSVKTMNDARTLFSNDKELVGLL

SEQ ID NO: 119471 - protein, 141 aa, Heterodera glycines
  misc_feature (12)..(12): Xaa can be any naturally occurring amino acid
  Coding regions on vcDNA: vcDNA=SeqID_45894; Strand=-; Position=1 -76,447-526,581-668,782-880,1130-1169
  Homolog annotation: Hit_ID=CAE68672.1; Match level="QueryCoverage =91%, HitCoverage=37%, E-value=2e-39, Identity=59%"; Hit description =Hypothetical protein CBG14576 [Caenorhabditis briggsae]
  Essential gene: C elegans homolog=M03F4.7a; Phenotype=Lva,Lvl,Unc
ILPTRSAILPHXLTDTYNFKTFRLQNNDVERTWKNYKEEQLKNGLLDWQDYRNLIYGKPQEGQEISNLIYGKPQEGQEISPEYVKMIERDERRWKVADYNSDGKMDRTEYGCFMHPEDCDHMRDIVVQETVEDIDKDGFVD

SEQ ID NO: 119472 - protein, 220 aa, Heterodera glycines
  Coding regions on vcDNA: vcDNA=SeqID_45895; Strand=-; Position=1 -189,240-431,485-763
  Homolog annotation: Hit_ID=CAE60278.1; Match level="QueryCoverage =99%, HitCoverage=52%, E-value=3e-38, Identity=41%"; Hit description =Hypothetical protein CBG03859 [Caenorhabditis briggsae]
  Essential gene: C elegans homolog=T04B2.2; Phenotype=Unclassified
MTEEISGTERVYALSVNVGGLLNHVIFRRHKGMFTVDLNSDKGFRTIERFVDNYLRTGVSVTTQQYVALIRAVPRAHWELSHTSIILGNELGRGTFGIVKSGVYVDQQGTRAAVAIKEVSQTSTKEQIKEFMNEARVMRQLRHPNVIQFYGVAVGQEPLMIVMELATDGSLTNYLKQQRRSARVKLYMCLGAAGGLDHIHSKGIIHCDVAARNCLYTDGV

SEQ ID NO: 119473 - protein, 289 aa, Heterodera glycines
  misc_feature (177)..(177): Xaa can be any naturally occurring amino acid
  misc_feature (217)..(217): Xaa can be any naturally occurring amino acid
  Coding regions on vcDNA: vcDNA=SeqID_45896; Strand=+; Position=1 -47,2949-3779
  Homolog annotation: Hit_ID=NP_510671.1; Match level="QueryCoverage =100%, HitCoverage=30%, E-value=3e-51, Identity=37%"; Hit description= predicted CDS, endonuclease/exonuclease/phosphatase family and RNA -directed DNA polymerase (XR69) [Caeno
  Essential gene: C elegans homolog=ZK250.3; Phenotype=Clr,Lvl,Sck
PQNMDLYGLKTFTKSTKLLMWIKDFLSNRTFRVKIGDDLSSSKVGSGVPQGSVLGPLLFLIYINDLPDALPSGVRIKLYADDVKLYICYRKNRNSMHKALHNLSEWANKWQIIISIKKTFVLYLGNKNPKEIYKIDGNIINVVDTIRDLGINIDNKLQFSNHVAQIIKNAYLRMRSXFRIIKSKSSRIWIILYKTYVRPLLEYAPEVWNPSLLKNIXKIEKCQKYFTKRVFFKCNLPPIPYQQRLEYLQLSTLESRRKLSDLFMAHKIIYGRTDMSLLIFKLLTLYIPF

SEQ ID NO: 119474 - protein, 211 aa, Heterodera glycines
  Coding regions on vcDNA: vcDNA=SeqID_45897; Strand=-; Position=1 -219,691-839,883-943,1192-1292,1344-1449
  Homolog annotation: Hit_ID=CAE70030.1; Match level="QueryCoverage =88%, HitCoverage=40%, E-value=2e-26, Identity=31%"; Hit description =Hypothetical protein CBG16451 [Caenorhabditis briggsae]
  Essential gene: C elegans homolog=F21D5.1; Phenotype=Emb
LVPLSNCSRYSKQLFVDCANGVGALWVNKYFDAITDGTPFSAPAKGLSVAASTDSVQLHALNTDTESLLLNHEGIEPVITKTGVKHLEEAALNFDIGLYFEANGHGTVCFSDRFYAYLEEISGNEIIPRHIQLLSMFSQLVNETAADRETVLIRPEGMQAKIDAIISEFDKARAFIRPSGTEPIVRIYAEAETTEKVNEIAERLVELVLPF

SEQ ID NO: 119475 - protein, 118 aa, Heterodera glycines
  Coding regions on vcDNA: vcDNA=SeqID_45898; Strand=+; Position=1 -247,494-603
  Homolog annotation: Hit_ID=AAK94492.1; Match level="QueryCoverage =70%, HitCoverage=89%, E-value=4e-36, Identity=92%"; Hit description =hypothetical esophageal gland protein scn1144 [Heterodera glycines]
  Essential gene: C elegans homolog=Y48A6B.3; Phenotype=Gro
MEDSEQNITEQSVSAPTTDHDEYEELCKLVNPISKPLANRKLAKKVYKLVKKAAKEKGFLRHGLADVMKAFRKNEKGIIVLAGYKRPAIVLLVKRHDSFAELFDQTHESTYALVVEPE

SEQ ID NO: 119476 - protein, 202 aa, Heterodera glycines
  Coding regions on vcDNA: vcDNA=SeqID_45899; Strand=-; Position=1 -391,450-494,536-706
  Homolog annotation: Hit_ID=CAE59526.1; Match level="QueryCoverage =75%, HitCoverage=44%, E-value=1e-11, Identity=35%"; Hit description =Hypothetical protein CBG02921 [Caenorhabditis briggsae]
  Essential gene: C elegans homolog=B0491.5; Phenotype=Emb,Lva
MELRWSGRKGRTVATTKVKWSNGEFPESLKTSRSRFLYFVFILSLVSSLKIRENCSQYKQIAEKWDLSDEHPGIAVNPSLDSIIRQKYRPIGTVFPLFPKILAWPRFWDKPMNEGCFEKGLALAKYSLPITWIAYAGALRGYDPPATNVGRFEAVEFVIQSFRGWLFSSRMILPAFYSFTFGLTSCTSATFRDEDDSWNWIA

SEQ ID NO: 119477 - protein, 136 aa, Heterodera glycines
  Coding regions on vcDNA: vcDNA=SeqID_45900; Strand=+; Position=1 -78,126-176,353-631
  Homolog annotation: Hit_ID=CAE57635.1; Match level="QueryCoverage =99%, HitCoverage=10%, E-value=3e-17, Identity=39%"; Hit description =Hypothetical protein CBG00620 [Caenorhabditis briggsae]
  Essential gene: C elegans homolog=F22B5.7; Phenotype=Emb
MKCIGEKALGCFISPELAKDANKMAKIAEYQDKAMAEAAVITQNQASAHANDLSGTSSSNQQSDECGTQQNACENEVDPWDLMEPVDISSKLNINFESPKWQERKEALDALQQLLLQSPRLSDSPNYREVIERLAK

SEQ ID NO: 119478 - protein, 221 aa, Heterodera glycines
  Coding regions on vcDNA: vcDNA=SeqID_45901; Strand=+; Position=1 -198,609-701,801-878,1274-1430,1492-1556,1809-1883
  Homolog annotation: Hit_ID=CAE72420.1; Match level="QueryCoverage =87%, HitCoverage=13%, E-value=6e-46, Identity=48%"; Hit description =Hypothetical protein CBG19582 [Caenorhabditis briggsae]
  Essential gene: C elegans homolog=ZK675.1; Phenotype=Unclassified
MQQRLDVAKRDGLLDNFDGDGTTTATTNSSSISAAATTPKAKHHSPDLQIAYSLACSYGQNYDCARAGTVRLIDESGTINTEGFYNYLYGWHEYEQMFYAVSQASFYPRLRKLRQGPPGPMKYRYFIPPAPKPLFSRIPFYCDGLRDTPTIMRMIREIRAISENYSRAGLPNYPEGVAFTFWEQYLHLDYYLVLAIGIISVSVFCVISTIIFNPWAAALVG

SEQ ID NO: 119479 - protein, 267 aa, Heterodera glycines
  Coding regions on vcDNA: vcDNA=SeqID_45902; Strand=-; Position=1 -139,541-718,927-1100,1583-1731,2084-2248
  Homolog annotation: Hit_ID=AAB99830.2; Match level="QueryCoverage =98%, HitCoverage=16%, E-value=1e-100, Identity=61%"; Hit description= thrombospondin [Haemonchus contortus]
  Essential gene: C elegans homolog=C37C3.6a; Phenotype=Lva,Unc
GDGHCAGPSIRYISCNLEPCPADAMDFRAEQCAAHNDDPVADKYYKWVPHTSKNKCELTCRPEGDSFYYNWAEKVIDGTKCDAYGEEICVDGICLPVGCDGKLGSEAKRDKCGVCQGDGSQCKTVEGLFDERALSSGYHDIIALPVGATAIHIEELRPSSNVFAIKNATGFFYLNGNFQIQVLDKNILAGGVPFKYEKGNGGTERLTANGPLQESVTVSLLLQRTGAKQSAVKYEYSVPLEKDVKYLYKPGEWSQCSVTCGRGKKMG

SEQ ID NO: 119480 - protein, 105 aa, Heterodera glycines
  Coding regions on vcDNA: vcDNA=SeqID_45903; Strand=-; Position=1 -107,173-299,542-603
  Homolog annotation: Hit_ID=CAE68671.1; Match level="QueryCoverage =97%, HitCoverage=22%, E-value=2e-43, Identity=73%"; Hit description =Hypothetical protein CBG14575 [Caenorhabditis briggsae]
  Essential gene: C elegans homolog=M03F4.6; Phenotype=Gro,Unc
YKDIHCVDPFNACIAGKCQCAPGTHRDSSKGRCFAVCPDGIAPCPDGIAPLQTCRRLFINDVDMLDNAATTDSCPIGYRCVTYGSPYIGHCCKVRCPYGEPDLRL

SEQ ID NO: 119481 - protein, 59 aa, Heterodera glycines
  Coding regions on vcDNA: vcDNA=SeqID_45904; Strand=+; Position=1 -165,354-368
  Homolog annotation: Hit_ID=CAE65135.1; Match level="QueryCoverage =93%, HitCoverage=33%, E-value=5e-20, Identity=81%"; Hit description =Hypothetical protein CBG10001 [Caenorhabditis briggsae]
  Essential gene: C elegans homolog=R10E11.8; Phenotype=Ste
MAGIVAIYGLVVAVIISGRLEAAGPGYTIDRGFSQFAAGLVCGLCGLGAGYAIGVCSLS

SEQ ID NO: 119482 - protein, 178 aa, Heterodera glycines
  Coding regions on vcDNA: vcDNA=SeqID_45905; Strand=-; Position=1 -386,675-822
  Homolog annotation: Hit_ID=CAE69591.1; Match level="QueryCoverage =99%, HitCoverage=14%, E-value=3e-61, Identity=61%"; Hit description =Hypothetical protein CBG15813 [Caenorhabditis briggsae]
  Essential gene: C elegans homolog=ZK1151.1b; Phenotype=Bmd,Lva,Lvl,Unc
TLDVDVSNVKELYRQLPHPTPTQRAAHDNMVQRWQDIWELSRMYVERLKGLESVLNGLDEVTDIVRRHEITLASFDDMPAALERLRGVHAQLLELNMVLQQQENIVKKLNRDTATLRQHVARTRFGAANHPDVDQIEDRVSQITVRWDNVNSQVAERLRIAEEAQQTQMVYRSQYTEE

SEQ ID NO: 119483 - protein, 247 aa, Heterodera glycines
  Coding regions on vcDNA: vcDNA=SeqID_45906; Strand=-; Position=1 -76,132-236,568-757,1038-1148,1608-1868
  Homolog annotation: Hit_ID=NP_490866.2; Match level="QueryCoverage =91%, HitCoverage=42%, E-value=4e-97, Identity=72%"; Hit description =SRC oncogene related (60.7 kD) (src-1) [Caenorhabditis elegans] gb|AAN31394.1| protein tyrosine kinase [C
  Essential gene: C elegans homolog=Y92H12A.1; Phenotype=Emb
EAQIMKQCNHPKLVRLYAVCTKGEPYYIVTEYMRNGSLLEYLRDTNNSLRLHALVDMAAQIASGMMYLESRKLVHRDLAARNVLVGDKISGVPEVKVADFGLARKLMDENIYEAATGAKFPVKWTAPEAQRCGNFTVKSDVWSFGILLYEIFSLGHTPYPGVQNHDVLRDLDQGKRMACPKNCPDEIYQEMLNCWDQNPDRRPTFEYLFTFFDDFFISSQPNYVPPSVDGTSFDAQAIDGIEGEQSG

SEQ ID NO: 119484 - protein, 80 aa, Heterodera glycines
  Coding regions on vcDNA: vcDNA=SeqID_45907; Strand=-; Position=1 -94,487-556,601-677
  Homolog annotation: Hit_ID=NP_508492.1; Match level="QueryCoverage =98%, HitCoverage=14%, E-value=8e-18, Identity=50%"; Hit description =5'-nucleotidase cytosolic II (64.3 kD) (XD454) [Caenorhabditis elegans] gb|AAC68740.2| Hypothetical prote
  Essential gene: C elegans homolog=Y71H10B.1a; Phenotype=Lva
MSHSEGTIFVNRTVHLQDIKLFGFDMDYTLAEYVSPTMEDQTFELCLDYLIQKTGYPKEIAAFKYDPMFSIRGLWFDLKF

SEQ ID NO: 119485 - protein, 209 aa, Heterodera glycines
  Coding regions on vcDNA: vcDNA=SeqID_45908; Strand=-; Position=1 -159,481-646,1563-1707,1770-1931
  Homolog annotation: Hit_ID=NP_502807.2; Match level="QueryCoverage =57%, HitCoverage=17%, E-value=5e-33, Identity=54%"; Hit description =putative endoplasmic reticulum protein of eukaryotic origin (78.7 kD) (4P720) [Caenorhabditis elegans] em
  Essential gene: C elegans homolog=Y41E3.1; Phenotype=Sck,Ste
LVPVHRIVLARIFQIGHSPFFAYASLLFVTRRHQPSAASGRRFGEPSEEDAHRQLEERLPFFSLRFPPSIDGISPQIVERILSNLKTNAQKRLTSPFDVHATLMDAMRLVPNSDLMKYSGVKDADGFVPDLKGNVKTTFATYQIGFQTQPGNAKYEATLFFDGQRRITVDMTAISHVNKYGDTPHCIIDKNYFLATYCVCYDKIDDGET

SEQ ID NO: 119486 - protein, 374 aa, Heterodera glycines
  Coding regions on vcDNA: vcDNA=SeqID_45909; Strand=-; Position=1 -242,295-421,474-551,690-808,1132-1175,1225-1387,1438-1723,1797-1861
  Homolog annotation: Hit_ID=CAE60123.1; Match level="QueryCoverage =64%, HitCoverage=80%, E-value=2e-60, Identity=45%"; Hit description =Hypothetical protein CBG03666 [Caenorhabditis briggsae]
  Essential gene: C elegans homolog=T07C12.11; Phenotype=Unclassified
MLDETSASRAIGSNETAVMINSDEHELDTDPGIQGSDNGASSSMQRQLSAAMQAVVEEPTFNLRLIDAVRQSHCLYDASDKQYRSADYKIKVWNRLVHVLGFQGDARTLYNRWKQLRDKYGKEKKKLKYSGEQHSQWQYFKVFKTFCKKEQRQIVITDPNFALHLINQVRTQPCLYDIKDTKYRHTEYRNQAWAEIAKNLAFPGDVSALYKQWKKIRDRYVREKRKLRMTNGTENEEPNWELYRELVWIDRYLDERAAQVKRKQESSDLSGEEFIEDAYSTQNASGLSNSLPGNSATPLDSAHPHHHPQQHHYANVLMPNSGQPIEETAIVGHQLQQLVKLQPQQQIVGATLQNSTRSRVSDVGTTLLGAGPIG

SEQ ID NO: 119487 - protein, 129 aa, Heterodera glycines
  Coding regions on vcDNA: vcDNA=SeqID_45910; Strand=+; Position=1 -74,239-387,917-986,1302-1360,1791-1830
  Homolog annotation: Hit_ID=NP_496061.2; Match level="QueryCoverage =75%, HitCoverage=31%, E-value=6e-31, Identity=67%"; Hit description =dimethyladenosine transferase (34.6 kD) (2J880) [Caenorhabditis elegans] emb|CAA87382.2| Hypothetical pro
  Essential gene: C elegans homolog=E02H1.1; Phenotype=Lva
IKFNTEKVQHILKNPGVVHAIVEKSAVKGTDTVLEVGPGTGNLSMKLLDRAGRLIAYELDPKMVAELQKRVVGTPVQYKLRIIAGDVIKAAEWPPFDVRRADAAEGIRRSTVGQAGQAWTGSGSRRDCP

SEQ ID NO: 119488 - protein, 154 aa, Heterodera glycines
  Coding regions on vcDNA: vcDNA=SeqID_45911; Strand=+; Position=1 -172,570-706,989-1141
  Homolog annotation: Hit_ID=NP_499964.1; Match level="QueryCoverage =90%, HitCoverage=68%, E-value=2e-63, Identity=78%"; Hit description =ribosomal Protein, Large subunit (24.1 kD) (rpl-15) [Caenorhabditis elegans] gb|AAC24397.1| Ribosomal pro
  Essential gene: C elegans homolog=K11H12.2; Phenotype=Gro,Stp
MGAYKYMQELWRKKQSEVMRYLLRIRCWQYRQMEAIHRCTRPTRPEKARRLGYKAKQGFLIYRVRIRRGGRKRQVTKGQTYGKPKTHGVNQLKNTRSLQAVAEARAGRRLGELRVLNSYWVGQDSTYKFFEVILVDPSHKVRFGFCLFVLLRSF

SEQ ID NO: 119489 - protein, 287 aa, Heterodera glycines
  Coding regions on vcDNA: vcDNA=SeqID_45912; Strand=+; Position=1 -67,113-180,265-576,623-709,780-874,1012-1151,1208-1277,1418-1444
  Homolog annotation: Hit_ID=AAT72430.1; Match level="QueryCoverage =97%, HitCoverage=46%, E-value=1e-76, Identity=51%"; Hit description =CPB-1 [Caenorhabditis sp. PS1010] gb|AAT72413.1| CPB-1 [Caenorhabditis sp. PS1010]
  Essential gene: C elegans homolog=Y54E10A.4b; Phenotype=Fog
GLPIDITETELKQAFHKCVSRRFGSLLVDWPNRSSDSHFVKKEHYSGAASRVTGYAFLIFLEEASVQRLIAKCYSEGDRFYMLMSSQTVREKPVQVRPWRLADMDYMPRPSAHLDPRRTVRDHRLTPLGPKPSHSKIFIGGVPRPTKASELAFVLEAAFGPVCYAGIDVDPEMKYPKGAARVTFSTFKSYAAAMAGRFVQIPHSDNTKRVEIKPYLVNDQMCDNCHGKLCQDRYAPYFCGDVACLQYYCEICWDRLHYGSGNRSREMHKPFVRMGEQIKIKIPQREF

SEQ ID NO: 119490 - protein, 283 aa, Heterodera glycines
  Coding regions on vcDNA: vcDNA=SeqID_45913; Strand=-; Position=1 -153,196-268,423-1046
  Homolog annotation: Hit_ID=NP_504464.1; Match level="QueryCoverage =92%, HitCoverage=43%, E-value=1e-33, Identity=34%"; Hit description =UDP glycosyltransferase 2 family polypeptide (5G26) [Caenorhabditis elegans] gb|AAK52183.1| Hypothetical
  Essential gene: C elegans homolog=C33A12.6; Phenotype=Unclassified
MGKGTDGVVFFSMGSIMRSSDMPESFRRHIFEAFSQLKNYHFIVKVEKDDNYSENLAKNLDNVFFTSWAPQLDILGHPRLRLFITHGGFNSLLEAANAGVPVLLMGFFADQHRNGRVAERNGWGKVVEKRQLLEGSENFRAAIQKVLEDQRQFTLYYQIPYGITVFPLQLRCQRKKNPSTVGNKGWHFVIHFLSIEFVPSVLKPFTAKERLLKNIRFLEMNGGQFPELLSESRHMGWVQLHNFDLAVLAALSALTFLFVLRYLAKFTLALAIWTKNMLQKKYK

SEQ ID NO: 119491 - protein, 661 aa, Heterodera glycines
  misc_feature (646)..(646): Xaa can be any naturally occurring amino acid
  misc_feature (649)..(649): Xaa can be any naturally occurring amino acid
  misc_feature (660)..(660): Xaa can be any naturally occurring amino acid
  Coding regions on vcDNA: vcDNA=SeqID_45914; Strand=-; Position=1 -450,509-796,867-1040,1099-1336,1540-1685,1765-1905,1961-2104,2170 -2295,2407-2523,3217-3302
  Homolog annotation: Hit_ID=CAE69741.1; Match level="QueryCoverage =99%, HitCoverage=70%, E-value=1e-134, Identity=28%"; Hit description= Hypothetical protein CBG16014 [Caenorhabditis briggsae]
  Essential gene: C elegans homolog=F15G9.4a; Phenotype=Egl,Pvl,Rup,Unc
SVNFSSHLLGDVILLISVPPAISRESAELNPRLPLGRSLTFFCDVIGKPPPNIRWTKDEKSLKEDANVQLGEGNRSLLIQNISLSDRGVYRCEATNHVGNDSVEYRLDVFQAPIIAKGGTEQAVEGKVAVLDCVASGEPAPLISWQRNGVLQRNGVLVEVGVRYVLEGSRLKVIDTRSSDSGIYVCEATNEAGTDQQAFTLEVLIPPKLTSESARQMAVLRGGNGTLSCTARGYPTPQVIWSAESTNVLKVLKRNAQYELSEYGQTLHLFGLSQGTRLFRCSAVNNAGIDQLEFGIGIIRAPTLSRKGILTINGILTINVTEGGPLLIPCGVIGTGKEWRANPMDLNGRALAGEGPTKSIGKVTRAQGGNYTCTMKNKAGNASSTVIVHVGVAPKIREDEARARGRVIVEKGATAELWCEAVGIPPPKIWLRDDQPLTKCGSVQSADTRRSTAVFGEVQPQHAGVYTCEADNWAGKANKTVDLVVLIPPSILPEREQIEVEPPSILPEREQIEVESGQMVVLQCNATGIPEPLVSWEKADDTAAADISEYQLLYQLLGTSLAIREVEKKDEGIYQCIAKSDAGQTIGVRQVIVKKKSEATAIFVECDANGKPVKHSFARVRGDRPKGSRLWPWKSLPSLGISHSVXTHXPPPPQSNRYKXT

SEQ ID NO: 119492 - protein, 227 aa, Heterodera glycines
  Coding regions on vcDNA: vcDNA=SeqID_45915; Strand=+; Position=1 -79,129-256,341-413,474-874
  Homolog annotation: Hit_ID=NP_740787.1; Match level="QueryCoverage =89%, HitCoverage=37%, E-value=8e-49, Identity=48%"; Hit description =GTP-binding protein, HSR1-related (1C307) [Caenorhabditis elegans] gb|AAK68267.1| Hypothetical protein C5
  Essential gene: C elegans homolog=C53H9.2a; Phenotype=Emb,Lva
HLLSILRQAVSEAFPDAIAQGSSQVIGMVGYPNVGKSMTINRLLGTKKTAVSSTPGKTKHFQTLIIDEGLVLCDCPGLVMPQFGISDADMILNGILPIAHMRDYFGPIQLLCERVPRQYFQQRYSVLLPKSIGSLNGHDLLTAVAFLKGFMNASGIPVRHAFGTSNAFLFPLKDCSRAARLILADVIDGSLKWVAAPSNVSQRQFDQWTFKTIELSKAHQQEQQRQQ

SEQ ID NO: 119493 - protein, 89 aa, Heterodera glycines
  Coding regions on vcDNA: vcDNA=SeqID_45916; Strand=+; Position=1 -85,174-358
  Homolog annotation: Hit_ID=AAB59207.1; Match level="QueryCoverage =95%, HitCoverage=68%, E-value=2e-16, Identity=48%"; Hit description =histone H2A [Psammechinus miliaris] sp|P13630|H2A_PARLI Histone H2A pir||HSURH2 histone H2A, embryonic (cl
  Essential gene: C elegans homolog=T23D8.6; Phenotype=Emb
MPRHRAKPRSFHAGLKFPVGRVHRKMKKGPYAKRLANGVPVYMTAVLEHITGELLKKIGEITQAEGMKRLSAFHIRTAARDDDEVEEGQ

SEQ ID NO: 119494 - protein, 99 aa, Heterodera glycines
  Coding regions on vcDNA: vcDNA=SeqID_45917; Strand=+; Position=1 -135,196-360
  Homolog annotation: Hit_ID=CAE61943.1; Match level="QueryCoverage =65%, HitCoverage=16%, E-value=4e-10, Identity=52%"; Hit description =Hypothetical protein CBG05941 [Caenorhabditis briggsae]
  Essential gene: C elegans homolog=F33D4.5; Phenotype=Emb,Lva
MRKAVLGPFINRASLITASAGPQQSFFPVDVSPWEALPTEEEIEKHEKTKKKKDQKKMKKKKETDELEEEEDEEEEAEEDGRIFPNLDTIDQKILMKLM

SEQ ID NO: 119495 - protein, 600 aa, Heterodera glycines
  misc_feature (379)..(379): Xaa can be any naturally occurring amino acid
  Coding regions on vcDNA: vcDNA=SeqID_45918; Strand=+; Position=1 -123,166-234,545-724,771-836,886-998,1054-1229,1387-1472,1526 -1601,1739-1909,1954-2062,2110-2314,2377-2460
  Homolog annotation: Hit_ID=CAE69165.1; Match level="QueryCoverage =93%, HitCoverage=89%, E-value=1e-129, Identity=48%"; Hit description= Hypothetical protein CBG15197 [Caenorhabditis briggsae]
  Essential gene: C elegans homolog=C13B9.3; Phenotype=Ste
RIKVKMKSIFVEFSLAQRQHTFVETNSVRYVYQPMDNIYMVLITTKASNILEDLVLITTKASNILEDLETLRLFSRVIPEYCRSNDESEITDKAFDLIFAFDEIVVLGYRESVNLAQIRTFTEMDSHEERVFNQIQIAQQRAAHTLMKEAQQRAAHTLMKEKEKEIKRQEKNYLNYSKKGTAASANYLNYSKKGTAASATGISSSQARTELTSVVKAPRPFLPGGPICGGGKALKLGAKSGGPICGGGKALKLGAKSANEDAFLQQLRHEGEKVLDKVNEMPNCVKSRKTIPLSRNRRVKAGAVHFKCVEKINAVLSRGGGLNSSDIFGSISLCVSDPKFNSVAIRIFGSISLCVSDPKFNSVAIRVLNNITSKNSQNXVHPNLDKSSWQSKSLLRLKSEQKPYPVGVDVGVLKWSIKLPDEDALPLTLNCWPNESSEGVTVNIEYNCWPNESSEGVTVNIEYTLQREDLQLKNVRIVIPLPPATAPPATAPVISECEGAYEYLKSKGQLLWSIPLVERGNKTGTLEFTTANGNADHFFPVQVHFSSTDSFSKITVESVETMQGDDVEFTDEVESVETMQGDDVEFTDEVNLFPEKYEII

SEQ ID NO: 119496 - protein, 142 aa, Heterodera glycines
  misc_feature (1)..(1): Xaa can be any naturally occurring amino acid
  misc_feature (130)..(130): Xaa can be any naturally occurring amino acid
  Coding regions on vcDNA: vcDNA=SeqID_45919; Strand=-; Position=1 -241,284-421
  Homolog annotation: Hit_ID=BAA22203.1; Match level="QueryCoverage =94%, HitCoverage=26%, E-value=2e-50, Identity=75%"; Hit description =alpha-3 tubulin [Caenorhabditis elegans]
  Essential gene: C elegans homolog=F26E4.8; Phenotype=Emb
XALTRVVKREVISIHVGQAGVQIGNACWELYCLEHGIQPDGKMPSDQNNQDDSFSTFFSETGNGRHVPRAVMVDLEPTVIDEIRTGTYKHLFHPEQLIEIRTGTYKHLFHPEQLITGKEDAANNYARGHXGDGKEIIDRLDR

SEQ ID NO: 119497 - protein, 383 aa, Heterodera glycines
  Coding regions on vcDNA: vcDNA=SeqID_45920; Strand=+; Position=1 -383,444-702,809-1055,1154-1416
  Homolog annotation: Hit_ID=CAE65110.1; Match level="QueryCoverage =83%, HitCoverage=14%, E-value=1e-111, Identity=60%"; Hit description= Hypothetical protein CBG09974 [Caenorhabditis briggsae]
  Essential gene: C elegans homolog=R10E11.1a; Phenotype=Emb
MEPFEQCQICDRKWHRICALHSNKIHPGGFVCEQCRVEKNRTRQENKFTAKSTFFGSLWPIKSDGMIVYHSNLLPELPHYNLSRHIEDRVNNFLRRKLTDSDPEVEVIIRVLCSADKEVEVKPAMLKKYASEGYTDRFPYRSKAVFAFEVVKDPDTGASHEVCFFGLYVQEYGTNCQQPNQRRVYIAYLDSVHFFQPRSLRTSVYYEILLGYLDYAKTLGYTMAHIWACPPSEGDDYIFHCHPPEQKIPKPKRLQDWYKTMLNNGQMEGTVYSYKDIYNQARDDGLDTPMKLPYFEGDYWPRIIDECIIGAEKEEEQEKRMKQHQQFQSAEERRRYRKGGGSAATASLSDDDTFQTDDGFPVVKQKQQPQQQQKASSNKKKTT

SEQ ID NO: 119498 - protein, 161 aa, Heterodera glycines
  Coding regions on vcDNA: vcDNA=SeqID_45921; Strand=-; Position=1 -157,721-1023,1590-1617
  Homolog annotation: Hit_ID=CAE60354.1; Match level="QueryCoverage =91%, HitCoverage=33%, E-value=6e-41, Identity=54%"; Hit description =Hypothetical protein CBG03950 [Caenorhabditis briggsae]
  Essential gene: C elegans homolog=F54D7.2; Phenotype=Gro
YNIIMVVSKLFGVNYLSQQQLAGFDQYKYSCIDNSPISTYISHPFWNWVVQVVCKISKNFFFQFYPRWLAPNVLTFAGALIVMCCYGLVVCFDPGLSANSATGPAELNIPRWVWLVCGVGTFLAHLLDGTDGKQARRVGASGPTGELCKYAVLKIFQNKFI

SEQ ID NO: 119499 - protein, 144 aa, Heterodera glycines
  Coding regions on vcDNA: vcDNA=SeqID_45922; Strand=+; Position=1 -126,173-294,340-436,487-575
  Homolog annotation: Hit_ID=NP_492528.1; Match level="QueryCoverage =93%, HitCoverage=24%, E-value=7e-19, Identity=37%"; Hit description =benzodiazepine receptor (1K94) [Caenorhabditis elegans] emb|CAB02840.1| Hypothetical protein C41G7.3 [Cae
  Essential gene: C elegans homolog=C41G7.3; Phenotype=Him
MPLHWTSVDTRNALLCAAVPSIGAFVGSTMAIKDQELVQFLKNQNFPSFARCCKYNYLLANTAVTIPFGYASYLVYKIGGGVSCTDSKIALGLYGATLLSGCFLVPTLKKHDTKALTANAVVLAGLSVATSVAFYNIDKISAYW

SEQ ID NO: 119500 - protein, 171 aa, Heterodera glycines
  Coding regions on vcDNA: vcDNA=SeqID_45923; Strand=-; Position=1 -51,106-342,397-624
  Homolog annotation: Hit_ID=CAE67394.1; Match level="QueryCoverage =87%, HitCoverage=35%, E-value=1e-15, Identity=32%"; Hit description =Hypothetical protein CBG12879 [Caenorhabditis briggsae]
  Essential gene: C elegans homolog=T04B2.2; Phenotype=Unclassified
MDPAELNLLRYEYYHGLIVQEDLQERLQKDGDFLLRRTQDKDETRTFTLSINTNGELLDVHFYENADGTFMRDNENINSIEGFIEYHQRSEDSLISGRCVVLKRGVKHADWEIKHNQLTLGEELGRGKYGVVLGGLLARTPKQKKRVAVKRLLETANKQKVTFVGDGRVFD

SEQ ID NO: 119501 - protein, 197 aa, Heterodera glycines
  Coding regions on vcDNA: vcDNA=SeqID_45924; Strand=+; Position=1 -107,309-795
  Homolog annotation: Hit_ID=BAA88337.1; Match level="QueryCoverage =79%, HitCoverage=17%, E-value=1e-16, Identity=37%"; Hit description =ORF2 [Platemys spixii]
  Essential gene: C elegans homolog=ZK250.3; Phenotype=Clr,Lvl,Sck
MYADDVKLYYAHENDDHSNQLDKAIEALEKWSKINGVLKSREIKTLTAAYKTFVRPQLEYATEVWNPNLKKDIDKIERVQKFFTRKALRKCGFVYKKYGERLKITGLHKLEERRKINDLTTAFKIIKGFTSLDAGKSFFFSERLRRPLLLRVKRHTAKTQNNFFNRIVKSWNNLPVVAVQINKAKEFRGLLKAMSSE

SEQ ID NO: 119502 - protein, 255 aa, Heterodera glycines
  Coding regions on vcDNA: vcDNA=SeqID_45925; Strand=+; Position=1 -205,282-378,457-581,652-890,1069-1168
  Homolog annotation: Hit_ID=AAO85519.1; Match level="QueryCoverage =94%, HitCoverage=76%, E-value=6e-70, Identity=54%"; Hit description =putative serine/threonine phosphatase [Oesophagostomum dentatum] gb|AAO85518.1| putative serine/threonine
  Essential gene: C elegans homolog=W09C3.6; Phenotype=Ste
MTTIWQLCEDATNVLRDQASLVETKPPLVMCGDIHGQFVDLKRIFNKMGYPPFTKYMFLGDIVDRGNQRPISLPPPNFKVRYPTEFYILRGNHECASINRIYGFYDEINERYGHHNVRPLWERFNMTFAWLPFVGLVSDCILCMHGGIAPEMTNIQQLRMLRRPYIDPPVPSLELDLLWADPSTVVEGTAPNPRGVSILFDADVVANVCKKLNIELVVRAHQCVPFGVSFFANSYMLTLFSAPMYQTEKNVGAVL

SEQ ID NO: 119503 - protein, 113 aa, Heterodera glycines
  Coding regions on vcDNA: vcDNA=SeqID_45926; Strand=+; Position=1 -56,535-610,779-910,1312-1389
  Homolog annotation: Hit_ID=CAE67139.1; Match level="QueryCoverage =61%, HitCoverage=9%, E-value=8e-13, Identity=52%"; Hit description =Hypothetical protein CBG12562 [Caenorhabditis briggsae]
  Essential gene: C elegans homolog=T08B2.7a; Phenotype=Unclassified
MNIPKQQHGAMPIIYKDQLRLGVIGAGLMGAGIANVSIDKGIHTTLVDTKQEALDRGLKQITAQMEGQLKRRKINAAEHAICLSKLKPTNRGFLGQSNHIKIFCIKIWVQLQF

SEQ ID NO: 119504 - protein, 251 aa, Heterodera glycines
  Coding regions on vcDNA: vcDNA=SeqID_45927; Strand=+; Position=1 -349,757-1103,1158-1217
  Homolog annotation: Hit_ID=CAG04443.1; Match level="QueryCoverage =97%, HitCoverage=19%, E-value=4e-27, Identity=33%"; Hit description =unnamed protein product [Tetraodon nigroviridis]
  Essential gene: C elegans homolog=H12C20.2a; Phenotype=Emb
MRLIGQFNNAFLIVRLRSDVFIIDQHAADEKYNFERLLAHNVIKSQTLIRPKRLRLGNVNAALMRDNLHVFHANGFDFQFYNGATSENAKWCWENGAAAAGNKDDAIVIEDTENNDVEPILLNDDDYDDNDEQERGEDELDKLGTVLLTAVPVLHGWQLDRDGQSEIRSNDFLEFGMPILDIFADIDQLLSMLSELPGIVHRPSKVRKIFASKACRHSVMFGKALTQREMETIIFNMGSMDQPWVKQLKLK

SEQ ID NO: 119505 - protein, 240 aa, Heterodera glycines
  Coding regions on vcDNA: vcDNA=SeqID_45928; Strand=-; Position=1 -158,219-324,389-459,518-610,656-741,793-868,925-1057
  Homolog annotation: Hit_ID=CAE67047.1; Match level="QueryCoverage =96%, HitCoverage=57%, E-value=6e-45, Identity=39%"; Hit description =Hypothetical protein CBG12454 [Caenorhabditis briggsae]
  Essential gene: C elegans homolog=ZK858.7; Phenotype=Dpy,Gro,Stp
PSKIHEGVFAIVRKVGGEHIRLCRLISGQRVLIERLSFNPKDAIGHFYGIFEVSNGGDMLCPIEFASKPFKTEFSNGNSAGDRGHGNESTQQLTSNQIMSLKEDGITTNELVSKLVSGNCHFQSRTKFSKEKYMRKKVQKHSDRVVILQPNIRLLADCYYRKDPERLGHLRIDQLGLMLQLSGLHSGKCNAFVFDQVLGLLGAAVLERINPFGHCIFLHRGDWPQSIPCLDSFTTDAQVK

SEQ ID NO: 119506 - protein, 127 aa, Heterodera glycines
  Coding regions on vcDNA: vcDNA=SeqID_45929; Strand=-; Position=1 -57,472-578,628-691,744-899
  Homolog annotation: Hit_ID=CAE68953.1; Match level="QueryCoverage =100%, HitCoverage=54%, E-value=9e-33, Identity=49%"; Hit description= Hypothetical protein CBG14933 [Caenorhabditis briggsae]
  Essential gene: C elegans homolog=C01G12.5; Phenotype=Gro
MIRLSQLVVPYLEKTKGSIFPAVTYYCISKAAVDKFTECLSMELAPKGIRVNAVNPALIVTELHLRSGMPEEQYSDFVRRGAQTHALGRVGTPEEVASSILFLARDATFTTGQLLKIDGGKALMTPR

SEQ ID NO: 119507 - protein, 178 aa, Heterodera glycines
  Coding regions on vcDNA: vcDNA=SeqID_45930; Strand=-; Position=1 -133,637-748,848-896,1352-1594
  Homolog annotation: Hit_ID=CAE71775.1; Match level="QueryCoverage =97%, HitCoverage=23%, E-value=1e-69, Identity=72%"; Hit description =Hypothetical protein CBG18772 [Caenorhabditis briggsae]
  Essential gene: C elegans homolog=F52B11.3; Phenotype=Emb,Lva,Unc
APFKGAIYAAEKFSTCSQVVENAKQISITFPPPNVSPACGTTIKDGKLEALVVVSLDGVLPHQVTTEWDRFYRVSCDVNMDKPGFEGTVIVTTIFETKEAEPQVLSAGTPPPITAQLSFLDKDNQPLEKASIGDQLHLVVNSEQAGPHNMMVTECVATRVGGEGEPVPFTIIDNGRRS

SEQ ID NO: 119508 - protein, 321 aa, Heterodera glycines
  Coding regions on vcDNA: vcDNA=SeqID_45931; Strand=-; Position=1 -35,4775-5721
  Homolog annotation: Hit_ID=NP_510671.1; Match level="QueryCoverage =89%, HitCoverage=29%, E-value=3e-63, Identity=41%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
VVWLSSTVSHARKNADCIYIDFRKAFDSVPHNLLLYKLEKIGIRGKLLMWIKSFLSNRTFRVKIGDALSSNKKVGSGVPQGSVLGPLLFLIYINDLPDALPSGVKIKLYADDVKLSRADTEIMHKALHNLSEWANKWQIKVSVQKTFVLYLGSKNPKETYKFDGNTINAVDTIRDLGVNIDNKLQFSDHVNKITRNAYLRMRSLFRIIKSKSSKIWITLYKTYIRPLLEYAPEVWNPSLQKNIKKIEKCQKYFTKRVFFKCSLPPIPYQNRLKYLQLPTLENRRKLFDLFMAHKIVYGRTDLKLFSIFNPSTRFNIPFYRF

SEQ ID NO: 119509 - protein, 77 aa, Heterodera glycines
  Coding regions on vcDNA: vcDNA=SeqID_45932; Strand=+; Position=1 -66,117-283
  Homolog annotation: Hit_ID=NP_505415.2; Match level="QueryCoverage =100%, HitCoverage=17%, E-value=2e-14, Identity=48%"; Hit description= ubiquinone biosynthesis monooxgenase coq6 (49.1 kD) (5J819) [Caenorhabditis elegans] gb|AAB54238.2| Coen
  Essential gene: C elegans homolog=K07B1.2; Phenotype=Age,Unclassified
WSDVRFLTAALQRAFDEGGDLGSLTYLRDFDSASQRRNGPIIFAIDCLNRLYSTDHPFCTLFRSVGLNILDRILPAK

SEQ ID NO: 119510 - protein, 264 aa, Heterodera glycines
  Coding regions on vcDNA: vcDNA=SeqID_45933; Strand=-; Position=1 -212,268-383,574-677,721-873,1424-1598,1872-1906
  Homolog annotation: Hit_ID=CAE63219.1; Match level="QueryCoverage =37%, HitCoverage=10%, E-value=4e-15, Identity=35%"; Hit description =Hypothetical protein CBG07577 [Caenorhabditis briggsae]
  Essential gene: C elegans homolog=F33C8.1a; Phenotype=Unc
MADDAPSTNVQQQSNPSSTLSPQSIISNVPSSIMVQDVIIVPSSSQHKQQNATCPLPCFMKSSCQSCIDSQWCPSNQRCVSMDTYMVSFPYGQCQSWVTAANTHKACQTRLGKCVEGTNSGALDPSQCPAERWYFTGEPGQVLLNANATGTAIARKMSLIGDCDVRNVSIERGVNIVNFVSSASSATHGMVGPVKRDTDVQFSITCEGDTGAKVTINLTTQLLEGRPPHTKHLMAGQLCTASGIKRTYSSTDPAVSLFFSLLRD

SEQ ID NO: 119511 - protein, 203 aa, Heterodera glycines
  Coding regions on vcDNA: vcDNA=SeqID_45934; Strand=-; Position=1 -195,243-368,426-714
  Homolog annotation: Hit_ID=NP_491134.1; Match level="QueryCoverage =99%, HitCoverage=41%, E-value=2e-81, Identity=73%"; Hit description =SAR DNA-binding like (54.6 kD) (1D835) [Caenorhabditis elegans] gb|AAK21475.1| Hypothetical protein W01B1
  Essential gene: C elegans homolog=W01B11.3; Phenotype=Lva
NSLDIKCLHNSAVSELMRSIRANVSSFLGEETAHEMNAMRLGVAHSIGRYKVKFNPEKIDTMIVQAVSLLDDLDKELNNYVMRCREWYGWHFPELGKLIADAQAYAKCVKAIGMKANAQNADLSAILPEELAEKVRQEAEISMGTDISELDLIHIVELCDQIVELAQYRAQLHDYLKNRMNALAPNLTVLLGELIGARLVSKA

SEQ ID NO: 119512 - protein, 107 aa, Heterodera glycines
  Coding regions on vcDNA: vcDNA=SeqID_45935; Strand=+; Position=1 -97,161-306,591-671
  Homolog annotation: Hit_ID=NP_500569.1; Match level="QueryCoverage =75%, HitCoverage=57%, E-value=1e-36, Identity=93%"; Hit description =histone H2A.F Z (14.7 kD) (4F211) [Caenorhabditis elegans] gb|AAC48074.1| Hypothetical protein R08C7.3 [C
  Essential gene: C elegans homolog=R08C7.3; Phenotype=Gro
KIISRSARAGLQFPVGRIHRFLKKRTTSTGRVGATAAVYSAAILEYLTAEVLELAGNASKDLKVKRVTPRHLHLAIRGDEEPPSQLNHSQQQNHSQQQMTNVGNGDN

SEQ ID NO: 119513 - protein, 246 aa, Heterodera glycines
  Coding regions on vcDNA: vcDNA=SeqID_45936; Strand=+; Position=1 -97,154-309,469-557,647-773,947-1047,1116-1283
  Homolog annotation: Hit_ID=NP_501327.1; Match level="QueryCoverage =60%, HitCoverage=21%, E-value=5e-11, Identity=26%"; Hit description =zw10 centromere protein (88.0 kD) (4I708) [Caenorhabditis elegans] gb|AAA81674.1| Caenorhabditis zeste wh
  Essential gene: C elegans homolog=F20D12.4; Phenotype=Emb,Lva,Unc
AGSALDSKEEKSSDILWKMEEKLRIKADDEDSPLPNKVTQGKMNWMCQSFPSVSQQVHLQFGCRSARCVARGCGDGLGDGGESAAVFFNNCHFIVHRLSTLSADILQNILTVSKITGQDCAFTDLFTELRILAATTLEQHITQARRQLSATIGEHDIFVGLRDDRTNKHCVKLLNGCVMQLEQTASVWREVLSDFVLTHCVGELVSYLLSAMANIILAKEDIASSDAEISANLLTTTVDRCKKLME

SEQ ID NO: 119514 - protein, 147 aa, Heterodera glycines
  Coding regions on vcDNA: vcDNA=SeqID_45937; Strand=+; Position=1 -107,1017-1189,1243-1413
  Homolog annotation: Hit_ID=CAE72614.1; Match level="QueryCoverage =100%, HitCoverage=67%, E-value=4e-28, Identity=46%"; Hit description= Hypothetical protein CBG19806 [Caenorhabditis briggsae]
  Essential gene: C elegans homolog=ZK909.3; Phenotype=Unclassified
MSDKFNNKKKQHFSSLLTKIQKKKKKLFLEQIRDYDEKPSPAAVLSHCDDMEGISLLVKAADFAARRHRFQKRKDERTPYINHPIGVALLISVAVAKVYDPATLAAAYLHDLVEDQTTFEELEFRRVAEIVRECTDDKNLPKDVQRK

SEQ ID NO: 119515 - protein, 149 aa, Heterodera glycines
  Coding regions on vcDNA: vcDNA=SeqID_45938; Strand=-; Position=1 -289,446-531,672-745
  Homolog annotation: Hit_ID=AAB29907.1; Match level="QueryCoverage =59%, HitCoverage=52%, E-value=1e-45, Identity=51%"; Hit description =AML1-EVI-1 fusion protein [Homo sapiens]
  Essential gene: C elegans homolog=R53.3a; Phenotype=Pvl
TAQLSAAPPTHYRPSEQKKRKNQTAGSSTQQAEKRASDSVTHLRRSNGASNRSADGVKESGGKERYQCRYCQKVFPRSANLTRHLRTHTGEQPYKCQYCERSFSISSNLQRHVRNIHNKEKPFRCHYCDRCFGQQTNLDRHLKKHENEN

SEQ ID NO: 119516 - protein, 257 aa, Heterodera glycines
  Coding regions on vcDNA: vcDNA=SeqID_45939; Strand=+; Position=1 -176,245-342,389-492,760-855,913-1000,1664-1770
  Homolog annotation: Hit_ID=AAL78223.1; Match level="QueryCoverage =88%, HitCoverage=81%, E-value=9e-43, Identity=46%"; Hit description =hypothetical protein Hgg-29 [Heterodera glycines]
  Essential gene: C elegans homolog=ZC373.5; Phenotype=Unc
LMGFVPVQDNPISECRMAELVRHFFALGWMCDNGSGMAVRVKDERTGEHLILNSSNSLENDLNDLFVMMNGEILKSPSKSDRSPTAPFYLLRDTDLACVIHTHSKWADLACVIHTHSKWANLITQLIRGDEFKISNQEMIQGCENRLTKGRLDNIDVLVVPIVQTEINEHMLYPILLRTLNQNAGASGILVRPILLRTLNQNAGASGILVRGHGFFCFGSNTANSVPSKNSRIFLKINLSLTKFYEWETKNDKFWLY

SEQ ID NO: 119517 - protein, 494 aa, Heterodera glycines
  misc_feature (10)..(10): Xaa can be any naturally occurring amino acid
  misc_feature (25)..(25): Xaa can be any naturally occurring amino acid
  Coding regions on vcDNA: vcDNA=SeqID_45940; Strand=-; Position=1 -216,673-873,926-1082,1326-1496,1539-1611,1773-1998,2057-2102,2149 -2393
  Homolog annotation: Hit_ID=CAE56922.1; Match level="QueryCoverage =93%, HitCoverage=75%, E-value=2e-73, Identity=36%"; Hit description =Hypothetical protein CBG24767 [Caenorhabditis briggsae]
  Essential gene: C elegans homolog=C33A12.6; Phenotype=Unclassified
TKRVKGINNXLIGKLNLQKKKKIFXEFITSNPDLIESLRKQKFDVVIEEQLNFCGAGLGHLLAIPIHILISSCPLQEHVASLFGLPFPFSYLPSLMDADLPDKMSLSERFDNLLRTFVGYVYLWHGIDPLTNIFRKHFGNDFPDLRDIVKNSPFVNDFPDLRDIVKNSPFVFVSVDELLDFPRPLFPNMVNIGGIGMDKLDKNAKLEEPFKSEMSKGKEGVVFVSMGTIIRSSDLPAKFRRNLLETFAKFSDYHFIMRIEKGDNYSAEIAAKFGNIYSAEIAAKFGNIFLTPWAPQPAILADPRLKLFITHGGYNSLLEATRGGVPVLAMGFFADQHRNARAAERNGWARSFDKLKLVEGTAQFEALLGEMLNNEKYAVGAKRIQNLMSTKYAVGAKRIQNLMSTKPFPAEERLPFPAEERLTKSIRFLEQNGGKLPELLSESRNMGTISLYNIDLALIGIVLLVLAFALTFFCANGFWHYKINGQNEGTTKAK

SEQ ID NO: 119518 - protein, 102 aa, Heterodera glycines
  Coding regions on vcDNA: vcDNA=SeqID_45941; Strand=-; Position=1 -163,208-323
  Homolog annotation: Hit_ID=CAE72182.1; Match level="QueryCoverage =99%, HitCoverage=17%, E-value=4e-28, Identity=64%"; Hit description =Hypothetical protein CBG19289 [Caenorhabditis briggsae]
  Essential gene: C elegans homolog=AH10.1; Phenotype=Unclassified
VAPAELEDLLLSHAGIKDCAVVGVADELAGEVPKAFVVRADQTLTESELKRFVREKVASYKQLGKVASYKQLGSVEFVDEIPKSASGKILRRVLREKDTKKS

SEQ ID NO: 119519 - protein, 110 aa, Heterodera glycines
  Coding regions on vcDNA: vcDNA=SeqID_45942; Strand=-; Position=1 -71,234-495
  Homolog annotation: Hit_ID=NP_506571.1; Match level="QueryCoverage =100%, HitCoverage=44%, E-value=1e-23, Identity=49%"; Hit description= proteasome Alpha Subunit (27.0 kD) (pas-1) [Caenorhabditis elegans] emb|CAB02738.1| Hypothetical protein
  Essential gene: C elegans homolog=C15H11.7; Phenotype=Emb
MLMISNDDEKGASVFSIDPAGHYISVRGYGIGVKQQQINGFLEKKLKSKDRKFGDTEVIQLALEALQTGLGIDLKADEVEVIVATKTDPKGVKVSDKSIEEHLTAIAERD

SEQ ID NO: 119520 - protein, 239 aa, Heterodera glycines
  Coding regions on vcDNA: vcDNA=SeqID_45943; Strand=-; Position=1 -11,299-567,759-916,1328-1436,1518-1622,2107-2174
  Homolog annotation: Hit_ID=CAE74131.1; Match level="QueryCoverage =65%, HitCoverage=13%, E-value=4e-55, Identity=55%"; Hit description =Hypothetical protein CBG21799 [Caenorhabditis briggsae]
  Essential gene: C elegans homolog=C46C2.1a; Phenotype=Egl,Gro
MCFTSSHAWDSSHAWLSGEEKSRLEVVQREWRLSRTASAQAKVEEEVPIPATALKPQTSLELDEVKKEAESRRESAEDYDEDYDEEKPIDKSPGVAVAWCELQEQKLNKAERQRFREEAEMLKGLQHPNIVKFYDYWERTDGKKKLGLYFLHTRPTPVIHRDLKCDNIFITGTTGSVKIGDLGLATLKNKSHAKSVIGTPEFMAPEMYEEQYDESVDGGTIWHSSGHSEQRPGFEQCQQ

SEQ ID NO: 119521 - protein, 123 aa, Heterodera glycines
  Coding regions on vcDNA: vcDNA=SeqID_45944; Strand=-; Position=1 -108,177-253,570-756
  Homolog annotation: Hit_ID=P30757; Match level="QueryCoverage=100%, HitCoverage=100%, E-value=2e-55, Identity=86%"; Hit description =Histone H2B pir||S16084 histone H2B - sipunculid (Sipunculus nudus)
  Essential gene: C elegans homolog=H02I12.6; Phenotype=Gro,Pvl,Ste
MPPKPSGKGAKKAVKSTKTVRTADKKRKKSRKESYSVYIYRVLKQVHPDTGISSKAMSIMNSFVNDVFERIAAEASRLAHYNKRSTISSREIQTAVRLILPGELAKHAVSEGTKAVTKYTSSK

SEQ ID NO: 119522 - protein, 137 aa, Heterodera glycines
  Coding regions on vcDNA: vcDNA=SeqID_45945; Strand=+; Position=1 -65,124-202,281-502,908-934
  Homolog annotation: Hit_ID=CAE62787.1; Match level="QueryCoverage =91%, HitCoverage=22%, E-value=2e-36, Identity=56%"; Hit description =Hypothetical protein CBG06960 [Caenorhabditis briggsae]
  Essential gene: C elegans homolog=F59E12.4a; Phenotype=Emb,Lva,Unc
MLPSNPDKIDEVDKILSKLDGKIERKMDKIERKMDPLMCRHNPRQKCTNCLPLDPYDEKFLHEKDIKHLSFHAHVHKLTDLHGRGTRSNNVLENVCCKLRPNCAGGHLPYPKGICTRCRPSTLTLNRQNFRLFVRIR

SEQ ID NO: 119523 - protein, 195 aa, Heterodera glycines
  Coding regions on vcDNA: vcDNA=SeqID_45946; Strand=-; Position=1 -126,171-340,390-494,542-579
  Homolog annotation: Hit_ID=XP_397483.1; Match level="QueryCoverage =91%, HitCoverage=12%, E-value=2e-34, Identity=46%"; Hit description =similar to CG7728-PA [Apis mellifera]
  Essential gene: C elegans homolog=Y61A9LA.10; Phenotype=Emb,Lva
QKGRKGFEEKEQKEWGYDGTKRQNPKAFKFRSAIKAQKLIRRAADLSEKKKHIPIVDAADLSEKKKHIPIVDRSPDVLPPLLVALVGPPGVGKSTLLRCLVKNYVKQSLSEIKGPVTVVTSKKRRVTFFEVPNDIKGPVTVVTSKKRRVTFFEVPNDINAMVDAAKIADLVGIIIDASFGFEMIIIDASFGFEME

SEQ ID NO: 119524 - protein, 294 aa, Heterodera glycines
  misc_feature (22)..(22): Xaa can be any naturally occurring amino acid
  Coding regions on vcDNA: vcDNA=SeqID_45947; Strand=+; Position=1 -245,291-349,403-517,588-777,959-1051,1175-1277
  Homolog annotation: Hit_ID=NP_871812.1; Match level="QueryCoverage =97%, HitCoverage=32%, E-value=2e-96, Identity=65%"; Hit description =HAlF transporter, PGP related (haf-4) [Caenorhabditis elegans]
  Essential gene: C elegans homolog=W04C9.1; Phenotype=Gro
QLWRSFIFREMDFSRRISLFFXVWTGLMQSVGASRKVFEYIDRKPDIDTNGTYAPDKLEGRIEFQNVHFAYPTRPDNPILRGLSFTVEPGLSFTVEPGEVVALVGPSGSGKSSCIALLEGKSSCIALLEHFYAPEGGKVLVDGVPIGEFDHHYIHNKLALVGQEPILALVGQEPILFARSVAENIAYGLERCTIVDVVEAAKMANAHTFIQQTRDQYETNVGEKGSQMSGGQKQRIAIARALVRRPAILLLDEATSALDTESEHLVQEAIYKNLKGRSVILRAHRLSTVEKVLG

SEQ ID NO: 119525 - protein, 554 aa, Heterodera glycines
  misc_feature (545)..(545): Xaa can be any naturally occurring amino acid
  Coding regions on vcDNA: vcDNA=SeqID_45948; Strand=-; Position=1 -192,239-328,383-625,668-904,950-1007,1054-1344,1437-1780
  Homolog annotation: Hit_ID=AAM73862.1; Match level="QueryCoverage =96%, HitCoverage=49%, E-value=1e-155, Identity=57%"; Hit description= putative serine/threonine protein kinase; HcSTK [Haemonchus contortus]
  Essential gene: C elegans homolog=H39E23.1a; Phenotype=Spo
QQPPQSSSATHQGGHHRHTSSGHHRSSGMTASSSRAPNRTPGDDLHIGKYKLLKTIGKGNFAKVKLAKHVPTGVEVAIKIIVKLAKHVPTGVEVAIKIIDKTALNQSSLQKLFREVRIMKQLFREVRIMKQLDHPNIVKLYQVIESETTLFLVMEYASGGELFDYLVAHGRMKEKEARAKFRQIVSAVQYLHSKNVIHRDLKAENLLLDADMNIKIAAENLLLDADMNIKIADFGFSNTFSPGNKLDTFCGSPPYAAPELFQGKKYDGPEVDVWSLGVILYTLVSGSLPFDGQNLKELRERVLRGKYRVPFYMSTDQNLKELRERVLRGKYRVPFYMSTDCENLLKCENLLKKFLVLNPIRRGTLEMIMRDKWMNMGYEEDELKPYTEPTKDVRDERRILKLQAFGYTLQQIHESLERERFDEIFGTYLLMKEAKKHDAQGQLVLAFHVINHIKPTVSNAKNSRRSSSNAEQIQPQQHAITSHSVINQQSAAPIQQISATPQAIPSRQSQTSGTSDVQNGTIHQSPTDSQRSTTRKRLKLSKNLXLWYYFLFLL

SEQ ID NO: 119526 - protein, 455 aa, Heterodera glycines
  Coding regions on vcDNA: vcDNA=SeqID_45949; Strand=-; Position=1-1368
  Homolog annotation: Hit_ID=NP_508269.1; Match level="QueryCoverage =97%, HitCoverage=64%, E-value=2e-42, Identity=27%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MSVIKKIDKDSVEGLEGSLSLFSLPPTNVAINKTNVRELLPLSALNQTGPYLFRLFSDSQYCDLSKTYMYLLSSIERKNDAGEWVALSDTDPNDKHVGVIQNFGSSFVRSLKVNISGIEVFDSSIYYHYRDYIMKELGYSQEIRKAFHEASCYYPDDDDQNSATNPGFTARAARFSGGKQCETMVKLNFDLARQNALMLNNQDVIFTIHRNNDSFLLLTPPYKKPDGTLQENKKEYRIRVHDMRLYVRTVDVTPSLNLAISRQLESTSAKYPLRKIEMRSIFLGTGRTELAHNVFTSTLPRRLICTFVSTDAYSGNRKMSPYKFEHANVRSISVEANGQTFPSTPYLLSFDGAQPRFVRAFVDMYAGLGLDDSDTKTVSIGMQRFLNGWAFFVIPLTSTLEDTPGFELIRQGTCTIKVQFEQPIKADGYEMLVLGEFDSVLSINADRVLSTDGSV

SEQ ID NO: 119527 - protein, 368 aa, Heterodera glycines
  Coding regions on vcDNA: vcDNA=SeqID_45950; Strand=-; Position=1 -201,362-498,893-1123,1170-1267,1317-1407,1854-2000,2051-2251
  Homolog annotation: Hit_ID=XP_316876.1; Match level="QueryCoverage =55%, HitCoverage=43%, E-value=3e-65, Identity=60%"; Hit description =ENSANGP00000017781 [Anopheles gambiae]
  Essential gene: C elegans homolog=D2089.1a; Phenotype=Unclassified
MKKTHPPQIVTIDPNLAALGLPAYPPLPPTTEPAKVEEIRRTVYVGNLPKGCDGEEVLNFFNACIGEVMYLRMAAGNDYLPCDYAYVEFSQQSSVPLALQNSDSLEFQGRPLRIQHSKVAIIKPQRKTADQALEEVEEAIKSGSDGRTTTDTGTNSMLLGEYANVEQLETEQRIKTALKQIMQSVDLDDVTSQDIRRRLSEQISVDQRRYKEFIDHQMLVILGQLDLPSKIFDYLYLGTEWNASNWEELKANGVQYILNVTKEVDNFFPTQFTYLKIWVSDETTTELLMHWQRTYDFIKEAKEKGAKVLVHCKKGISRSASTVIAYAMKAYGWGLDEALEYVKRKRDCITPNPGFMEQLGTFHGMMQA

SEQ ID NO: 119528 - protein, 143 aa, Heterodera glycines
  Coding regions on vcDNA: vcDNA=SeqID_45951; Strand=-; Position=1 -105,228-365,440-554,632-704
  Homolog annotation: Hit_ID=CAE59146.1; Match level="QueryCoverage =91%, HitCoverage=31%, E-value=1e-29, Identity=48%"; Hit description =Hypothetical protein CBG02451 [Caenorhabditis briggsae]
  Essential gene: C elegans homolog=C17G10.2; Phenotype =Emb,Gro,Pvl,Sma,Stp,Unc
MERTKYEKQKGFAAEAQKWEEDIDRFMEALAERGKNVRSSNSEKKFDFEKWCEEIDKHPAFARDLKPTEDGQYSMEMQAIQAMKYDEDNPTECANAYKEEGNRHFEKRNYRWAIDAYTKGIKLRCSDVRLNSVLFANRSAAHR

SEQ ID NO: 119529 - protein, 251 aa, Heterodera glycines
  Coding regions on vcDNA: vcDNA=SeqID_45952; Strand=-; Position=1 -90,143-241,508-678,720-838,896-958,1010-1058,1148-1310
  Homolog annotation: Hit_ID=CAE64412.1; Match level="QueryCoverage =94%, HitCoverage=16%, E-value=5e-21, Identity=31%"; Hit description =Hypothetical protein CBG09105 [Caenorhabditis briggsae]
  Essential gene: C elegans homolog=C16A3.8; Phenotype=Dpy
RNEHTPMSLYRVVSQLAQEGFVDIFTLFTLIAPTRKELLEEHKSLTDLVKLRSNRAETISSNVVGLLASVTESFPIASILNAANDSSLDQPSPASAISFSAATQCQLNEDRKLAGSRFDDTVLNKNQKLGLLCALLEFGDLEKAQKLLEFFPDGYPFGVCQRISMAFANIIGFCIEPFYRLKAASNYECLPNSSATGVSDWLSFFADACPIAFQLGPYIGARHEVAIKMIRLLNTYYSDEEAQSSVTEVDS

SEQ ID NO: 119530 - protein, 94 aa, Heterodera glycines
  Coding regions on vcDNA: vcDNA=SeqID_45953; Strand=-; Position=1 -100,417-505,555-647
  Homolog annotation: Hit_ID=NP_001002579.1; Match level="QueryCoverage= 75%, HitCoverage=39%, E-value=1e-14, Identity=59%"; Hit description =zgc:92732 [Danio rerio] gb|AAH76212.1| Zgc:92732 [Danio rerio]
  Essential gene: C elegans homolog=F52A8.5; Phenotype=Emb
MASTTIRFCSLFKRLPAKTFVSCRTLSTSRPMFADILYTDKHEWLSLDEARSVGTVGITNHAQESLGDVVYVELPEIGKKLDSGGTAGAIESVK

SEQ ID NO: 119531 - protein, 288 aa, Heterodera glycines
  Coding regions on vcDNA: vcDNA=SeqID_45954; Strand=-; Position=1 -23,248-342,514-557,781-870,1019-1077,1407-1544,1664-1737,2153 -2218,2278-2507
  Homolog annotation: Hit_ID=CAE64966.1; Match level="QueryCoverage =90%, HitCoverage=50%, E-value=3e-83, Identity=58%"; Hit description =Hypothetical protein CBG09800 [Caenorhabditis briggsae]
  Essential gene: C elegans homolog=T20G5.6; Phenotype=Egl,Unc
NVTNAIQGMFIVGLPFAVKIGGWCAILALTGVAWICYRTGLILIECLYEDCPTEKFSYREVAEAVRPGLGKFVLIAQLTELASTCILYIVLAGDLLQGCFPSVDRPAWMMLTTVVLLATAFLDDLRVVSNLSMANAVSHLVINGIMVHCCFSQFSEWRFSSLPIVPNFRLFPTVIGTVVFGYTSHIFLPALEGSMQDADEFKPMLALSHSAADADEFKPMLALSHSAAAVFKALFGLIGFLTFAEFTQKEISNSLPNQGFKVWRSAIWDNAKTDSIPAMFKALSRFFF

SEQ ID NO: 119532 - protein, 190 aa, Heterodera glycines
  Coding regions on vcDNA: vcDNA=SeqID_45955; Strand=-; Position=1 -207,441-828
  Homolog annotation: Hit_ID=XP_347271.1; Match level="QueryCoverage =88%, HitCoverage=56%, E-value=2e-28, Identity=44%"; Hit description =similar to hypothetical protein FLJ20013 [Rattus norvegicus] ref|XP _222071.1| similar to hypothetical pro
  Essential gene: C elegans homolog=F09F7.7a; Phenotype=Emb
DYGPRVNFKYQRVNSAKFFGLPDYVDHLLLRMGQMRGVDGFRPVELCNLDYSSERLSSIDLHKDEWIWGERLVVDLMNIRVLQYFSLLSTVFPLPILYVAAFTVSLNSDCVFTLEHPGRKLLVFVPVPRRSLLCLSGEVRSEWNHGIFPCHIFGRRVVITLRELASPFLVSLFLIFDLICDLFGFKDDPK

SEQ ID NO: 119533 - protein, 145 aa, Heterodera glycines
  Coding regions on vcDNA: vcDNA=SeqID_45956; Strand=-; Position=1 -255,725-907
  Homolog annotation: Hit_ID=CAE59273.1; Match level="QueryCoverage =97%, HitCoverage=48%, E-value=2e-57, Identity=79%"; Hit description =Hypothetical protein CBG02605 [Caenorhabditis briggsae]
  Essential gene: C elegans homolog=T24H7.1; Phenotype=Emb,Gro
LITQRQQVSLLVRKGLIERALDFNIILDDVAITELAFSPQYSAAVEAKQVAAQEAQRASFMVEKAIQQRQEKIVQAEGEAQAAKLLGESMKNDPGFLKLRKIRAAQKIARFIANSSNRVYLPSDGLFLNLADEDYLSLATNKGRR

SEQ ID NO: 119534 - protein, 154 aa, Heterodera glycines
  Coding regions on vcDNA: vcDNA=SeqID_45957; Strand=-; Position=1 -130,205-539
  Homolog annotation: Hit_ID=CAE59273.1; Match level="QueryCoverage =96%, HitCoverage=50%, E-value=2e-53, Identity=66%"; Hit description =Hypothetical protein CBG02605 [Caenorhabditis briggsae]
  Essential gene: C elegans homolog=T24H7.1; Phenotype=Emb,Gro
MASIDPKDFFNKFAKPSKGAGVGAGLMTAAAVAGYALYKSMYTIEAGHRAIMFNRIGGLGDEVYREGLHFRIPWFQYPIVYDIRARPNQIRSPTGSKDLQMVNIGLRVLSRPDPGQLQTICRMLGTNWEERVLPSICNEVTDGVIMGRDSNNII

SEQ ID NO: 119535 - protein, 399 aa, Heterodera glycines
  Coding regions on vcDNA: vcDNA=SeqID_45958; Strand=-; Position=1 -70,115-294,441-561,989-1246,1294-1367,1407-1596,1691-1998
  Homolog annotation: Hit_ID=NP_499564.2; Match level="QueryCoverage =67%, HitCoverage=34%, E-value=2e-31, Identity=33%"; Hit description =worm Apoptosis inducing factor Homolog (77.3 kD) (wah-1) [Caenorhabditis elegans] emb|CAB60511.2| Hypothe
  Essential gene: C elegans homolog=Y56A3A.32; Phenotype=Ced
EIDRFYKRVEELEVQREDEHEELNEQSALRSDIEMIDEQIERWKMVNELEKKKENIVESVATKFEQKPNFDPVEMSDDDDSDITLFRFAQMNFMRRAFIASINFPRLRNNVLRSVVPYVLIGGELWWFADEASIDSLSHTNPTSSTGRRRYAFYEADGFYLPPDKLDEWEHGGVGLIRGAKVVKVDTEGSFVLLEDGRKIEFGKCLIATGSDAWLHTQLEHLPELDDFVTTLGKASDFRKIYSKVDKMAVAENGTQNVIVVLGGGLLGTELAYSLNRRYARDQENPALKIVQLCQEPGILSEILPDALSDYSTDMLRYQGIEVLTDTRIDSASVKGRDEKRRRICLNTTAATTSDGPKERKQVMADFVIIALGAEPNIELVDEKSSIKLDKVIRSKFTN

SEQ ID NO: 119536 - protein, 169 aa, Heterodera glycines
  Coding regions on vcDNA: vcDNA=SeqID_45959; Strand=-; Position=1 -201,275-395,453-640
  Homolog annotation: Hit_ID=AAR85527.1; Match level="QueryCoverage =95%, HitCoverage=64%, E-value=5e-39, Identity=48%"; Hit description =14-3-3b protein [Meloidogyne incognita]
  Essential gene: C elegans homolog=M117.2; Phenotype=Emb
MSVELTEEERTLLSAAYRRAISTRRSAWRVIESHVKKSTIMDKQKQGVKVLQKKVESEAEEKGREILTLLDNQLIPKAADPEAKVFYMRMKGDFHRYLAEIKPSEADDLRKAQKAYQEAYSIAQEKLRPSHPIRLGVALNFSVFYEELLKSTEEARRIAQKVVGRISLF

SEQ ID NO: 119537 - protein, 165 aa, Heterodera glycines
  Coding regions on vcDNA: vcDNA=SeqID_45960; Strand=+; Position=1 -215,729-802,2574-2781
  Essential gene: C elegans homolog=ZK250.3; Phenotype=Clr,Lvl,Sck
MMRHKLQNGLDVIAILFFLREFTMRQDCTLTIFRNEHREICSWLYPSGGSSTLLITIQLTLLEKLGPYAFVTDMTQSELKILYSLRQQAYQANTAAGVPQGSVLGPLLFLIFINDRPSFITNEAASVGIKMYADDVNLYYAHENDDHSNQLDKEIEALEKWSKIN

SEQ ID NO: 119538 - protein, 179 aa, Heterodera glycines
  Coding regions on vcDNA: vcDNA=SeqID_45961; Strand=+; Position=1 -99,199-294,344-439,491-598,647-719,774-840
  Homolog annotation: Hit_ID=NP_510361.1; Match level="QueryCoverage =93%, HitCoverage=16%, E-value=1e-67, Identity=69%"; Hit description =WD-containing protein (115.0 kD) (XO784) [Caenorhabditis elegans] gb|AAQ75758.1| SYM-4 [Caenorhabditis el
  Essential gene: C elegans homolog=R03E1.1; Phenotype=Gro,Unc
MDRTAKLWHLHRNECLCSFQHIDFVTCLAFLPKDDRYFISGSLDGKIRLWHIPEKKVAIWNEVEQVNKFITAMTFVKNGKFVVIGTFLGRCFFYSTDQLKYHTVIDVRSSRGKNSVGHKITSLAVHGDKLLVASDDSRIRIYDLRDMDLCCKFKAFKRCPNQSEFNPRCLFARWFACDQ

SEQ ID NO: 119539 - protein, 400 aa, Heterodera glycines
  Coding regions on vcDNA: vcDNA=SeqID_45962; Strand=-; Position=1 -87,139-173,219-385,885-1103,1150-1225,1277-1359,1414-1459,1512 -1621,1701-1838
  Homolog annotation: Hit_ID=NP_497274.1; Match level="QueryCoverage =98%, HitCoverage=44%, E-value=1e-122, Identity=61%"; Hit description= solute carrier family 25 member 13 (3B467) [Caenorhabditis elegans] gb|AAK21421.1| Hypothetical protein
  Essential gene: C elegans homolog=K02F3.2; Phenotype=Ste
QVYIDLVKTRMQNQRTGSYLGEVMYKNSYDCFKKVIKFEGYDCFKKVIKFEGVLGLYRVLGLYRGLLPQIIGVAPEKAIKLTMNDFMRDKLTSDGRISLSSEILAGGCAGASQVVFTNPLEIVKIRLQTAGEIINGPKVNVFTVLRELGFGGLYRGAQACFLRDIPFSAIYFPVYAHMKMKTADEQGYNRPWSLFVSAFIAGGYNRPWSLFVSAFIAGAPAAALVTPADVIKTRLQVAARTDVIKTRLQVAARTGQTTYNGLIDCSRKILREEGPSILREEGPSAFWKGAAARVCRSSPQFAVTLLRVCRSSPQFAVTLLTYELLQRIFYVDFGGTRPSGSEVSTHTTILDQASVSTHTTILDQASENPHHIGGYKLAAATFSGIEHKFGLFMPRFEPKL

SEQ ID NO: 119540 - protein, 382 aa, Heterodera glycines
  Coding regions on vcDNA: vcDNA=SeqID_45963; Strand=-; Position=1 -51,111-249,301-486,529-551,592-776,819-964,1008-1114,2041-2178
  Homolog annotation: Hit_ID=NP_495367.1; Match level="QueryCoverage =99%, HitCoverage=85%, E-value=1e-106, Identity=52%"; Hit description= DumPY : shorter than wild-type DPY-2, ROLler: helically twisted, animals roll when moving ROL-2, collage
  Essential gene: C elegans homolog=T14B4.6; Phenotype=Bmd,Dpy
QVHSMARFAHNDFAFCERSVNDIESAAPNARSVNDIESAAPNAAFVLKNRTRREADYAGYSPSILPTNGPLFQECPACCIPGECCIPGERGPTGDPGLPGLPGAPGPDGAQGRPGTTPNASCIPERVFEPPPCLPCPQGPRGPPGHPGFPGEHPGFPGEPGDRGIPGRPGDRGIPGRPGQDGLPGKPGEDGPPGPDGAPGQPGPYGDKGPTPEAHIIPGPPGDPGETGPWGPPGHPGPPGEDGGPPGHPGPPGEDGYPGGSGEKGWPGPPGPPGPMGTPGLPGPMGEAGPIGTPGTCVCQDTTPGTCVCQDTEVVLTEKRPLSPSSAGGADGRRLRPPGGRDGLSPSVALRRRPLPLNSCSSTLVSDHPLIGWVAHFSSFPK

SEQ ID NO: 119541 - protein, 104 aa, Heterodera glycines
  Coding regions on vcDNA: vcDNA=SeqID_45964; Strand=-; Position=1 -135,194-373
  Homolog annotation: Hit_ID=NP_500846.1; Match level="QueryCoverage =87%, HitCoverage=23%, E-value=4e-09, Identity=30%"; Hit description =fer (fps/fes related) tyrosine protein kinase family member, has SH2 domain (48.8 kD) (4G442) [Caenorhabd
  Essential gene: C elegans homolog=F22D6.1; Phenotype=Sma
MDADLNTKRMSPEALRDRSFTQKSDTWAYGVLCWEVFMDGASPPRMLNGHRLQFPHDAPQKFVEFIMLHIWDPKDKNRYSMGAVYDWLKQHTEEGEEGRGKRLN

SEQ ID NO: 119542 - protein, 90 aa, Heterodera glycines
  Coding regions on vcDNA: vcDNA=SeqID_45965; Strand=-; Position=1 -108,379-540
  Homolog annotation: Hit_ID=CAE68556.1; Match level="QueryCoverage =66%, HitCoverage=15%, E-value=7e-09, Identity=40%"; Hit description =Hypothetical protein CBG14389 [Caenorhabditis briggsae]
  Essential gene: C elegans homolog=C52B9.7a; Phenotype=Emb,Ste,Stp
MDANLLQNVATDNNNDRQFGQQQILLGQTFDWTQFKNRLALDRCVCMGHSFGAASSLSACAEYPSLFNACVLLDAWLYPVERRMFPATVQ

SEQ ID NO: 119543 - protein, 657 aa, Heterodera glycines
  Coding regions on vcDNA: vcDNA=SeqID_45966; Strand=-; Position=1 -213,281-391,470-579,685-788,845-1048,1198-1393,1673-1980,2033 -2214,2433-2489,2667-2800,2856-2971,3473-3709
  Homolog annotation: Hit_ID=NP_496262.1; Match level="QueryCoverage =93%, HitCoverage=48%, E-value=1e-67, Identity=30%"; Hit description =prion-like Q/N-rich domain protein PQN-47, Prion-like Q/N-rich domain protein (pqn-47) [Caenorhabditis el
  Essential gene: C elegans homolog=F59B10.1; Phenotype=Lva,Unc
ASNPGQFEQPDQDLNWRQGQHGSLAFPGQVCIGAGGDKPIENASLTVYGNIATTGNITRPSDRRVKEDIAEVSTAEAMARVAQMRLVEFAYKPDIAQRWGLTEQDRHRELAEVLPEAVKDNGEFLTVDDTRVFYDTVAAAQELYRLTGNLGSKLDQVEKISQKLARYAQKRRQLGSMASGLSDFSTFFGTKSLLDGAGIGGGADGDKQSCVSYSRTSLASAVTTMPTTTHYDNDDIVQEKAKKQHIGIEDHHHPTVTIIVVAPIRRPRHTVTGPITVALVEAVVRALVVDSPLCTSKFTQGTIVTLVIIMALCLVTMCTLYVMDWYNRTYVFPVRLIDSYNGLPHHHHHPSSPSSPDSAAADHGRQPHQQQIEPGKMVKPFVEWKLPDRPQNVPPLTVFCGGAGTVMASLSSLIPVPLVGHGTCPHYCCGINSKLAATSKENFGEKLSKSVDEWVALASKVAENVVPPAPQLLLTQDQQNGIGQMNTLANGAKFEVLNMNFTIDARYCFNESCDARNGYFNLFVPVSEHFPTIPLQIRISTDDLTLFVDDCGGLNGFQYKPCQQYGNKQLQLEDDSERKSYRFRIGHSANLCERDERQRGRAFDEYNLFFYRTCALKATATATEAENGAETRSRTRTAAAETAKEGAAQQNGGGGVA

SEQ ID NO: 119544 - protein, 406 aa, Heterodera glycines
  misc_feature (3)..(3): Xaa can be any naturally occurring amino acid
  Coding regions on vcDNA: vcDNA=SeqID_45967; Strand=-; Position=1 -195,249-420,551-731,800-889,1358-1557,1638-1932
  Homolog annotation: Hit_ID=NP_501890.1; Match level="QueryCoverage =98%, HitCoverage=25%, E-value=1e-121, Identity=54%"; Hit description= predicted CDS, AMOP domain containing protein family member (4L60) [Caenorhabditis elegans] emb|CAA94300
  Essential gene: C elegans homolog=F54D1.6; Phenotype=Lva,Ste
LSXGVLVYVNNVERGQPEVYVVLEEAQIGVRIRESYAVDIDRMPMYQESMGMLDIALSVPPQYGVQPDGDKTREQETRQPDGDKTREQETRQRYNLPRVSGLMRPFPDTSTGSIYSTLTLNEVNSEAIRQQIINYYRIPGSGERFTDYQQQALNQFQIPTDNMFTTSKEEDKKFEAFPEASIKSEPIYKTAAIYETPQYRFVPRTPQYRFVPRTGAVLMQMLQQCNDLANRETSDLQPYQGQMYWDWASQCPDNPGKILQECGDNVPCLYDYTLLNAEVLGNEVKDTWNAFFHDRWSAIQNYNSCGPINIENSCGPINIEYPEYLIKTPALSSGYLQGDIARFECFQTHWIKGDAEFKCDEIRSTIKTWDMSFDSFDWARDIRNNLMKFILPNIDNLITVTVIGSK

SEQ ID NO: 119545 - protein, 157 aa, Heterodera glycines
  Coding regions on vcDNA: vcDNA=SeqID_45968; Strand=+; Position=1 -28,92-537
  Homolog annotation: Hit_ID=NP_491654.1; Match level="QueryCoverage =99%, HitCoverage=20%, E-value=4e-10, Identity=29%"; Hit description =CBF1 interacting corepressor (65.8 kD) (1G222) [Caenorhabditis elegans] gb|AAB37808.1| Hypothetical prote
  Essential gene: C elegans homolog=F55F8.4; Phenotype=Emb
MSGNAEDHGYANNPSDIIRDLNVEKKTKTVSDVTTNEQIDIKPKIEVRKSYEEKKKKRHHYSSEEEEEGTEEKKPEPIDQEQLLVNMREEHNLKFKTGILIGLRADEHIKVGTTLKFRAYQSITFQKMSAMVGGGEEKTFEAFLKGLDEKKRRKLMK

SEQ ID NO: 119546 - protein, 226 aa, Heterodera glycines
  Coding regions on vcDNA: vcDNA=SeqID_45969; Strand=+; Position=1 -169,225-412,470-547,594-676,740-778
  Homolog annotation: Hit_ID=NP_501935.1; Match level="QueryCoverage =96%, HitCoverage=40%, E-value=2e-57, Identity=52%"; Hit description =EGg Laying defective EGL-21, carboxypeptidase precursor, prohormone/enkephalin converting (52.3 kD) (egl-
  Essential gene: C elegans homolog=F59A3.1; Phenotype=Rup,Unc
PEMKYIGNMHGNEAIGRELLLRLAQFLCDGWRQGQRSVVEMLNSTNIHIMPSMNPDGFELTFELTLKTKPEQRGWVTGRTNAHGVDLNRNFPDLDAIFYKANAQRLPFFDHLLEVFHDSDNGQPEVPEVTAVANWVLSWPFVISANLHEGDLVANYPFDESLNPNELRAYSKGDLVANYPFDESLNPNELRAYSKSPDDVTFRYIAETYARAHAYIAETYARAHAH

SEQ ID NO: 119547 - protein, 349 aa, Heterodera glycines
  Coding regions on vcDNA: vcDNA=SeqID_45970; Strand=+; Position=1 -34,1081-1217,1278-1397,1455-1626,1684-1961,2005-2111
  Homolog annotation: Hit_ID=NP_498127.1; Match level="QueryCoverage =99%, HitCoverage=65%, E-value=8e-59, Identity=39%"; Hit description =similar to Transporter Of divalent Cations (47.0 kD) (toc-1) [Caenorhabditis elegans] gb|AAG00040.1| Simi
  Essential gene: C elegans homolog=ZC395.3; Phenotype =Egl,Gro,Unclassified
TLLVSLASLSCMAFLIYSVSVTRSLVLTGLAWLSVFSLFVIFSTIVAFICAASSSNKYTFGLARAPVLAVFSTTYTFGLARAPVLAVFSTTVLAQLSAVFLTKEAVERLFDSGHHHGGDAAPLSGGDILKTEHHGGDAAPLSGGDILKTEYLFYPAALASSSTMLIVAYALANQPFNYVLKHAQSSVIQHFADICAAVCYFVPGLARLLHFADICAAVCYFVPGLARLLLPRINSLTLLAFISTCCAIFVHWFRLEFPWVDSVASMVLSFTIFTSMAPLSSYTGRILLQTTPPHVQNLIDRSISEASTIDGVLESISEASTIDGVLELINTHFWQLNFNTIIGTVDVLV

SEQ ID NO: 119548 - protein, 255 aa, Heterodera glycines
  misc_feature (250)..(250): Xaa can be any naturally occurring amino acid
  Coding regions on vcDNA: vcDNA=SeqID_45971; Strand=-; Position=1-772
  Homolog annotation: Hit_ID=NP_508246.1; Match level="QueryCoverage =86%, HitCoverage=18%, E-value=3e-28, Identity=33%"; Hit description =predicted CDS, reverse transcriptase SjR1 like family member (XB959) [Caenorhabditis elegans] gb|AAC70878
  Essential gene: C elegans homolog=ZK250.3; Phenotype=Clr,Lvl,Sck
DDHSNQLDKAIDVLEWSKINGLEISTEKCFVLYLGKNNMKKEYFINSQRISESDNVRDLGIIIDSKLNFSEHISKIIRNAYLRSFQILRVLKSREIKTLTAAYKTFVRPQLEYATEVWNPNLKKDIDKIERVQKFFTRKAFQKCGFVYKKYMERLKITDLHKLEERRKINDLTTAFKIIKGFTSLEAEQNFFFSERRRPLLLRVKRHTAKTQNNFFHRIVRNWNNLPVLAVQINKAKEFRGLLKAMSSEXEISVP

SEQ ID NO: 119549 - protein, 174 aa, Heterodera glycines
  Coding regions on vcDNA: vcDNA=SeqID_45972; Strand=-; Position=1 -171,220-333,397-582
  Homolog annotation: Hit_ID=NP_497896.1; Match level="QueryCoverage =94%, HitCoverage=38%, E-value=5e-29, Identity=38%"; Hit description =programmed cell death 2 (43.3 kD) (3F508) [Caenorhabditis elegans] emb|CAA83630.1| Hypothetical protein R
  Essential gene: C elegans homolog=R07E5.10; Phenotype=Emb
MSAVSPSSVVHLGLPRPVDASQLFSLERHFLPLGKCGGHPAWLNPATIPQSAELACQVCGSPMAFLLVCGSPMAFLLQVYCPDEPSHAFHRTIFIFVCRKGNCSKINATPNFAINATPNFAAFRCQLSRENAFFSAESALCPSVVGEVSEPLRPLPFRAPLLRCGCRAASRCAR

SEQ ID NO: 119550 - protein, 153 aa, Heterodera glycines
  Coding regions on vcDNA: vcDNA=SeqID_45973; Strand=+; Position=1 -305,391-544
  Homolog annotation: Hit_ID=XP_420553.1; Match level="QueryCoverage =100%, HitCoverage=31%, E-value=6e-19, Identity=36%"; Hit description= PREDICTED: similar to COP9 signalosome subunit 4; COP9 (constitutive photomorphogenic, Arabidopsis, homo
  Essential gene: C elegans homolog=Y55F3AM.15; Phenotype=Emb,Lva,Unc
MVVSRQFIADIASYLSQPSLNTALIKGIGEAVLTQLHVGLFRHFVLIKLLKCTNCPPQARALAYEEQSTQIRMILANALERDRQFEQSARTLMGIPIETGQRGYRHEFKMELYLRITELFLEADNVEEADRHVKRASLLQQDVKEEALVIKYK

SEQ ID NO: 119551 - protein, 202 aa, Heterodera glycines
  Coding regions on vcDNA: vcDNA=SeqID_45974; Strand=+; Position=1 -58,106-193,254-398,460-592,641-720,766-867
  Homolog annotation: Hit_ID=CAE59176.1; Match level="QueryCoverage =99%, HitCoverage=65%, E-value=9e-70, Identity=46%"; Hit description =Hypothetical protein CBG02484 [Caenorhabditis briggsae]
  Essential gene: C elegans homolog=C18A3.5a; Phenotype=Rup
EMKVNWAIQPGTQQKIDTSKHFHIFVGDLSPEIDNKTLKDAFVPFGDVSDSKVIRDPTTLMSKGYGFVSFPKREEAERAIEQMNGQWLGRRTIRTNWATRKPGAMGGGVEYSSKPTVDEIMAQTSPENTSVYVGGVPPGATEEDIRSTFRRFGNIVDIRYFKPQGYAFVKYETKLAAGKAIHEMNSNEFMGQTLRLNWGKVD

SEQ ID NO: 119552 - protein, 43 aa, Heterodera glycines
  Coding regions on vcDNA: vcDNA=SeqID_45975; Strand=+; Position=1 -99,270-299
  Homolog annotation: Hit_ID=NP_067259.2; Match level="QueryCoverage =100%, HitCoverage=22%, E-value=6e-11, Identity=74%"; Hit description= c-K-ras2 protein [Mus musculus] gb|AAH10202.1| C-K-ras2 protein [Mus musculus] gb|AAH04642.1| C-K-ras2 p
  Essential gene: C elegans homolog=ZK792.6; Phenotype=Lva,Lvl,Unc
MDQRSIQELARSFGIPFIETSAKTRRHVDEAFHALVREIRKHK

SEQ ID NO: 119553 - protein, 119 aa, Heterodera glycines
  Coding regions on vcDNA: vcDNA=SeqID_45976; Strand=-; Position=1 -49,116-260,395-559
  Homolog annotation: Hit_ID=CAB58171.1; Match level="QueryCoverage =100%, HitCoverage=73%, E-value=2e-55, Identity=90%"; Hit description= troponin-like protein [Anisakis simplex]
  Essential gene: C elegans homolog=F54C1.7; Phenotype=Emb,Lvl
IMNAMEQDFDENILRKLIRKFDADGSGKLEFDEFCALVYTVANTVDKDTLRKELREAFRLFDKEGNGYISRPTLKGLLHEIAPDLSDKDLEAAVDEIDEDGSGKIEFEEFWELMAGETD

SEQ ID NO: 119554 - protein, 163 aa, Heterodera glycines
  Coding regions on vcDNA: vcDNA=SeqID_45977; Strand=+; Position=1 -95,499-648,1573-1704,1752-1865
  Homolog annotation: Hit_ID=CAE67561.1; Match level="QueryCoverage =50%, HitCoverage=13%, E-value=8e-33, Identity=81%"; Hit description =Hypothetical protein CBG13088 [Caenorhabditis briggsae]
  Essential gene: C elegans homolog=E04F6.5a; Phenotype=Emb,Gro
FQQRRTFAAAVPNEIPVEPNNGQQPDLANSKDAKPTESFCMNLFLGRAQLGQVFPYPLRLDDEQRETLQMVVTPSAKFLDESIGYKGILLYGTDAQKDKYLPDLATGKKFASFCLTEPSSGSDANSIRTRAEKSACGKFYTLSGGKIWISNGGFADVFTVFAK

SEQ ID NO: 119555 - protein, 351 aa, Heterodera glycines
  Coding regions on vcDNA: vcDNA=SeqID_45978; Strand=+; Position=1 -60,101-277,328-371,417-568,630-754,808-1062,1119-1164
  Homolog annotation: Hit_ID=CAE70529.1; Match level="QueryCoverage =97%, HitCoverage=48%, E-value=1e-83, Identity=50%"; Hit description =Hypothetical protein CBG17160 [Caenorhabditis briggsae]
  Essential gene: C elegans homolog=F09B9.2a; Phenotype=Gro,Lon,Unc
QMFGVRCCECDRFIAGRVLEAGGYKFHPTCARCSRCQLPFDDGAVLEAGGYKFHPTCARCSRCQLPFDDGAEMYMQGNEIWHPNCEHYRTTENIAVRRRRGQKRRRGSKFQSQFGSKFQSQFGQHLTYMYMLPETEQTLLKHPIAYMLPETEQTLLKHPIANPPQPTQYHTPQGPVIKIRKSRYSMLKTGMQRLTEDLERTEDLERTRPRSRSSSVDNDEPIELAHFPGAKVPDKDAVPPIDREDFPAPREDFPAPPYPYAVEELKRRLSSSSVENDDEEEEEEAVKLAHQNKAEKVMNRAQKVLDDIEQHSSIAHVIKQKLVEDSERKQRLRLHWRLHWDPRNCGRGGGN

SEQ ID NO: 119556 - protein, 212 aa, Heterodera glycines
  Coding regions on vcDNA: vcDNA=SeqID_45979; Strand=+; Position=1 -43,108-386,432-547,629-726,779-881
  Homolog annotation: Hit_ID=AAK55116.1; Match level="QueryCoverage =100%, HitCoverage=100%, E-value=1e-130, Identity=98%"; Hit description=venom allergen-like protein [Heterodera glycines]
  Essential gene: C elegans homolog=F49E11.9; Phenotype=Unclassified
MHLINLIALFFMLFGPSVQQYTKTPTNEDKEAAVNCHNKFRSQLALGNADNKSGGKKMPKAGNMRKFEWDENLAKLADEWANKCTLSHSWNGWAGENLAMNGGTFSNKDGFEYACGRWWDELNRYGFNPDLIMTGENFSGIGHWTQMAWADTDRIGCAMAQNCPNTNWKTYVVCWYYTGGNYFGAPVYLAGEPCSKCKANDKCDKATGLCSQ

SEQ ID NO: 119557 - protein, 167 aa, Heterodera glycines
  Coding regions on vcDNA: vcDNA=SeqID_45980; Strand=+; Position=1 -159,266-407,527-577,655-792,845-859
  Homolog annotation: Hit_ID=CAE67815.1; Match level="QueryCoverage =95%, HitCoverage=32%, E-value=4e-13, Identity=29%"; Hit description =Hypothetical protein CBG13395 [Caenorhabditis briggsae]
  Essential gene: C elegans homolog=M176.2; Phenotype=Emb,Lva
RRFKNPAAIIVSIVHKEYSYWHFLKRYDEYEIDELTKYKAKVVYLTVFECGNYLTLDDDLTLRLKGDPVAVVYANVVMTGHKMLPETLALFKMIERSTAFYSSTVCADLSQTKIVQQVLTRPGMVEKFFPSPGEAPMVTAIRKTFAKIWALDNDDDDTKAIIAQNET

SEQ ID NO: 119558 - protein, 142 aa, Heterodera glycines
  Coding regions on vcDNA: vcDNA=SeqID_45981; Strand=-; Position=1 -51,145-522
  Homolog annotation: Hit_ID=BAA88337.1; Match level="QueryCoverage =66%, HitCoverage=9%, E-value=8e-13, Identity=43%"; Hit description =ORF2 [Platemys spixii]
  Essential gene: C elegans homolog=ZK250.3; Phenotype=Clr,Lvl,Sck
MKKEYFINSKKISESDNILRVLKSREIKTLTAAYKTFVRPQLEYATEVWNPNLKKDIDKIERVQKFFTRKALRKCGFVYKKYGERLKIAGLHKLEERRKINDLTTAFKIIKGFTSLEADLFLRKAQEAFTFASKAPHGQNTK

SEQ ID NO: 119559 - protein, 198 aa, Heterodera glycines
  Coding regions on vcDNA: vcDNA=SeqID_45982; Strand=+; Position=1 -28,641-750,818-933,978-1142,1204-1304
  Homolog annotation: Hit_ID=CAF98122.1; Match level="QueryCoverage =98%, HitCoverage=32%, E-value=3e-36, Identity=45%"; Hit description =unnamed protein product [Tetraodon nigroviridis]
  Essential gene: C elegans homolog=T07A9.2; Phenotype=Gro
FLQPRKSFQCLSNVFVLPLPVSCSSAFVRPVRVRFAPSPTGELHLGSVRTALFNFSVRTALFNFLWARKYNGKFVLRIEDTDRERLVEGSEQRIEQTLSHFGLTPDESPIEQTLSHFGLTPDESPLRGGQFGSYYQSERLPLYRELADQLVDIGHSYKCFCSQERRLDFLRRKANSERIPFRYDGICRQLSTEETRAR

SEQ ID NO: 119560 - protein, 114 aa, Heterodera glycines
  misc_feature (1)..(1): Xaa can be any naturally occurring amino acid
  misc_feature (113)..(113): Xaa can be any naturally occurring amino acid
  Coding regions on vcDNA: vcDNA=SeqID_45983; Strand=+; Position=1 -167,792-966
  Homolog annotation: Hit_ID=AAN05584.1; Match level="QueryCoverage =91%, HitCoverage=91%, E-value=5e-42, Identity=80%"; Hit description =ribosomal protein L30 [Argopecten irradians]
  Essential gene: C elegans homolog=Y106G6H.3; Phenotype=Emb,Lva
XNGHILQKKSAENINARLGMVTKSGKYCLGYKQSLKTLRSGKAKLVIISSNTPSLRRSEIEYYAMLSKTGVHEYHGNNIELGTACGKLFRVSMLSITDPGDSDIIRSMPTEAXA

SEQ ID NO: 119561 - protein, 31 aa, Heterodera glycines
  Coding regions on vcDNA: vcDNA=SeqID_45984; Strand=+; Position=1-95
  Essential gene: C elegans homolog=Y106G6H.3; Phenotype=Emb,Lva
RRSEIEYYAMLSKTGVHEYHGNNIELGTAWA

SEQ ID NO: 119562 - protein, 222 aa, Heterodera glycines
  misc_feature (101)..(101): Xaa can be any naturally occurring amino acid
  misc_feature (122)..(122): Xaa can be any naturally occurring amino acid
  Coding regions on vcDNA: vcDNA=SeqID_45985; Strand=+; Position=1 -149,598-856,941-1039,1091-1176
  Homolog annotation: Hit_ID=NP_505762.1; Match level="QueryCoverage =90%, HitCoverage=56%, E-value=2e-27, Identity=41%"; Hit description =PRP38 family (38.2 kD) (5L286) [Caenorhabditis elegans] emb|CAA98434.1| Hypothetical protein D1054.14 [Ca
  Essential gene: C elegans homolog=D1054.14; Phenotype=Emb
PPPPPLRLSPSECFFNHFNLEFELLYMDEFVDNLLREDHYCDIQLPRLQKRQALEEKDQLELYASALDEDLERLSTDSEDEQETRKARPNVRIESLFLGRXLLGMRFLVKYLKFCAFNTHRXARKKHFPLGFGCLRQIVSRRRSRQIVSRRRSRSRSRGRSRKSRERRRRSLSTDGRRSAAKDTEREIEENNALRSAAKDTEREIEENNALRKKLGLAPLER

SEQ ID NO: 119563 - protein, 178 aa, Heterodera glycines
  Coding regions on vcDNA: vcDNA=SeqID_45986; Strand=-; Position=1 -187,234-320,372-632
  Homolog annotation: Hit_ID=AAN78131.1; Match level="QueryCoverage =100%, HitCoverage=43%, E-value=7e-72, Identity=77%"; Hit description= cAMP-dependent protein kinase [Onchocerca volvulus]
  Essential gene: C elegans homolog=R07E4.6a; Phenotype=Lva,Lvl,Unc
EGGSFGELALIYGTPRAATVVAKTNTVKLWAIDRITYRAILMGSTMRKRKMYDEFLSKVQILADLDKWERANVADALEQCQFPSGTHVVEQGHPGDEFFIIVEGEAEVLQRPNDDAPFEVVGKLGPSDYFGRFWHSLLRCINYRLIKGEIALLLDRPRAATVVAKTLLKCLKLDRARF

SEQ ID NO: 119564 - protein, 395 aa, Heterodera glycines
  Coding regions on vcDNA: vcDNA=SeqID_45987; Strand=+; Position=1 -89,165-266,767-857,937-999,1061-1134,1190-1288,1360-1408,1455 -1543,1583-1761,1828-1869
  Homolog annotation: Hit_ID=CAE75287.1; Match level="QueryCoverage =99%, HitCoverage=84%, E-value=5e-64, Identity=40%"; Hit description =Hypothetical protein CBG23255 [Caenorhabditis briggsae]
  Essential gene: C elegans homolog=D2023.7; Phenotype=Emb
FSATTVLLLLAILMVHNDLQQIWLEDTEMDQIKLETDDLWTMDQIKLETDDLWTDLLAMGAGTPSNRERRQVKSRYGGYAASGVQPPAPAVAAPVQVASGPLSVGTNNCPAGTQGQPGKPGPPGIPGVPGKDGVPGFSAEDVPGKDGVPGFSAEDAHNAPFKGCTNCPQGPQGVPGENCPQGPQGVPGEAGKPGIRGMRGPTGQPGMPGRDGVPGFPGETGAEGADGVPGFPGETGAEGALGLPGAAGSPGEKGEDQKKEIGLKGLGLPGAAGSPGEKGEDQKKEIGLKGPRGPTGDKFCQGPEGPVGLPGNAAPPGPRGPTGDKFCQGPEGPVGLPGNAAPPGREGVYGLTGPPGPAGVPGAEGEYGGPGSAGQPGKDAEYCKCPGRDAPADNA

SEQ ID NO: 119565 - protein, 144 aa, Heterodera glycines
  Coding regions on vcDNA: vcDNA=SeqID_45988; Strand=+; Position=1 -24,64-343,500-548
  Homolog annotation: Hit_ID=NP_502065.1; Match level="QueryCoverage =79%, HitCoverage=78%, E-value=3e-64, Identity=99%"; Hit description =UBiquitin Conjugating enzyme E2, Ubiquitin conjugating enzyme, LEThal LET-70 (16.7 kD) (let-70) [Caenorha
  Essential gene: C elegans homolog=M7.1; Phenotype=Emb
MALKRIQKELQDLGRDPPAQCSAGPVGDDLFRIQKELQDLGRDPPAQCSAGPVGDDLFHWQATIMGPPESPYQGGVFFLTIHFPTDYPFKPPKVAFTTRIYHPNINSNGSICLDILRSQWSPALTISKVLLSICSLLCDPNPDD

SEQ ID NO: 119566 - protein, 415 aa, Heterodera glycines
  Coding regions on vcDNA: vcDNA=SeqID_45989; Strand=+; Position=1-1277
  Homolog annotation: Hit_ID=NP_510671.1; Match level="QueryCoverage =94%, HitCoverage=40%, E-value=1e-67, Identity=37%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
RPENTAHCRVMERILSQNIYNFLLKNNKISEYQFGFVRNRSTTSQLITVVEDWYEAIINGKVDCIYIDFQKAFDSVPHNLLLYKLEKIGIRGKLLMRIKGFLSNRTFRVKIGDSLSSSKKVTSGVPQGSVLGPLLFLIYINDLPDALPSGVKIKLYADDVKLYISDTEIMHKALHNLFEWANKWQIKVSIQKTFVLYLGSKNPKETYKFDGNTINAVDTTRDLGVIIDNKLQFSDHINQITRNAYLRMRSLFRIIKSKSSKIWITLYKTYIRPLLEYAPEVWNPSLQKNIKKIEKCQKYFTKRVFFKCSLPPIPYQNRLEYLQLPTLENRRKLFDLFMAHKIVYGRTDLKLFSIFKHALTSPFIDLTQNTNWAKNSFPLLGGTKLWNQLDKELIKTNSYLNIFGLKYLPRNRIFS

SEQ ID NO: 119567 - protein, 200 aa, Heterodera glycines
  Coding regions on vcDNA: vcDNA=SeqID_45990; Strand=-; Position=1 -131,179-263,308-417,479-541,723-819,935-1051
  Homolog annotation: Hit_ID=NP_741342.1; Match level="QueryCoverage =99%, HitCoverage=99%, E-value=6e-68, Identity=60%"; Hit description =yeast Mitosis Arrest DeFicient related, component of the spindle -assembly checkpoint, interacts with MDF-
  Essential gene: C elegans homolog=Y69A2AR.30a; Phenotype=Pvl,Unc
MTELATKNSITLKGSAQMVQQFFHYGIHSILYQRGIYPSDNFTRDKKYGMTLLVNKDPKLEQFLNPLLQHVETMLTKQMLKKLVLVITDISSKEALERWQFDIETTPEGENGYGSKDEKRIKQEISDVLRQITASVAFLPLLEQRCSFDVLVYTFRDTELPEGWADSSECHIDNAEQVQLRSFSSSIHTVHTRVQYKADL

SEQ ID NO: 119568 - protein, 164 aa, Heterodera glycines
  Coding regions on vcDNA: vcDNA=SeqID_45991; Strand=-; Position=1 -190,249-401,472-621
  Homolog annotation: Hit_ID=BAC23047.1; Match level="QueryCoverage =56%, HitCoverage=19%, E-value=4e-13, Identity=42%"; Hit description =ankyrin-like protein [Solanum tuberosum]
  Essential gene: C elegans homolog=F35D6.1a; Phenotype=Stp
MHVESGTSIDMPGGQNGTTMLMIAAASGRVGKKCVSKYFPFVKVDFARYLLTRGATVGRLDNTGSVFALILAAETGSLEMCRLLVEEWAAEVNQQAIDGTTPLMGASSEGRLNVVTYLIDHGAEVQHTDADGYNALMHAVKNGKTEVARHLLTNGASTDQMGTD

SEQ ID NO: 119569 - protein, 1644 aa, Heterodera glycines
  Coding regions on vcDNA: vcDNA=SeqID_45992; Strand=-; Position=1 -133,309-513,677-799,854-904,1016-1123,1388-1516,1586-1691,1772 -1920,2299-2415,3239-3375,3419-3476,3621-3844,3978-4137,4261 -4325,4414-4543,4680-4837,...
  Coding regions on vcDNA: Position=...4902-5034,5219-5343,5549 -5843,6140-6289,6465-6539,6603-6830,7523-7648,8117-8358,8470 -8560,8739-9029,9262-9301,9416-10479
  Homolog annotation: Hit_ID=NP_741200.1; Match level="QueryCoverage =100%, HitCoverage=90%, E-value=0.0, Identity=31%"; Hit description =mesocentin, extracellular matrix adhesion molecule required for proper gonad positioning and sensory map f
  Essential gene: C elegans homolog=K07E12.1a; Phenotype=Pvl
PTQPNGPLHHYTVYFALEADDDSYKRWTRLTVPLPDGGGHFQVVLDRETYNILAQREYRLRVTAANDMNEGPPSAVARFTTGTGETPPTVAIVPADNPAEVQPLDDYSVHCDATGVPPPTLWWTLGTDEERQPGGAHLLLRKLRKDTTATCATCHAENNAGKAQLVLELRVLGPGTPPNELVVLPMPDQVLNVEWTAPDEPNGKLVGYIIHYAELADGQLEPPSDAWQQIRVGADVNRHRLTELRPKTIYTIRLQAVSDRGPGVLSDPVMARTLPLAPKAPEVMPVMVHDNNTVMVQFLPSDDPEEVGKKVQTYRIHYTKGDPSLEDAQWNEMTWSIPPGADTTKEMNVFLDGENFEPETKYHVRVIPIGVIEGPPSQPKDFDTKLGVVAPDKPMIHVDVEDNILRVPAGTDYTVACTANGFPATANGFPAPQIKWVDKEGNLISEGGMLRVSDIRQAKDFVCVAENEGGRTENGFTIFVAGPGSAPENIRLAATRPKSISVTWDPPQIANGNITRYIIYYIALDDQSRDLLVGQVPSKPISEWMSNHVMGKDLGVGEKQALITDFVEADTAYAVVVQAANQDGPGPYSNQHNIRTMSRARAAPPTQLQVEPINQTSVEVHWKPAEVLEESPLSYEIYYVPAEKKIEEDELLSLPKWSKVEVPDPSKNSHIIWNALEPDTEYVFKIRALYPSGPGIFSEPCIYPSGPGIFSEPCIAKTLPEGDAPFIVVSSGSRGTAGESVIQLLPGSDYTVFCRASGRPQPAVRWIRGGDIPIDPSTVKEDHTGTKWSLFVSNITEPSTFNCVARNPLGVANWTIRLEMMSDLSADWRDQLVRVESRRGQIYLHFADTLPNSLRRANQWTLRYTDDPNKERILWSVLESEDRTLEAPAAPMEPGVTYYLVVENANEGVRSPVFTILVPKAPGDLRVGSNINDEMVVDFRPAISGPQQPVREYSVRYWPAADAAQMADAAQMSTIRVEGNRTVGIRVPDLPRDVEFYFQAVAELSDGQELAGPPVRIRTPAKEIRCDCSHACKLLETDSVQVVRVECYCPDGWLLDEDEKTCSQVEPTGGAGTVVEVRNNRAIETEAGDDLGATVHVLPTDSLGREIRPVVMFNGTPLRTDGHGNYYDAMERKVERDEEQRALGPDGQVLKMNSDGNWVYPPLDKYGQPMPTGANMYPIYSVVDDDGVSMRRDEEGKILDHEGKPLPTDAYGQPMGPDSSPLPTNFYGQFVLGQRLEEEDKVLPTDTMGFPIYPIVYPVPTASSGLFLDSERGDEVQRDEQGIPVDTDGKTLPKNEEGMFVLPKATTTSTARPTVVEVIGPDGLPLSTTREGLVLDRAGSPLPTRGDGLLIGADGQPLPTDSLGRFIHVTVPPGGAETLPTDDYGHDIHPMVDQFGIAMPTDASGHYVDAGGAQIETDEFGRPVDSAGHLLPQGEQGQFIYTRPEGPVVASLGGGTLEPAATARGQIVVVDSAGQPLDRDEQGGCVGGERKPLATSADGLLLGPDGSPLPTNAEGQFVYAWSAEQEQERKLAPVTDSSGHLLMPVVDAEGTPLARDPASGRYLDPADGTPIAVDDQGRPLDRSGNVLSKNIYDEYVWLDVGLVSGRASGTDAGGRIGAEATTATLHDDHAVDGAELVPSDEGGP

SEQ ID NO: 119570 - protein, 225 aa, Heterodera glycines
  Coding regions on vcDNA: vcDNA=SeqID_45993; Strand=-; Position=1 -126,251-447,493-640,948-1029,1080-1201
  Homolog annotation: Hit_ID=XP_215134.2; Match level="QueryCoverage =72%, HitCoverage=23%, E-value=1e-54, Identity=52%"; Hit description =similar to cysteine-tRNA ligase isoform b; cysteine translase; cysteine-tRNA synthetase [Rattus norvegicu
  Essential gene: C elegans homolog=Y23H5A.7a; Phenotype=Lva
MALIRLDLRNWNNIFKQHCSIISKRHPLNPTPTKENFLWIRSIAKFETDLVQFKTRISQPDNGQSADVRTVLVRKLLESAKEVLSDWLDVTRGNTVTKHDIFAKLARKYENEFLCDMNALNVLEPDVLTRVSEYIPEIIDYVQQIIRNGYAYVSDGSEKRSPSDFALWKASKDGEPFWESPWGKGRPGWHIECSAMSGAICGDKLDIHAGGFDLKFPHHDNEIAQ

SEQ ID NO: 119571 - protein, 140 aa, Heterodera glycines
  Coding regions on vcDNA: vcDNA=SeqID_45994; Strand=+; Position=1 -249,313-483
  Homolog annotation: Hit_ID=CAE56730.1; Match level="QueryCoverage =88%, HitCoverage=58%, E-value=8e-56, Identity=80%"; Hit description =Hypothetical protein CBG24517 [Caenorhabditis briggsae]
  Essential gene: C elegans homolog=T08D2.1; Phenotype=Unc
MSNSFRILSLFCPLFLLLFVPETSRALYFHIAETEKKCFIEEIPDETMVMGRYKVQLYDPNTKAYGDYPTIGMHVEAKDPEEKVILSKLYTSEGMFTFTSHSPGEHLICLYSNSSAWFSGAQLRVHLDIQVGEHAQDYEQ

SEQ ID NO: 119572 - protein, 301 aa, Heterodera glycines
  Coding regions on vcDNA: vcDNA=SeqID_45995; Strand=-; Position=1 -81,137-382,434-498,555-679,735-973,1025-1174
  Homolog annotation: Hit_ID=AAO85519.1; Match level="QueryCoverage =97%, HitCoverage=94%, E-value=4e-81, Identity=49%"; Hit description =putative serine/threonine phosphatase [Oesophagostomum dentatum] gb|AAO85518.1| putative serine/threonine
  Essential gene: C elegans homolog=W09C3.6; Phenotype=Ste
MAVPFSLQVDGLIYRVRNSTYGQFPLDVTEHDLRQLCDATMDVFRQQQTLVRIQPPVNVCGDIHGQFTDLLRIFSTLGPPPEKKYLFLGDYVDRGPQSLETVVLLFCYKVKYPESVTLLRGNHECSNINRVYGFYSEIEQRYHQADTRRLFDMFNQTFAWMPYVGLIGDRILCMHGGISDRITSLQQLNELRRPLLTLPSPSLEMDLLWADPMLDIRGVEPSPRGAGVVFGEDVVFRICELLNLNYIIRAHELVHEGIEYFADERLVTVFSVPRYHNQMNTGAALTIAEDLSHDVTFFPPN

SEQ ID NO: 119573 - protein, 419 aa, Heterodera glycines
  Coding regions on vcDNA: vcDNA=SeqID_45996; Strand=-; Position=1 -132,180-421,481-872,922-1412
  Homolog annotation: Hit_ID=CAF93045.1; Match level="QueryCoverage =100%, HitCoverage=32%, E-value=1e-162, Identity=65%"; Hit description=unnamed protein product [Tetraodon nigroviridis]
  Essential gene: C elegans homolog=K02F2.3; Phenotype=Emb
GNMLIGVPGGHDGPSGVIVCCENYLVYKNLGDQPDIRCPIPRRRNDLDESERPIMIVCAATHKMKNLYFFLVQSEQGDVFKVTLDSDADIVTEMRIKYFDTLPVANSICILKTGFLFVASEFGNHHLYQIAHLGDNDDEPEFSSRIPLDEGETFFYDTRGLQNLILVDQIDSLNPMITSHVPFNAFPTFGICYVLCSLKIADLANEDAPQIYALCGRGPRSTLRVLRNGLEVSEMAVSELPGNPTAVWTVKKNVDDPFHAHIIVSFTNATLVLSIGETVEEVTDSGFLGTTPTLGCGLIGEDSLLQVYPSGIRHIRADRRVNEWRAPPKRPISKCAMNRRQVSGNIDILTKKETVVLLKVVISLLGGEIVYFELDMNNQLREYSERREMTSEVLCMSLSEVPEGELRSRFLTVGMADRT

SEQ ID NO: 119574 - protein, 532 aa, Heterodera glycines
  Coding regions on vcDNA: vcDNA=SeqID_45997; Strand=-; Position=1 -115,171-271,328-441,503-641,766-932,981-1179,1241-1471,1540 -1618,1687-1840,1894-1931
  Homolog annotation: Hit_ID=NP_499385.2; Match level="QueryCoverage =97%, HitCoverage=42%, E-value=0.0, Identity=74%"; Hit description =membrane Calcium ATPase, Sarco-Endoplasmic Reticulum Calcium ATPase (115.5 kD) (sca-1) [Caenorhabditis eleg
  Essential gene: C elegans homolog=K11D9.2a; Phenotype=Ste
MENAHTKSEDELFRFFGTGPDGLTEEQADELRDKYGYNEMPAEEGMPAEEGKKLWELILEQFDDLLVKILLLAAIISFVLALFEEHDDQTSAVVLALFEEHDDQTSAVTAFVEPFVILLILIANATVGVWQERNAESAIEALKEYEPERNAESAIEALKEYEPEMAKVIRAGKHGIQMIRAKELVPGDLVEVSVGDKIPADLRLVKIYSTTIRIDQSILTGESVSVIKNLDVVPDPRAVNQDKKNCLFSGTNVASGKARGIVFGTGGTNVASGKARGIVFGTGLSTEIGKIRTEMAETESDKTPLQQKLDEFSEQLSKVISIICVAVWAINIGHFNDPAHGGSHFNDPAHGGSWLKGAIYYFKIAVALAVAAIPEGLPAVITTCLALGTRRMAKKNAIVRSLPSVETLGCTSVICSDKTGTLTTNQMSVSTLTTNQMSVSKMFVVEHAHGDQITFGEEFTISGSTYEPTGQIMYNGVQINCATDQHKALTELATICSLCNDSSVDYNEMKHAYEKVGEATMKHAYEKVGEAT

SEQ ID NO: 119575 - protein, 117 aa, Heterodera glycines
  Coding regions on vcDNA: vcDNA=SeqID_45998; Strand=+; Position=1 -15,100-219,453-605,720-785
  Homolog annotation: Hit_ID=CAE68383.1; Match level="QueryCoverage =82%, HitCoverage=25%, E-value=2e-28, Identity=46%"; Hit description =Hypothetical protein CBG14139 [Caenorhabditis briggsae]
  Essential gene: C elegans homolog=K10B3.10; Phenotype=Lva
MKKKFLLARRRHLMDRMAQRRERLKESYRLHSFDRDCDEMLGWIQSYLDPTNIRGKLQKHGNFEQELRANRNRLDETNAPGQELIQSGHYANEHIQKLFSGFSFVTSTGLKNCLSLL

SEQ ID NO: 119576 - protein, 159 aa, Heterodera glycines
  Coding regions on vcDNA: vcDNA=SeqID_45999; Strand=+; Position=1 -270,886-984,1035-1143
  Homolog annotation: Hit_ID=NP_495011.1; Match level="QueryCoverage =100%, HitCoverage=31%, E-value=2e-56, Identity=58%"; Hit description= protein kinase C, iota/lambda/zeta type, component of a PDZ-mediated protein complex PAR-6/PAR-3/PKC-3 r
  Essential gene: C elegans homolog=F09E5.1; Phenotype=Emb
LDNVLLDAEGHIKLTDFGMCKENIGPGDGTSTFCGTPNYIAPEILMGEEYGFSVDFWALGVLMFEMMAGRSPFHLPTTEEDEQTAEDLLFSPSERLGCKTDLEEGLADIKMNSFFKSNIDWELLEQRQIAPPYNPNVSGDRDLQRFDTSFTNGNPSLTP

SEQ ID NO: 119577 - protein, 306 aa, Heterodera glycines
  Coding regions on vcDNA: vcDNA=SeqID_46000; Strand=-; Position=1 -201,254-452,523-728,1208-1351,1481-1651
  Homolog annotation: Hit_ID=CAE63863.1; Match level="QueryCoverage =98%, HitCoverage=73%, E-value=5e-69, Identity=59%"; Hit description =Hypothetical protein CBG08425 [Caenorhabditis briggsae]
  Essential gene: C elegans homolog=Y55F3AR.3; Phenotype=Emb,Lva,Unc
MVINRLEKLFVTNDAVSILNELEVQHPAARILVMAAQMQEKQIGDNTNTVVILAASFLEHALQLLDMGITAVEIASGYEFALQKVEELLPGLVVSTAEDLYDIVKVRSYLKSSLISKQTDHYELISDLVAKACVQIMPKNNTTAFNVDNIRICKILGAGVASSYVTNGMLFRRGAEGEVKGASNARVVVFACPFDLTQTETKVVVFDKKSEVGKVATIVVRGSSQSLVDDIERAIDDAVNTYKALTRDNKLLPGAGATEVELSHQIEIIGEKESGLRQYAIKKYATALDILPKQLAENAGLKVNIF

SEQ ID NO: 119578 - protein, 84 aa, Heterodera glycines
  Coding regions on vcDNA: vcDNA=SeqID_46001; Strand=-; Position=1 -71,123-261,315-450
  Homolog annotation: Hit_ID=NP_498579.2; Match level="QueryCoverage =98%, HitCoverage=94%, E-value=2e-28, Identity=69%"; Hit description =ribosomal Protein, Small subunit (9.7 kD) (rps-21) [Caenorhabditis elegans] gb|AAC48297.2| Ribosomal prot
  Essential gene: C elegans homolog=F37C12.11; Phenotype=Emb
MQNDAGDFVDLYVPRKCSSSSRIISAKDHASIQLEVVEVDQATGRMITGKTTKYAICGKLRFMGESDDCILRLAQRDGIIPQNL

SEQ ID NO: 119579 - protein, 176 aa, Heterodera glycines
  Coding regions on vcDNA: vcDNA=SeqID_46002; Strand=-; Position=1 -159,212-339,413-656
  Homolog annotation: Hit_ID=CAE67231.1; Match level="QueryCoverage =89%, HitCoverage=40%, E-value=2e-70, Identity=75%"; Hit description =Hypothetical protein CBG12670 [Caenorhabditis briggsae]
  Essential gene: C elegans homolog=T10E9.7a; Phenotype=Lva
MASLKGHHSPEFTNFIFACGLDVPTRKNRFEVIYALLSHRFNARIRVRTYTDEVAPIDSITPVFSGAEWYEREIYDMYGVWFNNHPDLRRILTDYGHPQRKDFPLSGYVELRWDHELNRVIYEPTEMTQEFRKFDLNTPWEVFPAFRDESITSGYNVIQKAGKIEAKKLDDASKKP

SEQ ID NO: 119580 - protein, 366 aa, Heterodera glycines
  Coding regions on vcDNA: vcDNA=SeqID_46003; Strand=-; Position=1-1101
  Homolog annotation: Hit_ID=NP_498735.1; Match level="QueryCoverage =92%, HitCoverage=79%, E-value=2e-37, Identity=28%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MHWTDICTTRQGGCPTVLMTAITSIKFNQVEVQNTELYDSGTLYPYKAYLTNELSFPNSAKGHFMASAGYHPSRKHDDATDAGFLARCARFAGGRKARFLSRLDFDLGNQELYLLNNMDVLFTIYRAKDAFLLQSLAPAAAAAAAGQHYALYLHDIKLYVKMVEVQPSLNLSIYKTLEKQPATYAVRKTEVKSVFLTAGRTEMDHNIFSAAIPRRLTIALVANGAFNGQLALSPFNFKPYAIREISVHAAGHVYPAVPHRMDFSGCAYIRPFVDMYEALGMANSERSMDITLEQFHDGWTIFVVPMTSTLDDSCGFELLRSGTTSIRLAFNEAIPAGGVEMVVLGEFDQLIMIDYNRHIVSDSKIA

SEQ ID NO: 119581 - protein, 326 aa, Heterodera glycines
  Coding regions on vcDNA: vcDNA=SeqID_46004; Strand=+; Position=1 -222,285-413,475-631,734-847,906-993,1049-1187
  Homolog annotation: Hit_ID=XP_392346.1; Match level="QueryCoverage =98%, HitCoverage=25%, E-value=6e-51, Identity=40%"; Hit description =similar to Probable DNA mismatch repair protein MSH6 [Apis mellifera]
  Essential gene: C elegans homolog=Y47G6A.11; Phenotype=Mut
CLLPRRGVDSEYDGTCREIEHCKEQLEAYLGWASKKLKCTPKFVGTGRNSHQLEIPESACHNLTDDFQFTSQRKGYKRYTTNNLQKLVDKLNGYKRYTTNNLQKLVDKLNDAETNCATISAEVTRRVFADLDVRSDKWASIVHQIATFDCDKWASIVHQIATFDCLMALSLYAQSSQMCFPEFVSNLTWFNNTLIVYSTIVLGCGSNTAHTMLLTGPNMGGKSTFMRQVATLVALAHIGSMVPADSMRLGSMVPADSMRLTPVDRIFCRIGASDRLSAGQSTQSTFFVELSETNTILSQATRHSLVLIDELGRRTSSFDTEARIVK

SEQ ID NO: 119582 - protein, 170 aa, Heterodera glycines
  Coding regions on vcDNA: vcDNA=SeqID_46005; Strand=+; Position=1 -177,443-544,599-707,1168-1268
  Homolog annotation: Hit_ID=NP_508932.1; Match level="QueryCoverage =100%, HitCoverage=37%, E-value=4e-41, Identity=52%"; Hit description= glycosyltransferase (50.3 kD) (XG113) [Caenorhabditis elegans] gb|AAA80383.2| Hypothetical protein T23F2
  Essential gene: C elegans homolog=T23F2.1; Phenotype =Dpy,Gro,Prz,Pvl,Unc
PTDERKFELYRQCDSVIYTPPNEHFGIVPIEALEQRRPVIVNNSGGPAETVLEDITGTRIADTCGVLLANAMASHMGRKEWPQLDKDELYAKQRIRFDEKRIRFDEKFSWKGFGRRVDEAIAELFSVDHPPTEEMAREVPATIGSKSSAFSAVLTNGHRNTALHRRHSEA

SEQ ID NO: 119583 - protein, 144 aa, Heterodera glycines
  Coding regions on vcDNA: vcDNA=SeqID_46006; Strand=-; Position=1 -151,195-344,410-509,554-587
  Homolog annotation: Hit_ID=XP_215553.2; Match level="QueryCoverage =79%, HitCoverage=19%, E-value=9e-12, Identity=38%"; Hit description =similar to Hypothetical protein KIAA1223 [Rattus norvegicus]
  Essential gene: C elegans homolog=F35D6.1a; Phenotype=Stp
MRFALLGAAIGARLEVCRLLVDEWAADVNQEAIDGTTPLLDASGEGHVDVVNFLIERGANLDHTDMDGYNALMCAVKKRRTEMARHLVAIGTSTDQIGTDGKRARDLAEESENAEMRDIFRAVAAEQQRENIDGQQNEQQQRRM

SEQ ID NO: 119584 - protein, 222 aa, Heterodera glycines
  Coding regions on vcDNA: vcDNA=SeqID_46007; Strand=-; Position=1 -45,252-618,1055-1201,1269-1378
  Homolog annotation: Hit_ID=XP_392810.1; Match level="QueryCoverage =75%, HitCoverage=23%, E-value=6e-10, Identity=26%"; Hit description =similar to ENSANGP00000005617 [Apis mellifera]
  Essential gene: C elegans homolog=F35D6.1a; Phenotype=Stp
MCSYENGLAHHPCWYGNVFGSSVAAADEEDNFEERTRQFFAFVNQGNIGQLRALVDSLDADELSILLEMNQPDVQHARPALVNAILNRHTETAVFLVKFPPTFRRQQFDFPPFFFIQLEKGADPHQTMIGQLNGLNMNVTPLWAAVVFVNLELCRALIAHGANIEMGTDSGHSPLLCACFNGNLEIATFLVENGANANLADTDGMTPLIVTSFSGQVEELDG

SEQ ID NO: 119585 - protein, 135 aa, Heterodera glycines
  Coding regions on vcDNA: vcDNA=SeqID_46008; Strand=-; Position=1 -133,192-285,342-524
  Homolog annotation: Hit_ID=CAE67815.1; Match level="QueryCoverage =88%, HitCoverage=23%, E-value=1e-12, Identity=29%"; Hit description =Hypothetical protein CBG13395 [Caenorhabditis briggsae]
  Essential gene: C elegans homolog=M176.2; Phenotype=Emb,Lva
LIRNYAAEAVKSEEELAELVEAAVDLAHEFGLIKRLSDDESRQRRTTDLASIQPFSLFPSPFPRSLFHRAIAVHKGMQKLFFRVSCDYEFLAKATEQLAKTNKTYERMVGLMDQVRREGHQQPYTLLLTRAVSCF

SEQ ID NO: 119586 - protein, 285 aa, Heterodera glycines
  misc_feature (103)..(103): Xaa can be any naturally occurring amino acid
  misc_feature (275)..(275): Xaa can be any naturally occurring amino acid
  Coding regions on vcDNA: vcDNA=SeqID_46009; Strand=-; Position=1 -784,1905-1995
  Homolog annotation: Hit_ID=NP_510671.1; Match level="QueryCoverage =98%, HitCoverage=29%, E-value=4e-52, Identity=37%"; Hit description =predicted CDS, endonuclease/exonuclease/phosphatase family and RNA -directed DNA polymerase (XR69) [Caenor
  Essential gene: C elegans homolog=ZK250.3; Phenotype=Clr,Lvl,Sck
LLMWIKGFLSNRTFRVKIGDSLSSSKVTSGVPQGSVLGPLLFLIYINDLPDALPSGVKIKLYADDVKLYISDTEIMHKALHNLFEWANKWQIKVSIQKTFVLXLGSNNPKETYKFDGNTINAVDTTRDLGVIIDNKLQFSDHINQITRNAYLRMRSLFRIIKSKSSKIWITLYKTYIRPLLEYAPEVWNPSLQKNIKKIEKCQKYFTKRVFFKCSLPPIPYQNRLEYLQLPTLENRRKLFDLFMAHKIVYGRTDLHEMSKRVKTHEMSKIFQNLXKQNESNLGFL

SEQ ID NO: 119587 - protein, 99 aa, Heterodera glycines
  Coding regions on vcDNA: vcDNA=SeqID_46010; Strand=+; Position=1 -176,482-606
  Homolog annotation: Hit_ID=NP_491206.1; Match level="QueryCoverage =56%, HitCoverage=4%, E-value=9e-12, Identity=57%"; Hit description =abnormal cell LINeage LIN-59, similar to mouse chromatin remodeling factor and Drosophila absent/ small/ h
  Essential gene: C elegans homolog=T12F5.4; Phenotype=Stp,Unc
PKSPRYLEDDVFVCEYQIDRNQRSFEKIPPKNRYYINTEPFVFNFFEKKLTMKRDFTVAEFGVRLLKDQCPKNCGWHWHQQKHCLTIITDQQQQWPLID

SEQ ID NO: 119588 - protein, 953 aa, Heterodera glycines
  misc_feature (543)..(543): Xaa can be any naturally occurring amino acid
  misc_feature (945)..(945): Xaa can be any naturally occurring amino acid
  Coding regions on vcDNA: vcDNA=SeqID_46011; Strand=+; Position=1 -263,402-1036,1121-1378,1425-1745,1795-1821,1883-2086,2141-2398,2448 -2606,2706-2903,2951-3051,3101-3200,3924-3960
  Homolog annotation: Hit_ID=NP_492132.1; Match level="QueryCoverage =91%, HitCoverage=47%, E-value=1e-152, Identity=37%"; Hit description= RNA-directed RNA polymerase related, regulates germline development and RNA interference, Enhancer of Gl
  Essential gene: C elegans homolog=F26A3.3; Phenotype=Emb
RGYVVMDHWIASKECDDFFNNLVLCNFKENREETLEALEMLADKLLDRAEIKHHYGLGGMFREILAEVSRNGNYVQPLREGFERVKKVVITPSRIIPCGHEILMGNRALRFDRDNFPLLRVIFRDENWERVRKNQVNGWLLEKFVLERLVCGISFAGQVYSFVGTSNSQMRDGGCYFLQISLDCYRNLCLYRLLIMEGVDEFRNRLGQFSLVPTIPKMMSRLGLCFTQGRETAVDMRLRMLVWDFTGMGCKNDEEEPYNFSDGCGCLSMSAARKISFLIGLDEHAPSCFQFFRYAGYKGVLAVNPVLDQNKQFFDTCVVDLRQSEAEFMAVDFLFRPSQKKFEVWQEYEDECRLDVVKCSAPTTVVLNKPFINILDQVSEMQSVRCHKRICSRIHSLVSEMQSVRCHKRICSRIHSLLDRHIFAVCASLTDEVFARRRLQELPRLIDYGAMNSVQFTREPFFRLVLRAAAKVAIHRVCQKLAITIPPELGRMMFGVIDETGILQYGQVFVQYSYGQVFVQYSPTKKPTKKRILTGRERFCPNXITSFGEGPILITKNPSVVGGDVRMFEAVDVMALRHLVDVLVFPRYGPRPHSDEMAGSDLDGDEYTVIWDDEMAGSDLDGDEYTVIWDEELLLDSTQPAADYSALKGSQAVTEDMTPFEYQSQMASFLVNYLNNDSVGQISNSHLANSDLYGINSDVCSTIAKKHSQAVDFPVCSTIAKKHSQAVDFPKTGVAPTQLTIQWEAADIPPEKYERTPDFMGKMSNEPHYVSNPHYVSNRLNAQLYRRIKTLSDFLSYAISDESVKLPHMDELLSSDEHSEFIELAAVHYQKYAYSIRSLMDSYGIQCEGELFSSSYSSLCNSLMDSYGIQCEGELFSSSYSSLCNRISDRENEDMSFFTTSRVIEQRLWSFFTTSRVIEQRLWDIRQAARKTFFASYGGDMEVIXLPEIFEKG

SEQ ID NO: 119589 - protein, 279 aa, Heterodera glycines
  misc_feature (261)..(261): Xaa can be any naturally occurring amino acid
  Coding regions on vcDNA: vcDNA=SeqID_46012; Strand=-; Position=1 -34,1588-2238,2323-2412,3314-3377
  Homolog annotation: Hit_ID=EAK90389.1; Match level="QueryCoverage =96%, HitCoverage=41%, E-value=3e-62, Identity=40%"; Hit description =cryptopsoridial mucin, large thr stretch, signal peptide sequence, transcripts identified by EST [Cryptosp
  Essential gene: C elegans homolog=ZK945.9; Phenotype=Gro
RISINFPFHIGNSIKQFQLKMNCQIWFGQLMCIMLLMVSTDYVVSQDDSSTSSSSSTSTSTSTSTSTSTSTTTPSTTSTSTSTSTATTPTSTSTSTSTTPTSTSSTSTSTSTTPTSTSTSTSTTPTSSSTSTSTSTSSSTSTSTSTSTTTPTSTSTSTSTTPTSASTSTSTSTTPTSTSTSTSTSTSTSTSTTPTSTSSSTSTSTSTTTPTTTSTSSTTTNPSSSSCTTCNMCPSTTSSTSTTTSTSTSTSSTTTKASVTXNSEKNPPCLTFGPDQKSL

SEQ ID NO: 119590 - protein, 243 aa, Heterodera glycines
  Coding regions on vcDNA: vcDNA=SeqID_46013; Strand=-; Position=1-728
  Homolog annotation: Hit_ID=EAL35153.1; Match level="QueryCoverage =97%, HitCoverage=26%, E-value=7e-60, Identity=46%"; Hit description =hypothetical protein Chro.30098 [Cryptosporidium hominis]
  Essential gene: C elegans homolog=ZK945.9; Phenotype=Gro
FKYLFCKTVLVLLLSLGTTLVSSHWFSSHSSEEETTSTSSTSSSSTSTTSTTTSSTSTPTGTTSTSTSTSSTTTSTSTSTTPTTSSSSSTSTTPTTSSSSSTSTSTTLTPTTSSSTTSSTSTATAPTTSSSTTTPTMTSSTSTTPTTSSSTTTPTTTSSTSTSTTPTTSSSSSSTSTTSTTTSTTPTTTTSSTSTSTTPSTTTSSTSTSTTPTTESTTETTLTSTSSSTTTTLPSSSCTDSAA

SEQ ID NO: 119591 - protein, 171 aa, Heterodera glycines
  Coding regions on vcDNA: vcDNA=SeqID_46014; Strand=-; Position=1 -69,379-484,687-763,820-859,1216-1407
  Homolog annotation: Hit_ID=AAP68903.1; Match level="QueryCoverage =94%, HitCoverage=12%, E-value=4e-44, Identity=50%"; Hit description =Tomosyn (vertebrate synaptic protein) homolog protein 1, isoform c [Caenorhabditis elegans]
  Essential gene: C elegans homolog=M01A10.2a; Phenotype=Emb,Lva,Unc
YFLFLGCLVSALQDDTLHLWNFRQRIPEIAHSLRMSKERISTIYLPFQSRWLYVGTEKGNVYFVCLATFELSTYVIQWNKAVDISCRTHPGAIKSLESCRTHPGAIKSLEVSPIDPTKLLIVFYRGQLVLWNIQTREVDRFRLDDQPMTAVSWHFDGKQLMAGHHDGRRYC

SEQ ID NO: 119592 - protein, 235 aa, Heterodera glycines
  Coding regions on vcDNA: vcDNA=SeqID_46015; Strand=-; Position=1 -112,294-400,446-560,635-874,921-1052
  Homolog annotation: Hit_ID=CAE59584.1; Match level="QueryCoverage =71%, HitCoverage=18%, E-value=1e-39, Identity=49%"; Hit description =Hypothetical protein CBG02984 [Caenorhabditis briggsae]
  Essential gene: C elegans homolog=F33A8.1; Phenotype=Emb
MLVLLMQRPTDDSIEVTVTLLKECGAMLLKVTPKGSIAVFERLRAVLNDCDSIHERTQYMIETMFHIRKTKFENYPTMLEELDLIDEDDQIAHLVQLNPEDGRPYDPEINLNVFKYDPDFEKNEADYEEIRKEIIGDADESEGEGADEEEEGDEQQPAESECQTEDILKREHKFAFSDHRHGNFGHDGTGHGGISTQRLFDHPIVIGLPRSGSQTDQKRIEAQIRGNGRLSGIIN

SEQ ID NO: 119593 - protein, 234 aa, Heterodera glycines
  Coding regions on vcDNA: vcDNA=SeqID_46016; Strand=-; Position=1 -164,225-297,474-731,1151-1357
  Homolog annotation: Hit_ID=XP_392346.1; Match level="QueryCoverage =69%, HitCoverage=15%, E-value=1e-23, Identity=36%"; Hit description =similar to Probable DNA mismatch repair protein MSH6 [Apis mellifera]
  Essential gene: C elegans homolog=Y47G6A.11; Phenotype=Mut
MDSSNGHPDSRANLFEADKYNKRKIKDLLIVLDGLEDTRKLMLLFEEINSQGESNAPPLLNECLSANYKEMVEDLGFFKGAFDRENALERGVILPRRGVDSEYDGTCREIEHCKEQLEAYLGWASKKLKCTPKFVGTGRNSHQLEIPESACHNLTDDFQFTSQRKPFVDIQRGFHPSLADLKSASAGSFNYIPNSCVLGCGSNTAHTMLLTGPNMGGKSTFMRQVATLVALAHI

SEQ ID NO: 119594 - protein, 295 aa, Heterodera glycines
  Coding regions on vcDNA: vcDNA=SeqID_46017; Strand=-; Position=1 -52,119-240,284-490,548-635,692-794,846-988
  Homolog annotation: Hit_ID=NP_491163.1; Match level="QueryCoverage =98%, HitCoverage=19%, E-value=1e-52, Identity=43%"; Hit description =MutS Homolog (133.6 kD) (msh-6) [Caenorhabditis elegans] gb|AAK95890.1| Msh (muts homolog) family protein
  Essential gene: C elegans homolog=Y47G6A.11; Phenotype=Mut
ISAEVTRRVFADLDVRSDKWDKWSSIVHQMAFDCLMALSLYAQSSPHKMCFPEFVFEFDTPFVDIQRGPFVDIQRGFHPSLADLKSASAGSFNYIPNSCVLGCGSNTAHTMLLTGPNMGGKSTFMRQVATLVALAHIGSMVPADSMRLTPVDRIFCGSMVPADSMRLTPVDRIFCRIGASDRLSAGQSTFFVELSEQSTFFVELSETNTILSQATRHSLVLIDELGRGTSTDGTAIACAVFKHIMRSITDGTAIACAVFKHIMRSIGCRTLFSTHYHSLCNFVATDPRIALAHKK

SEQ ID NO: 119595 - protein, 392 aa, Heterodera glycines
  Coding regions on vcDNA: vcDNA=SeqID_46018; Strand=-; Position=1 -207,284-439,547-611,666-891,978-1172,1291-1375,1687-1836,1954-2049
  Homolog annotation: Hit_ID=CAE60492.1; Match level="QueryCoverage =71%, HitCoverage=71%, E-value=7e-33, Identity=29%"; Hit description =Hypothetical protein CBG04107 [Caenorhabditis briggsae]
  Essential gene: C elegans homolog=F32B5.6a; Phenotype=Emb
PNEITFNGKSNIARKFYPPAPPQQSLLNKYNYLISRLRRLPNNFTSTAAYYSGQIHANSTPEFVRQFKAIKIAEKQSKAVAAVSGDSKVGQPQHLQRTKQQQQQQEFVTFRYTWPVRITERLIGAGESAILNVSPAFCTAFNGVQFTWLLRICEEEILPADISDQSEGDISMDSSYFASGGDDDELEMVQQQQQQRKVNITLYYKEGPARDVKLSGGNISIRNSEGILFDNMPLRNLEYTKGGGWSPISDEGLGGRQRDEQRKFSEFIHDHVGKQITVRVQMKMPASLFQPLQYLPSIESPQSDKLSALCAVFAHYYFNTVIVREAECFEDFLEALDASRHVQFPALRRECERFICTEVMAEFADLAFVKKMLLLAERFNLSVLKMVHALAN

SEQ ID NO: 119596 - protein, 109 aa, Heterodera glycines
  Coding regions on vcDNA: vcDNA=SeqID_46019; Strand=+; Position=1 -134,192-387
  Homolog annotation: Hit_ID=NP_741416.1; Match level="QueryCoverage =77%, HitCoverage=24%, E-value=2e-26, Identity=67%"; Hit description =methionine adenosyltransferase family member (38.4 kD) (4H42) [Caenorhabditis elegans] gb|AAM97949.1| Tem
  Essential gene: C elegans homolog=T13A10.11a; Phenotype=Gro,Unc
VSYAIAISKPLSITVISYGTSPLTEQELLQIVNDNFDLRPGVIIEELGLKRAIYSRTAANGHFGHADFPWEKAKPLEIRPELMEKLIAYRKSEHIPNGCFKGTHIHAHH

SEQ ID NO: 119597 - protein, 89 aa, Heterodera glycines
  Coding regions on vcDNA: vcDNA=SeqID_46020; Strand=+; Position=1 -142,200-324
  Homolog annotation: Hit_ID=UQWO7A; Match level="QueryCoverage=95%, HitCoverage=54%, E-value=2e-30, Identity=80%"; Hit description =ubiquitin / ribosomal protein S27a - tobacco hornworm emb|CAA37599.1| unnamed protein product [Manduca sexta]
  Essential gene: C elegans homolog=F25B5.4a; Phenotype=Emb
MFQIFVKTLTGKTITLEVEASDTIENVKAKIQDKQGIPPDQQRLIFAGKQLEDARTMVDYNIQNESTLQHCLKLFGGARTGKTAHYSRS

SEQ ID NO: 119598 - protein, 257 aa, Heterodera glycines
  Coding regions on vcDNA: vcDNA=SeqID_46021; Strand=-; Position=1 -204,260-589,756-995
  Homolog annotation: Hit_ID=CAE58778.1; Match level="QueryCoverage =99%, HitCoverage=11%, E-value=2e-98, Identity=69%"; Hit description =Hypothetical protein CBG01975 [Caenorhabditis briggsae]
  Essential gene: C elegans homolog=W07E11.1; Phenotype=Emb,Gro
MEFLEKSQRRRAGDDVQWEGLDPAGKRVIILGGGDTATDCIGTSLRLNAKTVQAFEILPQPAEIRKLENPWPQWPLIFRVDYGHEEAKVRDGKDPRTYAISTKVGRNGAGQAAKPYDLQEFITEEKNGVHVLVGLKTVNIEWEKDENGAWKMVELEGTEKVYDCDLCIMAMGFIGPEKTVIDQLRLDYDPRQNIKTPNEKYNTNCARVFAAGDCRRGQSLVVWAIHEGRQAARQVDHYLMGKTTLAGYGGIVLAPIA

SEQ ID NO: 119599 - protein, 206 aa, Heterodera glycines
  Coding regions on vcDNA: vcDNA=SeqID_46022; Strand=-; Position=1 -161,260-365,415-768
  Homolog annotation: Hit_ID=AAL32216.1; Match level="QueryCoverage =58%, HitCoverage=12%, E-value=6e-43, Identity=66%"; Hit description =Rabphilin protein 1, isoform a [Caenorhabditis elegans] gb|AAK84870.1| rabphilin [Caenorhabditis elegans]
  Essential gene: C elegans homolog=F37A4.7a; Phenotype=Stp
MPMPAPEKGMVGPNKATADERGKLLLAVQYNIQQGSLFVSIRRCAELLGMDSTGFSDPYCKVSLTPLSTKAHRQRTTIKKRTLNPEFNETLQFIVPFKDLPRKTLVIGVYDYDVGRHDDYIGKREGKGRIAKTFPRPPPPFRWNCSVHRRTRRKGPTMATSDGKPRQNIRTLAPIGSGRVSGRRHERKAHRTRSSKCLQQMRTPIR

SEQ ID NO: 119600 - protein, 111 aa, Heterodera glycines
  Coding regions on vcDNA: vcDNA=SeqID_46023; Strand=-; Position=1 -174,221-380
  Homolog annotation: Hit_ID=CAA29994.1; Match level="QueryCoverage =95%, HitCoverage=22%, E-value=3e-56, Identity=99%"; Hit description =EF-1-alpha [Drosophila melanogaster] pir||S01193 translation elongation factor eEF-1 alpha chain (gene F2)
  Essential gene: C elegans homolog=R03G5.1a; Phenotype=Emb,Lva,Unc
MGKEKIHINIVVIGHVDSGKSTTTGHLIYKCGGIDKRTIEKFEKEAQEMGKGSFKYAWVLDKLKAERERGITIDIALWKFETSKYYVTIIDAPGHRDFIKNMITGSVLQYL

SEQ ID NO: 119601 - protein, 336 aa, Heterodera glycines
  Coding regions on vcDNA: vcDNA=SeqID_46024; Strand=-; Position=1 -88,154-249,686-810,1357-1394,1533-1627,2040-2175,2509-2623,2896 -2974,3504-3585,3982-4097
  Homolog annotation: Hit_ID=NP_509832.1; Match level="QueryCoverage =99%, HitCoverage=57%, E-value=7e-87, Identity=46%"; Hit description =astacin and metridin-like ShK toxin family member (XL580) [Caenorhabditis elegans] emb|CAA91996.1| Hypoth
  Essential gene: C elegans homolog=C37H5.9a; Phenotype=Emb
DSQIGRDVEIRLSRTFQVKKAWIRKAGLEGRVEPANNGVFQQDGRVEPANNGVFQQDLLLTEQQANVLITEINQNSSAQFQSPSFHSRRQSLFFEASPTQKWPVGQPILYMFDQSVPESDKGSVRAAVQEIQSKSCLSFQEASRKPAGNHLYYVKINNPQFCGLSYVGRISPANPVYLSFCGNAVGIAIHETMHALGLQHEQLRVDRDLFININWANINPQNYDTFARSELVKYTSYGVRYDYGSIMHYASNIASKSAGLKTMTAKVSNQANDAQMGQRRGLSATDVEELRRMYCMPEGCADANVYCGVWATNNLCQLASTRPWMMQNCRKSCSLC

SEQ ID NO: 119602 - protein, 100 aa, Heterodera glycines
  Coding regions on vcDNA: vcDNA=SeqID_46025; Strand=-; Position=1 -167,231-362
  Homolog annotation: Hit_ID=Q01205; Match level="QueryCoverage=100%, HitCoverage=22%, E-value=2e-44, Identity=89%"; Hit description =Dihydrolipoyllysine-residue succinyltransferase component of 2 -oxoglutarate dehydrogenase complex, mitochondr
  Essential gene: C elegans homolog=W02F12.5; Phenotype=Emb,Lva
RDNKLAIEDMEGGTFTISNGGVFGSLFGTPIINPPQSAILGMHGIFDRPVAVDGKVVEIRPMMYIALTYDHRLIDGREAVTFLRKIKQAVEDPLTILLDL

SEQ ID NO: 119603 - protein, 229 aa, Heterodera glycines
  Coding regions on vcDNA: vcDNA=SeqID_46026; Strand=-; Position=1 -96,144-217,369-546,618-745,792-888,931-1047
  Homolog annotation: Hit_ID=CAE60905.1; Match level="QueryCoverage =82%, HitCoverage=48%, E-value=2e-30, Identity=40%"; Hit description =Hypothetical protein CBG04621 [Caenorhabditis briggsae]
  Essential gene: C elegans homolog=C15H11.6; Phenotype=Emb
MAENFLLEFFNFYDGPNGEQTRQQLLNAYDANATFTYSMCFLADTHPTGNRDRSDHQELIGLYIRSSHNIIQQHKWQSYRDKIIYRGPMDIAVALSKLPPTEHIKQSFLLDFNFTSDNLIVLSLQGIFRDGKEVSDGSTNFLNMKFFTRQFAIVPKTEGIAIISDILQITPISNARMERYNNLLKNATVAQVQQSALVPGGVLASAVQQQIDGMAPPPPSPQTQPVLMI

SEQ ID NO: 119604 - protein, 187 aa, Heterodera glycines
  Coding regions on vcDNA: vcDNA=SeqID_46027; Strand=-; Position=1 -162,218-618
  Homolog annotation: Hit_ID=P53021; Match level="QueryCoverage=64%, HitCoverage=88%, E-value=3e-30, Identity=58%"; Hit description=Major sperm protein 1 gb|AAA29146.1| major sperm protein
  Essential gene: C elegans homolog=C04G2.4; Phenotype=Unclassified
QRSQRSHIKHPQSQPDNSDKNINAQLPPEDIATMHTQKVVFNAPFDNGGTAWVRVINPGTERIGYAFKTTKPRRLGDAVKTTKAQRININPPNGTGRSAQRSSSTWASPATPSTPAPRATVEWTNTPHPDATVFKPEWFQGDGWCAARTCQSSTTSDGRMLRHHNMDMIGSHPTVPKLSFCPPSFKL

SEQ ID NO: 119605 - protein, 168 aa, Heterodera glycines
  Coding regions on vcDNA: vcDNA=SeqID_46028; Strand=+; Position=1 -153,220-282,346-469,560-723
  Homolog annotation: Hit_ID=NP_509939.1; Match level="QueryCoverage =95%, HitCoverage=63%, E-value=3e-40, Identity=52%"; Hit description =Fourteen-Three-Three family member (28.1 kD) (ftt-2) [Caenorhabditis elegans] emb|CAA91474.1| Hypothetica
  Essential gene: C elegans homolog=M117.2; Phenotype=Emb
LIKLDPNLTLEERISLSTAYKGAMASRRTSWRALVSIEERTGASLSDAQQQVLENYREKVQNELVNTCQELLTCINEVLFPKASDVEQKVFYLKMKADYYRYISEVATDEDRSGVVELAKVAYQEAIDMAGDKIPATNPTRLGLALNFAVFNYEILNSVTEARKVIQT

SEQ ID NO: 119606 - protein, 327 aa, Heterodera glycines
  Coding regions on vcDNA: vcDNA=SeqID_46029; Strand=-; Position=1 -111,162-262,461-538,603-753,1020-1336,1790-1957,2240-2297
  Homolog annotation: Hit_ID=CAE74346.1; Match level="QueryCoverage =88%, HitCoverage=28%, E-value=2e-12, Identity=25%"; Hit description =Hypothetical protein CBG22064 [Caenorhabditis briggsae]
  Essential gene: C elegans homolog=Y48G1A.4; Phenotype=Lva
KCSVSGPRHILDKLSEFRADFLHSKSARLASSPSFVQVTFLQLVAKLFPSEARFHPILTPTIAFASELVGNTRICSVDQCARLIFLCAQMCDWFCRRPRFFPEVLAFLLGALQLCCESKNEAKEVPFPSMNFPISLPHRQMLFVAPKESTTTSTTGTFGNLSLGQIFHPNIGDLETENGGILDEEENGGGATSTDEDKCRLRLATVRALFATIGQYARKYGTTTAADESVAAAGDQPTNDGGTMCPAFNACFGPFHRICLHLPVANYPAQLADEAARLTQLLAKLMAQNGRVMQMKRISKRGTTTTTNRIPSVENRYEIPWIRSFSF

SEQ ID NO: 119607 - protein, 420 aa, Heterodera glycines
  Coding regions on vcDNA: vcDNA=SeqID_46030; Strand=+; Position=1 -281,413-573,850-1097,1152-1273,1569-1701,2363-2680
  Homolog annotation: Hit_ID=CAE56191.1; Match level="QueryCoverage =97%, HitCoverage=80%, E-value=7e-71, Identity=37%"; Hit description =Hypothetical protein CBG23814 [Caenorhabditis briggsae]
  Essential gene: C elegans homolog=K09C4.5; Phenotype=Unclassified
MEKSRLLYVVLFHTVFASFGEIEANLLNYLTVPVRQFFADSLLQRYGIVPYSSQFEFVYSMVASIFFIGAIFGGAIMGPCMEHFGRRATAVYLRSFLGALSAICMLLSKWLTIVELFAIGHFIAGIIAAWKIAMIIYLAECAPDHSRGWSTSLIGSGSTLALLFMASLCLPSVFGTAQLWWLLPAFALLLSTFHLCFAAHFPESPKHLFCGDRRNKTGGNCHERAKLSIKFYHGSATDVFKVMNQFEQEQQLLASREHFRWSDFWKIPELRHSLFITLLTSWVFAFSLSNLKSQYLESMLMRYGLTQTGAMISTMAMIAVTAPCCFLSPVLIERWGRRPLFLLVTSFSVAELALITGAQFASDQTASGGSAATAALALIGFTLGQSSANLGILYMTPILVGELIPHAARSATIQVHLMAE

SEQ ID NO: 119608 - protein, 84 aa, Heterodera glycines
  Coding regions on vcDNA: vcDNA=SeqID_46031; Strand=+; Position=1 -141,196-262,796-840
  Homolog annotation: Hit_ID=CAE65556.1; Match level="QueryCoverage =79%, HitCoverage=24%, E-value=4e-19, Identity=53%"; Hit description =Hypothetical protein CBG10545 [Caenorhabditis briggsae]
  Essential gene: C elegans homolog=T21D12.3; Phenotype=Unclassified
MAELRLSDKYLEQRNKMLRNYPLPKDWVEIYDPGMHRHYYWNQMTDEVSWLSPKHPKAVISEAAAKSAKGPGSEDWRGCDGVWA

SEQ ID NO: 119609 - protein, 142 aa, Heterodera glycines
  Coding regions on vcDNA: vcDNA=SeqID_46032; Strand=-; Position=1 -85,174-349,423-590
  Homolog annotation: Hit_ID=AAH46078.1; Match level="QueryCoverage =92%, HitCoverage=91%, E-value=1e-22, Identity=42%"; Hit description =Similar to H2A histone family, member X [Danio rerio] ref|NP _957367.1| similar to H2A histone family, memb
  Essential gene: C elegans homolog=T23D8.6; Phenotype=Emb
MPRHRAKPRSFHAGLKFPVGRVHRKMKKGPYAKRLANGVPVYMTAVLEHITGELLKKIGEITQAEGMKRLSAFHIRTAARDDDELRKLFSGVSLAEVCVLPELESDVEQSSEGSGESDSDEESTEGSASGSQEGGGAAAAQQ

SEQ ID NO: 119610 - protein, 131 aa, Heterodera glycines
  Coding regions on vcDNA: vcDNA=SeqID_46033; Strand=+; Position=1 -225,282-366,831-916
  Homolog annotation: Hit_ID=CAH04312.1; Match level="QueryCoverage =91%, HitCoverage=67%, E-value=2e-40, Identity=55%"; Hit description =S2e ribosomal protein [Meladema coriacea]
  Essential gene: C elegans homolog=C49H3.11; Phenotype=Emb,Lva,Ste
MADRAGFQSGFGGAAPPSARGRGGPRGRGRGAARGRGRGKDAEKEWVPVTKLGRLVKDRKVLTIEEIYLHSLPIKEFEIIDLLLSGLKDEVLKIMPVQKQTRAVRRGYWGNKIGKPHTVPCKVSPSYSVVF

SEQ ID NO: 119611 - protein, 196 aa, Heterodera glycines
  Coding regions on vcDNA: vcDNA=SeqID_46034; Strand=-; Position=1 -171,219-638
  Homolog annotation: Hit_ID=CAE66826.1; Match level="QueryCoverage =74%, HitCoverage=3%, E-value=5e-44, Identity=60%"; Hit description =Hypothetical protein CBG12193 [Caenorhabditis briggsae]
  Essential gene: C elegans homolog=T21E12.4; Phenotype=Emb
MVKWARAQLSYAKMLNKIEPLNNELKRLEKDAEEKTVKGEELKHKIEALENRIQELKDEYAQLIGEAEHIKQDLQVVQEKVNRSIHLLKSLRVECDRWEAGRERFAQQNETLVGDVLLSAAFLSYSGYYDQLLRDTIFKNGWEYVILHKLCSVMSLLALSICQLRTSAYNGTIMECRRTNYARRMPLCSGSSTVSR

SEQ ID NO: 119612 - protein, 286 aa, Heterodera glycines
  misc_feature (279)..(279): Xaa can be any naturally occurring amino acid
  misc_feature (283)..(283): Xaa can be any naturally occurring amino acid
  Coding regions on vcDNA: vcDNA=SeqID_46035; Strand=-; Position=1 -134,207-340,385-531,576-769,1043-1178
  Homolog annotation: Hit_ID=AAF18300.1; Match level="QueryCoverage =96%, HitCoverage=31%, E-value=1e-55, Identity=42%"; Hit description =N-ethylmaleimide sensitive fusion protein [Manduca sexta]
  Essential gene: C elegans homolog=H15N14.2; Phenotype=Emb
LNRLLYGGLCLWGDCVSRVLEEGRLLIKAAAPDTRGFVRALLTGPPNTGKSFLAAQIPPNTGKSFLAAQIAKDSEFPFIKVCTPEEMVGYSEAEKCAKIRKIFEDAYKSPLSCVIIIFEDAYKSPLSCVIIDNVERLMDYSPIGPRYSNMVLQTLLVLLAKRPPQNHRLLMLATTSNHRLLMLATTSNEQFLYEADMLSVFSKVIRVEQLHTVNHVMAVLGEANIFSEEEIRQIEDELRSSDVSIGIKRMLELLDFVKQSEQKHRVQLLLDGIREAGLXKYFXFVN

SEQ ID NO: 119613 - protein, 294 aa, Heterodera glycines
  misc_feature (131)..(131): Xaa can be any naturally occurring amino acid
  Coding regions on vcDNA: vcDNA=SeqID_46036; Strand=+; Position=1 -183,718-794,852-1094,1399-1572,1627-1689,1754-1796,1858-1880
  Homolog annotation: Hit_ID=CAE60449.1; Match level="QueryCoverage =98%, HitCoverage=61%, E-value=2e-53, Identity=46%"; Hit description =Hypothetical protein CBG04057 [Caenorhabditis briggsae]
  Essential gene: C elegans homolog=F33D11.5; Phenotype=Ste
KFHQQMCRIALPHICLYVLLCLYLLAGAWAFARIEHNAERAEQAKKLERIGWWWWATILTDTTGYGPTTPLTPLGQWLSIGYGLLGIPPLTVLAAVDIGRFLSDVVLISYDKFLVFALLTSLTYLFILSQXQRTAKSLLAFCGVRCRTGKVISHVETKALQSLNRLQQTINVPSGKRRLPLSVNAAILLLFCMLGGVVYIAAAGNHNFIEGFFVTFNLVANLTMSEMPTDISRLMTLIYIFVFVTFVEMPTDISRLMTLIYIFVFVTFVLSMCADLAASELKWVFLKVFLKIHY

SEQ ID NO: 119614 - protein, 107 aa, Heterodera glycines
  Coding regions on vcDNA: vcDNA=SeqID_46037; Strand=+; Position=1 -68,117-261,379-488
  Homolog annotation: Hit_ID=CAB58171.1; Match level="QueryCoverage =100%, HitCoverage=66%, E-value=1e-42, Identity=80%"; Hit description= troponin-like protein [Anisakis simplex]
  Essential gene: C elegans homolog=F54C1.7; Phenotype=Emb,Lvl
MATQLASILDAMEQDYDEKTLRKLIRKFDADGSGKLEFDEFCALVFTVGNSVDKETLRNELKEAFRLFDKEGNGYISTQTLKELLHEIAPDLSDNELDAAVDEIDED

SEQ ID NO: 119615 - protein, 141 aa, Heterodera glycines
  Coding regions on vcDNA: vcDNA=SeqID_46038; Strand=+; Position=1 -98,147-291,434-616
  Homolog annotation: Hit_ID=CAB58171.1; Match level="QueryCoverage =88%, HitCoverage=77%, E-value=3e-52, Identity=80%"; Hit description =troponin-like protein [Anisakis simplex]
  Essential gene: C elegans homolog=F54C1.7; Phenotype=Emb,Lvl
MFDRSRNGYIMATQLASILDAMEQDYDEKTLRKLIRKFDADGSGKLEFDEFCALVFTVGNSVDKETLRNELKEAFRLFDKEGNGYISTQTLKELLHEIAPDLSDNELDAAVDEIDEDGSGKIEFEGKAKSNKYNYLIKTQL

SEQ ID NO: 119616 - protein, 124 aa, Heterodera glycines
  Coding regions on vcDNA: vcDNA=SeqID_46039; Strand=+; Position=1 -27,510-595,706-839,944-1031,1382-1403
  Homolog annotation: Hit_ID=NP_492449.2; Match level="QueryCoverage =100%, HitCoverage=29%, E-value=1e-27, Identity=52%"; Hit description= speckle-type POZ protein Spop, postmeiotic negative regulator of meiotic-specific spindle component MEI-
  Essential gene: C elegans homolog=ZK858.4; Phenotype=Bmd,Emb
AFAAEGRAVRVHKAILAARSPVFAAMLQHVDTSESKTGVLGVLEIKDVEYGVVKEMLNFIYCGKSSSAELNEIASDLLIAADKYRLEELEELKTHCEHCLIQAINFDNACQLLIIADLGFRPKL

SEQ ID NO: 119617 - protein, 117 aa, Heterodera glycines
  Coding regions on vcDNA: vcDNA=SeqID_46040; Strand=-; Position=1 -7,155-501
  Homolog annotation: Hit_ID=NP_572750.2; Match level="QueryCoverage =98%, HitCoverage=17%, E-value=9e-12, Identity=36%"; Hit description =CG32662-PA [Drosophila melanogaster] gb|AAF48098.2| CG32662-PA [Drosophila melanogaster]
  Essential gene: C elegans homolog=T05A10.3; Phenotype=Ste
MPEKHHRSIAHNYFKNSYKENKLKQTRKIMEKEEAAELAREKKREEEERRKKKWEEAERALREEEKREEEHRRKLVEERKHREKAMQREWEQRETEQMKKHREKTYKIGGKKKKDKK

SEQ ID NO: 119618 - protein, 60 aa, Heterodera glycines
  Coding regions on vcDNA: vcDNA=SeqID_46041; Strand=-; Position=1 -55,820-946
  Homolog annotation: Hit_ID=CAE63663.1; Match level="QueryCoverage =96%, HitCoverage=8%, E-value=3e-11, Identity=50%"; Hit description =Hypothetical protein CBG08165 [Caenorhabditis briggsae]
  Essential gene: C elegans homolog=ZK1193.5a; Phenotype=Lva
MLTMVCLVAKNGMTNEEKGLIQINNWKPINFETITDNPEELVSNLFREISTHITLKILAK

SEQ ID NO: 119619 - protein, 231 aa, Heterodera glycines
  misc_feature (9)..(9): Xaa can be any naturally occurring amino acid
  Coding regions on vcDNA: vcDNA=SeqID_46042; Strand=-; Position=1 -35,270-401,453-558,717-781,856-939,1264-1484
  Homolog annotation: Hit_ID=NP_495838.1; Match level="QueryCoverage =90%, HitCoverage=33%, E-value=1e-68, Identity=48%"; Hit description =carbamoylphosphate synthetase 2/aspartate transcarbamylase/dihydroorotase; rudimentary homolog, PYRimidin
  Essential gene: C elegans homolog=D2085.1; Phenotype =Emb,Gro,Lvl,Mlt,Unc
QVGETYFKXAVAIKALKEMGLRTVLVNPNVATVQTTKGFADRVYFLPIIKEYVTEVIKKERVIKKERPTGILCTFGGQTALNCAVDLHNSGVLSEYGVTVLGTSIETIMRTEDRELFKEFVLKIGEKVADEFVLKIGEKVADCRAANTIEEAEKAAEQIGYPVLVRAAYALGGLGSGFAETRDELMAIARQALAHSKQVLIDKSFQGWKEERRRLNDYIFLSRTANNFPNL

SEQ ID NO: 119620 - protein, 86 aa, Heterodera glycines
  Coding regions on vcDNA: vcDNA=SeqID_46043; Strand=+; Position=1 -78,446-628
  Homolog annotation: Hit_ID=CAE57188.1; Match level="QueryCoverage =65%, HitCoverage=8%, E-value=2e-12, Identity=60%"; Hit description =Hypothetical protein CBG00032 [Caenorhabditis briggsae]
  Essential gene: C elegans homolog=ZK686.2; Phenotype=Lva
MTIFGNYFWRFLPTKLVHHGIIRKLLVRVLIACDVLSRGIDVLDVDCVINYDLPINERIFVHRAGRTARAMKEGLLVSLTTKEEVC

SEQ ID NO: 119621 - protein, 129 aa, Heterodera glycines
  Coding regions on vcDNA: vcDNA=SeqID_46044; Strand=-; Position=1 -127,542-803
  Homolog annotation: Hit_ID=AAC50293.1; Match level="QueryCoverage =98%, HitCoverage=7%, E-value=4e-23, Identity=44%"; Hit description =cleavage and polyadenylation specificity factor
  Essential gene: C elegans homolog=Y76B12C.7; Phenotype=Emb,Lva
MALTTISLHSIEDEFLRDGYTDENIHQPELRADPEHRCCAFTVYGRHLAVVPFNIVELVRQQPSAVSSREEAKLYNQQQQQQQMLLQSYTIKMRLLDERLDNVLDMCFLHGYYEPTLLFLYEPIQTTAG

SEQ ID NO: 119622 - protein, 233 aa, Heterodera glycines
  Coding regions on vcDNA: vcDNA=SeqID_46045; Strand=+; Position=1 -139,840-1019,1071-1233,1358-1422,2409-2560
  Homolog annotation: Hit_ID=CAE70687.1; Match level="QueryCoverage =82%, HitCoverage=71%, E-value=2e-29, Identity=31%"; Hit description =Hypothetical protein CBG17404 [Caenorhabditis briggsae]
  Essential gene: C elegans homolog=C34F6.1; Phenotype=Him
MGRGSSARRTIGAMSERTRRPPFAAAEVGKARKHEKTMVVHLCSHSPDGDPCEQPLAEGIGQFKLTRFHFDASSRRCRAFVYRGLRGNANNFLLAEDCELVCQAEPTMPSFRVNPCPRGIPLTDDQNEPLVCGNSLAAPDLAQFGPLTAAHQNQLETGCPSGFWCHVGSSPDTTNCCPQLADVNFCPHGEPKWERKAWGHGQKKPQKCGPNNECPEGFVCHLNSDIGMALCCE

SEQ ID NO: 119623 - protein, 359 aa, Heterodera glycines
  misc_feature (6)..(6): Xaa can be any naturally occurring amino acid
  misc_feature (358)..(358): Xaa can be any naturally occurring amino acid
  Coding regions on vcDNA: vcDNA=SeqID_46046; Strand=+; Position=1 -71,142-178,242-316,367-429,619-768,834-1009,1073-1222,1267-1464
  Homolog annotation: Hit_ID=NP_509868.1; Match level="QueryCoverage =99%, HitCoverage=82%, E-value=2e-77, Identity=32%"; Hit description =papilin (115.5 kD) (XL812) [Caenorhabditis elegans] emb|CAB03944.1| Hypothetical protein C34F6.1 [Caenorh
  Essential gene: C elegans homolog=C34F6.1; Phenotype=Him
SDYCFXGFWCHGSSPDTTNCCGGKRPCDLPLGGKRPCDLPLEYGTGEQKLDRWYFDVDSQTGEQKLDRWYFDVDSQMCRHFRYSGIKGNANNFVSRDHCIKGNANNFVSRDHCQQKCPSANPCLFGDLLRDEDGNVLKCEQNEDKGCPEDTHFCHVGHRLTQSGCCPRTRSDPCLLPVSRGIGTVAHIRWHFNANTKHCEAFDYAGQKGNENNFMTKRQCEEQCDQQKNFCPHGEPKWERKAWGHGRKKPQKCGPNNECPEGFVCHLNSDIGMALCCENPAHFCLQSRERGPCNPAHFCLQSRERGPCGARELRYGYNPLTDTCVQFHYGGCGGTLNNFESIDRCREICCRQYQRRNXK

SEQ ID NO: 119624 - protein, 401 aa, Heterodera glycines
  Coding regions on vcDNA: vcDNA=SeqID_46047; Strand=-; Position=1 -217,270-468,537-722,765-890,958-1146,1200-1288
  Homolog annotation: Hit_ID=NP_492821.1; Match level="QueryCoverage =99%, HitCoverage=32%, E-value=1e-128, Identity=61%"; Hit description= of Ty 16 (116.9 kD) (1L369) [Caenorhabditis elegans] gb|AAF39835.1| Hypothetical protein F55A3.3 [Caenor
  Essential gene: C elegans homolog=F55A3.3; Phenotype=Emb
LPISTDKRHDTVIVPIFGIPTPFHISMIKNISQPTNEGDFTYLRINFTHPGSQIGKESAQFPNAFAKYLKELTFKSRTFKSRNVRPGERETPSVNLQTAARLIKEMQKRFRTQEAEEREKEGAVKQDKLIISTNGKGNPKLKDLYVRPNIIAKRISGDLYVRPNIIAKRISGTLEAHVNGFRYTSLRGDKIEVMYNNIKHAFFQPCDNEMIILLHFHLKNPVLWGKKKYSDVQFFTEVNPVLWGKKKYSDVQFFTEVGEITTDLGKYHHMQDRDDIQSEQMEREMRKKLNMAFQNMEREMRKKLNMAFQNFCDKVFRMTNEQVDFDTPFNDLSFIGAPHRSTVSLKPTSSCLVHLTEWPPFVVTLDEVELVHPPFVVTLDEVELVHFERVSSNTSTFDTVI

SEQ ID NO: 119625 - protein, 232 aa, Heterodera glycines
  Coding regions on vcDNA: vcDNA=SeqID_46048; Strand=+; Position=1 -292,549-778,841-1017
  Homolog annotation: Hit_ID=XP_475481.1; Match level="QueryCoverage =69%, HitCoverage=13%, E-value=2e-48, Identity=54%"; Hit description =putative SMC protein [Oryza sativa (japonica cultivar-group)] gb|AAT07581.1| putative SMC protein [Oryza
  Essential gene: C elegans homolog=F35G12.8; Phenotype=Emb
MEIDEEDDDEEGERETNNQLDNGQRATKSTAKVVANPDNLNKLFMPLPKLNEQLLRDEVDVDQLEHQLTELEKRKRKQSVANLTLVLDFFAKVDGLTQLVDSLDPFAEGIAFNVRPPKKSWKQITNLSGGEKTLASLSLVFGLHKYKPTPLYVMDEIDAALDFRNVSIIANYLLERTRNAQFIVISLRNQMYEKANRLIGIYKVRDCTKNVVVNPSAMSKAFEQDKKRNSNP

SEQ ID NO: 119626 - protein, 315 aa, Heterodera glycines
  Coding regions on vcDNA: vcDNA=SeqID_46049; Strand=+; Position=1-947
  Homolog annotation: Hit_ID=AAK61477.1; Match level="QueryCoverage =87%, HitCoverage=93%, E-value=3e-22, Identity=34%"; Hit description =glycoprotein gp2 [Equine herpesvirus 1]
  Essential gene: C elegans homolog=ZK945.9; Phenotype=Gro
VTHFPFSSFLSVVITTQFQFVNSFFTHRRDDFFKIGDPFHPLFSSAFSFPPPPIQRTRRATSNTASTTATAGRRRSRSRRRTRAEQVREATRRALRQNNGGNATRTRKKRGAAMRRPPKLKPLRGRPRGSRKSRAAPRTAGQKRGRGRPRTVKKGRARRGRSAAQRQTTTTADAATNTDAHWVTIAELRAATNTEVTAATTPATMTTTADGAVATNTDATGATTATTDAATAATTPAATTTADGATVTNANEPGATTATNTEAPAATTPATTTNADGATVTNANEPGATTTAAATNTETTAATAPATTTATADGT

SEQ ID NO: 119627 - protein, 166 aa, Heterodera glycines
  Coding regions on vcDNA: vcDNA=SeqID_46050; Strand=-; Position=1 -80,125-226,352-466,646-740,992-1055
  Homolog annotation: Hit_ID=AAC26138.1; Match level="QueryCoverage =100%, HitCoverage=96%, E-value=9e-83, Identity=90%"; Hit description= cleavage stimulation factor [Heterodera glycines]
  Essential gene: C elegans homolog=F28C6.3; Phenotype=Emb,Lva
SGSNDFTLKMFDYSKTAVKRAMKTITEVEPITAVSFHPSGEEVEPITAVSFHPSGEFFLCATRHPTLRLYSAETQQCFVSTIPKDQHSDSITDVCYSENARMFVTGSRDGNVKVWDGVSNRCIETFTRAHDGAPICSAQFTRNGKYVLTVGMAVCPNYGNCPPIAV

SEQ ID NO: 119628 - protein, 127 aa, Heterodera glycines
  Coding regions on vcDNA: vcDNA=SeqID_46051; Strand=+; Position=1 -93,434-646,1058-1135
  Homolog annotation: Hit_ID=CAG01324.1; Match level="QueryCoverage =91%, HitCoverage=46%, E-value=9e-25, Identity=47%"; Hit description =unnamed protein product [Tetraodon nigroviridis]
  Essential gene: C elegans homolog=Y41E3.10; Phenotype=Unclassified
MLLSWPKKAGQPPQKVVSKDSAPPAKKADAEEDFDLFGDEDSDDEEKKRITEERLKAYAEKKAKKPGPVAKSNVIYDVKPWDDTIDIKDIEANVRSIECEGLIGCCVVDEKVSTDWLEEQITGKHYN

SEQ ID NO: 119629 - protein, 166 aa, Heterodera glycines
  misc_feature (155)..(155): Xaa can be any naturally occurring amino acid
  Coding regions on vcDNA: vcDNA=SeqID_46052; Strand=+; Position=1 -232,323-575
  Homolog annotation: Hit_ID=P79432; Match level="QueryCoverage=89%, HitCoverage=46%, E-value=4e-28, Identity=43%"; Hit description=Cell division protein kinase 4 (Cyclin-dependent kinase 4) gb|AAB39636.1| cyclin-dependent kinase 4 [Sus scrof
  Essential gene: C elegans homolog=F18H3.5a; Phenotype=Lvl,Pvl,Unc
LCFQIADFGLSRNYGLHATFTTEVVTLWYRSPELLLQCKYGTAVDLWSAGCILAELYTRDALFRGDTEAEQLRIIFEKLGTPKLGTPSVSVWPADAIVPHSFYAENSPHITPPFANQMPQYLPASGVELLTAILQFNPHERPTAVECLQHKYFVXSLIAGNVHFRF

SEQ ID NO: 119630 - protein, 180 aa, Heterodera glycines
  Coding regions on vcDNA: vcDNA=SeqID_46053; Strand=-; Position=1 -136,229-423,470-532,926-1071
  Homolog annotation: Hit_ID=CAE59301.1; Match level="QueryCoverage =97%, HitCoverage=58%, E-value=2e-12, Identity=27%"; Hit description =Hypothetical protein CBG02636 [Caenorhabditis briggsae]
  Essential gene: C elegans homolog=C32D5.12; Phenotype=Dpy,Lvl,Unc
MGVKVAITGGSGFLAAHLIKRLRADANVDEIRTIDRKPFRQLGTIDDCPPSSVGFPSLIHFQCDLLDIAKLEKALDGVDVLFHLARKAFEYIFFADQKALNDRYSRDNLEATHSLLNTIFKCSVPRLVHVGGQPFHALFLRPTFVYGEGEKRLPMALKKVAERHGQINEIAGPSNGMLQY

SEQ ID NO: 119631 - protein, 389 aa, Heterodera glycines
  Coding regions on vcDNA: vcDNA=SeqID_46054; Strand=-; Position=1 -76,135-159,218-289,340-383,441-551,631-734,792-933,980-1050,1095 -1155,1315-1406,1463-1517
  Homolog annotation: Hit_ID=AAK66762.1; Match level="QueryCoverage =94%, HitCoverage=41%, E-value=1e-142, Identity=73%"; Hit description= proprotein convertase 2 [Heterodera glycines]
  Essential gene: C elegans homolog=K04F10.4a; Phenotype=Emb,Lvl
QVSHARRRSVGHNAKLSQDKDIIAYVEQMTGYKRLKRGYRPLADYKRLKRGYRPLADRLQKQLDFTSVQSPTDPLYPFQWQSPTDPLYPFQWYLKNDGQSNGKPRLDLNVEKAKNDGQSNGKPRLDLNVEKAWALGYTGKNITTAIMDDGVDYMHADLRFNFNAEASYDFSSNDPYPYPRYTDDWFNFNSHGTRCAGEISAARDNGICGVGVAYDSKVAGIRMLDQPYMTDLIEANSMGHEPNKIHIYSASWGPANSMGHEPNKIHIYSASWGPTDDGKTVDGPRNATMRAIVKGVNETDDGKTVDGPRNATMRAIVKGVNEGRFGLGSIFVWASGDGGEDDDCNCDGYAASMWAISIFSAFHLGENAHYFWAISIFSAFHLGENAHYF

SEQ ID NO: 119632 - protein, 92 aa, Heterodera glycines
  Coding regions on vcDNA: vcDNA=SeqID_46055; Strand=+; Position=1 -150,974-1102
  Homolog annotation: Hit_ID=NP_493627.1; Match level="QueryCoverage =94%, HitCoverage=62%, E-value=1e-09, Identity=32%"; Hit description =psf2 like (1P647) [Caenorhabditis elegans] emb|CAB07195.1| Hypothetical protein F31C3.5 [Caenorhabditis e
  Essential gene: C elegans homolog=F31C3.5; Phenotype=Emb,Lva,Pvl
PPDWLSVDELKRMIVAEAEQRAFAPIPECFFELSNLLMLNAREDVEQYEQYEIGHAQLDNLTRMEICCARATLIEGSKQLDRLTATLHSVRD

SEQ ID NO: 119633 - protein, 332 aa, Heterodera glycines
  Coding regions on vcDNA: vcDNA=SeqID_46056; Strand=+; Position=1 -104,769-856,943-1030,1074-1231,1281-1409,1768-1869,1922-2011,2091 -2330
  Homolog annotation: Hit_ID=CAE59546.1; Match level="QueryCoverage =96%, HitCoverage=91%, E-value=3e-43, Identity=33%"; Hit description =Hypothetical protein CBG02942 [Caenorhabditis briggsae]
  Essential gene: C elegans homolog=T06D8.8; Phenotype=Bmd,Gro,Unc
MTSQGVENYLKDQTISDIPTIAEGFQNLMNLYINKLWNQLSAEASQLVRNKLFVSTVNLFQFYEEFVRDFERRIEPLQLIELITPIAEDIFERDRQSAYTFLDNFDKVIKQDKRAIVRLEASKIQLRLRDKPTAEAKCCNDPALVRKMLEEAKTMVDQLVEVGSVHAAYYGCSAEYQFQMGDHDRYYEELAHPILNDLSDTPNAWLNELLHAVNAGDWDGFLKHKEKLVAAYSEAGQKIEALERKLRLQCLIELAHRLPAQRRDLNFGDIARVVRADEDAVELLVMKAVANKLIDAKIDDPSRVVNVSWVQPRVLSIEQVKNDAGNEVKGVE

SEQ ID NO: 119634 - protein, 398 aa, Heterodera glycines
  Coding regions on vcDNA: vcDNA=SeqID_46057; Strand=+; Position=1 -216,690-856,916-1078,1123-1283,1665-1788,1838-1963,2404-2457,2504 -2632,3167-3225
  Homolog annotation: Hit_ID=CAE69974.1; Match level="QueryCoverage =95%, HitCoverage=87%, E-value=1e-149, Identity=47%"; Hit description= Hypothetical protein CBG16372 [Caenorhabditis briggsae]
  Essential gene: C elegans homolog=F01G12.5a; Phenotype=Lva,Unc
QPGLPGTKGELGMPGFPGTKGEPGVPGRDGFPGMDGEKGDAGYPGQPGQYGPQGLPGPKGNAGLPGIPGLSGQSLGGVKGEPGLPGLPGRDGVPGPSGEKGDSGVPGVPGFDGEKGSVGAPGFPGQKGESGLPGIPGQRGQDGMPGSPGFPGPVGEPGPLGEPCLAGGPGMPGQPGFPGTKGELGMPGFPGEKGEPGFAGQPGVPGLPGAKGDAGLPGHPGPQGHPGQDGPQGPAGMAGPEPLTQHGQKGLPGAPGVPGLRGEKGQPGLDGPPGPSGIPGYRGEKGESGYPGQPGFPGEKGAAGLPGFPGTEGQSGPPGPSGLPGGPGPAGPALRDGFVVVTHSQTTQVPNCPQGTEKLWDGFSLLYIEGNERAHNQDLVMLHAMTNRIGYPPAKQLS

SEQ ID NO: 119635 - protein, 56 aa, Heterodera glycines
  Coding regions on vcDNA: vcDNA=SeqID_46058; Strand=+; Position=1 -117,164-214
  Homolog annotation: Hit_ID=NP_612041.2; Match level="QueryCoverage =91%, HitCoverage=3%, E-value=3e-10, Identity=50%"; Hit description =CG12031-PA, isoform A [Drosophila melanogaster] gb|AAF47395.4| CG12031-PA, isoform A [Drosophila melanogas
  Essential gene: C elegans homolog=C38C10.5a; Phenotype=Emb
MELTRLGDEPTTRWTLLNIRILVESAEVGEGQQMVHPLQINFLHQMVQEKLDTANE

SEQ ID NO: 119636 - protein, 525 aa, Heterodera glycines
  misc_feature (341)..(341): Xaa can be any naturally occurring amino acid
  Coding regions on vcDNA: vcDNA=SeqID_46059; Strand=+; Position=1 -180,231-367,563-729,788-945,995-1072,1423-1870,2032-2227,2448-2616
  Homolog annotation: Hit_ID=CAE59843.1; Match level="QueryCoverage =100%, HitCoverage=100%, E-value=1e-151, Identity=51%"; Hit description=Hypothetical protein CBG03316 [Caenorhabditis briggsae]
  Essential gene: C elegans homolog=C37A5.1; Phenotype=Unclassified
MTISYTLDVSKSTWGGFFRILSRWRGSVWKAVMGQLIVWTIIYMLISLVYRRLLNTRSQETFEHLVHTFEHLVHYLNYGLDSTIPLTFMLGFFVTQVVSRWQSVLNGLGWIDNSAMNFANYIRGTDTETRITRRTLIRYMVLCQALVLRDISVQVRKRFPTLDTLVAAGISKPELEQLDREVHDKYSRYWTPIHWCNSILYEARLHGKIASDFLLDSIINDIQHFRHGLASLDIQHFRHGLASLMKYDWVPIPLLYPQIVFLAVRLYFLICLISRQFIYRKEAKHHAEIDLFVPIGTMIQFIVYVGWMKVAEALLNPLGEDDDDLECNYVIDKNLITGPNXMDLSFKNHQPILRHFGFSLVDLATKRTPEQSRDVFWDNDHIAPLYSMEAAQRTVHPLIGSASKINMAKGKKTITMAPHKSKLSKMDERTRLAHIRLVDTMEHNVKHAEELKADKANNENKALGELRKRQSQKKRENPRRSAHGRDAVDAKCTRFGTRRVPSPSREHEHSPSHHRPNGTSLTSPH

SEQ ID NO: 119637 - protein, 307 aa, Heterodera glycines
  Coding regions on vcDNA: vcDNA=SeqID_46060; Strand=-; Position=1 -167,225-312,374-516,576-661,781-903,947-1124
  Homolog annotation: Hit_ID=NP_492033.1; Match level="QueryCoverage =95%, HitCoverage=58%, E-value=9e-61, Identity=44%"; Hit description =acyltransferase (46.9 kD) (1H765) [Caenorhabditis elegans] emb|CAA95833.1| Hypothetical protein M05B5.4 [
  Essential gene: C elegans homolog=M05B5.4; Phenotype=Unclassified
RKYWYFELLHYFVKLRSLIEQLYHANGNRKVIVLAHSMGNPMANFFYNKIVDKNWKDTFLLSNWKDTFLLSHISLAGAWGGSAQIVKLFASGYNMDYFRVLLPPSRLRAMQYNMDYFRVLLPPSRLRAMQRSFTSSAFLFPSAALWKSDEILATTPRQNYSLSNLDKFFANYSLSNLDKFFADIQYPQGFDQWKSASEASGILSDLPLKVHCIFGVGVDTPDQFQWAHNWFFPDYQPYIRYGDGDGTVYGDGDGTVNIRSLEVCERWAKETADGTVEVHRVNGTDHMGILNDQRTLELIRDILTKGE

SEQ ID NO: 119638 - protein, 236 aa, Heterodera glycines
  misc_feature (154)..(154): Xaa can be any naturally occurring amino acid
  misc_feature (159)..(159): Xaa can be any naturally occurring amino acid
  misc_feature (205)..(205): Xaa can be any naturally occurring amino acid
  misc_feature (208)..(208): Xaa can be any naturally occurring amino acid
  Coding regions on vcDNA: vcDNA=SeqID_46061; Strand=+; Position=1 -63,3456-3554,4117-4200,4273-4356,4527-4901
  Homolog annotation: Hit_ID=NP_003421.1; Match level="QueryCoverage =82%, HitCoverage=84%, E-value=1e-38, Identity=39%"; Hit description =zinc finger protein 91 (HPF7, HTF10) [Homo sapiens] sp|Q05481|ZN91 _HUMAN Zinc finger protein 91 (Zinc fin
  Essential gene: C elegans homolog=F25D7.3; Phenotype=Pvl,Sma
KLFTRCHFTFISLFSSINLFRMWYKCAHCPEAFRWLSALIRHERTHTGEKPFKCDQCGKDFARANTLNIHQRIHTGEKPYQCHLCDARFCHLCDARFTQDGQLKTHILIHTGEKPYKCTYCPQKFTRAGNLTTHLRRHTEKKPFMVCRSGQKSXNYLKXMNFHFFLKFFKCSHCGKQFAESSNLQIHLLTHYRKRKANGQLSNEXMNXCHKKLSFFELFNLYFLSILLLGLQKYSF

SEQ ID NO: 119639 - protein, 308 aa, Heterodera glycines
  misc_feature (121)..(121): Xaa can be any naturally occurring amino acid
  Coding regions on vcDNA: vcDNA=SeqID_46062; Strand=-; Position=1 -140,252-307,384-569,654-752,801-998,1285-1533
  Homolog annotation: Hit_ID=NP_494986.1; Match level="QueryCoverage =100%, HitCoverage=29%, E-value=5e-81, Identity=50%"; Hit description= PaTched Related (ptr-6) [Caenorhabditis elegans] gb|AAA68302.1| Hypothetical protein C54A12.1 [Caenorhab
  Essential gene: C elegans homolog=C54A12.1; Phenotype=Emb
ESSVAIFITSITDVVSFAAGTYSDILAVRGFCMMTAACMMFTFLYQITFFAALMVISSRLQMQQRNACNACLPCCLLAKDPFEFEEGKTELNNNNNNSKNDKSSKAMDYEERDEKGFQKKXIKNNTSAPISSSSSSALSASEFNLAMRQKGPMGKFFRNFYVNFYVDFLLDWRTKFAVGTIFFVYLAISLWGIVSMQGLDYEKLLLSSDPLVRKLEEIELFHGSDQVEIAVVRAPDLRMRENRARVEQLVADFERLPNSVGSAGTEFWLREYVRYANATGARLHDDHWSWVRGVFDWSQLFAFYKLWS

SEQ ID NO: 119640 - protein, 133 aa, Heterodera glycines
  Coding regions on vcDNA: vcDNA=SeqID_46063; Strand=+; Position=1 -122,408-685
  Homolog annotation: Hit_ID=NP_922915.2; Match level="QueryCoverage =81%, HitCoverage=23%, E-value=1e-31, Identity=60%"; Hit description =protein disulfide isomerase-related protein (provisional) [Danio rerio] gb|AAH44507.1| Protein disulfide
  Essential gene: C elegans homolog=B0403.4; Phenotype=Lva,Unc
WVWTEAGQQPDLEQSFGIGGFGYPAMVAVNTRKLKYSTMTGSFGQSGISEFLRDLSYGKGKTSSVPGANMPSLADVPAWDGRDAELPPMEDVDDIDLSDVSLDDEEEEMSTKEAKKGVDEEEKKKKGTKTEEE

SEQ ID NO: 119641 - protein, 88 aa, Heterodera glycines
  Coding regions on vcDNA: vcDNA=SeqID_46064; Strand=+; Position=1 -96,155-238,358-444
  Homolog annotation: Hit_ID=P53023; Match level="QueryCoverage=67%, HitCoverage=46%, E-value=1e-24, Identity=86%"; Hit description=Major sperm protein 3 gb|AAA29148.1| major sperm protein
  Essential gene: C elegans homolog=C04G2.4; Phenotype=Unclassified
MALLSPEDVATMPTQKVVFNAPFDNKVTYYMRVINPGTKRIGYAFKTTKPKRINMNPPNFTKVVLPISLPVTHFVWNSNVSRPNLEIN

SEQ ID NO: 119642 - protein, 387 aa, Heterodera glycines
  Coding regions on vcDNA: vcDNA=SeqID_46065; Strand=-; Position=1-1164
  Homolog annotation: Hit_ID=NP_508269.1; Match level="QueryCoverage =96%, HitCoverage=55%, E-value=1e-38, Identity=28%"; Hit description =ribonucleotide reductase R2 family member (XC45) [Caenorhabditis elegans] gb|AAG24065.1| Hypothetical pro
  Essential gene: C elegans homolog=F19G12.2; Phenotype=Unclassified
MYLLSSIERKNDAGEWVALSDTDANDKHAGVIQNFGSSFVRSLKVNISGIEVFDSSIYYHYRDYIMKELGYSQEIRKAFHEASCYYPDDDDQNSATNPGFTARAARFSGGKQCETMVKLNFDLARQNALMLNNQDVIFTIHRNNDSFLLLTPPYKKPDGTLQENKKEYRIRVHDMRLYVRTVDVTPNLNLAISRQLESTSAKYPLRKIEMRSIFLGTGRTELAHNVFTSTLPRRLICTFVSTDAYSGNRKMSPYKFEHANLRSISVEANGQTFPSTPYLLSFDGAQPRFVRAFVDMYAGLGLDDSDTKTVSIGMQRFLNGWAFFVIPLTSTLEDTPGFELIRQGTCTIKVQFEQPIKADGYEMLVLGEFDSVLSINADRVLSTDGSV

SEQ ID NO: 119643 - protein, 198 aa, Heterodera glycines
  Coding regions on vcDNA: vcDNA=SeqID_46066; Strand=-; Position=1 -19,73-162,222-409,512-653,949-1106
  Homolog annotation: Hit_ID=CAE59466.1; Match level="QueryCoverage =85%, HitCoverage=24%, E-value=9e-64, Identity=69%"; Hit description =Hypothetical protein CBG02850 [Caenorhabditis briggsae]
  Essential gene: C elegans homolog=F22B3.4; Phenotype=Emb,Ste
MDFTYNVHCGIGHTRWATHGKPKDENAHPQRSNFDNDFVVVHNGIITNYKEIKDYLLTKGYKFESETDTEVIAKLTQHIHQRHPHYGLRQLVEIVVQQLEGAFALAFKSRRFPGQLVATRRGSPLLVGIKSQSKLTTDHFPVFYSRPRRGPVSLVFDESCTTAMETPNKLNASDMFASFSAPFNGCHWVFQITLIYLF

SEQ ID NO: 119644 - protein, 469 aa, Heterodera glycines
  misc_feature (16)..(16): Xaa can be any naturally occurring amino acid
  misc_feature (30)..(30): Xaa can be any naturally occurring amino acid
  Coding regions on vcDNA: vcDNA=SeqID_46067; Strand=-; Position=1 -461,503-663,720-1186,1235-1384
  Homolog annotation: Hit_ID=NP_492222.2; Match level="QueryCoverage =91%, HitCoverage=16%, E-value=1e-120, Identity=53%"; Hit description= j-domain containing protein, required for endocytosis, Receptor Mediated Endocytosis RME-8 (259.2 kD) (r
  Essential gene: C elegans homolog=F18C12.2a; Phenotype=Emb,Lva,Unc
RESWGQFPDYPEFFNXIHLSVNCSYFFFSXKCFRDETGAVIRPMPRIKKVLSEPVLLYQLVQLLLTYDPSIVQRVATLVNDVMQDNPYISRLYLSGIFFFILMYNGSNILPVARFLKDTHLKQAFRSTLSKSELASRSVLCPMLPEANIFYLEEYGAEKYAEVFLGEFENPECIWNSEMEEYGAEKYAEVFLGEFENPECIWNSEMRRNMIEKIALHVSDFSSRLSSNVKALYRYCPIPPIDYPQLKYCPIPPIDYPQLKEELFCHFYYLRHLTDNHRFPNWPIREPVEFLRACLSAWHDEITRKPAKMSVEQACERLGLSTTDPRWKDASAVRRAYFKLAQKYHPDKNPDGREQFEQINYAYEFLTSTLVRANSSSTPDMNRIVIIIRAQSIVYKRNLQVLSPYKYAGYTQLITIDLESSLQVLSPYKYAGYTQLITIDLESSDDTLFAREGRGQLLCAREYAWTLRS

SEQ ID NO: 119645 - protein, 180 aa, Heterodera glycines
  Coding regions on vcDNA: vcDNA=SeqID_46068; Strand=+; Position=1 -127,289-349,504-642,712-903
  Homolog annotation: Hit_ID=CAE67195.1; Match level="QueryCoverage =100%, HitCoverage=86%, E-value=2e-82, Identity=85%"; Hit description= Hypothetical protein CBG12631 [Caenorhabditis briggsae]
  Essential gene: C elegans homolog=T23H2.5; Phenotype=Unclassified
MAKKQYDLLFKLLLIGDSGVGKTCILYRFSDDAFNTSFISTIGIDFKIKTIELRGKKIKLQIWDTAGQERFHTITTSYYRGAMGIMMVYDITNAKSFDNIAKWLRYIDEHASEDVVHASEDVVKMLLGNKCDMSDRRVVPKERGEKIAIDHGIRFLETSAKANINIEKAFYDLAEAILDK

SEQ ID NO: 119646 - protein, 105 aa, Heterodera glycines
  Coding regions on vcDNA: vcDNA=SeqID_46069; Strand=+; Position=1 -163,210-364
  Homolog annotation: Hit_ID=NP_741699.1; Match level="QueryCoverage =94%, HitCoverage=43%, E-value=1e-28, Identity=61%"; Hit description =putative protein of eukaryotic origin (XA697) [Caenorhabditis elegans] gb|AAK39366.1| Hypothetical protei
  Essential gene: C elegans homolog=Y24D9A.4a; Phenotype=Ste
MVRPNFYFYVNPKIKAKKSTKKKVAALPAAIKKTETKKPAKSTLFERRPRNFSIGQDIQPKRDLTRFVRWPKYILLQRQRAVLEKRLKIPPPINQFKFALDKPNS

SEQ ID NO: 119647 - protein, 356 aa, Heterodera glycines
  Coding regions on vcDNA: vcDNA=SeqID_46070; Strand=+; Position=1 -166,762-1008,1055-1110,1562-1682,2264-2422,2478-2797
  Homolog annotation: Hit_ID=XP_527165.1; Match level="QueryCoverage =69%, HitCoverage=35%, E-value=6e-59, Identity=40%"; Hit description =PREDICTED: hypothetical protein XP_527165 [Pan troglodytes]
  Essential gene: C elegans homolog=ZC518.2; Phenotype=Bmd,Emb,Gro,Unc
EDRNALKNLADVAVTNFNERGDELRKNWGGAIMSQRSQARQAKIEKARQKDVGQKKQQVKLRPPQPPIYLFVFDVGSAAIDCGYLNTFAEQLSLDIDKLPGQERAFIGFIGFDSALHFFQFDENEREPRHIIEFDVEESFAPVFSGLFVELNVFKEKIAFTPQIDFYKSLALECTGKQIAIDLFVVGCQNVDLRTLSDMSRFSSGTVYHFPEYHFLRDQVEVKRFQMILRRYFIRKLGLEAVLRIRCSRGLSLHTFYGNFFVRSTDLLALPNVSPDSAMGVQIKHDEVITASQVCFQAALLYTSTKGFPYPLFEMSKSQVTVVFASTHFVSPCSHKLHMYFLRWTLTRQYRYFQRW

SEQ ID NO: 119648 - protein, 303 aa, Heterodera glycines
  Coding regions on vcDNA: vcDNA=SeqID_46071; Strand=-; Position=1 -179,281-638,684-1058
  Homolog annotation: Hit_ID=NP_498735.1; Match level="QueryCoverage =98%, HitCoverage=80%, E-value=1e-31, Identity=27%"; Hit description =predicted CDS, putative cytoplasmic protein family member (3J53) [Caenorhabditis elegans] gb|AAK84536.1|
  Essential gene: C elegans homolog=F19G12.2; Phenotype=Unclassified
MPGATFIRNLKVHINQREVYDSNQLYSYKVFLDTELSYPVTAKDHTLAWQAISVTVTRPNNVEIDIELALQSDDFMIHQEAANRDKYTLEIVDCRLIVKTVDLMDGLSLDIAKKLDLEPARYGIRKTLMKSLFITGGRYDFSANLFTEEVPRRVIIGLVPNQNYIGHNQKNPFYFNHHNVRDIELTASGRTYPQFPYNLDYKNNRYARAYHDTQEHLGMACTTESNGISYSMFKTAYCLYVFQMTNAQEDSPGFELIKEGCTAVNIRFAEAVPNEGVTLIAYAEADGLILIDRNRSITSDLTV

SEQ ID NO: 119649 - protein, 178 aa, Heterodera glycines
  Coding regions on vcDNA: vcDNA=SeqID_46072; Strand=+; Position=1 -113,689-875,1355-1506,1560-1644
  Homolog annotation: Hit_ID=NP_741495.1; Match level="QueryCoverage =77%, HitCoverage=21%, E-value=7e-19, Identity=46%"; Hit description =UNCoordinated locomotion UNC-26, synaptojanin (123.4 kD) (unc-26) [Caenorhabditis elegans] emb|CAC44311.1
  Essential gene: C elegans homolog=JC8.10a; Phenotype=Unc
MSLRNVRIYRKILGNGTSSTLVDSSANEGFLLLQCGGMNRTLSFPFERFGVSIDDWLVKCICGSVLVRTIYVGHRTAKVALISRLSCDYVGTRFNVRGINTAINLSKLHSDVRFVSFDYHAEVKQSKENAKRLISEIDSFIDHCSFFFSHGSFQKGVIRTNCLDCLDRTNCVQTVLFC
